(12) United States Patent
Breton et al.

(10) Patent No.: US 6,562,958 B1
(45) Date of Patent: May 13, 2003

(54) **NUCLEIC ACID AND AMINO ACID SEQUENCES RELATING TO *ACINETOBACTER BAUMANNII* FOR DIAGNOSTICS AND THERAPEUTICS**

(75) Inventors: Gary Breton, Marlborough, MA (US); David Bush, Somerville, MA (US)

(73) Assignee: Genome Therapeutics Corporation, Waltham, MA (US)

( * ) Notice: Subject to any disclaimer, the term of this patent is extended or adjusted under 35 U.S.C. 154(b) by 0 days.

(21) Appl. No.: 09/328,352

(22) Filed: Jun. 4, 1999

Related U.S. Application Data

(60) Provisional application No. 60/088,701, filed on Jun. 9, 1998.

(51) Int. Cl.$^7$ .............................................. C07H 21/02
(52) U.S. Cl. ..................................... 536/23.7; 536/23.1
(58) Field of Search ............................... 536/23.1, 23.7; 435/69.1; 436/24.3; 335/60

(56) References Cited

U.S. PATENT DOCUMENTS

| | | | | |
|---|---|---|---|---|
| 5,814,499 A | * | 9/1998 | Moineau | 435/172 |
| 6,045,997 A | * | 4/2000 | Futreal | 435/6 |
| 6,060,644 A | * | 5/2000 | Schnable | 800/281 |

OTHER PUBLICATIONS database GenEmbl, accession No. J01687, Apr. 1993.*
database GenEmbl, accession No. U97062, May 1997.*
database GenEmbl, accession No. U52122, Aug. 1996.*
database GenEmbl, accession No. Z27166, Dec. 1993.*
Database GenEmbl, accession No. Z51613, Mar. 1996.*
Garcia, D.C., et al., "The use of plasmid profile analysis and ribotyping for typing *Acinetobacter baumannii* isolates," *Journal of Hospital Infection* 34:139–144 (1996).
Ibrahim, A., et al., "Phylogentic Relationship of the Twenty–one DNA Groups of the Genus Acinetobacter as Revealed by 16S Ribosomal DNA Sequence Analysis," *International Journal of Systematic Bacteriology* 47(3):837–841 (Jul. 1997).
Marques, M.B., et al., "Genotypic investigation of multi–drug–resistant *Acinetobacter baumannii* infections in a medical intensive care unit," *Journal of Hospital Infection* 37:125–135 (1997).
Sheehan, C., et al., "Genomic fingerprinting *Acinetobacter baumannii*: amplification of multiple inter–repetitive extragenic palindromic sequences," *Journal of Hospital Infection* 31:33–40 (1995).
Traub, W., et al., "Macrorestriction Analysis (PFGE) of Serologically Cross–reactive Serovars of *Acinetobacter baumannii* and Genospecies 3," *Zbl. Bakt.* 285:403–412; (1997).

* cited by examiner

Primary Examiner—Michael Borin
(74) Attorney, Agent, or Firm—Genome Therapeutics Corporation

(57) ABSTRACT

The invention provides isolated polypeptide and nucleic acid sequences derived from *Acinetobacter mirabilis* that are useful in diagnosis and therapy of pathological conditions; antibodies against the polypeptides; and methods for the production of the polypeptides. The invention also provides methods for the detection, prevention and treatment of pathological conditions resulting from bacterial infection.

15 Claims, No Drawings

NUCLEIC ACID AND AMINO ACID SEQUENCES RELATING TO *ACINETOBACTER BAUMANNII* FOR DIAGNOSTICS AND THERAPEUTICS

RELATED APPLICATIONS

This application claims the benefit of U.S. Provisional Application No. 60/088,701, filed Jun. 9, 1998, the entire teachings of which are incorporated herein by reference.

BACKGROUND OF THE INVENTION

The genus Acinetobacter is divided into at least 21 species by 16S ribosomal sequence analysis (Ibrahim, A., et al, 1997, Int J Syst Bacteriol. 47:837–841). They are gram-negative, oxidase-negative, non-motile, nitrate-negative, nonfermentative rods. The closest related lineage to Acinetobacter is the Moraxella genus. The glucose-oxidizing, nonhemolytic *Acinetobacter baumannii* (*A. baumannii*, spelling variants *A. baumanii* and *A. baumanni*), formerly known as *Acinetobacter calcoaceticus* var. *anitratus*, is the most frequently isolated species in this genus. This organism is commonly found in the environment as well as in hospitals. (Alexander Von Graevenitz, Acinetobacter, Alcaligenes, Moraxella, and Other Nonfermentative Gram-Negative Bacteria Chap. 41, Manual of Clinical Microbiology, Sixth Edition, Editor, Patrick R. Murry, ASM Press, Washington D.C., 1995) *A. baumannii* has only recently been recognized as a nosocomial pathogen. Invasive techniques such as surgery, and pulmonary ventilation combined with immunocompromized patients, have lead to the development and increased importance of the Acinetobacter genus as nosocomial pathogens (Towner, K., et al, 1997, Med Microbiol. 46: 721–746).

*A. baumannii* has been associated with bacteremia, septicemia, pneumonia, meningitis, and infections of burns, urinary tract and surgical wounds. Often these diseases are nosocomial in origin. The ability of *A. baumannii* to survive on dry surfaces for long periods of time has contributed to outbreaks in hospitals. These outbreaks have been traced to reusable pressure transducers, room humidifiers, mattresses, pillows, and components of ventilation equipment (Constanze, W., et al, 1997, J Clin Microbiol. 35: 1394–1397). Outbreaks have also been associated with respiratory therapy equipment, intravascular access devices, and the hands of care-givers (Marques, M., et al, 1997, J Hosp Infect. 37:125–135). The mortality rate of nosocomial infections by *A. baumannii* can be quite high. The mortality rate of meningitis caused by *A. baumannii* is 20% to 27%, and bacteremia mortality ranges from 19% to 44% (Jimenez-Mejias, M., et al, 1997, Clin Infect Dis. 24: 932–935).

Resistance to antibiotics by the genus Acinetobacter has increased over time, with *A. baumannii* usually being the most resistant. *A. baumannii* is becoming resistant to many compounds that it was previously susceptible to, such as floroquinolones, aminoglycosides, ceftazidime, ticarcillin, and imipenem (Duval, J., et al, 1994, J Clin Microbiol 32: 2677–2681). In one study, at least 82% of the *A. baumannii* isolates were resistant to piperacillin, gentamicin, amikacin, netrilaicin, ceftazidime, cefotaxime, and norfloxacin (Garcia, D., et al, 1996, J Hosp Infect. 34:139–144). Resistance to ciprofloxacin in *A. baumannii* isolated from ICU patients, has increased from 4% in 1986 to 34% in 1993. Acinetobacter clinical isolates may be resistant to any of the therapeutically relevant antibiotics, and resistance is influenced by selection pressure of the preferred antibiotic (Towner, K., et al, 1997, Med Microbiol. 46: 721–746).

The Acinetobacter genus, with *A. baumannii* playing the lead role, is becoming increasingly important pathogens. Thirty years ago, the Acinetobacter genus was considered environmental and non-pathogenic. Currently, they are responsible for 1–2% of all nosocomial infections. They infect the very ill and most clinical isolates are multidrug resistant. Furthermore, they are capable of increasing hospitalization and causing epidemics (Towner, K., et al, 1997, Med Microbiol. 46: 721–746).

SUMMARY OF THE INVENTION

The present invention fulfills the need for diagnostic tools and therapeutics by providing bacterial-specific compositions and methods for detecting Acinetobacter species including *A. baumannii*, as well as compositions and methods useful for treating and preventing Acinetobacter infection, in particular, *A. baumannii* infection, in vertebrates including mammals.

The present invention encompasses isolated nucleic acids and polypeptides derived from *A. baumannii* that are useful as reagents for diagnosis of bacterial disease, components of effective antibacterial vaccines, and/or as targets for antibacterial drugs including anti-*A. baumannii* drugs. They can also be used to detect the presence of *A. baumannii* and other Acinetobacter species in a sample; and in screening compounds for the ability to interfere with the *A. baumannii* life cycle or to inhibit *A. baumannii* infection. They also have use as biocontrol agents for plants.

In one aspect, the invention features compositions of nucleic acids corresponding to entire coding sequences of *A. baumannii* proteins, including surface or secreted proteins or parts thereof, nucleic acids capable of binding mRNA from *A. baumannii* proteins to block protein translation, and methods for producing *A. baumannii* proteins or parts thereof using peptide synthesis and recombinant DNA techniques. This invention also features antibodies and nucleic acids useful as probes to detect *A. baumannii* infection. In addition, vaccine compositions and methods for the protection or treatment of infection by *A. baumannii* are within the scope of this invention.

The nucleotide sequences provided in SEQ ID NO:1–SEQ ID NO:4126, a fragment thereof, or a nucleotide sequence at least about 99.5% identical to a sequence contained within SEQ ID NO:1–SEQ ID NO:4126 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO:1–SEQ ID NO:4126, a fragment thereof, or a nucleotide sequence at least about 99.5% identical to a sequence contained within SEQ ID NO:1–SEQ ID NO:4126. Uses for and methods for providing nucleotide sequences in a variety of media is well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO:1–SEQ ID NO:4126, a fragment thereof, or a nucleotide sequence at least about 99.5% identical to SEQ ID NO:1–SEQ ID NO:4126 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information). Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Computer algorithms enable the identification of *A. baumannii* open reading frames (ORFs) within SEQ ID NO:1–SEQ ID NO:4126 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. Suitable search algorithms are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washinigton, D.C. (1997). Such algorithms are utilized on computer systems as exemplified below. The ORFs so identified represent protein encoding fragments within the *A. baumannii* genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *A. baumannii* genome. As used herein, "a computer-based system" refers to the hardwaremeans, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *A. baumannii* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTX2 (NCBI) and Motifs (GCG). Suitable software programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the Netis Biology: Tools for Genomic and Molecular Research*, American Society for Microbiology, Washington, D.C. (1997). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *A. baumannii* genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *A. baumannii* genome possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *A. baumannii* genome. In the present examples, implementing software which implement the BLASTP2 and bic_SW algorithms (Altschul et al., J Mol. Biol. 215:403–410 (1990); Compugen Biocellerator) was used to identify open reading frames within the *A. baumannii* genome. A person skilled in the art can readily recognize that any one of the publicly available homology search programs can be used as the search means for the computer-based systems of the present invention. Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

The invention features *A. baumannii* polypeptides, preferably a substantially pure preparation of an *A. baumannii* polypeptide, or a recombinant *A. baumannii* polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150 amino acid residues in length; the polypeptide includes at least about 5, preferably at least about 10, more preferably at least about 20, still more preferably at least about 50, 100, or 150 contiguous amino acid residues of the invention contained in the Sequence Listing. In yet another preferred embodiment, the amino acid sequence which differs in sequence identity by about 7% to about 8% from the *A. baumannii* amino acid sequences of the invention contained in the Sequence Listing is also encompassed by the invention.

In preferred embodiments: the *A. baumannii* polypeptide is encoded by a nucleic acid of the invention contained in the Sequence Listing, or by a nucleic acid having at least about 60%, 70%, 80%, 90%, 95%, 98%, or 99% homology with a nucleic acid of the invention contained in the Sequence Listing.

In a preferred embodiment, the subject *A. baumannii* polypeptide differs in amino acid sequence at about 1, 2, 3, 5, 10 or more residues from a sequence of the invention contained in the Sequence Listing. The differences, however, are such that the *A. baumannii* polypeptide exhibits an *A. baumannii* biological activity, e.g., the *A. baumannii* polypeptide retains a biological activity of a naturally occurring *A. baumannii* enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *A. baumannii* polypeptide is a recombinant fusion protein having a first *A. baumannii* polypeptide portion and a second polypeptide portion, e.g., a second polypeptide portion having an amino acid sequence unrelated to *A. baumannii*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded *A. baumannii* polypeptide differs (e.g., by amino acid substitution, addition or deletion of at least one amino acid residue) in amino acid sequence at about 1, 2, 3, 5, 10 or more residues, from a sequence of the invention contained in the Sequence Listing. The differences, however, are such that: the *A. baumannii* encoded polypeptide exhibits an *A. baumannii* biological activity, e.g., the encoded *A. baumannii* enzyme retains a biological activity of a naturally occurring *A. baumannii*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *A. baumannii* strain, 15839, from which genomic sequences have been sequenced, has been deposited on Jan. 9, 1998, in the American Type Culture Collection and assigned the ATCC designation #202080.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to *A. baumannii* polypeptides, especially by antisera to an active site or binding domain of *A. baumannii* polypeptide. The invention also includes fragments, preferably biologically active fragments. These and other polypeptides are also referred to herein as *A. baumannii* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *A. baumannii* nucleic acid will include a transcriptional regulatory sequence, e.g., at least one of a transcriptional promoter or transcriptional enhancer sequence, operably linked to the *A. baumannii* gene sequence, e.g., to render the *A. baumannii* gene sequence suitable for expression in a recombinant host cell.

In yet a further preferred embodiment, the nucleic acid which encodes an *A. baumannii* polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; still more preferably to at least about 20 consecutive nucleotides of the invention contained in the Sequence Listing; most preferably to at least about 40 consecutive nucleotides of the invention contained in the Sequence Listing.

In another aspect, the invention provides a substantially pure nucleic acid having a nucleotide sequence which encodes an *A. baumannii* polypeptide. In preferred embodiments: the encoded polypeptide has biological activity; the encoded polypeptide has an amino acid sequence at least about 60%, 70%, 80%, 90%, 95%, 98% or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, still more preferably at least about 50, 100, or 150 contiguous amino acids of the invention contained in the Sequence Listing.

In another aspect, the invention encompasses: a vector including a nucleic acid which encodes an *A. baumannii* polypeptide or an *A. baumannii* polypeptide variant as described herein; a host cell transfected with the vector; and a method of producing a recombinant *A. baumannii* polypeptide or *A. baumannii* polypeptide variant; including culturing the cell, e.g., in a cell culture medium, and isolating an *A. baumannii* or *A. baumannii* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO:1–SEQ ID NO:4126 or complements thereof. Alternatively, the nucleic acids comprise sequences contained within any ORF (open reading frame), including a complete protein-coding sequence, of which any of SEQ ID NO:1–SEQ ID NO:4126 forms a part. The invention encompasses sequence-conservative variants and function-conservative variants of these sequences. The nucleic acids may be DNA, RNA, DNA/RNA duplexes, protein-nucleic acid (PNA), or derivatives thereof In another aspect, the invention features a purified recombinant nucleic acid having at least about 50%, 60%, 70%, 80%, 90%, 95%, 98%, or 99% homology with a sequence of the invention contained in the Sequence Listing.

The invention also encompasses recombinant DNA (including DNA cloning and expression vectors) comprising these *A. baumannii*-derived sequences; host cells comprising such DNA, including fungal, bacterial, yeast, plant, insect, and mammalian host cells; and methods for producing expression products comprising RNA and polypeptides encoded by the *A. baumannii* sequences. These methods are carried out by incubating a host cell comprising an *A. baumannii*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *A. baumannii* polypeptide from the cell fraction, the medium fraction, or both. The polypeptides can also be made by in vitro translation.

In another aspect, the invention features nucleic acids capable of binding mRNA of *A. baumannii*. Such nucleic acid is capable of acting as antisense nucleic acid to control the translation of mRNA of *A. baumannii*. A further aspect features a nucleic acid which is capable of binding specifically to an *A. baumannii* nucleic acid. These nucleic acids are also referred to herein as complements and have utility as probes and as capture reagents.

In another aspect, the invention features an expression system comprising an open reading frame corresponding to *A. baumannii* nucleic acid. The nucleic acid further comprises a control sequence compatible with an intended host. The expression system is useful for making polypeptides corresponding to *A. baumannii* nucleic acid.

In another aspect, the invention encompasses: a vector including a nucleic acid which encodes an *A. baumannii* polypeptide or an *A. baumannii* polypeptide variant as described herein; a host cell transfected with the vector; and a method of producing a recombinant *A. baumannii* polypeptide or *A. baumannii* polypeptide variant; including culturing the cell, e.g., in a cell culture medium, and isolating the *A. baumannii* or *A. baumannii* polypeptide variant, e.g., from the cell or from the cell culture medium.

In yet another embodiment of the invention encompasses reagents for detecting bacterial infection, including *A. baumannii* infection, which comprise at least one *A. baumannii*-derived nucleic acid defined by any one of SEQ ID NO:1–SEQ ID NO:4126, or sequence-conservative or function-conservative variants thereof. Alternatively, the diagnostic reagents comprise nucleotide sequences that are contained within any open reading frames (ORFs), including preferably complete protein-coding sequences, contained within any of SEQ ID NO:1–SEQ ID NO:4196, or polypeptide sequences contained within any of SEQ ID NO:4127–SEQ ID NO:8252, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one *A. baumannii*-derived immunogenic component, wherein the immunogenic component comprises one or more of the polypeptides encoded by any one of SEQ ID NO:1–SEQ ID NO:4126 or sequence-conservative or function-conservative variants thereof; or polypeptides that are contained within any ORFs, including complete protein-coding sequences, of which any of SEQ ID NO:1–SEQ ID NO:4126 forms a part; or polypeptide sequences contained within any of SEQ ID NO:4127–SEQ ID NO:8252; or polypeptides of which any of SEQ ID NO:4127–SEQ ID NO:8252 forms a part. Host animals include any warm blooded animal, including without limitation mammals and birds. Such antibodies have utility as reagents for immunoassays to evaluate the abundance and distribution of *A. baumannii*-specific antigens.

In yet another aspect, the invention provides diagnostic methods for detecting *A. baumannii* antigenic components or anti-*A. baumannii* antibodies in a sample. *A. baumannii* antigenic components may be detected by known processes, including but not limited to detection by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO:1–SEQ ID NO:4126 or sequence-conservative or function-conservative variants thereof, or against a polypeptide sequence contained in any of SEQ ID NO:4127–SEQ ID NO:8252 or function-conservative variants thereof.

In yet another aspect, the invention provides a method for detecting antibacterial-specific antibodies in a sample, which comprises: (i) contacting a sample suspected to contain antibacterial-specific antibodies with an *A. baumannii* antigenic component, under conditions in which a stable antigen-antibody complex can form between the *A. baumannii* antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO:1–SEQ ID NO:4126 or sequence-conservative and function-conservative variants thereof, or is a polypeptide sequence contained in any of SEQ ID NO:4127–SEQ ID NO:8252 or function-conservative variants thereof.

In another aspect, the invention features a method of generating vaccines for immunizing an individual against *A. baumannii*. The method includes: immunizing a subject with an *A. baumannii* polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g., a polypeptide, e.g., a fragment of a host cell polypeptide, for the ability to bind an *A. baumannii* polypeptide. The method includes contacting the compound to be evaluated with an *A. baumannii* polypeptide and determining if the compound binds or otherwise interacts with the *A. baumannii* polypeptide. Compounds which bind or otherwise interact with *A. baumannii* polypeptides are candidates as modulators, including activators and inhibitors, of the bacterial life cycle. These assays can be performed in vitro or in vivo.

In another aspect, the invention features a method of evaluating a compound, e.g., a polypeptide, e.g., a fragment of a host cell polypeptide, for the ability to bind an *A. baumannii* nucleic acid, e.g., DNA or RNA. The method includes contacting the compound to be evaluated with an *A. baumannii* nucleic acid and determining if the compound binds or otherwise interacts with the *A. baumannii* nucleic acid. Compounds which bind *A. baumannii* are candidates as modulators, including activators and inhibitors, of the bacterial life cycle. These assays can be performed in vitro or in vivo.

A particularly preferred embodiment of the invention is directed to a method of screening test compounds for anti-bacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, such as, for example, the strain *A. baumannii* 202080. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteria, including *A. baumannii*, which are carried out by administering to an animal in need of such treatment, in particular a warm-blooded vertebrate, including but not limited to birds and mamunals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO:1–SEQ ID NO:8252. Use of the terms "SEQ ID NO:1–SEQ ID NO:4126", "SEQ ID NO:4127–SEQ ID NO:8252, "the sequences depicted in Table 2", etc., is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

Definitions

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA-DNA, DNA-RNA and RNA-RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physicochemical properties (such as, for example, acidic, basic, hydrophobic, and the like). "Function-conservative" variants also include any polypeptides that have the ability to elicit antibodies specific to a designated polypeptide.

An "A. baumannii-derived" nucleic acid or polypeptide sequence may or may not be present in other bacterial species, and may or may not be present in all A. baumannii strains. This term is intended to refer to the source from which the sequence was originally isolated. Thus, an A. baumannii-derived polypeptide, as used herein, may be used, e.g., as a target to screen for a broad spectrum antibacterial agent, to search for homologous proteins in other species of bacteria or in eukaryotic organisms such asbacteria humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least about 10, 20, 50 70, 80 or 95% dry weight of the purified preparation. Preferably, the preparation contains sufficient polypeptide to allow protein sequencing; at least about 1, 10, or preferably 100 mg of polypeptide.

A purified preparation of cells refers to, in the case of plant or animal cells, an in vitro preparation of cells and not an entire intact plant or animal. In the case of cultured cells or microbial cells, it consists of a preparation of at least about 10%, more preferably at least about 50%, of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional A. baumannii DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared ×100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5×SSC, at 65° C.) requires that the sequences be essentially completely homologous. Conditions of intermediate stringency (such as, for example, 2×SSC at 65° C.) and low stringency (such as, for example 2×SSC at 55° C.) require correspondingly less overall complementarity between the hybridizing sequences. (1×SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has *A. baumannii* biological activity if it has one, two or preferably more of the following properties: (1) if when expressed in the course of an *A. baumannii* infection, it can promote, or mediate the attachment of *A. baumannii* to a cell; (2) it has an enzymatic activity, structural or regulatory function characteristic of an *A. baumannii* protein; (3) the gene which encodes it can rescue a lethal mutation in an *A. baumannii* gene. A polypeptide has biological activity if it is an antagonist, agonist, or superagonist of a polypeptide having one of the above-listed properties.

A biologically active fragment or analog is one having an in vivo or in vitro activity which is characteristic of the *A. baumannii* polypeptides of the invention contained in the Sequence Listing, or of other naturally occurring *A. baumannii* polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as *A. baumannii* polypeptides often exhibit a range of physiological properties and because such properties may be attributable to different portions of the molecule, a useful *A. baumannii* fragment or *A. baumannii* analog is one which exhibits a biological activity in any biological assay for *A. baumannii* activity. The fragment or analog possesses about 10%, preferably about 40%, more preferably about 60%, 70%, 80% or 90% or greater of the activity of *A. baumannii*, in any in vivo or in vitro assay.

Analogs can differ from naturally occurring *A. baumannii* polypeptides in amino acid sequence or in ways that do not involve sequence, or both. Non-sequence modifications include changes in acetylation, methylation, phosphorylation, carboxylation, or glycosylation. Preferred analogs include *A. baumannii* polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the *A. baumannii* polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
|---|---|---|
| Alanine | A | D-Ala, Gly, beta-Ala, L-Cys, D-Cys |
| Arginine | R | D-Arg, Lys, D-Lys, homo-Arg, D-homo-Arg, Met, Ile, D-Met, D-Ile, Orn, D-Orn |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, β-Ala, Acp |
| Isoleucine | I | D-Ile, Val, D-Val, Leu, D-Leu, Met,-D-Met |
| Leucine | L | D-Leu, Val, D-Val, Leu, D-Leu, Met, D-Met |
| Lysine | K | D-Lys, Arg, D-Arg, homo-Arg, D-homo-Arg, Met, D-Met, Ile, D-Ile, Orn, D-Orn |
| Methionine | M | D-Met, S-Me-Cys, Ile, D-Ile, Leu, D-Leu, Val, D-Val |
| Phenylalanine | F | D-Phe, Tyr, D-Thr, L-Dopa, His, D-His, Trp, D-Trp, Trans-3,4, or 5-phenylproline, cis-3,4, or 5-phenylproline |
| Proline | P | D-Pro, L-I-thioazolidine-4-carboxylic acid, D-or L-1-oxazolidine-4-carboxylic acid |
| Serine | S | D-Ser, Thr, D-Thr, allo-Thr, Met, D-Met, Met(O), D-Met(O), L-Cys, D-Cys |
| Threonine | T | D-Thr, Ser, D-Ser, allo-Thr, Met, D-Met, Met(O), D-Met(O), Val, D-Val |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g, β or γ amino acids; and cyclic analogs.

As used herein, the term "fragment", as applied to an *A. baumannii* analog, will ordinarily be at least about 20 residues, more typically at least about 40 residues, preferably at least about 60 residues in length. Fragments of *A. baumannii* polypeptides can be generated by methods known to those skilled in the art. The ability of an Acinetobacier fragment to exhibit a biological activity of *A. baumannii* polypeptide can be assessed by methods known to those skilled in the art as described herein. Also included are *A. baumannii* polypeptides containing residues that are not required for biological activity of the peptide or that result from alternative mRNA splicing or alternative protein processing events.

An "immunogenic component" as used herein is a moiety, such as an *A. baumannii* polypeptide, analog or fragment thereof, that is capable of eliciting a humoral and/or cellular immune response in a host animal.

An "antigenic component" as used herein is a moiety, such as an *A. baumannii* polypeptide, analog or fragment thereof, that is capable of binding to a specific antibody with sufficiently high affinity to form a detectable antigen-antibody complex.

The term "antibody" as used herein is intended to include fragments thereof which are specifically reactive with *A. baumannii* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning*, Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymoloqy* (Academic Press, Inc.), particularly Vol. 154 and Vol. 155 (Wu and Grossman, eds.); *PCR-A Practical Approach* (McPherson, Quirke, and Taylor, eds., 1991); *Immunology*, 2d Edition, 1989, Roitt et al., C. V. Mosby Company, and New York; *Advanced Immunology*, 2d Edition, 1991, Male et al., Grower Medical Publishing, New York.; *DNA Cloning: A Practical Approach*, Volumes I and II, 1985 (D. N. Glover ed.); *Oligonucleolide Synthesis*, 1984, (M. L. Gait ed); *Transcription and Translation*, 1984 (Hames and Higgins eds.); *Animal Cell Culture*, 1986 (R. I. Freshney ed.); *Immobilized Cells and Enymes*, 1986 (IRL Press); Perbal, 1984, *A Practical Guide to Molecular Cloning; Gene Transfer Vectors for Mammalian Cells*, 1987 (J. H. Miller and M. P. Calos eds., Cold Spring Harbor Laboratory); Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Any suitable materials and/or methods known to those of skill can be utilized in carrying out the present invention; however, preferred materials and/or methods are described. Materials, reagents and the like to which reference is made in the following description and examples are obtainable from commercial sources, unless otherwise noted.

A. *Baumannii* Genomic Sequence

This invention provides nucleotide sequences of the genome of *A. baumannii* which thus comprises a DNA sequence library of *A. baumannii* genomic DNA. The detailed description that follows provides nucleotide sequences of *A. baumannii*, and also describes how the sequences were obtained and how ORFs and protein-coding sequences were identified. Also described are compositions and methods of using the disclosed *A. baumannii* sequences in methods including diagnostic and therapeutic applications. Furthermore, the library can be used as a database for identification and comparison of medically important sequences in this and other strains of *A. baumannii*.

To determine the genomic sequence of *A. baumannii*, DNA from strain 15839 of *A. baumannii* was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in *A. baumannii*. In Microbial Genome Methods. K. W. Adolph, editor. CRC Press. New York. p 17–37.). DNA was sheared hydrodynamically using an HPLC (Oefner, et. al., 1996) to an insert size of 2000–3000 bp. After size fractionation by gel electrophoresis the fragments were blunt-ended, ligated to adapter oligonucleotides and cloned into the pGTC (Thomann) vector to construct a "shotgun" subclone library.

DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p. 157). The average contig length was about 3–4 kb.

All subsequent steps were based on sequencing by ABI377 automated DNA sequencing methods. The cloning and sequencing procedures are described in more detail in the Exemplification.

A variety of approaches may be used to order the contigs so as to obtain a continuous sequence representing the entire A. baumannii genome. Synthetic oligonucleotides are designed that are complementary to sequences at the end of each contig. These oligonucleotides may be hybridized to libaries of A. baumannii genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The A. baumannii sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring A. baumannii polypeptide. These ORFs may contain start codons which indicate the initiation of protein synthesis of a naturally-occurring A. baumannii polypeptide. Such start codons within the ORFs provided herein were identified by those of ordinary skill in the relevant art, and the resulting ORF and the encoded A. baumannii polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring A. baumannii polypeptide was recognized. The predicted coding regions were defined by evaluating the coding potential of such sequences with the program GENEMARK™ (Borodovsky and McIninch, 1993, Comp. 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

A. Baumannii Nucleic Acids

The present invention provides a library of A. baumannii-derived nucleic acid sequences. The libraries provide probes, primers, and markers which are used as markers in epidemiological studies. The present invention also provides a library of *A. baumannii*-derived nucleic acid sequences which comprise or encode targets for therapeutic drugs.

The nucleic acids of this invention may be obtained directly from the DNA of the above referenced *A. baumannii* strain by using the polymerase chain reaction (PCR). See "*PCR, A Practical Approach*" (McPherson, Quirke, and Taylor, eds., IRL Press, Oxford, UK, 1991) for details about the PCR. High fidelity PCR's used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., *Molecular Cloning, A Laboratory Manual* 2nd edition, 1989, Cold Spring Harbor Press, NY).

It is also possible to obtain nucleic acids encoding *A. baumannii* polypeptides from a cDNA library in accordance with protocols herein described. A cDNA encoding an *A. baumannii* polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding *A. baumannii* polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect *A. baumannii*. With the sequence information set forth in the present application, sequences of twenty or more nucleotides are identified which provide the desired inclusivity and exclusivity with respect to *A. baumannii*, and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other Acinetobacter species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate A. baumannii nucleic acid from one strain from the nucleic acid of other another strain as well as from other organisms. Nucleic acid having twenty or more nucleotides in a sequence of the invention contained in the Sequence Listing can also have utility to separate other Acinetobacter species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of A. baumannii nucleic acid. These nucleic acids may also have utility as primers for the amplification of nucleic acids in other Acinetobacter species. With respect to polymerase chain reaction (PCR) techniques, nucleic acid sequences of $\geq$10–15 nucleotides of the invention contained in the Sequence Listing have utility in conjunction with suitable enzymes and reagents to create copies of A. baumannii nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from A. baumannii and/or other Acinetobacter species. The copies can also be incorporated into cloning and expression vectors to generate polypeptides corresponding to the nucleic acid synthesized by PCR, as is described in greater detail herein.

The nucleic acids of the present invention find use as templates for the recombinant production of A. baumannii-derived peptides or polypeptides.

Antisense

Nucleic acid or nucleic acid-hybridizing derivatives isolated or synthesized in accordance with the sequences described herein have utility as antisense agents to prevent the expression of A. baumannii genes. These sequences also have utility as antisense agents to prevent expression of genes of other Acinetobacter species.

In one embodiment, nucleic acid or derivatives corresponding to A. baumannii nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from *A. baumannii* that are useful as reagents for diagnosis of bacterial infection, components of effective anti-bacterial vaccines, and/or as targets for anti-bacterial drugs, including anti-*A. baumannii* drugs.

Expression of *A. Baumannii* Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLAST algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. The first column contains a designation for the contig, from which each ORF was identified (numbered arbitrarily). Each contig represents a continuous stretch of the genomic sequence of the organism. The second column lists the ORF designation. The third and fourth columns list the SEQ ID numbers for the nucleic acid and amino acid sequences corresponding to each ORF, respectively. The fifth and sixth columns list the length of the nucleic acid ORF and the length of the amino acid ORF, respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The seventh and eighth columns provide metrics for assessing the likelihood of the homology match (determined by the BLASTP2 algorithm), as is known in the art, to the genes indicated in the nineth column when the designated ORF was compared against a non-redundant comprehensive protein database. Specifically, the seventh column represents the "Blast Score" for the match (a higher score is a better match), and the eighth column represents the "P-value" for the match (the probability that such a match can have occurred by chance; the lower the value, the more likely the match is valid). If a BLASTP2 score of less than 46 was obtained, no value is reported in the table the "P-value". The ninth column provides, where available, the Swissprot accession number (SP), (SP), the locus name (LN), the Organism (OR), Source of variant (SR), E.C. number (EC), the gene name (GN), the product name (PN), the Function Description (FN), Left End (LE), Right End (RE), Coding Direction (DI), and the description (DE) or notes (NT) for each ORF. Information that is not preceded by a code designation in the eleventh column represents a description of the ORF. This information allows one of ordinary skill in the art to determine a potential use for each identified coding sequence and, as a result, allows to use the polypeptides of the present invention for commercial and industrial purposes.

Using the information provided in SEQ ID NO:1–SEQ ID NO:4126, SEQ ID NO:4127–SEQ ID NO:8252 and in Table 2 together with routine cloning and sequencing methods, one of ordinary skill in the art will be able to clone and sequence all the nucleic acid fragments of interest including open reading frames (ORFs) encoding a large variety of proteins of *A. baumannii*.

Nucleic acid isolated or synthesized in accordance with the sequences described herein have utility to generate polypeptides. The nucleic acid of the invention exemplified in SEQ ID NO:1–SEQ ID NO:4126 and in Table 2 or fragments of said nucleic acid encoding active portions of *A. baumannii* polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae*, Methanobacierium strains or other Archaea, and Eubacteria such as *E. coli, B. Subtilis, S. Aitreus, S. Pneumonia* or *Pseudomonas putida*. In some cases the expression host will utilize the natural *A. baumannii* promoter whereas in others, it will be necessary to drive the gene with a promoter sequence derived from the expressing organism (e.g., an *E. coli* beta-galactosidase promoter for expression in *E. coli*).

To express a gene product using the natural *A. baumannii* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual*, 2nd Edition, Cold Spring Harbor Laboratory Press (1989)), and other laboratory textbooks.

For example, a host cell transfected with a nucleic acid vector directing expression of a nucleotide sequence encoding an *A. baumannii* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *A. baumannii* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy would be to alter the nucleic acid encoding an *A. baumannii* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known; including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *A. baumannii*-derived nucleic acid sequences. The libraries provide probes, primers, and markers which can be used as markers in epidemiological studies. The present invention also provides a library of *A. baumannii*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO:1–SEQ ID NO:4126. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO:4127–SEQ ID NO:8252 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *A. baumannii* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *A. baumannii*-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded *A. baumannii* polypeptides may be expressed by using many known vectors, such as pUC plasmids, pET plasmids (Novagen, Inc., Madison, Wis.), or pRSET or pREP (anvitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *A. baumannii* coding sequences may be synthesized by standard methods, isolated from natural sources, or prepared as hybrids, etc. Ligation of the *A. baumannii* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are *A. baumannii, E. coli, B. Subtilis, Saccharomyces cerevisiae, Saccharomyces carlsbergensis, Schizosaccharomyces pombi*, SF9 cells, C129 cells, 293 cells, Neurospora, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts Examples of these regions, methods of isolation, manner of manipulation, etc. are known in the art. Under appropriate expression conditions, host cells can be used as a source of recombinantly produced *A. baumannii*-derived peptides and polypeptides.

Advantageously, vectors may also include a transcription regulatory element (i.e., promoter) operably linked to the *A. baumannii* portion. The promoter may optionally contain operator portions and/or ribosome binding sites. Non-limiting examples of bacterial promoters compatible with *E. coli* include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant *A. baumannii*-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of *A. baumannii*-derived peptides or polypeptides.

Identification and Use of *A. Baumannii* Nucleic Acid Sequences

The disclosed *A. baumannii* polypeptide and nucleic acid sequences, or other sequences that are contained within ORFs, including complete protein-coding sequences, of which any of the disclosed *A. baumannii*-specific sequences forms a part, are useful as target components for diagnosis and/or treatment of *A. baumannii*-caused infection.

It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic *A. baumannii* DNA as template; this is followed by sequencing the amplified product. The isolated nucleic acid encoding the disclosed sequence, or fragments thereof, can also be hybridized to *A. baumannii* genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against *A. Baumannii*

The disclosed *A. baumannii* genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against *A. baumannii*. Identification of said immunogenic components involved in the determination of the function of the disclosed sequences, which can be achieved using a variety of approaches. Non-limiting examples of these approaches are described briefly below.

Homology to Known Sequences

Computer-assisted comparison of the disclosed *A. baumannii* sequences with previously reported sequences present in publicly available databases is useful for identifying functional *A. baumannii* nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein-:protein interactions, etc. These consensus sequences may be quite short and thus may represent only a fraction of the entire protein-coding sequence. Identification of such a feature in an *A. baumannii* sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. *A. baumannii* proteins identified as containing putative signal sequences and/or transmembrane domains are useful as immunogenic components of vaccines.

Targets for therapeutic drugs according to the invention include, but are not limited to, polypeptides of the invention, whether unique to *A. baumannii* or not, that are essential for growth and/or viability of *A. baumannii* under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, *Proc. Natl. Acad. Sci. USA* 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-specific Sequences

Because of the evolutionary relationship between different A. baumannii strains, it is believed that the presently disclosed A. baumannii sequences are useful for identifying, and/or discriminating between, previously known and new A. baumannii strains. It is believed that other A. baumannii strains will exhibit at least about 70% sequence homology with the presently disclosed sequence. Systematic and routine analyses of DNA sequences derived from samples containing A. baumannii strains, and comparison with the present sequence allows for the identification of sequences that can be used to discriminate between strains, as well as those that are common to all A. baumannii strains. In one embodiment, the invention provides nucleic acids, including probes, and peptide and polypeptide sequences that discriminate between different strains of A. baumannii. Strain-specific components can also be identified functionally by their ability to elicit or react with antibodies that selectively recognize one or more A. baumannii strains.

In another embodiment, the invention provides nucleic acids, including probes, and peptide and polypeptide sequences that are common to all A. baumannii strains but are not found in other bacterial species.

A. Baumannii Polypeptides

This invention encompasses isolated A. baumannii polypeptides encoded by the disclosed A. baumannii genomic sequences, including the polypeptides of the invention contained in the Sequence Listing. Polypeptides of the invention are preferably at least about 5 amino acid residues in length. Using the DNA sequence information provided herein, the amino acid sequences of the polypeptides encompassed by the invention can be deduced using methods well-known in the art. It will be understood that the sequence of an entire nucleic acid encoding an A. baumannii polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic A. baumannii DNA as template; this is followed by sequencing the amplified product.

The polypeptides of the present invention, including function-conservative variants of the disclosed ORFs, may be isolated from wild-type or mutant A. baumannii cells, or from heterologous organisms or cells (including, but not limited to, bacteria, fungi, insect, plant, and mammalian cells) including A. baumannii into which an A. baumannii-derived protein-coding sequence has been introduced and expressed. Furthermore, the polypeptides may be part of recombinant fusion proteins.

A. baumannii polypeptides of the invention can be chemically synthesized using commercially automated procedures such as those referenced herein , including, without limitation, exclusive solid phase synthesis, partial solid phase methods, fragment condensation or classical solution synthesis. The polypeptides are preferably prepared by solid phase peptide synthesis as described by Merrifield, 1963, J. Am. Chem. Soc. 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the A. baumannii protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against an A. baumannii protein or against peptides derived therefrom can be used as purification reagents. Other purification methods are possible.

The present invention also encompasses derivatives and homologues of A. baumannii-encoded polypeptides. For some purposes, nucleic acid sequences encoding the peptides may be altered by substitutions, additions, or deletions that provide for functionally equivalent molecules, i.e., function-conservative variants. For example, or or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify A. baumannii-derived polypeptides for use in the present invention, essentially the complete genomic sequence of a virulent, methicillin-resistant isolate of Acinetobacter mirabilis isolate was analyzed. While, in very rare instances, a nucleic acid sequencing error may be revealed, resolving a rare sequencing error is well within the art, and such an occurrence will not prevent one skilled in the art from practicing the invention.

Also encompassed are any A. baumannii polypeptide sequences that are contained within the open reading frames (ORFs), including complete protein-coding sequences, of which any of SEQ ID NO:1–SEQ ID NO:4126 forms a part. Table 2, which is appended herewith and which forms part of the present specification, provides putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of A. baumannii-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *A. baumannii*-derived polypeptide sequences, and a corresponding library of nucleic acid sequences encoding the polypeptides, wherein the polypeptides themselves, or polypeptides contained with ORFs of which they form a part, comprise sequences lacking homology to any known prokaryotic or eukaryotic sequences. Such libraries provide probes, primers, and markers which can be used to diagnose *A. baumannii* infection, including use as markers in epidemiological studies. Non-limiting examples of such sequences are listed by SEQ ID NO in Table 2, which is appended hereto and part hereof.

The present invention also provides a library of *A. baumannii*-derived polypeptide sequences, and a corresponding library of nucleic acid sequences encoding the polypeptides, wherein the polypeptides themselves, or polypeptides contained within ORFs of which they form a part, comprise targets for therapeutic drugs.

SPECIFIC EXAMPLE

Determination of Acinetobacter Protein Antigens for Antibody and Vaccine Development The selection of Acinetobacter protein antigens for vaccine development can be derived from the nucleic acids encoding *A. baumannii* polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta* 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1 \times 10^{-6}$ that the homology is only due to random chance) to membrane or exported proteins represent protein antigens for vaccine development. Possible functions can be provided to *A. baumannii* genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of *A. Baumannii* Nucleic Acids and Polypeptides Based on the discovery of the *A. baumannii* gene products of the invention provided in the Sequence Listing, one skilled in the art can alter the disclosed structure of *A. baumannii* genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *A. baumannii* polypeptides. Such screens are useful for the identification of inhibitors of *A. baumannii*.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc 3rd Cleveland Sympos. Macromolecules*, ed. A G Walton, Amsterdam: Elsevier pp 273–289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides: Methods for Directed Mutagenesis Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization;, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci. USA*, 75: 5765[1978]).

Cassette Mutagenesis

Another method for preparing variants, cassette mutagenesis, is based on the technique described by Wells et al. (*Gene*, 34:315[1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of A. Baumannii Nucleic Acids and Polypeptides

It is possible to modify the structure of an *A. baumannii* polypeptide for such purposes as increasing solubility, enhancing stability (e.g., shelf life ex vivo and resistance to proteolytic degradation in vivo). A modified *A. baumannii* protein or peptide can be produced in which the amino acid sequence has been altered, such as by amino acid substitution, deletion, or addition as described herein.

An *A. baumannii* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, an *A. baumannii* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce, modified protein within the scope of this invention. Furthermore, an *A. baumannii* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *A. baumannii* proteins include reduction/alkylation (Tarr, *Methods of Protein Microcharacterization*, J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology*, WH Freeman, San Francisco, Calif. (1980), U.S. Pat. No. 4,939,239; or mild formalin treatment (Marsh, (1971) *Int. Arch. of Allergy and Appl. Immunol.*, 41: 199–215).

To facilitate purification and potentially increase solubility of an *A. baumannii* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology*, 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *A. baumannii* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *A. baumannii* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *A. baumannii* polypeptide, e.g., of cellular proteins, or of randomly generated polypeptides which bind to an *A. baumannii* protein. (The *A. baumannii* domain is used as the bait protein and the library of variants are expressed as prey fusion proteins.) In an analogous fashion, a two hybrid assay (as with the other screening methods described herein), can be used to find polypeptides which bind an *A. baumannii* polypeptide.

Display Libraries

In one approach to screening assays, the Acinetobacter peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligar can be used to score for potentially functional peptide homologs. Fluorescently labele ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and fl, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of other bacterial species have also served as peptide fusion partners. Examples include the Staphylococcus protein A and the outer membrane IgA protease of Neisseria (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89–1869).

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad Sci. U.S.A.* 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are under-represented in the libraries (Gallop et al. (1994) *J. Med. Chem.* 37(9):1233–1251). These particular biases are not a factor in the LacI display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233–1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem.* 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of A. Baumannii Polypeptides

The invention also provides for reduction of the protein binding domains of the subject A. baumannii polypeptides to generate mimetics, e.g. peptide or non-peptide agents. The peptide mimetics are able to disrupt binding of a polypeptide to its counter ligand, e.g., in the case of an A. baumannii polypeptide binding to a naturally occurring ligand. The critical residues of a subject A. baumannii polypeptide which are involved in molecular recognition of a polypeptide can be determined and used to generate A. baumannii-derived peptidomimetics which competitively or noncompetitively inhibit binding of the A. baumannii polypeptide with an interacting polypeptide (see, for example, European patent applications EP-412,762A and EP-B31,080A).

For example, scanning mutagenesis can be used to map the amino acid residues of a particular A. baumannii polypeptide involved in binding an interacting polypeptide, peptidomimetic compounds (e.g. diazepine or isoquinoline derivatives) can be generated which mimic those residues in binding to an interacting polypeptide, and which therefore can inhibit binding of an A. baumannii polypeptide to an interacting polypeptide and thereby interfere with the function of A. baumannii polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffinan et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for A. Baumannii Nucleic Acids and Polypeptides

This invention also features vaccine compositions for protection against infection by A. baumannii or for treatment of A. baumannii infection. In one embodiment, the vaccine compositions contain one or more immunogenic components such as a surface protein from A. baumannii, or portion thereof, and a pharmaceutically acceptable carrier. Nucleic acids within the scope of the invention are exemplified by the nucleic acids of the invention contained in the Sequence Listing which encode A. baumannii surface proteins. Any nucleic acid encoding an immunogenic A. baumannii protein, or portion thereof, which is capable of expression in a cell, can be used in the present invention. These vaccines have therapeutic and prophylactic utilities.

One aspect of the invention provides a vaccine composition for protection against infection by A. baumannii which contains at least one immunogenic fragment of an A. baumannii protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length A. baumannii protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is as saved by contacting a peptide known or suspected of being immunogenic with an antigen presenting cell which presents appropriate MHC molecules in a T cell culture. Presentation of an immunogenic A. baumannii peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *A. baumannii* polypeptide or fragment thereof or nucleic acid encoding an *A. baumannii* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *A. baumannii* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications. Oral immunization is preferred over parenteral methods for inducing protection against infection by *A. baumannii*. Cain et. al. (1993) *Vaccine* 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl-L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A. referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the *A. baumannii* polypeptide with cholera toxin or its B subunit, procholeragenoid, fungal polysaccharides, including schizophyllan, muramyl dipeptide, muramyl dipeptide derivatives, phorbol esters, labile toxin of *E. coli*, non-*A. baumannii* bacterial lysates, block polymers or saponins.

Other suitable delivery methods include biodegradable microcapsules or immuno-stimulating complexes (ISCOMs), cochleates, or liposomes, genetically engineered attenuated live vectors such as viruses or bacteria, and recombinant (chimeric) virus-like particles, e.g., blue-tongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including *A. baumannii* polypeptide in an insoluble form as fusion proteins. Suitable carriers for the vaccines of the invention are enteric coated capsules and polylactide-glycolide microspheres. Suitable diluents are 0.2 N $NaHCO_3$ and/or saline.

Vaccines of the invention can be administered as a primary prophylactic agent in adults or in children, as a secondary prevention, after successful eradication of *A. baumannii* in an infected host, or as a therapeutic agent in the aim to induce an immune response in a susceptible host to prevent infection by *A. baumannii*. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an *E. coli* lysate (6 mg dose daily up to total of 540 mg) and with an enterotoxigenic *E. coli* purified antigen (4 doses of 1 mg) (Schulman et al., *J. Urol.* 150:917–921 (1993); Boedecker et al., *American Gastroenterological Assoc.* 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of an *A. baumannii* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *A. baumannii* infection, some are useful only for treating *A. baumannii* infection, and some are useful for both preventing and treating *A. baumannii* infection. In a preferred embodiment, the vaccine composition of the invention provides protection against *A. baumannii* infection by stimulating humoral and/or cell-mediated immunity against *A. baumannii*. It should be understood that amelioration of any of the symptoms of *A. baumannii* infection is a desirable clinical goal, including a lessening of the dosage of medication used to treat *A. baumannii*-caused disease, or an increase in the production of antibodies in the serum or mucous of patients.

Antibodies Reactive with *A. Baumannii* Polypeptides

The invention also includes antibodies specifically reactive with the subject *A. baumannii* polypeptide. Antiprotein/anti-peptide antisera or monoclonal antibodies can be made by standard protocols (See, for example, *Antibodies: A Laboralory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *A. baumannii* polypeptide can be administered in the presence of adjuvant. The progress of immunization can be monitored by detection of antibody liters in plasma or serum. Standard ELISA or other immunoassays can be used with the immunogen as antigen to assess the levels of antibodies.

In a preferred embodiment, the subject antibodies are immunospecific for antigenic determinants of the *A. baumannii* polypeptides of the invention, e.g. antigenic determinants of a polypeptide of the invention contained in the Sequence Listing, or a closely related human or non-human mammalian homolog (e.g. 90% homologous, more preferably at least about 95% homologous). In yet a further preferred embodiment of the invention, the anti-*A. baumannii* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *A. baumannii* polypeptides. Antibodies can be fragmented using conventional techniques and the fragments screened for utility in the same manner as described above for whole antibodies. For example. $F(ab')_2$ fragments can be generated by treating antibody with pepsin. The resulting $F(ab')_2$ fragment can be treated to reduce disulfide bridges to produce Fab' fragments. The antibody of the invention is further intended to include bispecific and chimeric molecules having an anti-*A. baumannii* portion.

Both monoclonal and polyclonal antibodies (Ab) directed against *A. baumannii* polypeptides or *A. baumannii* polypeptide variants, and antibody fragments such as Fab' and $F(ab')_2$, can be used to block the action of *A. baumannii* polypeptide and allow the study of the role of a particular *A. baumannii* polypeptide of the invention in aberrant or unwanted intracellular signaling, as well as the normal cellular function of the *A. baumannii* and by microinjection of anti-*A. baumannii* polypeptide antibodies of the present invention.

Antibodies which specifically bind *A. baumannii* epitopes can also be used in immunohistochemical staining of tissue samples in order to evaluate the abundance and pattern of expression of *A. baumannii* antigens. Anti-*A. baumannii* polypeptide antibodies can be used diagnostically in immuno-precipitation and immuno-blotting to detect and evaluate *A. baumannii* levels in tissue or bodily fluid as part of a clinical testing procedure. Likewise, the ability to monitor *A. baumannii* polypeptide levels in an individual can allow determination of the efficacy of a given treatment regimen for an individual afflicted with such a disorder. The level of an *A. baumannii* polypeptide can be measured in cells found in bodily fluid, such as in urine samples or can be measured in tissue, such as produced by gastric biopsy. Diagnostic assays using anti-*A. baumannii* antibodies can include, for example, immunoassays designed to aid in early diagnosis of *A. baumannii* infections. The present invention can also be used as a method of detecting antibodies contained in samples from individuals infected by this bacterium using specific *A. baumannii* antigens.

Another application of anti-*A. baumannii* polypeptide antibodies of the invention is in the immunological screening of cDNA libraries constructed in expression vectors such as λgt11, λgt18–23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *A. baumannii* polypeptide can then be detected with antibodies, as, for example, reacting nitrocellulose filters lifted from infected plates with anti-*A. baumannii* polypeptide antibodies. Phage, scored by this assay, can then be isolated from the infected plate. Thus, the presence of *A. baumannii* gene homologs can be detected and cloned from other species, and alternate isoforms (including splicing variants) can be detected and cloned.

Kits Containing Nucleic Acids Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Bio Chip Technology

The nucleic acid sequence of the present invention may be used to detect *A. baumannii* or other species of Acinetobacter acid sequence using bio chip technology. Bio chips containing arrays of nucleic acid sequence can also be used to measure expression of genes of *A. baumannii* or other species of Acinetobacter. For example, to diagnose a patient with a *A. baumannii* or other Acinetobacter infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467–470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science*, 283:83–87) genes essential in the cell cycle can be identified using bio chips. Furthermore, the present invention provides nucleic acid sequence which can be used with bio chip technology to understand regulatory networks in bacteria, measure the response to environmental signals or drugs as in drug screening, and study virulence induction. (Mons et al., 1998, *Nature Biotechnology*, 16: 45–48. Patents teaching this technology include U.S. Pat. Nos. 5,445,934, 5,744,305, and 5,800,992.

Drug Screening Assays Using A. Baumannii Polypeptides

By making available purified and recombinant *A. baumannii* polypeptides, the present invention provides assays which can be used to screen for drugs which are either agionists or antagonists of the normal cellular function, in this case, of the subject *A. baumannii* polypeptides, or of their role in intracellular signaling. Such inhibitors or potentiators may be useful as new therapeutic agents to combat *A. baumannii* infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *A. baumannii* polypeptide.

Screening assays can be constructed in vitro with a purified *A. baumannii* polypeptide or fragment thereof, such as an *A. baumannii* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the *A. baumannii* polypeptide. Some of these active compounds may directly, or with chemical alterations to promote membrane permeability or solubility, also inhibit or potentiate the same activity (e.g., enzymatic activity) in whole, live *A. baumannii* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA; described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.* 4:2061–2068; Eilers and Schatz, *Nature*, 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245–246). The yeast two-hybrid system takes advantage of the properties of the GAL4 protein of the yeast *Saccharomyces cerevisiae*. The GAL4 protein is a transcriptional activator required for the expression of genes encoding enzymes of galactose utilization. This protein consists of two separable and functionally essential domains: an N-terminal domain which binds to specific DNA sequences (UASG); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein-protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, *Science* 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics*, 8th ed., Pergamon Press; and *Remington's Pharmaceutical Sciences*, 17th ed., 1990, Mack Publishing Co., Easton, Pa.; Avis et al. (eds.), 1993, *Pharmaceutical Dosage Forms: Parenteral Medications*, Dekker, New York; Lieberman et al (eds.), 1990, *Pharmaceutical Dosage Forms: Disperse Systems*, Dekker, New York.

The antibacterial agents and compositions of the present invention are useful for preventing or treating *A. baumannii* infections. Infection prevention methods incorporate a prophylactically effective amount of an antibacterial agent or composition. A prophylactically effective amount is an amount effective to prevent *A. baumannii* infection and will depend upon the specific bacterial strain, the agent, and the host. These amounts can be determined experimentally by methods known in the art and as described above.

*A. baumannii* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

EXEMPLIFICATION

Cloning and Sequencing A. Baumannii Genomic Sequence

This invention provides nucleotide sequences of the genome of A. baumannii which thus comprises a DNA sequence library of A. baumannii genomic DNA. The detailed description that follows provides nucleotide sequences of A. baumannii, and also describes how the sequences were obtained and how ORFs (Open Reading Frames) and protein-coding sequences can be identified. Also described are methods of using the disclosed A. baumannii sequences in methods including diagnostic and therapeutic applications. Furthermore, the library can be used as a database for identification and comparison of medically important sequences in this and other strains of A. baumannii as well as other species of Acinetobacter.

Chromosomal DNA from strain 15839 of A. baumannii was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in A. baumannii. In Microbial Genome Methods. K. W. Adolph, editor. CRC Press. New York. p 17–37.). Genomic A. baumannii DNA was hydrodynamically sheared in an HPLC and then separated on a standard 1% agarose gel. Fractions corresponding to 2500–3000 bp in length were excised from the gel and purified by the GeneClean procedure (Bio101, Inc.).

The purified DNA fragments were then blunt-ended using T4 DNA polymerase. The healed DNA was then ligated to unique BstXI-linker adapters (5'-GTCTTCACCACGGGG-3' and 5'-GTGGTGAAGAC-3' in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5α competent cells (Gibco/BRL, DH5á transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 µg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP (P. Green, Abstracts of DOE Human Genome Program Contractor-Grantee Workshop V, January 1996, p. 157) with default program parameters and quality scores. The initial assembly was done at 8.25 fold coverage and yielded 29 ordered contigs.

Finishing can follow the initial assembly. Missing mates (sequences from clones that only gave reads from one end of the Acinetobacter DNA inserted in the plasmid) can be identified and sequenced with ABI technology to allow the identification of additional overlapping contigs.

End-sequencing of randomly picked genomic lambda was also performed. Sequencing on a both sides was done for all lambda sequences. The lambda library backbone helped to verify the integrity of the assembly and allowed closure of some of the physical gaps. Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

To identify A. baumannii polypeptides the complete genomic sequence of A. baumannii were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GENEMARK™ (Borodovsky and McIninch, 1993, Comp. Chem. 17:123).

Identification, Cloning and Expression of A. Baumannii Nucleic Acids

Expression and purification of the A. baumannii polypeptides of the invention can be performed essentially as outlined below.

To facilitate the cloning, expression and purification of membrane and secreted proteins from *A. baumannii*, a gene expression system, such as the pET System (Novagen), for cloning and expression of recombinant proteins in *E. coli*, is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO:1–SEQ ID NO:4126 for cloning from the 15839 strain of *A. baumannii* are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native *A. bauman-* nii DNA sequence. All reverse primers (specific for the 3' end of any *A. baumannii* ORF) include EcoRI site at the extreme 5' terminus to permit cloning of each *A. baumannii* sequence into the reading frame of the pET-28b. The pET-28b vector provides sequence encoding n additional 20 carboxy-terminal amino acids including six histidine residues (at the extreme C-terminus), which comprise the His-Tag.

Genomic DNA prepared from the 15839 strain of *A. baumannii* is used as the source of template DNA for PCR amplification reactions (Current Protocols in Molecular Biology, John Wiley and Sons, Inc., F. Ausubel et al., eds., 1994). To amplify a DNA sequence containing an *A. baumannii* ORF, genomic DNA (50 nanograms) is introduced into a reaction vial containing 2 mM $MgCl_2$, 1 micromolar synthetic oligonucleotide primers (forward and reverse primers) complementary to and flanking a defined *A. baumannii* ORF, 0.2 mM of each deoxynucleotide triphosphate; dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g. NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif. USA).

Cloning of *A. Baumannii* Nucleic Acids into an Expression Vector

The pET-28b vector is prepared for cloning by digestion with restriction endonucleases, e.g. NcoI and EcoRI (Current Protocols in Molecular Biology, John Wiley and Sons, Inc. F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of *E. coli* (Current Protocols in Molecular Biology, John Wiley and Sons, Inc., F. Ausubel et al., eds., 1994) as described below.

Transformation of Competent Bacteria with Recombinant Plasmids

Competent bacteria, *E. coli* strain BL21 or *E. coli* strain BL21(DE3), are transformed with recombinant pET expression plasmids carrying the cloned *A. baumannii* sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM $MgCl_{2,\ 10}$ mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with *A. Baumannii* Nucleic Acids Individual BL21 clones transformed with recombinant pET-28b *A. baumannii* ORFs are analyzed by PCR amplification of the cloned inserts using the same forward and reverse primers, specific for each *A. baumannii* sequence, that were used in the original PCR amplification cloning reactions. Successful amplification verifies the integration of the *A. baumannii* sequences in the expression vector (Current Protocols in Molecular Biology, John Wiley and Sons, Inc. F. Ausubel et al., eds., 1994).

Isolation and Preparation of Nucleic Acids from Transformants

Individual clones of recombinant pET-28b vectors carrying properly cloned *A. baumannii* ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression of Recombinant *A. Baumannii* Sequences in *E. Coli*

The pET vector can be propagated in any *E. coli* K-12 strain e.g. HMS174, HB101, JM109, DH5, etc. for the purpose of cloning or plasmid preparation. Hosts for expression include *E. coli* strains containing a chromosomal copy of the gene for T7 RNA polymerase. These hosts are lysogens of bacteriophage DE3, a lambda derivative that carries the lad gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60–89).

To express recombinant *A. baumannii* sequences, 50 nanograms of plasmid DNA isolated as described above is used to transform competent BL21(DE3) bacteria as described above (provided by Novagen as part of the pET expression system kit). The lacZ gene (beta-galactosidase) is expressed in the pET-System as described for the *A. baumannii* recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the *A. baumannii* recombinant DNA constructions.

After induction of gene expression with IPTG, bacteria are pelleted by centrifugation in a Sorvall RC-3B centrifuge at 3500×g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000×g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resupended in buffer and ruptured by several passages through a small volume microfluidizer (Model M-110S, Microfluidics International Corporation. Newton, Mass.). The resultant homogenize may be centrifuged to yield a clear supernatant (crude extract) and following filtration the crude extract may be fractionated over columns. Fractions may be monitored by absorbance at $OD_{280}$ nm. and peak fractions may analyzed by SDS-PAGE.

The concentrations of purified protein preparations may be quantified spectrophotometrically using absorbance coefficients calculated from amino acid content (Perkins, S. J. 1986 Eur. J. Biochem. 157, 169–180). Protein concentrations are also measured by the method of Bradford, M. M. (1976) Anal. Biochem. 72, 248–254, and Lowry, O. H., Rosebrough. N., Farr, A. L. & Randall, R. J. (1951) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), E. coli (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| Query | Orf | NT ID | AA ID | NT Lgth | AA Lgth | Score | P-value | Subject |
|---|---|---|---|---|---|---|---|---|
| Contig011G | 10831463_f2_47 | 1 | 4127 | 372 | 123 | | | NO-HIT |
| Contig011G | 11063133_c1_82 | 2 | 4128 | 702 | 233 | 130 | 2.30E-07 | gp:[GI:d1016402:g1736514] [LN:D90829] [AC:D90829:AB001340] [PN:Isochrismatase(EC 3.3.2.1) (2,3 dihydro-2,3] [GN:yecD] [OR:*Escherichia coli*] [SR:*Escherichia coli* (strain:K12) DNA, clone_lib:Kohara lambda minise] [DE:*E.coli* genomic DNA, Kohara clone #337(41.9–42.3 min.).] [NT:ORF_ID:o337#8; similar to [SwissProt Accession] |
| Contig011G | 12398261_c1_96 | 3 | 4129 | 447 | 148 | 679 | 8.10E-67 | sp:[LN:YPR2_ECOLI] [AC:P10018] [OR:*ESCHERICHIA COLI*] [DE:HYPOTHETICAL 14.7 KD PROTEIN (ORF2)] [SP:P10018] |
| Contig011G | 135818_f2_34 | 4 | 4130 | 1032 | 343 | 1673 | 3.80E-172 | gp:[GI:g1402861] [LN:PRU60777] [AC:U60777] [PN:transposase] [GN:tnpA] [OR:Plasmid R751] [DE:Plasmid R751 transposon Tn4321 insertion sequence IS4321Ltransposase, Pep1, Pep2, and insertion sequence IS432R.transposase,complete cds.] [NT:TnpA of IS4321L; similar to putative transposases] |
| Contig011G | 14093786_f1_15 | 5 | 4131 | 1299 | 432 | 2144 | 4.70E-222 | gp:[GI:g4378784] [LN:AF118810] [AC:AF118810] [PN:RK2 tetracycline resistance protein] [OR:Shuttle vector pME6010, [DE:Shuttle vector pME6010, complete sequence.] [NT:TetA] |
| Contig011G | 14506651_c3_145 | 6 | 4132 | 210 | 69 | | | NO-HIT |
| Contig011G | 14736436_f2_39 | 7 | 4133 | 279 | 92 | | | NO-HIT |
| Contig011G | 14884665_f2_42 | 8 | 4134 | 663 | 220 | 127 | 3.60E-08 | pir:[LN:C69895] [AC:C69895] [PN:conserved hypothetical protein yoaA] [GN:yoaA] [CL:hypothetical protein yoaA] [OR:*Bacillus subtilis*] |
| Contig011G | 16207837_f1_17 | 9 | 4135 | 192 | 63 | | | NO-HIT |
| Contig011G | 16228168_f2_36 | 10 | 4136 | 375 | 124 | 104 | 9.60E-05 | sp:[LN:SP96_DICDI] [AC:P14328] [GN:COTA] [OR:DICTYOSTELIUM DISCOIDEUM] [SR:,SLIME MOLD] [DE:SPORE COAT PROTEIN SP96] [SP:P14328] |

TABLE 2-continued

| Query | Orf | NT ID | AA ID | NT Lgth | AA Lgth | Score | P-value | Subject |
|---|---|---|---|---|---|---|---|---|
| Contig011G | 16616332_c1_94 | 11 | 4137 | 216 | 71 | | | NO-HIT |
| Contig011G | 16688765_c3_152 | 12 | 4138 | 615 | 204 | 1040 | 4.50E−105 | gp:[GI:g45481] [LN:PDGOAADB] [AC:X04555] [OR:unidentified bacterium] [DE:IncC multiresistance plasmid pDGO100dB gene for AAD (2')aminoglycoside adenylyltransferase.] [NT:AAD(2) (AA 1-249)] [SP:P10019] |
| Contig011G | 16821001_f3_65 | 13 | 4139 | 183 | 60 | | | NO-HIT |
| Contig011G | 21666540_c3_125 | 14 | 4140 | 942 | 313 | 1128 | 2.10E−114 | gp:[GI:g1119228] [LN:TRNI5AAA] [AC:M12900] [GN:P12] [OR:Transposon Tn1525] [SR:Transposon Tn1525 DNA] [DE:Insertion sequence IS15-R, complete cds.] [NT:putative] [RE: |
| Contig011G | 21740787_c1_76 | 15 | 4141 | 273 | 90 | | | NO-HIT |
| Contig011G | 22549128_c1_87 | 16 | 4142 | 693 | 230 | 1139 | 1.50E−115 | gp:[GI:g4378785] [LN:AF118810] [AC:AF118810] [PN:RK2 tetracycline repressor protein] [OR:Shuttle vector pME6010] [DE:Shuttle vector pME6010, complete sequence.] [NT:TetR] |
| Contig011G | 22947936_f1_12 | 17 | 4143 | 264 | 87 | | | NO-HIT |
| Contig011G | 24644811_f1_3 | 18 | 4144 | 1020 | 339 | 1764 | 8.60E−182 | pir:[LN:S32184] [AC:S32184] [PN:integrase] [CL:integrase-like protein] [OR:*Klebsiella pneumoniae*] |
| Contig011G | 2578161_f2_32 | 19 | 4145 | 207 | 68 | | | NO-HIT |
| Contig011G | 29386591_c3_137 | 20 | 4146 | 903 | 300 | 978 | 1.70E−98 | gp:[GI:g460277] [LN:ECOMERTET] [AC:L29404] [OR:*Escherichia coli*] [SR:*Escherichia coli* (strain DH1) DNA] [DE:*E. coli* mercuric reductase (merA) gene; merD gene; URF1; URF2;invasin (ORFA) gene; ORFB; and tetracycline resistance protein(tetA) gene.] [NT:ORFB; putative] |
| Contig011G | 30707281_f3_70 | 21 | 4147 | 318 | 105 | | | NO-HIT |
| Contig011G | 33786251_f3_72 | 22 | 4148 | 216 | 71 | 91 | 0.00037 | gp:[GI:g1196674] [LN:NTITNIS] [AC:M20306] [PN:unknown protein] [OR:Plasmid NTP16] [SR:Plasmid NTP16 (tissue library: AB1157) DNA] [DE:Plasmid NTP16 DNA with inserted transposon Tn4352, flanked bydirect repeats of insertion element IS176, and encodesaminoglycoside 3'-phosphotransferase, complete cds.] [NT:ORF1; putative] |
| Contig011G | 3416040_c2_122 | 23 | 4149 | 762 | 254 | 1125 | 4.50E−114 | sp:[LN:DHP1_ECOLI] [AC:P11744] [GN:SULI:SUL1] [OR:*ESCHERICHIA COLI:SHIGELLA FLEXNERI:SALMONELLA TYPHIMURIUM:PSEUDOMONAS AERUGINOSA:CORYNEBACTERIUM GLUTAMICUM*] [EC:2.5.1.15] [DE:PYROPHOSPHORYLASE TYPE I)] [SP:P11744] |
| Contig011G | 34557330_c2_103 | 24 | 4150 | 351 | 116 | 526 | 1.30E−50 | pir:[LN:S07258] [AC:S07258:A44020:S26289] [PN:helix-destabilizing protein:san protein:single-stranded DNA-binding protein Ssb] [CL:single-stranded DNA-binding protein homology] [OR:plasmid RK2] |

TABLE 2-continued

| Query | Orf | NT ID | AA ID | NT Lgth | AA Lgth | Score | P-value | Subject |
|---|---|---|---|---|---|---|---|---|
| Contig011G | 35586561_c3_147 | 25 | 4151 | 543 | 180 | | | NO-HIT |
| Contig011G | 35629583_c1_95 | 26 | 4152 | 435 | 144 | 708 | 6.90E−70 | sp:[LN:YPR1_ECOLI] [AC:P10017] [OR:*ESCHERICHIA COLI*] [DE:HYPOTHETICAL 14.4 KD PROTEIN (ORF 1)] [SP:P10017] |
| Contig011G | 35675303_c3_142 | 27 | 4153 | 552 | 183 | | | NO-HIT |
| Contig011G | 36189141_c1_77 | 28 | 4154 | 330 | 109 | | | NO-HIT |
| Contig011G | 4345205_c2_109 | 29 | 4155 | 219 | 72 | | | NO-HIT |
| Contig011G | 4571917_c2_101 | 30 | 4156 | 327 | 108 | 237 | 5.60E−20 | pir:[LN:S10929] [AC:S10929] [PN:transposase] [CL:Salmonella typhimurium conserved hypothetical protein] [OR:*Mycobacterium fortuitum*] [SR:strain FC1.,, strain FC1] [SR:strain FC1,] |
| Contig011G | 4723833_c3_153 | 31 | 4157 | 387 | 128 | 586 | 5.80E−57 | sp:[LN:EBR_ECOLI] [AC:P14502] [GN:EBR:E1] [OR:*ESCHERICHIA COLI:SALMONELLA TYPHIMURIUM:PSEUDOMON AS AERUGINOSA*] [DE:PUTATIVE ETHIDIUM BROMIDE RESISTANCE PROTEIN (E1 PROTEIN)] [SP:P14502] |
| Contig011G | 5189156_c2_110 | 32 | 4158 | 246 | 81 | | | NO-HIT |
| Contig011G | 6141566_c1_80 | 33 | 4159 | 531 | 176 | | | NO-HIT |
| Contig011G | 6377266_c3_143 | 34 | 4160 | 390 | 129 | | | NO-HIT |
| Contig011G | 7213408_f2_46 | 35 | 4161 | 234 | 77 | | | NO-HIT |
| Contig011G | 908506_c1_81 | 36 | 4162 | 684 | 227 | 157 | 1.70E−11 | sp:[LN:YHHY_ECOLI] [AC:P46854] [GN:YHHY] [OR:*ESCHERICHIA COLI*] [DE:HYPOTHETICAL 18.8 KD PROTEIN IN GNTR-GGT INTERGENIC REGION (0162)] [SP:P46854] |
| Contig011G | 9929075_f3_53 | 37 | 4163 | 618 | 205 | 909 | 3.50E−91 | gp:[GI:e301204:g2117128] [LN:ECMERTREL] [AC:Y09025] [PN:resolvase family recombinase] [GN:tnpR] [OR:*Enterobacter cloacae*] [DE:*Enterobacter cloacae* DNA, mosaic mercury resistance transposableelement (mer-operon).] |
| Contig023G | 10739430_f1_2 | 38 | 4164 | 339 | 112 | | | NO-HIT |
| Contig023G | 10817837_c3_307 | 39 | 4165 | 474 | 157 | 115 | 4.80E−07 | sp:[LN:YBBJ_ECOLI] [AC:P75709:P77124] [GN:YBBJ] [OR:*ESCHERICHIA COLI*] [DE:HYPOTHETICAL 16.8 KD PROTEIN IN USHA-TESA INTERGENIC REGION] [SP:P75709:P77124] |
| Contig023G | 11190687_c1_191 | 40 | 4166 | 189 | 62 | | | NO-HIT |
| Contig023G | 12009688_f2_102 | 41 | 4167 | 2856 | 951 | 3212 | 0 | sp:[LN:ODO1_AZOVI] [AC:P20707] [GN:SUCA:ODHA] [OR:*AZOTOBACTER VINELANDII*] [EC:1.2.4.2] [DE:KETOGLUTARATE DEHYDROGENASE)] [SP:P20707] |
| Contig023G | 1204428_f1_22 | 42 | 4168 | 1254 | 417 | 381 | 3.10E−35 | sp:[LN:AMPG_ECOLI] [AC:P36670] [GN:AMPG] [OR:*ESCHERICHIA COLI*] [DE:AMPG PROTEIN] [SP:P36670] |
| Contig023G | 1210312_c3_292 | 43 | 4169 | 357 | 118 | 294 | 5.10E−26 | pir:[LN:E69358] [AC:E69358] [PN:conserved hypothetical protein AF0869] [CL:hypothetical protein MJ1413] [OR:*Archaeoglobus fulgidus*] |
| Contig023G | 12304715_f2_82 | 44 | 4170 | 462 | 153 | | | NO-HIT |
| Contig023G | 12318966_f2_98 | 45 | 4171 | 249 | 82 | | | NO-HIT |
| Contig023G | 129382_f2_88 | 46 | 4172 | 834 | 277 | | | NO-HIT |
| Contig023G | 13081415_f3_113 | 47 | 4173 | 582 | 193 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig023G | 13159675_f1_156 | 48 | 4174 | 933 | 310 | 702 | 3.00E-69 | pir:[LN:B65023] [AC:B65023] [PN:hypothetical protein b2475] [OR:*Escherichia coli*] |
| Contig023G | 13689676_c2_229 | 49 | 4175 | 1215 | 404 | 576 | 6.70E-56 | sp:[LN:MEDH_BACMT] [AC:P31005] [GN:MDH] [OR:*BACILLUS METHANOLICUS*] [EC:1.1.1.244] [DE:NAD-DEPENDENT METHANOL DEHYDROGENASE, (MEDH)] [SP:P31005] |
| Contig023G | 13797952_f1_6 | 50 | 4176 | 1719 | 572 | 966 | 3.10E-97 | sp:[LN:YMFN_ECOLI] [AC:P75978] [GN:YMFN] [OR:*ESCHERICHIA COLI*] [DE:HYPOTHETICAL 50.9 KD PROTEIN IN INTE-PIN INTERGENIC REGION] [SP:P75978] |
| Contig023G | 13806500_f3_112 | 51 | 4177 | 489 | 162 | | | NO-HIT |
| Contig023G | 14142155_f2_101 | 52 | 4178 | 756 | 251 | 910 | 2.70E-91 | gp:[GI:e325438:g2239250] [LN:SPSDH] [AC:Y13760] [PN:succinate dehydrogenase putative iron sulphur] [GN:sdhB] [OR:*Shewanella putrefaciens*] [DE:*Shewanella putrefaciens* sdhA, sdhB, sdhC, sdhD and sucA genes.] |
| Contig023G | 14303928_c2_228 | 53 | 4179 | 678 | 225 | 589 | 2.80E-57 | gp:[GI:g3493319] [LN:AF084362] [AC:AF084362] [PN:lipoate-protein ligase B] [OR:Homo sapiens] [DE:Homo sapiens lipoate-protein ligase B mRNA, partial cds.] [RE: |
| Contig023G | 14490693_f2_54 | 54 | 4180 | 543 | 180 | | | NO-HIT |
| Contig023G | 14844567_c3_309 | 55 | 4181 | 1362 | 453 | 1467 | 2.60E-150 | pir:[LN:QRECAA] [AC:H64733:JS0447:S10720:S45191] [PN:aromatic amino acid transport protein aroP] [GN:aroP] [CL:arginine permease] [OR:*Escherichia coli*] [MP:2.6 min] |
| Contig023G | 14875883_c2_241 | 56 | 4182 | 2886 | 961 | 3099 | 0 | sp:[LN:SYV_HAEIN] [AC:P43834] [GN:VALS:H11391] [OR:*HAEMOPHILUS INFLUENZAE*] [EC:6.1.1.9] [DE:VALYL-TRNA SYNTHETASE, (VALINE--TRNA LIGASE) (VALRS)] [SP:P43834] |
| Contig023G | 16284549_c1_159 | 57 | 4183 | 439 | 146 | 508 | 1.10E-48 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |
| Contig023G | 16532658_f2_96 | 58 | 4184 | 222 | 73 | 130 | 1.20E-08 | gp:[GI:g1197665] [LN:APU46856] [AC:U46856] [PN:vitellogenin] [FN:precursor of yolk proteins, serum transport] [OR:*Anolis pulchellus*] [DE:*Anolis pulchellus* vitellogenin mRNA, partial cds.] [NT:ApVtg18] [RE: |
| Contig023G | 16587800_f3_111 | 59 | 4185 | 354 | 117 | | | NO-HIT |
| Contig023G | 16595062_f3_117 | 60 | 4186 | 276 | 91 | | | NO-HIT |
| Contig023G | 16610077_c1_171 | 61 | 4187 | 1275 | 424 | 2219 | 5.30E-230 | pir:[LN:139506] [AC:139506] [PN:citrate (si)-synthase,] [CL:citrate (si)-synthase] [OR:*Acinetobacter anitralus*] [EC:4.1.3.7] |
| Contig023G | 16875215_f1_5 | 62 | 4188 | 396 | 131 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig023G | 16879625_c2_235 | 63 | 4189 | 2109 | 702 | 716 | 9.80E−71 | gp:[GI:g1923241] [LN:NGU82253] [AC:U82253] [PN:site-specific recombinase] [GN:gcr] [FN:mediates recombination of *Moraxella lacunata*] [OR:*Neisseria gonorrhoeae*] [DE:*Neisseria gonorrhoeae* site-specific recombinase (gcr) gene,complete cds.] [NT:putative] |
| Contig023G | 17004375_f2_73 | 64 | 4190 | 927 | 308 | 578 | 4.10E−56 | sp:[LN:ISPA_ECOLI] [AC:P22939] [GN:ISPA] [OR:*ESCHERICHIA COLI*] [EC:2.5.1.10] [DE:(FPP SYNTHASE)] [SP:P22939] |
| Contig023G | 2048392_f3_153 | 65 | 4191 | 1467 | 488 | 1547 | 8.50E−159 | gp:[GI:g1256717] [LN:PSESTRC] [AC:M80189:M38421] [PN:lipoamide dehydrogenase] [GN:IpdG] [OR:*Pseudomonas putida*] [SR:*Pseudomonas putida* (strain PpG2) DNA] [DE:*Pseudomonas putida* lipoamide dehydrogenase (IpdG) gene, completecds.] |
| Contig023G | 20506385_f2_91 | 66 | 4192 | 612 | 203 | 138 | 4.60E−12 | sp:[LN:P25_SCHPO] [AC:P30821] [GN:OBR1:SPAC3C7.14C] [OR:*SCHIZOSACCHAROMYCES POMBE*] [SR:,FISSION YEAST] [DE:P25 PROTEIN (BREFELDIN A RESISTANCE PROTEIN)] [SP:P30821] |
| Contig023G | 21593753_c1_187 | 67 | 4193 | 909 | 302 | 450 | 1.50E−42 | pir:[LN:E70030] [AC:E70030] [PN:transcription regulator LysR family homolog yvbU] [GN:yvbU] [OR:*Bacillus subtilis*] |
| Contig023G | 22270327_f3_154 | 68 | 4194 | 1167 | 388 | 1270 | 1.90E−129 | sp:[LN:SUCC_ECOLI] [AC:P07460] [GN:SUCC] [OR:*ESCHERICHIA COLI*] [EC:6.2.1.5] [DE:SUCCINYL-COA SYNTHETASE BETA CHAIN, (SCS-BETA)] [SP:P07460] |
| Contig023G | 22273891_f3_149 | 69 | 4195 | 207 | 68 | | | NO-HIT |
| Contig023G | 22460886_f3_116 | 70 | 4196 | 2562 | 853 | 125 | 0.00074 | sp:[LN:EGT2_YEAST] [AC:P42835] [GN:EGT2:YNL327W:N0320] [OR:*SACCHAROMYCES CEREVISIAE*] [SR:,BAKER'S YEAST] [DE:EGT2 PROTEIN PRECURSOR (EARLY G1 TRANSCRIPT 2)] [SP:P42835] |
| Contig023G | 22665142_f2_66 | 71 | 4197 | 663 | 220 | | | NO-HIT |
| Contig023G | 22697277_c2_240 | 72 | 4198 | 1461 | 486 | 899 | 4.00E−90 | gp:[GI:d1029634:g3184190] [LN:AB011381] [AC:AB011381] [PN:OprM] [GN:oprM] [OR:*Pseudomonas aeruginosa*] [SR:*Pseudomonas aeruginosa* (strain:TNP058) DNA] [DE:*Pseudomonas aeruginosa* gene for OprM, complete cds.] |
| Contig023G | 23521877_c3_289 | 73 | 4199 | 1275 | 424 | 894 | 1.30E−89 | sp:[LN:ACRA_ECOLI] [AC:P31223] [GN:ACRA:MTCA:LIR] [OR:*ESCHERICHIA COLI*] [DE:ACRIFLAVIN RESISTANCE PROTEIN A PRECURSOR] [SP:P31223] |
| Contig023G | 23650062_f2_67 | 74 | 4200 | 477 | 158 | | | NO-HIT |
| Contig023G | 23712802_c1_162 | 75 | 4201 | 1017 | 338 | 1013 | 3.30E−102 | sp:[LN:SYW_CLOLO] [AC:Q46127] [GN:TRPS:TRSA] [OR:*CLOSTRIDIUM LONGISPORUM*] [EC:6.1.1.2] [DE:(TRPRS)] [SP:Q46127] |
| Contig023G | 2395011_c2_217 | 76 | 4202 | 339 | 112 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig023G | 24031717_f2_57 | 77 | 4203 | 504 | 167 | 124 | 5.30E-08 | pir:[LN:D70541] [AC:D70541] [PN:hypothetical protein Rv1578c] [GN:Rv1578c] [OR:*Mycobacterium tuberculosis*] |
| Contig023G | 24040937_c1_184 | 78 | 4204 | 438 | 145 | 148 | 1.50E-10 | pir:[LN:S77530] [AC:S77530] [PN:hypothetical protein sll1118] [CL:hypothetical protein MJ1413] [OR:Synechocystis sp.] [SR:PCC 6803,, PCC 6803] [SR:PCC 6803,] |
| Contig023G | 24241633_f2_76 | 79 | 4205 | 225 | 74 | | | NO-HIT |
| Contig023G | 24335888_c2_245 | 80 | 4206 | 660 | 219 | 126 | 1.90E-06 | pir:[LN:E70476] [AC:E70476] [PN:2-acylglycerophosphoethanolamine acyltransferase] [GNs] [OR:*Aquifex aeolicus*] |
| Contig023G | 24337787_f2_78 | 81 | 4207 | 678 | 225 | 485 | 2.90E-46 | sp:[LN:YGIX_ECOLI] [AC:P52076] [GN:YGIX] [OR:*ESCHERICHIA COLI*] [DE:PROBABLE TRANSCRIPTIONAL REGULATORY PROTEIN YGIX] [SP:P52076] |
| Contig023G | 24344692_f3_151 | 82 | 4208 | 456 | 151 | 240 | 2.70E-20 | sp:[LN:DHSD_ECOLI] [AC:P10445] [GN:SDHD] [OR:*ESCHERICHIA COLI*] [DE:SUCCINATE DEHYDROGENASE HYDROPHOBIC MEMBRANE ANCHOR PROTEIN] [SP:P10445] |
| Contig023G | 24823302_f1_21 | 83 | 4209 | 384 | 127 | 331 | 6.10E-30 | sp:[LN:YBDF_ECOLI] [AC:P39454:P77200] [GN:YBDF] [OR:*ESCHERICHIA COLI*] [DE:HYPOTHETICAL 14.1 KD PROTEIN IN NFNB-ENTD INTERGENIC REGION] [SP:P39454:P77200] |
| Contig023G | 24891876_f1_13 | 84 | 4210 | 321 | 106 | | | NO-HIT |
| Contig023G | 2520128_f1_30 | 85 | 4211 | 204 | 67 | | | NO-HIT |
| Contig023G | 25398453_c1_179 | 86 | 4212 | 300 | 99 | | | NO-HIT |
| Contig023G | 25429812_c2_224 | 87 | 4213 | 183 | 60 | | | NO-HIT |
| Contig023G | 25509650_f1_18 | 88 | 4214 | 312 | 103 | | | NO-HIT |
| Contig023G | 25596062_f1_35 | 89 | 4215 | 708 | 235 | 314 | 3.90E-28 | gp:[GI:g4063381] [LN:AF095845] [AC:AF095845] [PN:periplasmic chaperone protein] [GN:lolA] [OR:*Pseudomonas syringae*] [DE:*Pseudomonas syringae* cell division/stress response protein (ftsK)and periplasmic chaperone protein (lolA) genes, complete cds.] [NT:LolA] |
| Contig023G | 25677082_f2_63 | 90 | 4216 | 549 | 182 | | | NO-HIT |
| Contig023G | 25783128_c3_300 | 91 | 4217 | 1296 | 431 | 665 | 2.50E-65 | sp:[LN:YD43_METJA] [AC:Q58739] [GN:MJ1343] [OR:*METHANOCOCCUS JANNASCHII*] [DE:PUTATIVE AMMONIUM TRANSPORTER MJ1343] [SP:Q58739] |
| Contig023G | 25797327_f1_15 | 92 | 4218 | 540 | 179 | 119 | 8.20E-07 | gp:[GI:e1388750:g4455819] [LN:BMB18133] [AC:Y18133] [PN:hypothetical protein] [OR:Bacteriophage MB78] [DE:Bacteriophage MB78 ORF1, ORF2, ORF3, and ORF4.] [NT:ORF2] |
| Contig023G | 26176575_f3_130 | 93 | 4219 | 726 | 241 | 165 | 2.00E-10 | gp:[GI:g3172126] [LN:ACCPCAOP] [AC:L05770:U04359:M33798:U20284:U11554:L13114:L03407] [PN:putative regulatory protein PobS] [GN:pobS] [OR:Acinetobacter sp. ADPI] [DE:Acinetobacter sp. ADPI pca-qui-pob supraoperonic cluster, completesequence.] |
| Contig023G | 26439702_f2_104 | 94 | 4220 | 195 | 64 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig023G | 29328281_f1_17 | 95 | 4221 | 321 | 106 | | | NO-HIT |
| Contig023G | 29331450_c2_225 | 96 | 4222 | 264 | 87 | | | NO-HIT |
| Contig023G | 29961463_f3_127 | 97 | 4223 | 1428 | 475 | 404 | 1.10E−42 | sp:[LN:YGIY_ECOLI] [AC:P40719] [GN:YGIY] [OR:*ESCHERICHIA COLI*] [EC:27.3.—] [DE:PROBABLE SENSOR PROTEIN YGIY,] [SP:P40719] |
| Contig023G | 30282827_c2_230 | 98 | 4224 | 381 | 126 | 234 | 1.20E−19 | gp:[GI:e1359193:g4007733] [LN:SC7A1] [AC:AL034447] [PN:hypothetical protein SC7A1.18c] [GN:SC7A1.18c] [OR:*Streptomyces coelicolor*] [DE:*Streptomyces coelicolor* cosmid 7A1.] [NT:SC7A1.18c. conserved hypothetical protein, len:] |
| Contig023G | 30289001_f1_25 | 99 | 4225 | 1086 | 361 | 170 | 2.40E−09 | gp:[GI:g2246532] [LN:U93872] [AC:U93872] [OR:Kaposi's sarcoma-associated herpesvirus] [SR:Kaposi's sarcoma-associated herpesvirus-Human herpesvirus 8] [DE:Kaposi's sarcoma-associated herpesvirus glycoprotein M, DNAreplication protein, glycoprotein, DNA replication protein, FLICEinhibitory protein and v-cyclin genes, complete cds, and tegumentprotein gene, partial cds.] [NT:ORF 73, contains large complex repeat CR 73] |
| Contig023G | 3132635_c3_287 | 100 | 4226 | 1062 | 353 | 1394 | 1.40E−142 | gp:[GI:d1023737:g2547044] [LN:AB001997] [AC:AB001997] [PN:solanesyl diphosphate synthase] [GN:sds1] [OR:*Rhodobacter capsulatus*] [SR:*Rhodobacter capsulatus* (strain:SB1003) DNA] [DE:*Rhodobacter capsulatus* DNA for solanesyl diphosphate synthase,complete cds.] |
| Contig023G | 3142807_f3_118 | 101 | 4227 | 1242 | 413 | 551 | 3.00E−53 | sp:[LN:YRAM_BACSU] [AC:O07931] [GN:YRAM] [OR:*BACILLUS SUBTILIS*] [DE:HYPOTHETICAL 39.5 KD PROTEIN IN SIGZ-CSN INTERGENIC REGION] [SP:O07931] |
| Contig023G | 32088500_c1_196 | 102 | 4228 | 189 | 62 | | | NO-HIT |
| Contig023G | 32221090_f2_60 | 103 | 4229 | 840 | 279 | 300 | 1.20E−26 | gp:[GI:g4530143] [LN:AF005222] [AC:AF085222] [PN:putative scaffolding protein] [OR:*Streptococcus thermophilus* bacteriophage DT1] [DE:*Streptococcus thermophilus* bacteriophage DT1 complete genome.] [NT:Orf7] |
| Contig023G | 32464812_f1_29 | 104 | 4230 | 693 | 230 | | | NO-HIT |
| Contig023G | 3301936_f1_43 | 105 | 4231 | 462 | 153 | 275 | 5.30E−24 | sp:[LN:DHSC_ECOLI] [AC:P10446] [GN:SDHC:CYBA] [OR:*ESCHERICHIA COLI*] [DE:SUCCINATE DEHYDROGENASE CYTOCHROME B-556 SUBUNIT] [SP:P10446] |
| Contig023G | 33630010_c2_243 | 106 | 4232 | 711 | 236 | | | NO-HIT |
| Contig023G | 33681561_f1_3 | 107 | 4233 | 354 | 117 | 192 | 3.30E−15 | gp:[GI:d1037663:g4126656] [LN:AB016282] [AC:AB016282] [OR:bacteriophage phi-105] [SR:bacteriophage phi-105 DNA] [DE:Bacteriophage phi-105 DNA, complete sequence.] [NT:ORF19] |
| Contig023G | 3400292_f2_62 | 108 | 4234 | 225 | 74 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig023G | 34119063_f1_49 | 109 | 4235 | 927 | 308 | 872 | 2.90E−87 | sp:[LN:YEDI_ECOLI] [AC:P46125:P76332] [GN:YEDI] [OR:*ESCHERICHIA COLI*] [DE:HYPOTHETICAL 32.2 KD PROTEIN IN DSRB-VSR INTERGENIC REGION] [SP:P46125:P76332] |
| Contig023G | 34258406_f3_157 | 110 | 4236 | 1296 | 431 | 527 | 1.00E−50 | gp:[GI:d1032656:g3327262] [LN:AB010827] [AC:AB010827] [PN:NhaP] [GN:nhaP] [OR:*Pseudomonas aeruginosa*] [SR:*Pseudomonas aeruginosa* (strain:PAOI) DNA] [DE:*Pseudomonas aeruginosa* gene for NhaP, complete cds.] |
| Contig023G | 34413411_f2_99 | 111 | 4237 | 531 | 176 | 127 | 2.30E−07 | sp:[LN:Y4JE_RHISN] [AC:P55505] [GN:Y4JE] [OR:RHIZOBIUM SP] [DE:HYPOTHETICAL 29.4 KD PROTEIN Y4JE] [SP:P55505] |
| Contig023G | 34417183_c1_174 | 112 | 4238 | 1893 | 630 | 2044 | 1.80E−211 | sp:[LN:RPSD_PSEAE] [AC:P26480] [GN:RPOD:RPODA] [OR:*PSEUDOMONAS AERUGINOSA*] [DE:RNA POLYMERASE SIGMA FACTOR RPOD (SIGMA-70)] [SP:P26480] |
| Contig023G | 34644057_f1_45 | 113 | 4239 | 1218 | 405 | 1334 | 3.20E−136 | gp:[GI:g39283] [LN:AVSUCCTR] [AC:X52432] [PN:succinyltransferase] [OR:*Azotobacter vinelandii*] [DE:*A.vinelandii* gene for succinyltransferase.] [SP:P20708] |
| Contig023G | 34650462_f3_106 | 114 | 4240 | 222 | 73 | | | NO-HIT |
| Contig023G | 35282327_f1_14 | 115 | 4241 | 2280 | 759 | 170 | 5.90E−09 | sp:[LN:Y4SI_RHISN] [AC:P55652] [GN:Y4SI] [OR:RHIZOBIUM SP] [DE:PROBABLE CHEMORECEPTOR Y4SI (METHYL-ACCEPTING CHEMOTAXIS PROTEIN)] [SP:P55652] |
| Contig023G | 35314030_f3_108 | 116 | 4242 | 1362 | 453 | 569 | 3.70E−55 | sp:[LN:VP3_BPHK7] [AC:P49859] [GN:3] [OR:BACTERIOPHAGE HK97] [DE:PORTAL PROTEIN (GP3)] [SP:P49859] |
| Contig023G | 35319187_f1_41 | 117 | 4243 | 516 | 171 | | | NO-HIT |
| Contig023G | 35417007_f2_61 | 118 | 4244 | 402 | 133 | | | NO-HIT |
| Contig023G | 36114678_f3_129 | 119 | 4245 | 960 | 319 | 386 | 9.10E−36 | pir:[LN:E71694] [AC:E71694] [PN:hypothetical protein RP372] [GN:RP372] [OR:*Rickettsia prowazekii*] |
| Contig023G | 36130302_c3_288 | 120 | 4246 | 645 | 214 | 194 | 2.00E−15 | pir:[LN:S32217] [AC:S32217] [PN:hypothetical protein 2] [OR:*Bacillus megaterium*] |
| Contig023G | 36539683_f3_110 | 121 | 4247 | 405 | 134 | 98 | 0.00015 | gp:[GI:g2688942] [LN:AF025480] [AC:AF025480] [PN:Na—Ca+K exchanger] [GN:BISNCKX] [OR:Bison bison] [SR:American bison] [DE:Bison bison Na—Ca+K exchanger (BISNCKX) mRNA, partial cds.] [NT:ion exchanger; cytosolic region; expressed in] [RE: |
| Contig023G | 36600417_f2_103 | 122 | 4248 | 912 | 303 | 1108 | 2.80E−112 | gp:[GI:g4512118] [LN:AF128399] [AC:AF128399] [PN:succinyl-CoA synthetase alpha subunit] [GN:sucD] [OR:*Pseudomonas aeruginosa*] [DE:*Pseudomonas aeruginosa* succinyl-CoA synthetase beta subunit (sucC)and succinyl-CoA synthetase alpha subunit (sucD) genes, completecds.] |

TABLE 2-continued

| Query | Orf | NT ID | AA ID | NT Lgth | AA Lgth | Score | P-value | Subject |
|---|---|---|---|---|---|---|---|---|
| Contig023G | 3914053_f1_7 | 123 | 4249 | 1230 | 409 | 657 | 1.70E−64 | sp:[LN:COAT_BPHK7] [AC:P49861] [GN:5] [OR:BACTERIOPHAGE HK97] [DE:MAJOR CAPSID PROTEIN PRECURSOR (GPS) (HEAD PROTEIN)] [SP:P49861] |
| Contig023G | 3947805_c3_282 | 124 | 4250 | 1410 | 469 | 1155 | 3.00E−117 | sp:[LN:YEEF_ECOLI] [AC:P33016] [GN:YEEF] [OR:*ESCHERICHIA COLI*] [DE:HYPOTHETICAL 49.8 KD TRANSPORT PROTEIN IN SBCB-HISL INTERGENIC REGION] [SP:P33016] |
| Contig023G | 3959552_f2_53 | 125 | 4251 | 234 | 77 | | | NO-HIT |
| Contig023G | 3964192_c1_192 | 126 | 4252 | 870 | 289 | 548 | 6.20E−53 | sp:[LN:YBBK_ECOLI] [AC:P77367] [GN:YBBK] [OR:*ESCHERICHIA COLI*] [DE:HYPOTHETICAL 33.7 KD PROTEIN IN USHA_TESA INTERGENIC REGION] [SP:P77367] |
| Contig023G | 4142757_f1_46 | 127 | 4253 | 777 | 258 | | | NO-HIT |
| Contig023G | 422502_c1_172 | 128 | 4254 | 963 | 320 | 659 | 1.10E−64 | pir:[LN:S76272] [AC:S76272] [PN:yceA protein homolog] [CL:*Escherichia coli* yceA protein] [OR:Synechocystis sp.] [SR:PCC 6803,, PCC6803] SR:PCC 6803,] |
| Contig023G | 426090_c3_306 | 129 | 4255 | 960 | 319 | 402 | 1.80E−37 | pir:[LN:H69874] [AC:H69874] [PN:conserved hypothetical protein ylbK] [GN:ylbK] [OR:*Bacillus subtilis*] |
| Contig023G | 4329813_f3_152 | 130 | 4256 | 1845 | 614 | 2329 | 1.20E−241 | gp:[GI:d1032167:g3273345] [LN:AB015757] [AC:AB015757] [PN:fumarate reductase flavoprotein subunit] [OR:*Rhodoferax fermentans*] [SR:*Rhodoferax fermentans* (strain:FR2) DNA] [DE:*Rhodoferax fermentans* genes for fumarate reductase subunits,complete cds.] |
| Contig023G | 4345293_f1_9 | 131 | 4257 | 483 | 160 | | | NO-HIT |
| Contig023G | 4745400_f1_1 | 132 | 4258 | 399 | 132 | 355 | 1.80E−32 | sp:[LN:VG64_BPMD2] [AC:O64256] [GN:64] [OR:MYCOBACTERIOPHAGE] D29] [DE:GENE 64 PROTEIN (GP64)] [SP:O64256] |
| Contig023G | 4875438_f2_81 | 133 | 4259 | 816 | 271 | 326 | 2.10E−29 | gp:[GI:g1125836] [GN:CELT25G12] [AC:U43283] [GN:T25G12.7] [OR:*Caenorhabditis elegans*] [DE:*Caenorhabditis elegans* cosmid T25G12.] [NT:Similar to dehydrogenase; T25G12.7] |
| Contig023G | 4949042_f1_16 | 134 | 4260 | 2871 | 956 | 137 | 5.30E−06 | gp:[GI:e1388752:g4455821] [LN:BMB18133] [AC:Y18133] [PN:hypothetical protein] [OR:Bacteriophage MB78] [DE:Bacteriophage MB78 ORF1, ORF2, ORF3, and ORF4.] [NT:ORF4] [RE: |
| Contig023G | 5078838_f3_125 | 135 | 4261 | 1305 | 434 | 110 | 1.40E−05 | pir:[LN:A26892] [AC:A26892] [PN: Mopa box protein] [OR:*Mus musculus*] [SR:,house mouse] |
| Contig023G | 5109700_f3_142 | 136 | 4262 | 1278 | 425 | 1464 | 5.30E−150 | sp:[LN:SYS_ECOLI] [AC:P09156] [GN:SERS] [OR:*ESCHERICHIA COLI*] [EC:6.1.1.11] [DE:SERYL-TRNA SYNTHETASE, (SERINE--TRNA LIGASE) (SERRS)] [SP:P09156] |

TABLE 2-continued

| Query | Orf | NT ID | AA ID | NT Lgth | AA Lgth | Score | P-value | Subject |
|---|---|---|---|---|---|---|---|---|
| Contig023G | 5190805_f3_126 | 137 | 4263 | 1659 | 552 | 1124 | 5.70E−114 | sp:[LN:YJDB_ECOLI] [AC:P30845:P76793] [GN:YJDB] [OR:ESCHERICHIA COLI] [DE:HYPOTHETICAL 61.7 KD PROTEIN IN BASS-ADIY INTERGENIC REGION] [SP:P30845:P76793] |
| Contig023G | 5203957_c2_227 | 138 | 4264 | 330 | 109 | 112 | 9.90E−07 | sp:[LN:YBED_ECOLI] [AC:P30977] [GN:YBED] [OR:ESCHERICHIA COLI] [DE:HYPOTHETICAL 9.8 KD PROTEIN IN LIPB-DACA INTERGENIC REGION (ORF1)] [SP:P30977] |
| Contig023G | 5367750_f3_115 | 139 | 4265 | 414 | 137 | | | NO-HIT |
| Contig023G | 5917577_f1_19 | 140 | 4266 | 369 | 122 | | | NO-HIT |
| Contig023G | 5978587_f2_69 | 141 | 4267 | 561 | 186 | 132 | 7.50E−09 | gp:[GI:e51245:g1143594] [LN:STPES18G] [AC:X67137] [PN:gp19 protein] [GN:gene 19] [OR:Salmonella typhimurium] [DE:S.typhimurium-phage ES18 genes 13, 19 and 15.] |
| Contig023G | 6019127_f3_114 | 142 | 4268 | 396 | 131 | | | NO-HIT |
| Contig023G | 6031578_f2_90 | 143 | 4269 | 474 | 157 | 422 | 1.40E−39 | sp:[LN:YIBK_HAEIN] [AC:P44868] [GN:HI0766] [OR:HAEMOPHILUS INFLUENZAE] [EC:2.1.1.—] [DE:HYPOTHETICAL TRNA/RRNA METHYLTRANSFERASE HI0766,] [SP:P44868] |
| Contig023G | 603515_f1_52 | 144 | 4270 | 279 | 92 | | | NO-HIT |
| Contig023G | 6417325_f1_33 | 145 | 4271 | 324 | 107 | 377 | 8.20E−35 | sp:[LN:RL21_HAEIN] [AC:P44359] [GN:RPLU:RPL21:HI0880] [OR:HAEMOPHILUS INFLUENZAE] [DE:50S RIBOSOMAL PROTEIN L21] [SP:P44359] |
| Cnntig023G | 6688292_c2_213 | 146 | 4272 | 186 | 61 | | | NO-HIT |
| Contig023G | 6930180_f1_34 | 147 | 4273 | 276 | 91 | 330 | 7.80E−30 | pir:[LN:F64099] [AC:F64099] [PN:ribosomal protein L27] [CL:Escherichia coli ribosomal protein L27:eubacterial ribosomal protein L27 homology] [OR:Haemophilus influenzae] |
| Contig023G | 7218842_f1_38 | 148 | 4274 | 1383 | 460 | 1082 | 1.60E−109 | sp:[LN:CYSG_ECOLI] [AC:P11098:P76685] [GN:CYSG] [OR:ESCHERICHIA COLI] [EC:2.1.1.107:1.—.—.—:4.99.1.—] [DE:(EC 4.99.1.—)]] [SP:P11098:P76685] |
| Contig023G | 789058_f2_71 | 149 | 4275 | 234 | 77 | | | NO-HIT |
| Contig023G | 960452_c3_290 | 150 | 4276 | 3177 | 1058 | 3139 | 0 | sp:[LN:MEXB_PSEAE] [AC:P52002] [GN:MEXB] [OR:PSEUDOMONAS AERUGINOSA] [DE:MULTIDRUG RESISTANCE PROTEIN MEXB (MULTIDRUG-EFFLUX TRANSPORTER MEXB)] [SP:P52002] |
| Contig023G | 9806686_c1_175 | 151 | 4277 | 537 | 178 | | | NO-HIT |
| Contig023G | 984752_c3_311 | 152 | 4278 | 186 | 61 | | | NO-HIT |
| Contig023G | 9860215_f3_107 | 153 | 4279 | 264 | 87 | | | NO-HIT |
| Contig066G | 10430167_f1_11 | 154 | 4280 | 942 | 313 | 299 | 1.50E−26 | sp:[LN:YEAM_ECOLI] [AC:P76241] [GN:YEAM] [OR:ESCHERICHIA COLI] [DE:HYPOTHETICAL TRANSCRIPTIONAL REGULATOR IN GAPA-RND INTERGENIC REGION] [SP:P76241] |

TABLE 2-continued

| Query | Orf | NT ID | AA ID | NT Lgth | AA Lgth | Score | P-value | Subject |
|---|---|---|---|---|---|---|---|---|
| Contig066G | 10662776_f2_35 | 155 | 4281 | 1209 | 402 | 985 | 3.10E−99 | pir:[LN:C70505] [AC:C70505] [PN:probable acyl-coa dehydrogenase] [GN:fadE20] [CL:acyl-CoA dehydrogenase] [OR:*Mycobacterium tuberculosis*] |
| Contig066G | 1189152_f2_24 | 156 | 4282 | 1473 | 490 | 1408 | 4.60E−144 | sp:[LN:YLEA_HAEIN] [AC:Q57163] [GN:H10019] [OR:*HAEMOPHILUS INFLUENZAE*] [DE:HYPOTHETICAL PROTEIN HI0019] [SP:Q57163] |
| Contig066G | 1207157_f3_49 | 157 | 4283 | 2373 | 790 | 441 | 7.80E−40 | gp:[GI:e1352251:g3892703] [LN:ATF7K2] [AC:AL033545] [PN:putative glycine-rich protein] [GN:F7K2_60] [OR:*Arabidopsis thaliana*] [SR:thate cress] [DE:*Arabidopsis thaliana* DNA chromosome 4, BAC clone F7K2 (ESSAIIproject).] [NT:long ORF and comparable genepredictions are also] |
| Contig066G | 12907532_f3_50 | 158 | 4284 | 2448 | 815 | 1522 | 1.40E−159 | sp:[LN:VACB_HAEIN] [AC:P44907] [GN:VACB:H10861] [OR:*HAEMOPHILUS INFLUENZAE*] [DE:VACB PROTEIN HOMOLOG] [SP:P44907] |
| Contig066G | 14881562_c2_105 | 159 | 4285 | 840 | 279 | 353 | 2.90E−32 | sp:[LN:PSS_HELPY] [AC:Q48269:007681] [GN:PSSA:PTR:HP1071] [OR:*HELICOBACTER PYLORI*] [SR:,*CAMPYLOBACTER PYLORI*] [EC:2.7.8.8] [DE:(PHOSPHATIDYLSERINE SYNTHASE)] [SP:Q48269:007681] |
| Contig066G | 1511550_c1_62 | 160 | 4286 | 396 | 131 | 476 | 2.60E−45 | sp:[LN:RL17_PSEAE] [AC:052761] [GN:RPLQ] [OR:*PSEUDOMONAS AERUGINOSA*] [DE:50S RIBOSOMAL PROTEIN L17] [SP:052761] |
| Contig066G | 15870462_c2_91 | 161 | 4287 | 579 | 192 | | | NO-HIT |
| Contig066G | 16206258_c2_96 | 162 | 4288 | 456 | 151 | 122 | 1.90E−07 | gp:[GI:g1155358] [LN:BPU43599] [AC:U43599] [PN:microfilarial sheath protein SHP3 precursor] [GN:shp3] [FN:structural protein] [OR:*Brugia pahangi*] [DE:*Brugia pahangi* microfilarial sheath protein SHP3 (shp3) gene,complete cds.] |
| Contig066G | 181292_f2_27 | 163 | 4289 | 648 | 215 | 672 | 4.50E−66 | sp:[LN:XPT_BACSU] [AC:P42085] [GN:XPT] [OR:*BACILLUS SUBTILIS*] [EC:2.4.2.—] [DE:XANTHINE PHOSPHORIBOSYLTRANSFERASE,] [SP:P42085] |
| Contig066G | 19585052_c3_124 | 164 | 4290 | 948 | 315 | 118 | 0.0002 | sp:[LN:INVO_PIG] [AC:P18175] [GN:IVL] [OR:SUS SCROFA] [DE:INVOLUCRIN] [SP:P18175] |
| Contig066G | 1985642_c3_109 | 165 | 4291 | 1524 | 507 | 1357 | 1.20E−138 | pir:[LN:G70852] [AC:G70852] [PN:hypothetical protein Rv3083] [GN:Rv3083] [OR:*Mycobacterium tuberculosis*] |
| Contig066G | 20506530_c2_104 | 166 | 4292 | 321 | 106 | | | NO-HIT |
| Contig066G | 22688768_f2_21 | 167 | 4293 | 612 | 203 | 137 | 6.80E−07 | gp:[GI:e1345871:g3876300] [LN CEF22E12] [AC:Z71180] [GN:egl-9] [OR:*Caenorhabditis elegans*] [DE:*Caenorhabditis elegans* cosmid F22E12, complete sequence.] [NT:Weak similarity with apoptosis protein RP-8; cDNA] |

TABLE 2-continued

| Query | Orf | NT ID | AA ID | NT Lgth | AA Lgth | Score | P-value | Subject |
|---|---|---|---|---|---|---|---|---|
| Contig066G | 23446055_c3_125 | 168 | 4294 | 2004 | 667 | 396 | 3.60E−34 | pir:[LN:QQECW1] [AC:S56616:G65254:A41332:A93 698:A93867:A04435] [PN:soluble lytic transglycosylase, precursor] [GN:slt] [CL:soluble lytic transglycosylase] [OR:*Escherichia coli*] [EC:3.2.1.—] [MP:100 min] |
| Contig066G | 23572212_c2_88 | 169 | 4295 | 390 | 129 | 540 | 4.40E−52 | gp:[GI:g4098575] [LN:XCU79735] [AC:U79735] [PN:ribosomal protein S11] [GN:rpsK] [OR:*Xanthomonas campestris* pv. *campestris*] [DE:*Xanthomonas campestris* pv. *campestris* ALPHA operon, ribosomalprotein S13 (rpsM), ribosomal protein S11 (rpsK), ribosomal protein S4 (rpsD), RNA polymerase ALPHA subunit (rpoA) and ribosomalprotein L17 (rplQ) genes, complete cds.] |
| Contig066G | 24616057_c3_116 | 170 | 4296 | 537 | 178 | 215 | 1.20E−17 | sp:[LN:MSP8_EIMAC] [AC:P09125] [OR:*EIMERTA ACERVULINA*] [DE:MEROZOITE SURFACE PROTEIN CMZ-8 (FRAGMENT)] [SP:P09125] |
| Contig066G | 24631392_f3_46 | 171 | 4297 | 1110 | 369 | 945 | 5.30E−95 | sp:[LN:PHOL_ECOLI] [AC:P77349] [GN:YBEZ] [OR:*ESCHERICHIA COLI*] [DE:PHOH-LIKE PROTEIN] [SP:P77349] |
| Contig066G | 25409677_c1_61 | 172 | 4298 | 1029 | 342 | 1218 | 6.20E−124 | gp:[GI:g2896137] [LN:AF047025] [AC AF047025] [PN:DNA-directed RNA polymerase alpha chain] [GN:rpoA] [OR:*Pseudomonas aeruginosa*] [DE:*Pseudomonas aeruginosa* ribosomal protein S4 (rpsD) gene, partialcds; DNA-directed RNA polymerase alpha chain (rpoA), ribosomallarge subunit protein L17 (rplQ), and catalase isozyme A (kalA)genes., complete cds; and bacterioferritin (bfr) genQ partial cds.] [NT:Similar to *Heamophilus influenza* RpoA, Swissprot] |
| Contig066G | 25475890_c3_110 | 173 | 4299 | 1131 | 376 | | | NO-HIT |
| Contig066G | 26181541_f2_29 | 174 | 4300 | 1251 | 416 | 422 | 1.40E−39 | sp:[LN:RBN_ECOLI] [AC:P32146] [GN:RBN] [OR:*ESCHERICHIA COLI*] [EC:3.1.—.—] [DE:RIBONUCLEASE BN, (RNASE BN)] [SP:P32146] |
| Contig066G | 26375702_c1_67 | 175 | 4301 | 258 | 85 | 118 | 2.30E−07 | sp:[LN:YGFY_ECOLI] [AC:Q46825] [GN:YGFY] [OR:*ESCHERICHIA COLI*] [DE:HYPOTHETICAL 10.5 KD PROTEIN IN FLDB-BGLA INTERGENIC REGION] [SP:Q46825] |
| Contig066G | 29460757_f2_25 | 176 | 4302 | 186 | 61 | | | NO-HIT |
| Contig066G | 30506562_f1_14 | 177 | 4303 | 2061 | 686 | 1732 | 2.10E−178 | sp:[LN:OPDA_ECOLI] [AC:P27298] [GN:PRLC:OPDA] [OR:*ESCHERICHIA COLI*] [EC:3.4.24.70] [DE:OLIGOPEPTIDASE A.] [SP:P27298] |
| Contig066G | 32058137_c2_100 | 178 | 4304 | 660 | 219 | 337 | 1.40E−30 | gp:[GI:g3493605] [LN:AF067083] [AC:AF067083] [PN:Trp repressor binding protein] [OR:Vitreoscilla sp.] [SR:Vitreoscilla sp] [DE:Vitreoscilla sp. outer membrane protein homolog gene, complete cds;Trp repressor binding protein gene. partial cds; and unknown genes.] [RE: |

TABLE 2-continued

| Query | Orf | NT ID | AA ID | NT Lgth | AA Lgth | Score | P-value | Subject |
|---|---|---|---|---|---|---|---|---|
| Contig066G | 32632952_c1_79 | 179 | 4305 | 915 | 304 | 245 | 8.00E−21 | pir:[LN:G69897] [AC:G69897] [PN:conserved hypothetical protein yoaV] [GN:yoaV] [OR:*Bacillus subtilis*] |
| Contig066G | 32695300_f3_42 | 180 | 4306 | 546 | 181 | | | NO-HIT |
| Contig066G | 33367202_c3_126 | 181 | 4307 | 663 | 220 | | | NO-HIT |
| Contig066G | 34021887_c1_86 | 182 | 4308 | 351 | 116 | | | NO-HIT |
| Contig066G | 34443_f3_47 | 183 | 4309 | 486 | 161 | 320 | 9.00E−29 | sp:[LN:YBEY_ECOLI] [AC:P77385] [GN:YBEY] [OR:*ESCHERICHIA COLI*] [DE:HYPOTHETICAL 17:5 KD PROTEIN IN CUTE-ASNB INTERGENIC REGION] [SP:P77385] |
| Contig066G | 35400067_f1_10 | 184 | 4310 | 717 | 238 | | | NO-HIT |
| Contig066G | 35558452_c2_106 | 185 | 4311 | 1080 | 359 | | | NO-HIT |
| Contig066G | 448426_f1_15 | 186 | 4312 | 447 | 148 | 104 | 0.00085 | gp:[GI:g467292] [LN:DDU07817] [AC:U07817] [PN:glutamine-asparagine rich protein] [OR:*Dictyostelium discoideum*] [DE:*Dictyostelium discoideum* AX3 glutamine-asparagine rich proteingene, partial cds.] |
| Contig066G | 4772807_c3_119 | 187 | 4313 | 291 | 96 | 142 | 2.00E−09 | gp:[GI:g2271518] [LN:AF009829] [AC:AF009829] [PN:unknown] [GN:MBE4863a] [OR:*Mycobacterium bovis*] [DE:*Mycobacterium bovis* MBE4863a gene, partial cds, and MBE4863b gene,complete cds.] |
| Contig066G | 4860312_c3_115 | 188 | 4314 | 510 | 169 | 131 | 1.10E−08 | gp:[GI:e1326345:g3688206] [LN:CAJ10321] [AC:AJ010321] [PN:cicA protein] [GN:cicA] [OR:*Caulobacter crescentus*] [DE:*Caulobacter crescentus* partial tig gene and clpP, cicA, clpX, longenes.] |
| Contig066G | 4879713_c3_111 | 189 | 4315 | 2217 | 738 | 137 | 2.30E−13 | gp:[GI:e1375212:g4226003] [LN:WSU132740] [AC:AJ132740] [PN:large integral C4-dicarboxylate membrane] [GN:dctM] [OR:*Wolinella succinogenes*] [DE:*Wolinella succinogenes* dctP, dctQ and dctM genes, and partial orfN.] |
| Contig066G | 4954377_f3_48 | 190 | 4316 | 735 | 244 | 244 | 1.00E−20 | sp:[LN:YC08_YEAST] [AC:P37261] [GN:YCLX08C:YCLX8C] [OR:*SACCHAROMYCES CEREVISIAE*] [SR:,BAKER'S YEAST] [DE:HYPOTHETICAL 21.1 KD PROTEIN IN FUSI-AGPI INTERGENIC REGION] [SP:P37261] |
| Contig066G | 4969003_c1_76 | 191 | 4317 | 681 | 226 | 437 | 3.60E−41 | pir:[LN:A64864] [AC:A64864] [PN:probable 2-hydroxyhepta-2,4-diene-1,7-dioate isomerase b1180] [CL:2-hydroxyhepta-2,4-diene-1,7 dioate isomerase] [OR:*Escherichia coli*] |
| Contig066G | 5078375_c1_68 | 192 | 4318 | 396 | 131 | | | NO-HIT |
| Contig066G | 5125285_c1_75 | 193 | 4319 | 507 | 168 | | | NO-HIT |
| Contig066G | 5163432_c3_118 | 194 | 4320 | 429 | 142 | 237 | 9.10E−20 | pir:[LN:S71558] [AC:S71558] [PN:probable cell walt-plasma membrane linker protein PRP precursor:hybrid-proline-rich protein] [CL:hydroxyproline-rich glycoprotein] [OR:*Brassica napus*] [SR:, rape] |
| Contig066G | 552012_c1_85 | 195 | 4321 | 1032 | 343 | 1320 | 9.70E−135 | gp:[GI:g4235484] [LN:AF109682] [AC:AF109682] [PN:malate dehydrogenase] [GN:MDH] [OR:*Aquaspirillum arcticum*] [DE:*Aquaspirillum arcticum* malate dehydrogenase (MDH) gene, completecds.] |

TABLE 2-continued

| Query | Orf | NT ID | AA ID | NT Lgth | AA Lgth | Score | P-value | Subject |
|---|---|---|---|---|---|---|---|---|
| Contig066G | 6111002_f2_33 | 196 | 4322 | 237 | 78 | 108 | 2.60E−06 | sp:[LN:YHEV_ECOLI] [AC:P56622] [GN:YHEV] [OR:*ESCHERICHIA COLI*] [DE:HYPOTHETICAL 7.6 KD PROTEIN IN SLYD-KEFB INTERGENIC REGION] [SP:P56622] |
| Contig066G | 6828443_c3_127 | 197 | 4323 | 873 | 290 | 560 | 3.30E−54 | sp:[LN:YHIR_ECOLI] [AC:P37634] [GN:YHIR] [OR:*ESCHERICHIA COLI*] [DE:HYPOTHETICAL 31.9 KD PROTEIN IN PRLC-GOR INTERGENIC REGION (0280A)] [SP:P37634] |
| Contig066G | 6835385_f2_26 | 198 | 4324 | 774 | 257 | | | NO-HIT |
| Contig066G | 898568_c2_89 | 199 | 4325 | 639 | 212 | 734 | 1.20E−72 | pir:[LN:R3EC4] [AC:C23807:A02703:A30417:559 052:157736:177540:177542;1 [PN:ribosomal protein S4] [GN:rpsD] [CL:*Escherichia coli* ribosomal protein S4] [OR:*Escherichia coli*] [MP:73 min] |
| Contig067G | 102205_f2_198 | 200 | 4326 | 792 | 263 | 942 | 1.10E−94 | pir:[LN:A57432] [AC:A57432:A53967] [PN:ferredoxin--NADP+ reductase,] [GN:fpr] [OR:*Azotobacter vinelandii*] [EC:1.18.1.2] |
| Contig067G | 10313955_c1_561 | 201 | 4327 | 222 | 73 | | | NO-HIT |
| Contig067G | 10557702_f1_41 | 202 | 4328 | 618 | 205 | 310 | 1.00E−27 | pir:[LN:S76551] [AC:S76551] [PN:hypothetical protein] [OR:Synechocystis sp.] [SR:PCC 6803, PCC 68031 [SR:PCC 6803;] |
| Contig067G | 10631930_f2_220 | 203 | 4329 | 201 | 66 | | | NO-HIT |
| Contig067G | 10656285_f2_312 | 204 | 4330 | 255 | 84 | | | NO-HIT |
| Contig067G | 1070880_f3_330 | 205 | 4331 | 231 | 76 | 283 | 7.50E−25 | pir:[LN:R3EC21] [AC:A02749:A30426:I57721:G65 094] [PN:ribosomal protein S21] [GN:rpsU] [CL:*Escherichia coli* ribosomal protein S21] [OR:*Escherichia coli*] [MP:67 min] |
| Contig067G | 10719000_f1_107 | 206 | 4332 | 558 | 185 | 448 | 2.50E−42 | gp:[GI:e1154545:g2570059] [LN:NGMS11DNA] [AC:AJ004687] [PN:N-4 cytosine-specificmMethyltransferase] [OR:*Neisseria gonorrhoeae*] [DE:*Neisseria gonorrheae* MS11 encoding N-4 cytosine-specificmethyltransferase.] |
| Contig067G | 10759817_c1_629 | 207 | 4333 | 1167 | 389 | 551 | 1.50E−52 | sp:[LN:YK69_YEAST] [AC:P36165] [GN:YKR089C:YKR409] [OR:*SACCHAROMYCES CEREVISIAE*] [SR:,BAKER'S YEAST] [DE:HYPOTHETICAL 102.7 KD PROTEIN IN PRP16-SRP40 INTERGENIC REGION] [SP:P36165] |
| Contig067G | 10818752_c3_852 | 208 | 4334 | 318 | 105 | | | NO-HIT |
| Contig067G | 10973917_f1_40 | 209 | 4335 | 1149 | 382 | 1028 | 8.50E−104 | sp:[LN:RODA_ECOLI] [AC:P15035:P13409] [GN:MRDB:RODA] [OR:*ESCHERICHIA COLI*] [DE:ROD SHAPE-DETERMINING PROTEIN RODA] [SP:P15035:P13409] |
| Contig067G | 11020162_c1_541 | 210 | 4336 | 225 | 74 | | | NO-HIT |
| Contig067G | 11125630_f1_88 | 211 | 4337 | 225 | 74 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig067G | 11135962_f1_152 | 212 | 4338 | 807 | 268 | 476 | 2.60E−45 | sp:[LN:YMFC_ECOLI] [AC:P75966] [GN:YMFC] [OR:*ESCHERICHIA COLI*] [DE:HYPOTHETICAL 24.9 KD PROTEIN IN TRMU-ICDA INTERGENIC REGION] [SP:P75966] |
| Contig067G | 11720307_c3_826 | 213 | 4339 | 1026 | 341 | 1113 | 8 30E−113 | sp:[LN:FATD_VIBAN] [AC:P37738] [GN:FATD] [OR:*VIBRIO ANGUILLARUM*] [DE:FERRIC ANGUIBACTIN TRANSPORT SYSTEM PERMEASE PROTEIN FATD] [SP:P37738] |
| Contig067G | 11739418_c3_898 | 214 | 4340 | 1122 | 373 | 1048 | 6.40E−106 | sp:[LN:PHEA_PSEST] [AC:P27603] [GN:PHEA] [OR:*PSEUDOMONAS STUTZERI*] [SR:,*PSEUDOMONAS PERFECTOMARINA*] [EC:5.4.99.5:4.2.1.51] [DE:(EC 4.2.1.51) (PDT) (P-PROTEIN)] [SP:P27603] |
| Contig067G | 11848562_f2_258 | 215 | 4341 | 189 | 62 | | | NO-HIT |
| Contig067G | 1196937_c3_883 | 216 | 4342 | 192 | 63 | | | NO-HIT |
| Contig067G | 1203137_c3_792 | 217 | 4343 | 969 | 322 | 752 | 1.50E−74 | gp:[GI:g290470] [LN:ECOSOHB] [AC:M73320] [GN:sohB] [OR:*Escherichia coli*] [SR:*Escherichia coli* (sub_strain W3110, strain K-12) DNA] [DE:*E.coli* sohB gene, complete CDS.] |
| Contig067G | 1210317_c2_654 | 218 | 4344 | 711 | 236 | 92 | 1.40E−05 | sp:[LN:VENB_VIBVU] [AC:P74965] [GN:VENB] [OR:*VIBRIO VULNIFICUS*] [EC:3.3.2.1] [DE:DIHYDROXYBENZOATE SYNTHASE)] [SP:P74965] |
| Contig067G | 12226556_f2_276 | 219 | 4345 | 543 | 180 | 241 | 2.10E−20 | pir:[LN:C64858] [AC:C64858] [PN:probable dNTP pyrophosphohydrolase b1134] [CL:mutT domain homology] [OR:*Escherichia coli*] |
| Contig067G | 12298200_f1_57 | 220 | 4346 | 660 | 219 | 750 | 2.40E−74 | sp:[LN:SODF_SYNP7] [AC:P18655] [GN:SODB] [OR:SYNECHOCOCCUS SP] [SR:PCC 7942,ANACYSTIS NIDULANS R2] [EC:1.15.1.1] [DE:SUPEROXIDE DISMUTASE [FE].] [SP:P18655] |
| Contig067G | 1230458_f1_124 | 221 | 4347 | 798 | 265 | 148 | 3.10E−13 | sp:[LN:YCFC_HAEIN] [AC:P44796] [GN:H10638] [OR:*HAEMOPHILUS INFLUENZAE*] [DE:HYPOTHETICAL PROTEIN H10638] [SP:P44796] |
| Contig067G | 12787750_c1_604 | 222 | 4348 | 1272 | 423 | 2035 | 1.70E−210 | gp:[GI:g3284000] [LN:AF073769] [AC:AF073769] [PN:serine hydroxymethyltransferase] [GN:gtyA] [OR:*Acinetobacter radioresistens*] [DE:*Acinetobacter radioresistens* serine hydroxymethyltransferase (glyA)gene, complete cds.] |
| Contig067G | 135087_f3_455 | 223 | 4349 | 1218 | 405 | 797 | 2.60E−79 | sp:[LN:DACA_HAEIN] [AC:P44466] [GN:DACA:H10029] [OR:*HAEMOPHILUS INFLUENZAE*] [EC:3.4.16.4] [DE:(DD-CARBOXYPEPTIDASE) (PBP-5)] [SP:P44466] |

TABLE 2-continued

| Query | Orf | NT ID | AA ID | NT Lgth | AA Lgth | Score | P-value | Subject |
|---|---|---|---|---|---|---|---|---|
| Contig067G | 1352155_f1_138 | 224 | 4350 | 726 | 241 | 381 | 3.10E−35 | sp:[LN:YIJC_ECOLI] [AC:P27307] [GN:YIJC] [OR:*ESCHERICHIA COLI*] [DE:HYPOTHETICAL 26.6 KD PROTEIN IN UDHA-TRMA INTERGENIC REGION (ORFA)] [SP:P27307] |
| Contig067G | 1359428_c3_764 | 225 | 4351 | 633 | 210 | 237 | 5.60E−20 | gp:[GI:g2565360] [LN:AF025663] [AC:AF025663] [PN:lipoprotein] [GN:vlpA] [OR:*Vibrio cholerae*] [DE:*Vibrio cholerae* lipoprotein (vlpA) gene, complete cds.] [NT:VlpA] |
| Contig067G | 1360317_f3_438 | 226 | 4352 | 246 | 81 | | | NO-HIT |
| Contig067G | 13672552_c1_596 | 227 | 4353 | 885 | 294 | 925 | 7.00E−93 | sp:[LN:RS2_SPIPL] [AC:P34831] [GN:RPSB] [OR:*SPIRULINA PLATENSIS*] [DE:30S RIBOSOMAL PROTEIN S2] [SP:P34831] |
| Contig067G | 13756562_c1_621 | 228 | 4354 | 831 | 276 | 889 | 4.50E−89 | sp:[LN:YAAA_ECOLI] [AC:P11288] [GN:YAAA] [OR:*ESCHERICHIA COLI*] [DE:HYPOTHETICAL 29.6 KD PROTEIN IN THRC-TALB INTERGENIC REGION] [SP:P11288] |
| Contig067G | 13786577_f1_337 | 229 | 4355 | 246 | 81 | 98 | 3.00E−05 | sp:[LN:YHHP_HAEIN] [AC:P44841] [GN:H10721] [OR:*HAEMOPHILUS INFLUENZAE*] [DE:HYPOTHETICAL PROTEIN H10721] [SP:P44841] |
| Contig067G | 13869027_c1_533 | 230 | 4356 | 906 | 301 | 821 | 7.30E−82 | pir:[LN:F69419] [AC:F69419] [PN:phosphate ABC transporter, ATP-binding protein (pstB) homolog] [CL:inner membrane protein malK: ATP-binding cassette homology] [OR:*Archaeoglobus fulgidus*] |
| Contig067G | 13875000_f1_328 | 231 | 4357 | 225 | 74 | | | NO-HIT |
| Contig067G | 13961502_c3_907 | 232 | 4358 | 672 | 223 | | | NO-HIT |
| Contig067G | 14297265_c1_610 | 233 | 4359 | 1071 | 356 | 546 | 1.00E−52 | pir:[LN:S47741] [AC:S47741:D65150] [PN:hypothetical transcription regulator treF-kdgk intergenic region:hypothetical protein o323] [GN:yhjC] [OR:*Escherichia coli*] |
| Contig067G | 14304175_c1_619 | 234 | 4360 | 1200 | 399 | 960 | 1.40E−96 | gp:[GI:e1420018:g4539191] [LN:SC6A5] [AC:AL049485] [PN:probable acyl-CoA dehydrogenase] [GN:SC6A5.36] [OR:*Streptomyces coelicolor*] [DE:*Streptomyces coelicolor* cosmid 6A5.] [NT:SC6A5.36 probable acyl-CoA dehydrogenase, len:] |
| Contig067G | 1439650_f1_30 | 235 | 4361 | 1440 | 479 | 1563 | 1.70E−160 | sp:[LN:YEGQ_ECOLI] [AC:P76403:008007:008010] [GN:YEGQ] [OR:*ESCHERICHIA COLI*] [EC:3.4.—.—] [DE:PUTATIVE PROTEASE IN BAER-OGRK INTERGENIC REGION,] [SP:P76403:008007:008010] |
| Contig067G | 14542165_c2_680 | 236 | 4362 | 234 | 77 | | | NO-HIT |
| Contig067G | 14585177_c3_849 | 237 | 4363 | 1470 | 489 | 1765 | 6.80E−182 | sp:[LN:GLNA_AZOVI] [AC:P22248] [GN:GLNA] [OR:*AZOTOBACTER VINELANDII*] [EC:6.3.1.2] [DE:GLUTAMINE SYNTHETASE, (GLUTAMATE--AMMONIA LIGASE)] [SP:P22248] |
| Contig067G | 14656332_c2_758 | 238 | 4364 | 240 | 79 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig067G | 14729817_c3_763 | 239 | 4365 | 2034 | 677 | 2351 | 5.40E−244 | sp:[LN:UVRB_PSEAE] [AC:P72174:P72147] [GN:UVRB] [OR:*PSEUDOMONAS AERUGINOSA*] [DE:EXCINUCLEASE ABC SUBUNIT B] [SP:P72174:P7247] |
| Contig067G | 14730307_f2_210 | 240 | 4366 | 471 | 156 | 155 | 2.70E−11 | sp:[LN:YGBO_YEAST] [AC:P25338] [GN:YGL010W:YGL021] [OR:*SACCHAROMYCES CEREVISIAE*] [SR:,BAKER'S YEAST] [DE:HYPOTHETICAL 20.2 KD PROTEIN IN PRS2-LEU1 INTERGENIC REGION] [SP:P25338] |
| Contig067G | 14977187_c3_785 | 241 | 4367 | 1095 | 364 | 326 | 2.10E−29 | pir:[LN:J70590] [AC:H70590] [PN:hypothetical protein Rv3230c] [GN:Rv3230c] [OR:*Mycobacterium tuberculosis*] |
| Contig067G | 15031302_c1_522 | 242 | 4368 | 1320 | 439 | 1452 | 9.90E−149 | sp:[LN:GSA_PSEAE] [AC:P48247] [GN:HEML] [OR:*PSEUDOMONAS AERUGINOSA*] [EC:5.4.3.8] [DE:(GLUTAMATE-1-SEMIALDEHYDE AMINOTRANSFERASE) (GSA-AT)] [SP:P48247] |
| Contig067G | 15039077_f1_160 | 243 | 4369 | 1845 | 614 | | | NO-HIT |
| Contig067G | 15790912_f3_488 | 244 | 4370 | 660 | 219 | 169 | 9.00E−13 | gp:[GI:e1326345:g3688206] [LN:CAJ10321] [AC:AJ010321] [PN:cicA protein] [GN:cicA] [OR:*Caulobacter crescentus*] [DE:*Caulobacter crescentus* partial tig gene and clpP, cicA, clpX, longenes.] |
| Contig067G | 15837765_c1_585 | 245 | 4371 | 2772 | 923 | 781 | 1.30E−77 | gp:[GI:g1397291] [LN:CELF49E8] [AC:U61949] [GN:F49E8.3] [OR:*Caenorhabditis elegans*] [SR:*Caenorhabditis elegans* strain=Bristol N2] [DE:*Caenorhabditis elegans* cosmid F49E8.] [NT:coded for by *C. elegans* cDNA yk2g1.3; coded for by] |
| Contig067G | 158562_c3_904 | 246 | 4372 | 1158 | 385 | 150 | 9.80E−08 | sp:[LN:GSPL_KLEPN] [AC:P15751] [GN:PULL] [OR:*KLEBSIELLA PNEUMONIAE*] [DE:PULL)] [SP:P15751] |
| Contig067G | 16047936_f1_26 | 247 | 4373 | 2445 | 814 | 1217 | 7.90E−124 | pir:[LN:ZPECPB] [AC:E64738:A03417:545218:B22 950] [PN:penicillin-binding protein IB:peptidoglycan synthetase] [GN:mrcB:ponB] [CL:penicillin-binding protein IB] [OR:*Escherichia coli*] |
| Contig067G | 16422177_f2_294 | 248 | 4374 | 1068 | 355 | 187 | 3.20E−12 | pir:[LN:D69771] [AC:D69771] [PN:conserved hypothetical protein ybdl] [GN:ybdl] [OR:*Bacillus subtilis*] |
| Contig067G | 16448377_f1_28 | 249 | 4375 | 348 | 115 | | | NO-HIT |
| Contig067G | 16525251_c1_623 | 250 | 4376 | 216 | 71 | 225 | 1.00E−18 | sp:[LN:CAPB_PSEFR] [AC:P80415:P72189] [GN:CAPB] [OR:*PSEUDOMONAS FRAGI*] [DE:COLD SHOCK PROTEIN CAPB (COLD ACCLIMATION PROTEIN B) (C8.0) [SP:P80415:P72189] |
| Contig067G | 16594687_c2_734 | 251 | 4377 | 1275 | 424 | | | NO-HIT |
| Contig067G | 16832175_f1_1 | 252 | 4378 | 888 | 295 | 487 | 1.80E−46 | pir:[LN:S76006] [AC:S76006] [PN:hypothetical protein] [OR:Synechocystis sp.] [SR:PCC 6803,, PCC 6803] [SR:PCC 6803,] |
| Contig067G | 16834826_f3_439 | 253 | 4379 | 252 | 83 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig067G | 16986250_f1_53 | 254 | 4380 | 741 | 246 | 405 | 8.80E−38 | [AC:P44627] [GN:HI0303] [OR:*HAEMOPHILUS INFLUENZAE*] [DE:HYPOTHETICAL PROTEIN HI0303] [SP:P44627] |
| Contig067G | 17182_f1_47 | 255 | 4381 | 1401 | 466 | 793 | 6.80E−79 | sp:[GI:g3005576] [LN:AF047718] [AC:AF047718] [PN:putative high affinity nitrate transporter] [GN:NRT2] [OR:Glycine max] [DE:Glycine max putative high affinity nitrate transporter (NRT2) mRNA,complete cds.] [NT:BmNRTs] |
| Contig067G | 180443_f3_358 | 256 | 4382 | 1461 | 486 | 1182 | 4.10E−120 | gp:GI:g1061410] [LN:BCU38944] [AC:U38944] [PNLOpcM] [GN:opcM] [OR:*Burkholderia cepacia*] [SR:*Burkholderia cepacia* strain=PC138] [DE:*Burkholderia cepacia* outer membrane lipoprotein (opcM) gene,partial cds.] [NT:outer membrane lipoprotein] [RE: |
| Contig067G | 19531453_f3_456 | 257 | 4383 | 594 | 197 | 577 | 5.20E−56 | sp:[LN:YRDA_ECOLI] [AC:P45770] [GN:YRDA] [OR:*ESCHERICHIA COLI*] [DE:HYPOTHETICAL 28.4 KD PROTEIN IN RRND-AROE INTERGENIC REGION (O256)] [SP:P45770] |
| Contig067G | 19535212_f1_78 | 258 | 4384 | 195 | 64 | | | NO-HIT |
| Contig067G | 19562692_f2_278 | 259 | 4385 | 657 | 218 | 204 | 1.80E−16 | sp:[LN:YJDF_ECOLI] [AC:P39270] [GN:YJDF] [OR:*ESCHERICHIA COLI*] [DE:HYPOTHETICAL 23.4 KD PROTEIN IN MELB-FUMB INTERGENIC REGION (F209)] [SP:P39270] |
| Contig067G | 19645887_f1_17 | 260 | 4386 | 669 | 222 | 175 | 2.10E−13 | pir:[LN:D71706] [AC:D71706] [PN:hypothetical protein RP471] [GN:RP471] [OR:*Rickettsia prowazekii*] |
| Contig067G | 196886_c1_628 | 261 | 4387 | 432 | 143 | 356 | 1.40E−32 | sp:[LN:GCP_HAEIN] [AC:P43764] [GN:GCP:H10530] [OR:*HAEMOPHILUS INFLUENZAE*] [EC:3.4.24.57] [DE:(GLYCOPROTEASE)] [SP:P43764] |
| Contig067G | 198515_f2_207 | 262 | 4388 | 948 | 315 | 952 | 9.60E−96 | sp:[LN:YADG_ECOLI] [AC:P36879] [GN:YADG] [OR:*ESCHERICHIA COLI*] [DE:HYPOTHETICAL ABC TRANSPORTER ATP-BINDING PROTEIN YADG] [SP:P36879] |
| Contig067G | 20011716_f1_37 | 263 | 4389 | 219 | 72 | | | NO-HIT |
| Contig067G | 20509667_f1_109 | 264 | 4390 | 318 | 105 | | | NO-HIT |
| Contig067G | 20509677_f1_63 | 265 | 4391 | 1545 | 514 | 868 | 7.60E−87 | sp:[LN:YCLF_BACSU] [AC:P9440] [GN:YCLF] [OR:*BACILLUS SUBTILIS*] [DE:HYPOTHETICAL 53.3 KD PROTEIN IN SFP-GERKA INTERGENIC REGION] [SP:P94408] |
| Contig067G | 20579375_f1_48 | 266 | 4392 | 1290 | 429 | 442 | 1.10E−41 | pir:[LN:G69748] [AC:G69748] [PN:conserved hypothetical protein ybfB] [GN:ybfB] [OR:*Bacillus subtilis*] |
| Contig067G | 20589375_c3_838 | 267 | 4393 | 489 | 162 | | | NO-HIT |
| Contig067G | 2070963_c3_786 | 268 | 4394 | 1107 | 368 | 851 | 4.80E−85 | pir:[LN:G70590] [AC:G70590] [PN:probable desA3 protein] [GN:desA3] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig067G | 20735677_c3_769 | 269 | 4395 | 1032 | 343 | 892 | 2.20E−89 | gp:[GI:g3885440] [LN:AF040378] [AC:AF040378] [PN:yhdG homolog] [OR:*Serratia marcescens*] [DE:*Serratia marcescens* ribosomal protein L11 methyltransferase (prmA)gene, partial cds; and yhdG homolog and small DNA binding proteinFis (fis) genes, complete cds.] [NT:Orf1] |
| Contig067G | 20736002_f2_199 | 270 | 4396 | 1467 | 488 | 729 | 4.10E−72 | gp:[GI:e1331956:g4106587] [LN:YP102KB] [AC:AL031866] [OR:*Yersinia pestis*] [DE:*Yersinia pestis* 102 kbases unstable region: from 1 to 119443.] [NT:ORF19. len: 473, similar to tyrosine] |
| Contig067G | 21484427_f2_186 | 271 | 4397 | 183 | 60 | | | NO-HIT |
| Contig067G | 21494140_c1_574 | 272 | 4398 | 1260 | 419 | 636 | 2.90E−62 | gp:[GI:e1364859:g4150886] [LN:PFFBSCEAB] [AC:Y09356] [PN:isochorismate synthase] [GN:fbsC] [OR:*Pseudomonas fluorescens*] [DE:*Pseudomonas fluorescens* fbsC, fbsE, fbsA and fbsB genes.] |
| Contig067G | 21531532_c1_550 | 273 | 4399 | 537 | 178 | | | NO-HIT |
| Contig067G | 21572153_f1_146 | 274 | 4400 | 387 | 128 | | | NO-HIT |
| Contig067G | 21616337_c1_518 | 275 | 4401 | 2835 | 944 | 327 | 2.40E−28 | pir:[LN:D64646] [AC:D64646] [PN:proteinase,] [OR:*Helicobacter pylori*] [EC:3.4.—.—] |
| Contig067G | 21681562_c3_828 | 276 | 4402 | 2307 | 763 | 1653 | 5.00E−170 | sp:[LN:FATA_VIBAN] [AC:P11461:P19830] [GN:FATA] [OR:*VIBRIO ANGUILLARUM*] [DE:FERRIC ANGUIBACTIN RECEPTOR PRECURSOR (OM2)] [SP:P11461:P19830] |
| Contig067G | 21687515_c2_652 | 277 | 4403 | 411 | 136 | | | NO-HIT |
| Contig067G | 21719001_c3_790 | 278 | 4404 | 1134 | 377 | 407 | 5.40E−38 | pir:[LN:l40842] [AC:l40842] [PN:hypothetical protein] [OR:*Cowdria ruminantium*] [SR:. heartwater *rickettsia*] |
| Contig067G | 22033517_c2_673 | 279 | 4405 | 330 | 109 | 151 | 7.30E−11 | sp:[LN:YBDD_ECOLI] [AC:P23518] [GN:YBDD] [OR:*ESCHERICHIA COLI*] [DE:HYPOTHETICAL 7.5 KD PROTEIN IN CSTA-AHPC INTERGENIC REGION] [SP:P23518] |
| Contig067G | 22165108_c1_515 | 280 | 4406 | 2292 | 763 | 3038 | 0 | pir:[LN:C70848] [AC:C70848] [PN:probable icd2 protein] [GN:icd2] [OR:*Mycobacterium tuberculosis*] |
| Contig067G | 22365625_c1_551 | 281 | 4407 | 708 | 235 | 293 | 6.50E−26 | gp:[GI:d1037663:g4126656] [LN:AB016282] [AC:AB016282] [OR:bacteriophage phi-105] [SR:bacteriophage phi-105 DNA] [DE:Bacteriophage phi-105 DNA, complete sequence.] [NT:ORF19] |
| Contig067G | 22384712_c1_517 | 282 | 4408 | 1428 | 475 | 1875 | 1.50E−193 | pir:[LN:A64932] [AC:A64932] [PN:hypothetical protein b1729] [CL:*Bacillus subtilis* sodium-glutamate symporter homolog yhcL] [OR:*Escherichia coli*] |
| Contig067G | 22454703_c2_700 | 283 | 4409 | 735 | 244 | 249 | 3.00E−21 | gp:[GI:d1037670:g4126668] [LN:AB016427] [AC:AB016427] [PN:thioesterase II-like protein] [GN:bacT] [OR:*Bacillus licheniformis*] [SR:*Bacillus licheniformis* (strain:ATCC 10716) DNA] [DE:*Bacillus licheniformis* genes for transmembrane protein,thioesterase II-like protein and bacitracin synthetase I (BA1),complete and partial cds] |
| Contig067G | 22456540_f3_332 | 284 | 4410 | 222 | 73 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig067G | 22461086_c3_891 | 285 | 4411 | 675 | 224 | 452 | 9.20E−43 | sp:[LN:YGIX_ECOLI] [AC:P52076] [GN:YGIX] [OR:*ESCHERICHIA COLI*] [DE:PROBABLE TRANSCRIPTIONAL REGULATORY PROTEIN YGIX] [SP:P52076] |
| Contig067G | 22553137_c2_661 | 286 | 4412 | 2205 | 734 | 323 | 1.80E−25 | gp:[GI:g2286204] [LN:AF011339] [AC:AF011339] [PN:unknown] [OR:Acinetobacter sp ADPI] [DE:Acinetobacter sp. ADPI unknown protein gene. partial cds.] [RE: |
| Contig067G | 22687837_c1_580 | 287 | 4413 | 990 | 329 | 144 | 6.60E−11 | pir:[LN:C65071] [AC:C65071] [PN:hypothetical protein b2875] [OR:*Escherichia coli*] |
| Contig067G | 22703125_c3_837 | 288 | 4414 | 801 | 266 | 444 | 6.50E−42 | pir:[LN:E69897] [AC:E69897] [PN:hypothetical protein yoaT] [GN:yoaT] [OR:*Bacillus subtilis*] |
| Contig067G | 22938511_f3_481 | 289 | 4415 | 1371 | 456 | 420 | 6.70E−45 | sp:[LN:DACA_HAEIN] [AC:P44466] [GN:DACA:H10029] [OR:*HAEMOPHILUS INFLUENZAE*] [EC:3.4.16.4] [DE:(DD-CARBOXYPEPTIDASE) (PBP-5)] [SP:P44466] |
| Contig067G | 22947590_f1_159 | 290 | 4416 | 1311 | 436 | 682 | 3.90E−67 | pir:[LN:D69769] [AC:D69769] [PN:cellulose synthase homolog ydaM] [GN:ydaM] [OR:*Bacillus subtilis*] |
| Contig067G | 23438802_f2_227 | 291 | 4417 | 618 | 205 | 975 | 3.50E−98 | sp:[LN:TRPG_ACICA] [AC:P00902] [GN:TRPG] [OR:*ACINETOBACTER CALCOACETICUS*] [EC:4.1.3.27] [DE:TRANSFERASE)] [SP:P00902] |
| Contig067G | 23453127_c1_617 | 292 | 4418 | 441 | 146 | 169 | 9.00E−13 | sp:[LN:YGIW_ECOLI] [AC:P52083] [GN:YGIW] [OR:*ESCHERICHIA COLI*] [DE:11.9 KD PROTEIN IN PARC-MDAB INTERGENIC REGION PRECURSOR (F130)] [SP:P52083] |
| Contig067G | 23453136_f1_24 | 293 | 4419 | 963 | 320 | 326 | 2.10E−29 | pir:[LN:B70013] [AC:B70013] [PN:hypothetical protein yuil] [GN:yuil] [OR:*Bacillus subtilis*] |
| Contig067G | 23470135_f3_475 | 294 | 4420 | 1248 | 415 | 378 | 6.40E−35 | gp:[GI:g4154820] [LN:AE001466] [AC:AE001466:AE001439] [PN:putative] [GN:jhp0298] [OR:*Helicobacter pylori* J99] [DE:*Helicobacter pylori*, strain J99 section 27 of 132 of the completegenome] [NT:similar to *H. pylori* 26695 gene HP0313] |
| Contig067G | 23476637_c2_688 | 295 | 4421 | 2589 | 862 | | | NO-HIT |
| Contig067G | 2353452_c3_804 | 296 | 4422 | 390 | 129 | | | NO-HIT |
| Contig067G | 23563450_f2_177 | 297 | 4423 | 462 | 153 | 366 | 1.20E−33 | gp:[GI:g1575483] [LN:LPU63641] [AC:U63641] [LN:porfX] [GN:lporfX] [FN:unknown] [OR:*Legionella pneumophila*] [DE:*Legionella pneumophila* rpofD operon LporfX, LpdnaG, and LprpoDgenes, complete cds.] |
| Contig067G | 23625287_f2_321 | 298 | 4424 | 723 | 240 | 185 | 1.80E−22 | sp:[LN:NO21_SOYBN] [AC:P16313] [OR:GLYCINE MAX] [DE:NODULIN 21 (N-21)] [SP:P16313] |

TABLE 2-continued

| Query | Orf | NT ID | AA ID | NT Lgth | AA Lgth | Score | P-value | Subject |
|---|---|---|---|---|---|---|---|---|
| Contig067G | 23634427_c3_835 | 299 | 4425 | 777 | 258 | 138 | 1.40E−07 | gp:[GI:e1388120:g4455682] [LN:MLCBS96] [AC:AL035472] [PN:putative iron-chelating complex subunit.] [GN:MLCB596.23] [OR:*Mycobacterium leprae*] [DE:*Mycobacterium leprae* cosmid B596.] [NT:MLCB596.23, possible iron-chelating complex] |
| Contig067G | 23646087_f2_338 | 300 | 4426 | 459 | 152 | 207 | 8.50E−17 | sp:[LN:YGDD_HAEIN] [AC:P45019] [GN:HI1073] [OR:*HAEMOPHILUS INFLUENZAE*] [DE:HYPOTHETICAL PROTEIN HI1073] [SP:P45019] |
| Contig067G | 23712832_c2_681 | 301 | 4427 | 1275 | 424 | 472 | 7.00E−45 | sp:[LN:VP3_BPHK7] [AC:P49859] [GN:3] [OR:BACTERIOPHAGE HK97] [DE:PORTAL PROTEIN (GP3)] [SP:P49859] |
| Contig067G | 23992036_f1_42 | 302 | 4428 | 225 | 74 | | | NO-HIT |
| Contig067G | 24103412_f1_150 | 303 | 4429 | 414 | 137 | | | NO-HIT |
| Contig067G | 24114717_f1_39 | 304 | 4430 | 786 | 261 | 805 | 3.60E−80 | sp:[LN:YADH_ECOLI] [AC:P36880:P75657] [GN:YADH] [OR:*ESCHERICHIA COLI*] [DE:HYPOTHETICAL 28.5 KD PROTEIN IN HPT-PAND INTERGENIC REGION] [SP:P36880:P75657] |
| Contig067G | 24219180_c3_806 | 305 | 4431 | 549 | 182 | 139 | 1.40E−09 | pir:[LN:D70541] [AC:D70541] [PN:hypothetical protein Rv1578c] [GN:Rv1578c] [OR:*Mycobacterium tuberculosis*] |
| Contig067G | 24250260_c1_616 | 306 | 4432 | 1788 | 595 | 905 | 9.20E−91 | pir:[LN:B70469] [AC:B70469] [PN:type IV pilus assembly protein TapB] [GN:tapB] [CL:secretion protein xcpR] [OR:*Aquifex aeolicus*] |
| Contig067G | 24257830_c2_727 | 307 | 4433 | 345 | 114 | | | NO-HIT |
| Contig067G | 24265832_f3_368 | 308 | 4434 | 861 | 286 | 820 | 9.30E−82 | sp:[LN:AMPM_ECOLI] [AC:P07906] [GN:MAP] [OR:*ESCHERICHIA COLI*] [EC:3.4.11.18] [DE:METHIONINE AMINOPEPTIDASE, (MAP) (PEPTIDASE M)] [SP:P07906] |
| Contig067G | 24267130_f2_248 | 309 | 4435 | 2163 | 720 | 575 | 3.10E−54 | gp:[GI:e307537:g2052277] [LN:SVSNBDE] [AC:Y11547] [PN:*Virginiamycin S synthetase*] (GN:snbDE] [OR:*Streptomyces virginiae*] [DE:*S.virginiae* snbDE gene, partial.] [RE: |
| Contig067G | 24274177_c3_819 | 310 | 4436 | 294 | 97 | | | NO-HIT |
| Contig067G | 24391592_f1_172 | 311 | 4437 | 450 | 149 | 143 | 5.10E−10 | pir:[LN:F69365] [AC:F69365] [PN:conserved hypothetical protein AF0926] [OR:*Archaeoglobus fulgidus*] |
| Contig067G | 24395328_c2_677 | 312 | 4438 | 1779 | 592 | | | NO-HIT |
| Contig067G | 24399143_c3_831 | 313 | 4439 | 939 | 312 | 698 | 7.90E−69 | sp:[LN:ENTB_ECOLI] [AC:P15048] [GN:ENTB:ENTG] [OR:*ESCHERICHIA COLI*] [EC:3.3.2.1] [DE:SYNTHASE)] [SP:P15048] |
| Contig067G | 24410636_f1_156 | 314 | 4440 | 768 | 255 | | | NO-HIT |
| Contig067G | 24423762_f3_453 | 315 | 4441 | 384 | 127 | | | NO-HIT |
| Contig067G | 24431500_c2_667 | 316 | 4442 | 2193 | 730 | 516 | 8.80E−97 | gp:[GI:g4456996] [LN:AF082985] [AC:AF082985] [PN:permease for AmpC beta-lactamase expression] [GN:ampG] [FN:cell wall recycling] [OR:*Pseudomonas aeruginosa*] [DE:*Pseudomonas aeruginosa* permease for AmpC beta-lactamase expressionAmpG (ampG) gene. complete cds; and unknown gene.] |
| Contig067G | 24489752_f2_268 | 317 | 4443 | 309 | 102 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig067G | 24642052_c1_568 | 318 | 4444 | 975 | 324 | 1113 | 8.30E−113 | sp:[LN:FATB_VIBAN] [AC:P11460] [GN:FATB] [OR:*VIBRIO ANGUILLARUM*] [DE:FERRIC ANGUIBACTIN-BINDING PROTEIN PRECURSOR] [SP:P11460] |
| Contig067G | 24642055_f3_357 | 319 | 4445 | 3186 | 1061 | 4231 | 0 | gp:[GI:g2109271] [LN:BCU97042] [AC:U97042] [PN:CeoB] [GN:ceoB] [OR:*Burkholderia cepacia*] [DE:*Burkholderia cepacia* CeoA (ceoA) and CeoB (ceoB) genes, completecds.] [NT:similar to cyloplasmic membrane proteins of the RND] |
| Contig067G | 24644137_c1_571 | 320 | 4446 | 1635 | 544 | 1983 | 5.40E−205 | gp:[GI:c1371504:g4165301] [LN:PFFBSCFAB] [AC:Y09356] [PN:ATP-dependent activating enzyme] [GN:fbsE] [OR:*Pseudomonas fluorescens*] [DE:*Pseudomonas fluorescens* fbsC, fbsE, fbsA and fbsB genes.] |
| Contig067G | 24644752_f3_345 | 321 | 4447 | 1020 | 339 | 273 | 8.60E−24 | pir:[LN:E70319] [AC:E70319] [PN:phosphoribosylanthranilate transferase] [GN:trpD2] [OR:*Aquifex aeolicus*] |
| Contig067G | 24645325_c1_625 | 322 | 4448 | 594 | 197 | 134 | 4.60E−09 | sp:[LN:CVPA_HAEIN] [AC:P45108] [GN:CVPA:HI1206] [DR:*HAEMOPHILUS INFLUENZAE*] [DE:COLICIN V PRODUCTION PROTEIN HOMOLOG] [SP:P45108] |
| Contig067G | 24648437_f1_108 | 323 | 4449 | 465 | 154 | | | NO-HIT |
| Contig067G | 24650328_f1_115 | 324 | 4450 | 1749 | 582 | | | NO-HIT |
| Contig067G | 24689678_c1_611 | 325 | 4451 | 846 | 281 | 690 | 5.60E−68 | sp:[LN:ARGT_SALTY] [AC:P02911] [GN:ARGT] [OR:*SALMONELLA TYPHIMURIUM*] [DE:(LAO-BINDING PROTEIN)] [SP:P02911] |
| Contig067G | 24782911_c2_632 | 326 | 4452 | 201 | 66 | | | NO-HIT |
| Contig067G | 25391937_c3_832 | 327 | 4453 | 189 | 62 | | | NO-HIT |
| Contig067G | 25395433_f2_270 | 328 | 4454 | 183 | 60 | | | NO-HIT |
| Contig067G | 25411003_c2_674 | 329 | 4455 | 204 | 67 | | | NO-HIT |
| Contig067G | 25414165_c2_656 | 330 | 4456 | 2856 | 951 | 1042 | 1.90E−201 | sp:[LN:HEPA_ECOLI] [AC:P23852:P75633] [GN:HEPA:RAPA] [OR:*ESCHERICHIA COLI*] [DE:RNA POLYMERASE ASSOCIATED PROTEIN (ATP-DEPENDENT HELICASE HEPA)] [SP:P23852:P75633] |
| Contig067G | 25421925_c3_801 | 331 | 4457 | 2118 | 705 | 2228 | 5.80E−231 | sp:[LN:CSTA_ECOLI] [AC:P15078:P23517:P77740] [GN:CSTA] [OR:*ESCHERICHIA COLI*] [DE:CARBON STARVATION PROTEIN A] [SP:P15078:P23517:P77740] |
| Contig067G | 25509652_c3_761 | 332 | 4458 | 183 | 60 | | | NO-HIT |
| Contig067G | 25525292_c3_902 | 333 | 4459 | 1077 | 358 | 648 | 1.60E−63 | sp:[LN:GPDA_BACSU] [AC:P46919] [GN:GPSA:GLYC] [OR:*BACILLUS SUBTILIS*] [EC:1.1.1.94] [DE:DEPENDENT DIHYDROXYACETONE-PHOSPHATE REDUCTASE)] [SP:P46919] |
| Contig067G | 25547177_f2_237 | 334 | 4460 | 1170 | 389 | 846 | 1.60E−84 | sp:[LN:AMPC_PSEAE] [AC:P24735] [GN:AMPC] [OR:*PSEUDOMONAS AERUGINOSA*] [EC:3.5.2.6] [DE:BETA-LACTAMASE PRECURSOR, (CEPHALOSPORINASE)] [SP:P24735] |

TABLE 2-continued

| Query | Orf | NT ID | AA ID | NT Lgth | AA Lgth | Score | P-value | Subject |
|---|---|---|---|---|---|---|---|---|
| Contig067G | 25547180_f2_252 | 335 | 4461 | 1305 | 434 | 789 | 1.80E−78 | gp:[GI:g862633] [LN:XXU13633] [AC:U13633] [PN:RumB(R391)] [GN:rumB(R391)] [OR:incJ plasmid R391] [DE:incJ plasmid R391 rumA(R391) and rumB(R391) genes, complete cds.] [NT:similar to *Escherichia coli* UmuC, Swiss-Prot] |
| Contig067G | 25600337_c1_528 | 336 | 4462 | 1782 | 593 | 1052 | 2.40E−106 | sp:[LN:DCP3_YEAST] [AC:P26263] [GN:PDC6:YGR087C] [OR:*SACCHAROMYCES CEREVISIAE*] [SR:,BAKER'S YEAST] [EC:4.1.1.1] [DE:PYRUVATE DECARBOXYLASE ISOZYME 3,] [SP:P26263] |
| Contig067G | 25626568_c2_683 | 337 | 4463 | 546 | 181 | | | NO-HIT |
| Contig067G | 25781552_c2_650 | 338 | 4464 | 858 | 285 | 379 | 5.00E−35 | gp:[GI:g3850584] [LN:F15K9] [AC:AC005278] [GN:F15K9.19] [OR:*Arabidopsis thaliana*] [SR:thale cress] [DE:*Arabidopsis thaliana* chromosome 1 BAC F15K9 sequence, completesequence.] [NT:ESTs gb|H37641 and gb|AA651422 come from this] |
| Contig067G | 25830327_f3_364 | 339 | 4465 | 813 | 270 | 584 | 9.50E−57 | sp:[LN:YQCD_HAEIN] [AC:P44153] [GN:HI1291] [OR:*HAEMOPHILUS INFLUENZAE*] [DE:HYPOTHETICAL PROTEIN HI1291] [SP:P44153] |
| Contig067G | 25976425_c1_567 | 340 | 4466 | 855 | 284 | 660 | 8.40E−65 | pir:[LN:D69763] [AC:D69763] [PN:ferrichrome ABC transporter (ATP-binding p) homolog yclP] [GN:yclP] [CL:ATP-binding cassette homology] [OR:*Bacillus subtilis*] |
| Contig067G | 25977250_f3_380 | 341 | 4467 | 1815 | 604 | 1015 | 2.00E−102 | gp:[GI:g2760920] [LN:AF038591] [AC:AF038591] [PN:*cytoplasmic aminopeptidase* P] [GN:APP] [OR:*Rattus norvegicus*] [SR:Norway rat] [DE:*Rattus norvegicus* cytoplasmic aminopeptidase P (APP) mRNA, completecds.] |
| Contig067G | 26019126_c2_754 | 342 | 4468 | 1560 | 519 | 1618 | 2.60E−166 | pir:[LN:XQEC] [AC:F65003:A92366:A92367:S01 389:151823:A00581] [PN:amidophosphoribosyltransferase,] [GN:purF] [CL:amidophosphoribosyltransferase] [OR:*Escherichia coli*] [EC:2.4.2.14] [MP:49 min] |
| Contig067G | 26027132_c2_713 | 343 | 4469 | 540 | 179 | 162 | 5.00E−12 | sp:[LN:UBIC_ECOLI] [AC:P26602:P76783] [GN:UBIC] [OR:*ESCHERICHIA COLI*] [EC:4.—.—.—] [DE:CHORISMATE--PYRUVATE LYASE,] [SP:P26602:P76783] |
| Contig067G | 26172333_c3_767 | 344 | 4470 | 1251 | 416 | 1089 | 2.90E−110 | sp:[LN:YHBZ_ECOLI] [AC:P42641] [GN:YHBZ] [OR:*ESCHERICHIA COLI*] [DE:REGION] [SP:P42641] |
| Contig067G | 26181537_c3_842 | 345 | 4471 | 1503 | 500 | 807 | 2.20E−80 | gp:[GI:e1254996:g2956674] [LN:RCXDHAB] [AC:AJ001013] [PN:xanthine dehydrogenase] [GN:xdhA] [OR:*Rhodobacter capsulatus*] [EC:1.1.1.204] [DE:*Rhodobacter capsulatus* dnaE and xdhA and B genes.] |
| Contig067G | 26219625_c3_771 | 346 | 4472 | 1239 | 412 | | | NO-HIT |
| Contig067G | 26365675_f1_79 | 347 | 4473 | 384 | 127 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig067G | 26365827_c2_694 | 348 | 4474 | 1848 | 615 | 622 | 1.60E−59 | gp:[GI:g2982194] [LN:AF007865] [AC:AF007865] [PN:*bacitracin synthetase* 1] [GN:bacA] [OR:*Bacillus licheniformis*] [DE:*Bacillus licheniformis bacitracin synthetase* operon, completesequence; BacS (bacS), BcrA (bcrA), BcrB (bcrB), and BcrC (bcrC)genes, complete cds] [NT:peptide synthetase: BA1; BacA] |
| Contig067G | 26385913_c3_788 | 349 | 4475 | 1446 | 481 | 876 | 1.10E−87 | gp:[GI:e1370586:g4158187] [LN:SC9B5] [AC:AL035206] [PN:putative aldehyde dehydrogenase] [GN:SC9B5.08] [OR:*Streptomyces coelicolor*] [DE:*Streptomyces coelicolor* cosmid 9B5.] [NT:SC9B5.08, probable aldehyde dehydrogenase, len:] |
| Contig067G | 26441076_c1_525 | 350 | 4476 | 651 | 216 | 138 | 5.80E−09 | pir:[LN:C70487] [AC:C70487] [PN:transcription regulator TetR/AcrR family] [GN:acrR2] [OR:*Aquifex aeolicus*] |
| Contig067G | 26453950_f2_266 | 351 | 4477 | 444 | 147 | | | NO-HIT |
| Contig067G | 26648452_c1_549 | 352 | 4478 | 522 | 173 | | | NO-HIT |
| Contig067G | 26751500_c3_815 | 353 | 4479 | 2664 | 887 | 156 | 1.60E−07 | sp:[LN:MYSP_BRUMA] [AC:Q01202:P90711] [OR:*BRUGIA MALAYI*] [DE:PARAMYOSIN] [SP:Q01202:P90711] |
| Contig067G | 26756250_f3_469 | 354 | 4480 | 720 | 239 | 138 | 1.60E−07 | pir:[LN:S74325] [AC:S74325] [PN:hypothetical protein slr0431] [OR:Synechocystis sp.] [SR:PCC 6803., PCC 6803] [SR:PCC 6803,] |
| Contig067G | 26769687_c3_768 | 355 | 4481 | 149 | 382 | 734 | 1.20E−72 | sp:[LN:PROB_HAEIN] [AC:P43763] [GN:PROB:H10900] [OR:*HAEMOPHILUS INFLUENZAE*] [EC:2.7.2.11] [DE:GLUTAMATE 5-KINASE (GAMMA-GLUTAMYL KINASE) (GK)] [SP:P43763] |
| Contig067G | 2734561_f3_376 | 356 | 4482 | 789 | 262 | 613 | 8.00E−60 | sp:[LN:YBGI_HAEIN] [AC:Q57354:O05008] [GN:HI0105] [OR:*HAEMOPHILUS INFLUENZAE*] [DE:HYPOTHETICAL PROTEIN HI0105] [SP:Q57354:005008] |
| Contig067G | 2819758_c3_805 | 357 | 4483 | 255 | 84 | | | NO-HIT |
| Contig067G | 2915936_f3_403 | 358 | 4484 | 2946 | 981 | 633 | 2.20E−57 | pir:[LN:B70674] [AC:B70674] [PN:probable mbtB protein] [GN:mbtB] [CL:oleoyl-[acyl-carrier-protein] hydrolase homology] [OR:*Mycobacterium tuberculosis*] |
| Contig067G | 2929628_c1_556 | 359 | 4485 | 330 | 109 | | | NO-HIT |
| Contig067G | 29304581_c1_598 | 360 | 4486 | 792 | 263 | 204 | 1.80E−16 | sp:[LN:YH55_ARCFU] [AC:O28519] [GN:AF1755] [OR:*ARCHAEOGLOBUS FULGIDUS*] [DE:HYPOTHETICAL PROTEIN AF1755] [SP:O28519] |
| Contig067G | 29312687_c3_853 | 361 | 4487 | 1203 | 400 | 801 | 9.60E−80 | gp:[GI:g1184675] [LN:PAU29172] [AC:U29172] [PN:AlgW] [OR:*Pseudomonas aeruginosa*] [DE:*Pseudomonas aeruginosa* HtrA-like serine protease AlgW gene,complete cds.] [NT:HtrA-like serine protease] |

TABLE 2-continued

| Query | Orf | NT ID | AA ID | NT Lgth | AA Lgth | Score | P-value | Subject |
|---|---|---|---|---|---|---|---|---|
| Contig067G | 29331376_f3_457 | 362 | 4488 | 1158 | 385 | 1240 | 2.90E−126 | sp:[LN:TRMU_ECOLI] [AC:P25745:P75964] [GN:TRMU:ASUE] [OR:*ESCHERICHIA COLI*] [EC:2.1.1.61] [DE:(EC2.1.1.61)] [SP:P25745:P75964] |
| Contig067G | 29490641_f1_454 | 363 | 4489 | 477 | 158 | | | NO-HIT |
| Contig067G | 29495915_c2_752 | 364 | 4490 | 483 | 160 | 129 | 1.60E−08 | gp:[GI:d1016922:g1799731] [LN:D90864] [AC:D90864:AB001340] [OR:*Escherichia coli*] [SR:*Escherichia coli* (strain:K12) DNA, clone_lib:Kohara lambda minise] [DE:*E.coli* genomic DNA, Kohara clone #409(52.8–53.1 min.).] [NT:similar to [SwissProt Accession Number P44164]] |
| Contig067G | 29505090_c2_753 | 365 | 4491 | 510 | 169 | | | NO-HIT |
| Contig067G | 29567813_c3_787 | 366 | 4492 | 1578 | 525 | 2613 | 9.30E−272 | gp:[GI:d1010181:g893355] [LN:ACCL24DD] [AC:D55724] [PN:L-2,4-diaminobutyrate decarboxylase] [OR:*Acinetobacter baumannii*] [SR:*Acinetobacter baumannii* (strain:ATCC19606) DNA, clone:pBDD7] [DE:*Acinetobacter baumannii* gene for L-2,4-diaminobutyratedecarboxylase, complete cds.] [NT:Translated amino acid sequence homologous to] |
| Contig067G | 29854563_f3_361 | 367 | 4493 | 696 | 231 | | | NO-HIT |
| Contig067G | 30207250_f3_351 | 368 | 4494 | 324 | 107 | 296 | 3.10E−26 | sp:[LN:YFHL_HAEIN] [AC:P44746] [GN:HI0527] [OR:*HAEMOPHILUS INFLUENZAE*] [DE:PUTATIVE FERREDOXIN-LIKE PROTEIN HI0527] [SP:P44746] |
| Contig067G | 30281575_f3_483 | 369 | 4495 | 504 | 167 | 425 | 8.40E−43 | sp:[LN:SLYD_ECOLI] [AC:P30856] [GN:SLYD] [OR:*ESCHERICHIA COLI*] [EC:5.2.1.8] [DE:(PPIASE) (ROTAMASE) (HISTIDINE RICH PROTEIN) (WHP)] [SP:P30856] |
| Contig067G | 30353162_c3_822 | 370 | 4496 | 669 | 222 | 91 | 0.00049 | gp:[GI:g1079814] [LN:579230] [AC:579230] [PN:BMIPI] [PN:CYP106] [OR:*Bacillus megaterium*] [DE:CYP106=BMIP2 orf...CYP106=P450BM-1 orf {regulatory regions}[*Bacillus megaterium*, mRNA Partial, 3 genes, 1400 nt].] [NT:positive transcription factor involved in] |
| Contig067G | 30640933_c1_546 | 371 | 4497 | 1143 | 380 | 364 | 2.00E−33 | sp:[LN:YF72_HAEIN] [AC:P46495] [GN:HI1572] [OR:*HAEMOPHILUS INFLUENZAE*] [DE:PUTATIVE INTEGRASE/RECOMBINASE HI1572] [SP:P46495] |
| Contig067G | 30709575_c1_579 | 372 | 4498 | 2397 | 798 | 1868 | 8.20E−193 | gp:[GI:e1254997:g2956675] [LN:RCXDHAB] [AC:AJ001013] [PN:*xanthine dehydrogenase*] [GN:xdhB] [OR:*Rhodobacter capsulatus*] [EC:1.1.1.204] [DE:*Rhodobacter capsulatus* dnaE and xdhA and B genes.] |
| Contig067G | 31369000_c2_675 | 373 | 4499 | 210 | 69 | | | NO-HIT |
| Contig067G | 31376557_f3_369 | 374 | 4500 | 1146 | 381 | 86 | 0.0002 | sp:[LN:OMPW_ECOLI] [AC:P21364:P97217:P97220] [GN:OMPW] [OR:*ESCHERICHIA COLI*] [DE:OUTER MEMBRANE PROTEIN W PRECURSOR] [SP:P21364:P97217:P97220] |

TABLE 2-continued

| Query | Orf | NT ID | AA ID | NT Lgth | AA Lgth | Score | P-value | Subject |
|---|---|---|---|---|---|---|---|---|
| Contig067G | 31457267_c2_695 | 375 | 4501 | 1023 | 340 | 913 | 1.30E−91 | sp:[LN:FATC_VIBAN] [AC:P37737] [GN:FATC] [OR:*VIBRIO ANGUILLARUM*] [DE:FERRIC ANGUIBACTIN TRANSPORT SYSTEM PERMEASE PROTEIN FATC] [SP:P37737] |
| Contig067G | 3182886_c2_736 | 376 | 4502 | 222 | 73 | | | NO-HIT |
| Contig067G | 32039042_f2_184 | 377 | 4503 | 861 | 286 | 728 | 5.20E−72 | pir:[LN:B70487] [AC:B70487] [PN:thiamine biosynthesis. thiazole moiety] [GN:thiG] [CL:thiamine biosynthesis protein thiG] [OR:*Aquifex aeolicus*] |
| Contig067G | 32453153_c3_807 | 378 | 4504 | 1845 | 614 | 568 | 1.10E−58 | gp:[GI:g3128374] [LN:AF010496] [AC:AF010496] [PN:hypothetical protein] [OR:*Rhodobacter capsulatus*] [DE:*Rhodobacter capsulatus* strain SB1003, partial genome.] |
| Contig067G | 32457802_c1_539 | 379 | 4505 | 408 | 135 | 536 | 1.20E−51 | sp:[LN:LGUL_NEIME] [AC:O33393] [GN:GLOA] [OR:*NEISSERIA MENINGITIDIS*] [EC:4.4.1.5] [DE:(S-D-LACTOYLGLUTATHIONE METHYLGLYOXAL LYASE)] [SP:O33393] |
| Contig067G | 32463455_c3_800 | 380 | 4506 | 231 | 76 | 246 | 6.20E−21 | sp:[LN:RL31_HAEIN] [AC:P44367] [GN:RPME:RPL31:HI0758] [OR:*HAEMOPHILUS INFLUENZAE*] [DE:50S RIBOSOMAL PROTEIN L31] [SP:P44367] |
| Contig067G | 3322066_c2_698 | 381 | 4507 | 1197 | 398 | 1488 | 1.50E−21 | sp:[LN:RL31_HAEIN] [AC:M62746] [PN:histidine decarboxylase] [GN:hdc] [OR:*Klebsiella planticola*] ]SR:*Klebsiella planticola*(library: ATCC 43176) DNA] [EC:4.1.1.22] [DE:*Klebsiella planticola* pyridoxal phosphate-dependent histidinedecarboxylase (hdc) gene, complete cds.] [NT:alpha-4 subunit] |
| Contig067G | 3329818_f3_485 | 382 | 4508 | 909 | 302 | | | NO-HIT |
| Contig067G | 33397255_c2_651 | 383 | 4509 | 666 | 221 | | | NO-HIT |
| Contig067G | 33414037_f2_175 | 384 | 4510 | 1134 | 377 | | | NO-HIT |
| Contig067G | 33641702_c2_686 | 385 | 4511 | 543 | 180 | | | NO-HIT |
| Contig067G | 33987562_f1_70 | 386 | 4512 | 1269 | 422 | 173 | 1.90E−12 | pir:[LN:S76259] [AC:S76259] [PN:hypothetical protein] [OR:Synechocystis sp.] [SR:PCC 6803,,PCC 6803] [SR:PCC 6803,] |
| Contig067G | 34021875_c1_626 | 387 | 4513 | 1458 | 485 | 457 | 2.70E−43 | pir:[LN:S76259] [AC:E650025] [PN:hypothetical protein b2494] [OR:*Escherichia coli*] |
| Contig067G | 34026692_c1_572 | 388 | 4514 | 1623 | 540 | 387 | 2.00E−34 | gp:[GO:g4097161] [LN:PMU46488] [AC:U46488] [PN:NrpA] [GN:nrpA] [OR:*Proteus mirabilis*] [DE:*Proteus mirabilis* NrpS (nrpS) gene, partial cds, NrpU (nrpU), NrpT(nrpT), NrpA (nrpA), NrpB (nrpB), NrpG (nrpG) and IrpP (irpP)genes, complete cds.] |
| Contig067G | 34065667_f2_318 | 389 | 4515 | 1608 | 535 | 949 | 2.00E−95 | sp:[LN:PHR_ECOLI] [ACP00914] [GN:PHRB:PHR] [OR:*ECHERICHIA COLI*] [EC:4.1.99.3] [DE:(PHOTOREACTIVATING ENZYME)] [SP:P00914] |
| Contig067G | 34117936_f3_371 | 390 | 4516 | 2478 | 825 | 1828 | 1.40E−188 | pir:[LN:F64746] [AC:F64746] [PN:probable membrane protein b0221:hypothetical protein b0221] [OR:*Echerichia coli*] |

TABLE 2-continued

| Query | Orf | NT ID | AA ID | NT Lgth | AA Lgth | Score | P-value | Subject |
|---|---|---|---|---|---|---|---|---|
| Contig067G | 34179068_c2_633 | 391 | 4517 | 765 | 254 | 139 | 1.00E−06 | gp:[GI:g767685] [LN:PEXARTP60A] [AC:L41557] [PN:articulin p60] [OR:*Pseudomicrothorax dubius*] [SR:*Pseudomicrothorax dubius* (strain N5b) (clone library:lambda ZAP o] [DE:*Pseudomicrothorax dubius* articulin p60 mRNA. complete cds.] [NT:the authors do not exclude the possibility that the] |
| Contig067G | 34182627_c2_630 | 392 | 4518 | 519 | 172 | | | NO-HIT |
| Contig067G | 34245652_c1_506 | 393 | 4519 | 732 | 243 | | | NO-HIT |
| Contig067G | 34250087_c1_557 | 394 | 4520 | 390 | 129 | | | NO-HIT |
| Contig067G | 34375902_c2_746 | 395 | 4521 | 2277 | 758 | 954 | 5.90E−96 | sp:[LN:AROA_BACSU] [AC:P20691] [GN:AROE] [OR:*BACILLUS SUBTILIS*] [EC:2.51.19] [DE:(5-ENOLPYRUVYLSHIKIMATE-3-PHOSPHATE SYNTHASE) (EPSP SYNTHASE)] [SP:P20691] |
| Contig067G | 34407567_f3_385 | 396 | 4522 | 702 | 233 | 185 | 1.80E−14 | pir:[LN:A65006] [AC:A65006] [PN:hypothetical protein b2331] [OR:*Escherichia coli*] |
| Contig067G | 34407905_c1_526 | 397 | 4523 | 1380 | 459 | 2261 | 1.90E−234 | gp:[GI:d1022701:g2340815] [LN:AB001599] [AC:AB001599] [PN:L-2,4-diaminobutyrate:2-ketoglutarate] [OR:*Acinetobacter baumannii*] [SR:*Acinetobacter baumannii* (strain:ATCC 19606) DNA, clone:pBDD71] [DE:*Acinetobacter baumannii* DNA forL-2,4-diaminobutyrate:2-ketoglutarate 4-aminotransferase. completecds.] [NT:amino acid sequence translated is homologous to] |
| Contig067G | 34556525_c1_555 | 398 | 4524 | 330 | 109 | | | NO-HIT |
| Contig067G | 34563905_f2_327 | 399 | 4525 | 1257 | 418 | 1074 | 1.10E−108 | pir:[LN:B71718] [AC:B71718] [PN:aspartate aminotransferase A tA) RP091] [GNtA:RP091] [OR:*Rickettsia prowazekii*] |
| Contig067G | 34569017_c3_765 | 400 | 4526 | 963 | 320 | 509 | 8.40E−49 | sp:[LN:Y680_HAEIN] [AC:Q57389:O05030] [GN:H10680] [OR:*HAEMOPHILUS INFLUENZAE*] [DE:HYPOTHETICAL PROTEIN H10680] [SP:Q57389:O05030] |
| Contig067G | 34640903_c1_564 | 401 | 4527 | 642 | 213 | 224 | 1.30E−18 | sp:[LN:YHEO_HAEIN] [AC:P44761] [GN:HI0575] [OR:*HAEMOPHILUS INFLUENZAE*] [DE:HYPOTHETICAL PROTEIN HI0575] [SP:P44761] |
| Contig067G | 35183130_f1_16 | 402 | 4528 | 246 | 81 | 95 | 6.30E−05 | sp:[LN:YC40_PORPU] [AC:P51344] [GN:YCF40] [OR:*PORPHYRA PURPUREA*] [DE:HYPOTHETICAL 8.1 KD PROTEIN YCF40 (ORF71)] [SP:P51344] |
| Contig067G | 35197257_c1_624 | 403 | 4529 | 1017 | 338 | 950 | 1.60E−95 | sp:[LN:PYRD_SALTY] [AC:P25468] [GN:PYRD] [OR:*SALMONELLA TYPHIMURIUM*] [EC:1.3.3.1] [DE:(DHODEHASE)] [SP:P25468] |
| Contig067G | 35290876_c2_684 | 404 | 4530 | 471 | 156 | | | NO-HIT |
| Contig067G | 35391255_f2_320 | 405 | 4531 | 936 | 311 | | | NO-HIT |
| Contig067G | 35426563_c1_530 | 406 | 4532 | 1398 | 465 | 583 | 1.20E−56 | pir:[LN:D69419] [AC:D69419] [PN:phosphate ABC transporter, permease protein (pstC) homolog] [OR:*Archaeoglobus fulgidus*] |

TABLE 2-continued

| Query | Orf | NT ID | AA ID | NT Lgth | AA Lgth | Score | P-value | Subject |
|---|---|---|---|---|---|---|---|---|
| Contig067G | 35806517_c1_521 | 407 | 4533 | 615 | 204 | 286 | 3.60E−25 | sp:[LN:THIE_SYNY3] [AC:P72965] [GN:THIE:SLL0635] [OR:SYNECHOCYSTIS SP] [SR:PCC 6803,] [EC:2.5.1.3] [DE:PYROPHOSPHORYLASE) (TMP-PPASE) (THIAMIN-PHOSPHATE SYNTHASE)) [SP:P72965] |
| Contig067G | 35817637_c3_895 | 408 | 4534 | 933 | 310 | 628 | 2.10E−61 | pir:[LN:B65040] [AC:B65040] [PN:yfjB protein] [GN:yfjB] [CL:conserved hypothetical protein HI0072] [OR:Escherichia coli] |
| Contig067G | 35948380_f1_106 | 409 | 4535 | 324 | 107 | | | NO-HIT |
| Contig067G | 36023552_f3_408 | 410 | 4536 | 987 | 328 | 1274 | 7.20E−130 | gp:[GI:e1284435:g2995376] [LN:SPCC320] [AC:AL022245] [PN:serine/threonine dehydratase] [GN:SPCC320.14] [OR:Schizosaccharomyces pombe] [SR:fission yeast] [DE:S.pombe chromosome III cosmid c320.), [NT:SPCC320.14, putative serine/threonine dehydratase,] |
| Contig067G | 36048842_c3_789 | 411 | 4537 | 1419 | 472 | 1484 | 4.00E−152 | pir:[LN:QRECAA] [AC:H64733:J50447:S10720:545191] [PN:aromatic amino acid transport protein aroP] [GN:aroP] [CL:arginine permease] [OR:Escherichia coli] [MP:2.6 min] |
| Contig067G | 36070256_f1_119 | 412 | 4538 | 441 | 146 | | | NO-HIT |
| Contig067G | 36125075_f3_360 | 413 | 4539 | 705 | 234 | 183 | 3.00E−14 | pir:[LN:D64946] [AC:D64946] [PN:probable DNA polymerase III epsilon chain] [OR:Escherichia coli] |
| Contig067G | 36220040_c2_664 | 414 | 4540 | 852 | 283 | 529 | 6.40E−51 | sp:[LN:SURE_HAEIN] [AC:P45681] [GN:SURE:HI0702] [OR:HAEMOPHILUS INFLUENZAE] [DE:SURVIVAL PROTEIN SURE HOMOLOG] [SP:P45681] |
| Contig067G | 36367202_c3_810 | 415 | 4541 | 735 | 244 | 182 | 3.80E−14 | sp:[LN:VP4_BPHK7] [AC:P49860] [GN:4] [OR:BACTERIOPHAGE HK97] [DE:PUTATIVE PROHEAD PROTEASE (GP4)] [SP:P49860] |
| Contig067G | 36437_f3_464 | 416 | 4542 | 540 | 179 | 233 | 1.50E−19 | gp:[GI:d1021388:g2217944] [LN:D89015] [AC:D89015] [PN:Lrp-family transcriptional regulators] [GN:mdeR] [OR:Pseudomonas putida] [SR:Pseudomonas putida (strain:ICR3460) DNA] [DE:Pseudomonas putida genes for MdeR,MdeA and MdeB,complete cds.] [NT:an essential positive regulator allowing the] |
| Contig067G | 36438912_c2_740 | 417 | 4543 | 1398 | 465 | 412 | 1.60E−38 | sp:[LN:YGIY_ECOLI] [AC:P40719] [GN:YGIY] [OR:ESCHERICHIA COLI] [EC:2.7.3.—] [DE:PROBABLE SENSOR PROTEIN YGIY,] [SP:P40719] |
| Contig067G | 36460953_c2_687 | 418 | 4544 | 2892 | 963 | | | NO-HIT |
| Contig067G | 36564012_c3_814 | 419 | 4545 | 342 | 113 | | | NO-HIT |
| Contig067G | 3906292_c1_588 | 420 | 4546 | 987 | 328 | 735 | 9.50E−73 | sp:[LN:UBIA_ECOLI] [AC:P26601] [GN:UBIA:CYR] [OR:ESCHERICHIA COLI] [EC:2.5.1.—] [DE:POLYPRENYLTRANSFERASE)] [SP:P26601] |

TABLE 2-continued

| Query | Orf | NT ID | AA ID | NT Lgth | AA Lgth | Score | P-value | Subject |
|---|---|---|---|---|---|---|---|---|
| Contig067G | 3906308_c1_537 | 421 | 4547 | 969 | 322 | 344 | 2.60E-31 | pir:[LN:S77670] [AC:S77670:S77669] [PN:probable transcription activator ptxR] [GN:ptxR] [OR:*Pseudomonas aeruginosa*] |
| Contig067G | 3906663_c2_682 | 422 | 4548 | 309 | 102 | | | NO-HIT |
| Contig067G | 3914017_f1_393 | 423 | 4549 | 573 | 190 | 519 | 7.30E-50 | gp:[GI:g2981082] [LN:AF052048] [AC:AF052048] [PN:GTP-cyclohydrolase] [GN:gch] [OR:*Ostertagia ostertagi*] [DE:*Ostertagia ostertagi* GTP-cyclohydrolase (gch) mRNA, complete cds.] |
| Contig067G | 3914681_f3_450 | 424 | 4550 | 2133 | 710 | 182 | 1.20E-09 | sp:[LN:YPHS_THIVI] [AC:P45365] [OR:*THIOCYSTIS VIOLACEA*] [DE:HYPOTHETICAL 76.5 KD PROTEIN IN PHBC 3'REGION (DRF5)] [SP:P45365] |
| Contig067G | 3923437_f1_54 | 425 | 4551 | 2859 | 952 | 788 | 1.50E-83 | pir:[LN:S74707] [AC:S74707] [PN:nitrogen fixation positive activator protein:protein slr1305:protein slr1305] [GN:nifL] [CL:response regulator homology] [OR:Synechocystis sp.] [SR:PCC 6803, PCC 6803] [SR:PCC 6803,] |
| Contig067G | 3939050_c3_775 | 426 | 4552 | 1287 | 428 | 1704 | 2.00E-175 | sp:[LN:IDH_ECOLI] [AC:P08200] [GN:ICD:ICDA:ICDE] [OR:*ESCHERICHIA COLI*] [EC:1.1.1.42] [DE:DECARBOXYLASE) (IDH) (NADP+-SPECIFIC ICDH) (IDP)] [SP:P08200] |
| Contig067G | 3945263_c3_811 | 427 | 4553 | 1278 | 425 | 428 | 3.20E-40 | sp:[LN:COAT_BPHK7] [AC:P49861] [GN:5] [OR:BACTERIOPHAGE HK97] [DE:MAJOR CAPSID PROTEIN PRECURSOR (GP5) (HEAD PROTEIN)] [SP:P49861] |
| Contig067G | 3947703_c2_691 | 428 | 4554 | 303 | 100 | | | NO-HIT |
| Contig067G | 3956568_f1_125 | 429 | 4555 | 1398 | 465 | 1549 | 5.20E-159 | sp:[LN:PUR8_HAEIN] [AC:P44797] [GN:PURB:H10639] [OR:*HAEMOPHILUS INFLUENZAE*] [EC:4.3.2.2] [DE:ADENYLOSUCCINATE LYASE, (ADENYLOSUCCINASE) (ASL)] [SP:P44797] |
| Contig067G | 3960892_c3_897 | 430 | 4556 | 1368 | 455 | 1575 | 9.20E-162 | sp:[LN:DCTA_SALTY] [AC:P50334] [GN:DCTA] [OR:*SALMONELLA TYPHIMURIUM*] [DE:C4-DICARBOXYLATE TRANSPORT PROTEIN] [SP:P50334] |
| Contig067G | 3964383_f2_249 | 431 | 4557 | 876 | 291 | 190 | 6.90E-14 | sp:[LN:VIUB_VIBVU] [AC:Q56743] [GN:VIUB] [OR:*VIBRIO VULNIFICUS*] [DE:VULNIBACTIN UTILIZATION PROTEIN VIUB] [SP:Q56743] |
| Contig067G | 3995713_c3_888 | 432 | 4558 | 879 | 292 | 471 | 9.00E-45 | sp:[LN:YHI9_YEAST] [AC:P38765] [GN:YHR029C] [OR:*SACCHAROMYCES CEREVISIAE*] [SR:,BAKER'S YEAST] [DE:HYPOTHETICAL 32.6 KD PROTEIN IN DAP2-SLT2 INTERGENIC REGION] [SP:P38765] |

TABLE 2-continued

| Query | Orf | NT ID | AA ID | NT Lgth | AA Lgth | Score | P-value | Subject |
|---|---|---|---|---|---|---|---|---|
| Contig067G | 4025277_f3_383 | 433 | 4559 | 1059 | 352 | 1553 | 2.00E-159 | sp:[LN:TRPD_ACICA] [AC:P00500] [GN:TRPD] [OR:*ACINETOBACTER CALCOACETICUS*] [EC:2.4.2.18] [DE:ANTHRANILATE PHOSPHORIBOSYLTRANSFER ASE.,] [SP:P00500] |
| Contig067G | 4035087_f2_213 | 434 | 4560 | 1068 | 355 | 964 | 5.10E-97 | gp:[GI:g146625] [LN:ECOLIPAB] [AC:L07636] [PN:LIPA protein] [GN:lipA] [OR:*Escherichia coli*] [SR:*Escherichia coli* (sub_strain W3110, strain K-12) (library: Kohar] [DE:*E.coli* tipoic acid biosynthesis lipA, lipB and ORFs 1, 2 and 3genes, complete cds; dacA gene, 3' end.] |
| Contig067G | 4068888_c3_821 | 435 | 4561 | 1413 | 470 | 164 | 9.00E-09 | sp:[LN:Y886_METJA] [AC:Q58296] [GN:MJ0886] [OR:*METHANOCOCCUS JANNASCHII*] [DE:PUTATIVE MOLYBDOPTERIN BIOSYNTHESIS PROTEIN MJ0886] [SP:Q58296] |
| Contig067G | 4069138_c3_870 | 436 | 4562 | 834 | 277 | 369 | 5.80E-34 | gp:[GI:c1310305:g3294250] [LN:SC7C7] [AC:AL031031] [PN:putative transcriptional regulator] [GN:5C7C7.17] [OR:*Streptomyces coelicolor*] [DE:*Streptomyces coelicolor* cosmid 7C7.] [NT:SC7C7.17, possible transcriptional regulatory] |
| Contig067G | 4084511_f3_349 | 437 | 4563 | 1305 | 434 | 226 | 3.10E-18 | pir:[LN:B69060] [AC:B69060] [PN:hypothetical protein MTH1450] [GN:MTH1450] [CL:hypothetical protein MTH1450] [OR:*Methanobacterium thermoautotrophicum*] |
| Contig067G | 4103402_c2_744 | 438 | 4564 | 276 | 91 | 174 | 2.70E-13 | pir:[LN:A64938] [AC:A64938] [PN:hypothetical protein b1777] [OR:*Escherichia coli*] |
| Contig067G | 4105187_c2_726 | 439 | 4565 | 501 | 166 | 404 | 1.10E-37 | pir:[LN:S37736] [AC:S37736] [PN:hypothetical protein] [OR:*Vibrio cholerae*] |
| Contig067G | 411561_c2_689 | 440 | 4566 | 291 | 96 | | | NO-HIT |
| Contig067G | 42827_f1_151 | 441 | 4567 | 492 | 163 | 101 | 0.00096 | pir:[LN:F64563] [AC:F64563] [PN:hypothetical protein HP0350] [OR:*Helicobacter pylori*] |
| Contig067G | 4296918_f2_264 | 442 | 4568 | 651 | 216 | 248 | 3.80E-21 | sp:[LN:RPC2_BPP22] [AC:P03035] [GN:C2] [OR:BACTERIOPHAGE P22:BACTERIOPHAGE P21] [SR:,BACTERIOPHAGE 21] [DE:REPRESSOR PROTEIN C2] [SP:P03035] |
| Contig067G | 4312693_f3_384 | 443 | 4569 | 816 | 271 | 1200 | 5.00E-122 | sp:[LN:TRPC_ACICA] [AC:P00911] [GN:TRPC] [OR:*ACINETOBACTER CALCOACETICUS*] [EC:4.1.1.48] [DE:INDOLE-3-GLYCEROL PHOSPHATE SYNTHASE, (IGPS)] [SP:P00911] |
| Contig067G | 4317088_f3_356 | 444 | 4570 | 1230 | 409 | 807 | 2.20E-80 | gp:[GI:e256814:g1707644] [LN:PAMEXEFOP] [AC:X99514] [GN:mexE] [FN:periplasmic link protein of multidrug efflux] [OR:*Pseudomonas aeruginosa*] [DE:*P.aeruginosa* mexE, mexF & oprN genes.) |

TABLE 2-continued

| Query | Orf | NT ID | AA ID | NT Lgth | AA Lgth | Score | P-value | Subject |
|---|---|---|---|---|---|---|---|---|
| Contig067G | 4320443_f1_14 | 445 | 4571 | 876 | 291 | 950 | 1.60E−95 | sp:[LN:RP32_PSEAE] [AC:P42378] [GN:RPOH] [OR:*PSEUDOMONAS AERUGINOSA*] [DE:RNA POLYMERASE SIGMA-32 FACTOR] [SP:P42378] |
| Contig067G | 4353387_c1_595 | 446 | 4572 | 1446 | 481 | 1496 | 2.20E−153 | gp:[GI:g1907384] [LN:PFU91523] [AC:U91523] [PN:soluble pyridine nucleotide transhydrogenase] [GN:sth] [FN:transfers reducing equivalents between NAD and] [OR:*Pseudomonas fluorescens*] [DE:*Pseudomonas fluorescens* soluble pyridine nucleotidetranshydrogenase (sth) gene, complete cds.] |
| Contig067G | 4410693_f2_208 | 447 | 4573 | 660 | 219 | | | NO-HIT |
| Contig067G | 4468890_f2_219 | 448 | 4574 | 453 | 150 | | | NO-HIT |
| Contig067G | 4487838_c3_869 | 449 | 4575 | 885 | 294 | 709 | 5.40E−70 | pir:[LN:EFECS] [AC:A03525:A45269:A32881:S45 235:B6474:S66207] [PN:translation elongation factor EF-Ts] [GN:tsf] [CL:translation elongation factor EF-Ts] [OR:*Escherichia coli*] [MP:4 min] |
| Contig067G | 4490892_f2_244 | 450 | 4576 | 1320 | 439 | 1417 | 5.10E−145 | gp:[GI:g4151935] [LN:AF110737] [AC:AF110737] [PN:RhsE] [GN:rhsE] [FN:*siderophore biosynthesis*] [OR:*Sinorhizobium meliloti*] [DE:*Rhizobium melitoti* strain 2011 rhizobactin regulon.; completesequence.] [NT:similar to AlcA] |
| Contig067G | 4494138_c2_668 | 451 | 4577 | 975 | 324 | 808 | 1.70E−80 | gp:[GI:d1017009:g1799824] [LN:D90870] [AC:D90870:AB001340] [GN:yfeH] [OR:*Escherichia coli*] [SR:*Escherichia coli* (strain:K12) DNA, clone_lib:Kohara lambda minise] [DE:*E.coli* genomic DNA, Kohara clone #417(54.4–54.6 min.).] [NT:similar to [SwissProt Accession Number P39836];] |
| Contig067G | 4542751_f2_182 | 452 | 4578 | 393 | 130 | | | NO-HIT |
| Contig067G | 4548830_f1_114 | 453 | 4579 | 1026 | 341 | 802 | 7.50E−80 | sp:[LN:YJEK_ECOLI] [AC:P39280] [GN:YJEK] [OR:*ESCHERICHIA COLI*] [DE:HYPOTHETICAL 38.7 KD PROTEIN IN MOPA-EFP INTERGENIC REGION] [SP:P39280] |
| Contig067G | 4554712_f1_171 | 454 | 4580 | 1446 | 481 | 201 | 1.80E−17 | pir:[LN:E70426] [AC:E70426] [PN:conserved hypothetical protein aq_1455] [GN:aq_1455] [OR:*Aquifex aeolicus*] |
| Contig067G | 4570302_f1_170 | 455 | 4581 | 807 | 268 | | | NO-HIT |
| Contig067G | 4579013_c2_649 | 456 | 4582 | 891 | 296 | 401 | 2.30E−37 | sp:[LN:YNEJ_ECOLI] [AC:P77309] [GN:YNEJ] [OR:*ESCHERICHIA COLI*] [DE:HYPOTHETICAL TRANSCRIPTIONAL REGULATOR IN UXAB-MARR INTERGENIC REGION] [SP:P77309] |
| Contig067G | 4688202_c2_685 | 457 | 4583 | 360 | 119 | | | NO-HIT |
| Contig067G | 4695338_f1_51 | 458 | 4584 | 393 | 130 | 265 | 6.00E−23 | sp:[LN:DC4C_ACICA] [AC:P20370] [GN:PCAC] [OR:*ACINETOBACTER CALCOACETICUS*] [EC:4.1.1.44] [DE:4-CARBOXYMUCONOLACTONE DECARBOXYLASE, (CMD)] [SP:P20370] |

TABLE 2-continued

| Query | Orf | NT ID | AA ID | NT Lgth | AA Lgth | Score | P-value | Subject |
|---|---|---|---|---|---|---|---|---|
| Contig067G | 4695878_c2_751 | 459 | 4585 | 591 | 196 | 305 | 3.50E−27 | sp:[LN:YDJA__ECOLI] [AC:P24250] [GN:YDJA] [OR:*ESCHERICHIA COLI*] [DE:HYPOTHETICAL 20.1 KD PROTEIN IN SELD-SPPA INTERGENIC REGION (ORF183)] [SP:P24250] |
| Contig067G | 4703193_c1_558 | 460 | 4586 | 372 | 123 | | | NO-HIT |
| Contig067G | 4703193_c2_638 | 461 | 4587 | 1149 | 382 | 858 | 8.80E−86 | gp:[GI:g2979673] [LN:AF019760] [AC:AF019760] [PN:putative UDP-N-acetyl-D-glucosamine 2-epimerase] [GN:sacA] [FN:*meningococcal* capsule biosynthesis] [OR:*Neisseria meningitidis* serogroup A] [DE:*Neisseria meningitidis* serogroup A putativeUDP-N-acetyl-D-glucosamine 2-epimerase (sacA), SacB (sacB), SacC(sacC), and SacD (sacD) genes, complete cds.] [NT:NfrC and RffE homolog; SacA] |
| Contig067G | 4729578_c3_899 | 462 | 4588 | 417 | 138 | | | NO-HIT |
| Contig067G | 4821015_f2_189 | 463 | 4589 | 249 | 82 | | | NO-HIT |
| Contig067G | 4822567_c3_836 | 464 | 4590 | 1083 | 360 | 1211 | 3.40E−123 | sp:[LN:DCUP__ECOLI] [AC:P29680:P78135] [GN:HEME] [OR:*ESCHERICHIA COLI*] [EC:4.1.1.37] [DE:UROPORPHYRINOGEN DECARBOXYLASE, (UPD)] [SP:P29680:P78135] |
| Contig067G | 4864027_c1_584 | 465 | 4591 | 2790 | 929 | 285 | 8.30E−39 | gp:[GI:g2529416] [LN:SSU73935] [AC:U73935] [PN:unknown] [OR:Shewanella sp. SCRC-2738] [DE:Shewanella sp. SCRC-2738 eicosapentaenoic acid (EPA) synthesis genecluster complete sequence.] [NT:ORF3] |
| Contig067G | 4876882_c3_759 | 466 | 4592 | 480 | 159 | 170 | 7.10E−13 | gp:[GI:e1132704:g2408054] [LN:SPAC29B12] [AC:Z99164] [PN:hypothetical protein] [GN:SPAC29B12.13] [OR:*Schizosaccharomyces pombe*] [SR:fission yeast] [DE:*S.pombe* chromosome 1 cosmid c29B1[0017]2.] [NT:SPAC29B12.13, unknown, len:13] |
| Contig067G | 4881578_f3_482 | 467 | 4593 | 1296 | 431 | 962 | 8.40E−97 | pir:[LN:DEECR] [AC:A00461:B64855] [PN:NADH dehydrogenase,] [GN:ndh] [CL:NADH dehydrogenase] [OR:*Escherichia coli*] [EC:1.6.99.3] [MP:22 min] |
| Contig067G | 4902151_c3_834 | 468 | 4594 | 1611 | 536 | 474 | 1.50E−46 | gp:[GI:g3128315] [LN:AF010496] [AC:AF010496] [PN:potential secretion ATP-binding protein] [OR:*Rhodobacter capsulatus*] [DE:*Rhodobacter capsulatus* strain SB1003, partial genome.] |
| Contig067G | 492175_f2_200 | 469 | 4595 | 357 | 118 | 324 | 3.40E−29 | gp:[GI:c1374320:g4210828] [LN:PAF223604] [AC:AJ223604] [GN:gacE2] [OR:*Pseudomonas aeruginosa*] [DE:*Pseudomonas aeruginosa* integron In 101 DNA] |
| Contig067G | 4944058_c3_791 | 470 | 4596 | 1407 | 468 | 533 | 2.40E−51 | pir:[LN:E69419] [AC:E69419] [PN:phosphate ABC transporter, permease protein (pstA) homolog] [OR:*Archaeoglobus fulgidus*] |
| Contig067G | 4961067_f1_163 | 471 | 4597 | 1071 | 356 | 461 | 1.00E−43 | pir:[LN:B69978] [AC:B69978] [PN :2-nitropropane dioxygenase homolog yrpB] [GN:yrpB] [OR:*Bacillus subtilis*] |

TABLE 2-continued

| Query | Orf | NT ID | AA ID | NT Lgth | AA Lgth | Score | P-value | Subject |
|---|---|---|---|---|---|---|---|---|
| Contig067G | 506880_f1_120 | 472 | 4598 | 2655 | 884 | 384 | 7.70E−77 | pir:[LN:E71377] [AC:E71377] [PN:probable ATP-dependent proteinase LA (lon-1)] [GN:TP0016] [OR:*Treponema pallidum* subsp. *pallidum*] [SR:, syphilis spirochete] |
| Contig067G | 5085925_c1_575 | 473 | 4599 | 1902 | 633 | | | NO-HIT |
| Contig067G | 5097213_f2_214 | 474 | 4600 | 1392 | 463 | 1224 | 1.40E−124 | sp:[LN:SAHH_YEAST] [AC:P39954] [GN:SAHI:YER043C] [OR:*SACCHAROMYCES CEREVISIAE*] [SR:.BAKER'S YEAST] [EC:3.3.1.1] [DE:HYDROLASE) (ADOHCYASE)] [SP:P39954] |
| Contig067G | 5132813_c2_739 | 475 | 4601 | 741 | 246 | 491 | 6.80E−47 | sp:[LN:YAEB_HAEIN] [AC:P44740] [GN:HI0510] [OR:*HAEMOPHILUS INFLUENZAE*] [DE:HYPOTHETICAL PROTEIN HI0510] [SP:P44740] |
| Contig067G | 5136713_c3_816 | 476 | 4602 | 492 | 163 | | | NO-HIT |
| Contig067G | 5164718_c2_665 | 477 | 4603 | 840 | 279 | 439 | 2.20E−41 | sp:[LN:NLPD_PSEAE] [AC:P45682] [OR:*PSEUDOMONAS AERUGINOSA*] [DE:LIPOPROTEIN NLPD/LPPB HOMOLOG PRECURSOR] [SP:P45682] |
| Contig067G | 525252_c2_717 | 478 | 4604 | 540 | 179 | | | NO-HIT |
| Contig067G | 5272275_c2_676 | 479 | 4605 | 1029 | 342 | 257 | 1.20E−20 | gp:[GI:d1033524:g351021] [LN:D84370] [AC:D84370] [PN:SogL protein] [GN:sogL] [OR:*Salmonella typhimurium*] [SR:*Salmonella typhimurium* (strain:drd-11) plasmid:IncII plasmid R6] [DE:*Salmonella typhimurium* IncII plasmid R64 sogL and sogS genes,complete cds.] |
| Contig067G | 5275465_c3_818 | 480 | 4606 | 564 | 187 | 142 | 6.50E−10 | gp:[GI:e51245:g11143594] [LN:STPES18G] [AC:X67137] [PN:gp19 protein] [GN:gene 19] [OR:*Salmonella typhimurium*] [DE:*S.typhimurium*-phage ES18 genes 13, 19and 15.] |
| Contig067G | 53517_c2_747 | 481 | 4607 | 1473 | 490 | 1024 | 2.20E−103 | sp:[LN:PEPD_ECOLI] [AC:P15288] [GN:PEPD:PEPH] [OR:*ESCHERICHIA COLI*] [EC:3.4.13.3] [DE:(PEPTIDASE D)] [SP:P15288] |
| Contig067G | 5366053_c2_756 | 482 | 4608 | 981 | 326 | 677 | 1.30E−66 | sp:[LN:YIAE_ECOLI] [AC:P37666] [GN:YIAE] [OR:*ESCHERICHIA COLI*] [DE:PROBABLE 2-HYDROXYACID DEHYDROGENASE IN BISC-CSPA INTERGENIC REGION] [SP:P37666] |
| Contig067G | 54212_c3_908 | 483 | 4609 | 645 | 214 | 727 | 6.70E−72 | pir:[LN:QQECR6] [AC:F65094:D29049] [PN:O-sialoglycoprotein endopeptidase,] [GN:ygjD] [CL:O-sialoglycoprotein endopeptidase] [OR:*Escherichia coli*] [EC:3.4.24.57] [MP:67 min] |
| Contig067G | 580066_c2_637 | 484 | 4610 | 219 | 72 | | | NO-HIT |
| Contig067G | 5865916_f1_136 | 485 | 4611 | 540 | 179 | | | NO-HIT |
| Contig067G | 6136253_c2_670 | 486 | 4612 | 588 | 195 | 614 | 6.30E−60 | pir:[LN:S34443] [AC:S34443:S56375:A65225] [PN:translation elongation factor EF-P] [GN:efp] [CL:translation elongation factor EF-P] [OR:*Escherichia coli*] |

TABLE 2-continued

| Query | Orf | NT ID | AA ID | NT Lgth | AA Lgth | Score | P-value | Subject |
|---|---|---|---|---|---|---|---|---|
| Contig067G | 625426_f3_372 | 487 | 4613 | 2304 | 767 | 2428 | 3.70E−252 | pir:[LN:F65021] [AC:F65021] [PN:hypothetical protein b2463] [OR:*Escherichia coli*] |
| Contig067G | 626636_f1_55 | 488 | 4614 | 1269 | 422 | 1167 | 1.60E−118 | sp:[LN:CCA_ECOLI] [AC:P06961] [GN:CCA] [OR:*ESCHERICHIA COLI*] [EC:2.7.7.25) [DE:(TRNA CCA-PYROPHOSPHORYLASE) (CCA-ADDING ENZYME)] [SP:P0696] |
| Contig067G | 629181_c1_563 | 489 | 4615 | 195 | 64 | | | NO-HIT |
| Contig067G | 6464175_c3_766 | 490 | 4616 | 1473 | 490 | 1351 | 5.00E−138 | gp:[GI:g3170587] [LN:AF058302] [AC:AF058302] [PN:glyceraldehyde-3-phosphate dehydrogenase] [GN:gapx] [OR:*Streptomyces roseofulvus*] [DE:*Streptomyces roseofulvus frenolicin* biosynthetic gene cluster,complete sequence.] [NT:GapX; probably not the G3PDH isoform used in] |
| Contig067G | 6522061_f3_347 | 491 | 4617 | 579 | 192 | | | NO-HIT |
| Contig067G | 6640937_c2_742 | 492 | 4618 | 921 | 306 | 172 | 9.40E−13 | pir:[LN:164101] [AC:16410] [PN:mutator mutT (AT-GC transversion) homolog] [CL:mutT domain homology] [OR:*Haemophilus influenzae*] |
| Contig067G | 6650332_c3_812 | 493 | 4619 | 369 | 122 | | | NO-HIT |
| Contig067G | 666443_f2_317 | 494 | 4620 | 216 | 71 | | | NO-HIT |
| Contig067G | 673387_c2_733 | 495 | 4621 | 219 | 72 | | | NO-HIT |
| Contig067G | 6892318_f1_77 | 496 | 4622 | 699 | 232 | 503 | 3.60E−48 | sp:[LN:YHHW_ECOLI] [AC:P46852] [GN:YHHW] [OR:*ESCHERICHIA COLI*] [DE:HYPOTHETICAL 26.3 KD PROTEIN IN GNTR-GGT INTERGENIC REGION (F231)] [SP:P46852] |
| Contig067G | 7035752_f3_362 | 497 | 4623 | 264 | 87 | | | NO-HIT |
| Contig067G | 7151468_f1_52 | 498 | 4624 | 900 | 299 | 563 | 1.60E−54 | pir:[LN:D70424] [AC:D70424] [PN:5,10-methylenetetrahydrofolate reductase] [GN:metF] [CL:5.10-methylenetetrahydrofolate reductase (FADH2)] [OR:*Aquifex acolicus*] |
| Contig067G | 7211077_c1_613 | 499 | 4625 | 777 | 258 | 953 | 7.50E−96 | sp:[LN:HISP_ECOLI] [AC:P07109:P77299] [GN:HISP] [OR:*ESCHERICHIA COLI*] [DE:HISTIDINE TRANSPORT ATP-BINDING PROTEIN HISP] [SP:P07109:P77299] |
| Contig067G | 788207_c1_612 | 500 | 4626 | 750 | 258 | 832 | 5.00E−83 | sp:[LN:HISM_ECOLI] [AC:P20691:P76936] [GN:HISM] [OR:*ESCHERICHIA COLI*] [DE:HISTIDINE TRANSPORT SYSTEM PERMEASE PROTEIN HISM] [SP:P20091:P76936] |
| Contig067G | 789825_c2_755 | 501 | 4627 | 1905 | 634 | | | NO-HIT |
| Contig067G | 798805_f2_209 | 502 | 4628 | 1047 | 348 | 515 | 1.90E−49 | sp:[LN:MLTB_ECOLI] [AC:P41052] [GN:MLTB] [OR:*ESCHERICHIA COLI*] [EC:3.2.1.—] [DE:(MUREIN HYDROLASE B) (35 KD SOLUBLE LYTIC TRANSGLYCOSYLASE) (SLT35)] [SP:P41052] |
| Contig067G | 819025_c2_655 | 503 | 4629 | 750 | 249 | 460 | 1.30E−43 | sp:[LN:RLUA_ECOLI] [AC:P39219] [GN:RLUA] [OR:*ESCHERICHIA COLI*] [EC:4.2.1.70] [DE:(PSEUDOURIDYLATE SYNTHASE) (URACIL HYDROLYASE)] [SP:P39219] |

TABLE 2-continued

| Query | Orf | NT ID | AA ID | NT Lgth | AA Lgth | Score | P-value | Subject |
|---|---|---|---|---|---|---|---|---|
| Contig067G | 87778_c2_737 | 504 | 4630 | 693 | 230 | 717 | 7.70E−71 | sp:[LN:HISQ_ECOLI] [AC:P52094:P77635] [GN:HISQ] [OR:*ESCHERICHIA COLI*] [DE:HISTIDINE TRANSPORT SYSTEM PERMEASE PROTEIN HISQ] [SP:P52094:P77635] |
| Contig067G | 960843_f1_165 | 505 | 4631 | 1338 | 445 | 332 | 8.50E−47 | sp:[LN:YAIW_ECOLI] [AC:P77562] [GN:YAIW] [OR:*ESCHERICHIA COLI*] [DE:HYPOTHETICAL 40.4 KD PROTEIN IN SBMA-DDLA INTERGENIC REGION] [SP:P77562] |
| Contig067G | 976577_c1_559 | 506 | 4632 | 468 | 155 | | | NO-HIT |
| Contig067G | 992252_c3_774 | 507 | 4633 | 1716 | 571 | 781 | 1.30E−77 | gp:[GI:g790611] [LN:ASU21853] [AC:U21853] [PN:unknown] [OR:Anabaena sp.] [SR:Anabaena sp] [DE:Anabaena sp. *phycobilisome* core component (apcF) gene, completecds, and glutamine synthetase (glnA) gene, partial cds.] [NT:ORF2] |
| Contig067G | 9930437_c1_589 | 508 | 4634 | 1470 | 489 | | | NO-HIT |
| Contig067G | 9938130_c2_750 | 509 | 4635 | 1191 | 396 | 874 | 1.80E−87 | sp:[LN:RHLB_ECOLI] [AC:P24229] [GN:RHLB:MMRA] [OR:*ESCHERICHIA COLI*] [DE:PUTATIVE ATP-DEPENDENT RNA HELICASE RHLB] SPP24229] |
| Contig067G | 99606926_f3_339 | 510 | 4636 | 975 | 324 | 399 | 3.80E−37 | sp:[LN:Y0505_SYNY3] [AC:Q55132] [GN:SLR0050] [OR:SYNECHOCYSTIS SP] [SR:PCC 6803, [DE:HYPOTHETICAL 36.1 KD PROTEIN] [SP:Q55132] |
| Contig067G | 9969552_f1_145 | 511 | 4637 | 1488 | 495 | 236 | 4.20E−17 | sp:[LN:YGIF_ECOLI] [AC:P30871] [GN:YGIF] [OR:*ESCHERICHIA COLI*] [DE:HYPOTHETICAL 48.4 KD PROTEIN IN GLNE-CCA INTERGENIC REGION (ORFXE)] [SP:P30871] |
| Contig076G | 1048967_c1_234 | 512 | 4638 | 594 | 197 | 556 | 8.80E−54 | sp:[LN:PTH_SALTI] [AC:Q60001] [GN:PTH] [OR:*SALMONELLA TYPHI*] [EC:3.1.1.29] [DE:PEPTIDYL-TRNA HYDROLASE, (PTH)] [SP:Q60001] |
| Contig067G | 10568750_c3_494 | 513 | 4639 | 219 | 72 | | | NO-HIT |
| Contig067G | 1070136_f2_119 | 514 | 4640 | 2157 | 718 | 149 | 2.00E−06 | gp:[GI:g3319425] [LN:CELH02F09 [AC:AF077538] [pn:unknown [GN:H02F09.3] [OR:*Caenorhabditis elegans*] [DE:*Caenorhabditis elegans* cosmid H02F09.] |
| Contig067G | 10742127_f1_67 | 515 | 4641 | 1347 | 448 | | | NO-HIT |
| Contig067G | 10828561_c1_258 | 516 | 4642 | 183 | 60 | | | NO-HIT |
| Contig067G | 10970380_f1_56 | 517 | 4643 | 1290 | 429 | 864 | 2.00E−86 | sp:[LN:HEMI_SALTY] [AC:P13581] [GN:HEMA] [OR:*SALMONELLA* TYPHIMURIUM] [EC:1.2.1.—] [DE:GLUTAMYL-TRNA REDUCTASE, (GLUTR)] [SP:P13581] |

TABLE 2-continued

| Query | Orf | NT ID | AA ID | NT Lgth | AA Lgth | Score | P-value | Subject |
|---|---|---|---|---|---|---|---|---|
| Contig076G | 10976535_f3_200 | 518 | 4644 | 273 | 90 | 144 | 1.40E−09 | gp:[GI:g3282803] [LN:AF044668] [AC:AF044668] [PN:malonyl CoA acyl carrier protein transacylase] [GN:fabD] [OR:*Salmonella typhimurium*] [DE:*Salmonella typhimurium* (g30k) gene, partial cds; and 50S ribosomalprotein L32 (rpmF), PlsX (plsX), 3-oxoacyl-acyl carrier proteinsynthase III (fabH), malonyl CoA-acyl carrier protein transacylase(fabD), and 3-oxoaecyl-acyl carrier protein reductase (fabG) genes,complete cds.] [NT:similar to *Escherichia coli* fabD] |
| Contig076G | 11211067_f1_174 | 519 | 4645 | 579 | 192 | 441 | 1.40E−41 | sp:[LN:NUOJ_ECOLI] [AC:P33605:P78236] [GN:NUOJ] [OR:*ESCHERICHIA COLI*] [EC:1.6.5.3] [DE:OXIDOREDUCTASE CHAIN 10) (NUO10)] [SP:P33605:P78236] |
| Contig076G | 1174056_f3_210 | 520 | 4646 | 327 | 108 | 296 | 3.10E−26 | pir:[LN:FEKRV] [AC:S72167:S78121:A00210] [PN:ferredoxin 2[4Fe-4S]] [CL:ferredoxin 2[4Fe-4S]:ferredoxin 2[4Fe-4S] homology] [OR:*Chromatium vinosum*] |
| Contig076G | 11895780_c2_335 | 521 | 4647 | 1026 | 341 | 1159 | 1.10E−117 | gp:[GI:g147379] [LN:ECOPRS] [AC:M13174] [GN:prs] [OR:*Escherichia coli*] [SR:*E.coli* DNA, clone pHO5] [DE:*E.coli* prs gene encoding phosphoribosylpyrophosphate synthetase,complete cds.] [NT:phosphoribosylpyrophosphate synthetase (gtg start)] |
| Contig076G | 12212752_f2_118 | 522 | 4648 | 1380 | 414 | | | NO-HIT |
| Contig076G | 12369200_f1_69 | 523 | 4649 | 1248 | 415 | 1613 | 8.60E−166 | pir:[LN:F64078] [AC:F64078] [PN:translation elongation factor EF-G] [CL:translation elongation factor G:translation elongation factor Tu homology] [OR:*Haemophilus influenzae*] |
| Contig076G | 1285056_f1_36 | 524 | 4650 | 2460 | 819 | 106 | 9.60E−10 | pir:[LN:B70520] [AC:B70520:S60770] [PN:probable PPE protein:hypothetical protein 5'] [GN:PPE] [OR:*Mycobacterium tuberculosis*] |
| Contig076G | 13082313_f2_101 | 525 | 4651 | 1800 | 599 | 2191 | 4.90E−227 | pir:[LN:D65000] [AC:D65000:538313:S38312:S65634:565635:S37060:S37061] [PN:NADH dehydrogenase (ubiquinone), I, chain C-D] [GN:nuoC:nuoD] [OR:*Escherichia coli*] [EC:1.6.5.3] [MP:49.5 min] |
| Contig076G | 1364392_c2_334 | 526 | 4652 | 297 | 98 | | | NO-HIT |
| Contig076G | 13960062_f2_99 | 527 | 4653 | 654 | 217 | 357 | 1.10E−32 | gp:[GI:g3273735] [LN:AF057063] [AC:AF057063] [PN:NADH dehydrogenase chain A] [GN:nuoA] [OR:*Erwinia carotovora* subsp. *carotovora*] [DE:*Erwinia carotovora* subsp. *carotovora* aspartate aminotransferaset) gene, partial cds; HexA (hexA), NADH dehydrogenase chain A(nuoA), and NADH dehydrogenase chain B (nuoB) genes, complete cds;and NADH dehydrogenase chain C (nuoC) gene, partial cds.] [NT:NuoA] |

TABLE 2-continued

| Query | Orf | NT ID | AA ID | NT Lgth | AA Lgth | Score | P-value | Subject |
|---|---|---|---|---|---|---|---|---|
| Contig076G | 14323511_f1_27 | 528 | 4654 | 795 | 264 | 462 | 8.10E−44 | sp:[LN:FENR_ECOLI] [AC:P28861:P11007] [GN:FPR:MVRA] [OR:*ESCHERICHIA COLI*] [EC:1.18.1.2] [DE:(FLXR) (METHYL VIOLOGEN RESISTANCE PROTEIN A) (DAI)] [SP:P28861:P11007] |
| Contig076G | 14572160_c2_391 | 529 | 4655 | 255 | 84 | | | NO-HIT |
| Contig076G | 14720811_f1_17 | 530 | 4656 | 2715 | 904 | 2777 | 3.90E−289 | pir:[LN:A65000] [AC:A65000:S65638:S38316:S37064] [PN:NADH dehydrogenase, I chain G] [GN:nuoG] [OR:*Escherichia coli*] [EC:1.6.99.3] |
| Contig076G | 14964087_c2_337 | 531 | 4657 | 762 | 253 | 660 | 8.40E−65 | sp:[LN:RIBB_ECOLI] [AC:P24199] [GN:RIBB:HTRP] [OR:*ESCHERICHIA COLI*] [DE:3,4-DIHYDROXY-2-BUTANONE 4-PHOSPHATE SYNTHASE (DHBP SYNTHASE)] [SP:P24199] |
| Contig076G | 15626708_f1_37 | 532 | 4658 | 1422 | 473 | 1537 | 9.80E−158 | sp:[LN:SR54_HAEIN] [AC:P44518] [GN:FFH:H10106] [OR:*HAEMOPHILUS INFLUENZAE*] [DE:SIGNAL RECOGNITION PARTICLE PROTEIN (FIFTY-FOUR HOMOLOG)] [SP:P44518] |
| Contig076G | 15663383_f2_138 | 533 | 4659 | 1095 | 364 | 847 | 1.30E−84 | sp:[LN:RLUD_ECOLI] [AC:P33643:P77003] [GN:RLUD:SFHB] [OR:*ESCHERICHIA COLI*] [EC:4.2.1.70] [DE:(PSEUDOURIDYLATE SYNTHASE) (URACIL HYDROLYASE)] [SP:P33643:P77003] |
| Contig076G | 15808137_f1_35 | 534 | 4660 | 927 | 308 | 162 | 2.20E−19 | sp:[LN:PFS_BACSU] [AC:O32028] [GN:PFS] [OR:*BACILLUS SUBTILIS*] [EC:3.2.2.16:3.2.2.9] [DE:NUCLEOSIDASE; (MTA/SAH NUCLEOSIDASE) (P46)] [SP:O32028] |
| Contig076G | 181386_c3_427 | 535 | 4661 | 1107 | 368 | 493 | 4.20E−47 | sp:[LN:YPIY_PSEAE] [AC:P33641] [OR:*PSEUDOMONAS AERUGINOSA*] [DE:HYPOTHETICAL 38.5 KD PROTEIN IN PILS 5'REGION (ORGY) [SP:P33641] |
| Contig076G | 19647000_c1_300 | 536 | 4662 | 192 | 63 | | | NO-HIT |
| Contig076G | 19718768_f3_158 | 537 | 4663 | 1380 | 459 | 557 | 6.90E−54 | pir:[LN:G71097] [AC:G71097] [PN:probable amidohydrolase] [GN:PH1043] [OR:*Pyrococcus horikoshii*] |
| Contig076G | 19727128_f2_83 | 538 | 4664 | 357 | 118 | 94 | 0.00089 | pir:[LN:C70420] [AC:C70420] [PN:NADH dehydrogenase I chain M] [GN:nuoM2] [CL:NADH dehydrogenase (ubiquinone) chain 4] [OR:*Aquifex aeolicus*] |
| Contig076G | 20012_f3_187 | 539 | 4665 | 594 | 197 | 717 | 7.70E−71 | pir:[LN:B71565] [AC:B71565] [PN:probable dctp deaminase] [GN:ded] [CL:dCTP deaminase] [OR:*Chlamydia trachomatis*] |
| Contig076G | 20040966_f2_80 | 540 | 4666 | 1059 | 352 | | | NO-HIT |
| Contig076G | 20115762_f2_117 | 541 | 4667 | 216 | 71 | | | NO-HIT |
| Contig076G | 20198811_c3_492 | 542 | 4668 | 2853 | 950 | 2442 | 1.20E−253 | pir:[LN:D71466] [AC:D71466] [PN:probable ribonucleoside reductase, large chain] [GN:nrdA] [OR:*Chlamydia trachomatis*] |

TABLE 2-continued

| Query | Orf | NT ID | AA ID | NT Lgth | AA Lgth | Score | P-value | Subject |
|---|---|---|---|---|---|---|---|---|
| Contig076G | 20312562_f2_128 | 543 | 4669 | 300 | 99 | 251 | 1.80E−21 | gp:[GI:g1173842] [LN:VHU39441] [AC:U39441] [PN:acyl carrier protein] [GN:acpP] [OR:*Vibrio harveyi*] [DE:*Vibrio harveyi* malonyl-CoA:ACP transacylase (fabD) gene, partialcds, and 3-ketoacyl-ACP reductase (fabG), acyl carrier protein(acpP), 3-ketoacyl-ACP synthase II (fabF) and aminodeoxychorismatelyase (pabC) genes, complete cds.] |
| Contig076G | 20318780_c3_430 | 544 | 4670 | 852 | 283 | 581 | 2.00E−56 | sp:[LN:YCHB_HAEIN] [AC:P45271) [GN:H11608] [OR:*HAEMOPHILUS INFLUENZAE*] [DE:HYPOTHETICAL PROTEIN HI1608] [SP:P45271] |
| Contig076G | 210932_c2_398 | 545 | 4671 | 1080 | 359 | 389 | 4.40E−36 | gp:[GI:d1037181:g4062962] [LN:AB014757] [AC:AB014757] [PN:PhbR] [GN:phbR] [OR:Pseudomonas sp. 61-3] [SR:Pseudomonas sp. 61-3 (strain:61-3) DNA] [DE:Pseudomonas sp. 61-3 genes for PhbR. acetoacetyl-CoA reductase,beta-ketothiolase and PHB synthase, complete cds.] |
| Contig076G | 2125138_c3_434 | 546 | 4672 | 417 | 138 | 364 | 2.00E−33 | sp:[LN:PAND_ECOLI] [AC:P31664] [GN:PAND) [OR:*ESCHERICHIA COLI*] [EC:4.1.1.11] [DE:DECARBOXYLASE)] [SP:P31664] |
| Contig076G | 2150250_f2_123 | 547 | 4673 | 699 | 232 | 146 | 1.10E−08 | sp:[LN:GNTR_BACLI] [AC:P46833] [GN:GNTR] [OR:*BACILLUS LICHENIFORMIS*] [DE:GLUCONATE OPERON TRANSCRIPTIONAL REPRESSOR (P28 PROTEIN)] [SP:P46833] |
| Contig076G | 21681525_f1_18 | 548 | 4674 | 1020 | 339 | 1140 | 1.10E−115 | sp:[LN:NUOH_ECOLI] [AC:P33603:P78307] [GN:NUOH] [OR:*ESCHERICHIA COLI*] [EC:1.6.5.3] [DE:OXIDOREDUCTASE CHAIN 8) (NUO8)) [SP:P33603:P78307] |
| Contig076G | 21743812_c2_333 | 549 | 4675 | 1722 | 573 | 380 | 4.00E−33 | sp:[LN:YHE3_PSEAE] [AC:P42810] [OR:*PSEUDOMONAS AERUGINOSA*] [DE:HYPOTHETICAL 64.8 KD PROTEIN IN HEMM-HEMA INTERGENIC REGION (ORF3)] [SP:P42810] |
| Contig076G | 21761375_f1_43 | 550 | 4676 | 1053 | 350 | 138 | 5.00E−09 | sp:[LN:ZIPA_ECOLI] [AC:P77173] [GN:ZIPA] [OR:*ESCHERICHIA COLI*] [DE:CELL DIVISION PROTEIN ZIPA] [SP:P77173] |
| Contig076G | 21907812_f3_157 | 551 | 4677 | 1407 | 468 | 342 | 4.60E−46 | gp:[GI:g598251] [LN:MBOOMPE] [AC:L31788] [PN:outer membrane protein E] [OR:*Moraxella catarrhalis*] [SR:*Moraxella catarrhalis* (strain 25240) DNA] [DE:*Moraxella catarrhalis* outer membrane protein E gene., complete cds.] |

TABLE 2-continued

| Query | Orf | NT ID | AA ID | NT Lgth | AA Lgth | Score | P-value | Subject |
|---|---|---|---|---|---|---|---|---|
| Contig076G | 21992203_f2_126 | 552 | 4678 | 876 | 291 | 670 | 7.30E−66 | gp:[GI:g2738154] [LN:PAU91631] [AC:U91631] [PN:malonyl-CoA:acyl carrier protein transacylase] [GN:fabD] [OR:*Pseudomonas aeruginosa*] [DE:*Pseudomonas aeruginosa* PlsX protein homolog (plsX) gene, partialcds; and malonyl-CoA:acyl carrier protein transacylase (fabD),3-oxoacyl-acyl carrier protein reductase (fabG), acyl carrierprotein (acpP), and 3-oxoacyl-acyl carrier protein synthase II(fabF) genes, complete cds.] |
| Contig076G | 2214075_c2_388 | 553 | 4679 | 240 | 79 | | | NO-HIT |
| Contig076G | 22158452_f1_47 | 554 | 4680 | 657 | 218 | 479 | 1.30E−45 | sp:[LN:BID2_HAEIN] [AC:P45248] [GN:BIOD-B:H11550] [OR:*HAEMOPHILUS INFLUENZAE*] [EC:6.3.3.3] [DE:2) (DTB SYNTHETASE 2) (DTBS 2)] [SP:P45248] |
| Contig076G | 22285625_c3_429 | 555 | 4681 | 612 | 203 | 259 | 2.60E−22 | sp:[LN:LOLB_PSEAE] [AC:P42812] [GN:LOLB:HEMM] [OR:*PSEUDOMONAS AERUGINOSA*] [DE:OUTER MEMBRANE LIPOPROTEIN LOLB PRECURSOR] [SP:P42812] |
| Contig076G | 2244062_f3_202 | 556 | 4682 | 477 | 158 | 323 | 4.30E−29 | pir:[LN:B65046] [AC:B65046] [PN:hypothetical protein b2665] [OR:Escherichia coli] |
| Contig076G | 22681512_c3_439 | 557 | 4683 | 621 | 206 | 597 | 4.00E−58 | sp:[LN:YCIO_ECOLI] [AC:P45847] [GN:YCIO] [OR:*ESCHERICHIA COLI*] [DE:HYPOTHETICAL 23.2 KD PROTEIN IN TRPL-BTUR INTERGENIC REGION] [SP:P45847] |
| Contig076G | 234627_f1_11 | 558 | 4684 | 855 | 284 | | | NO-HIT |
| Contig076G | 23525341_f2_140 | 559 | 4685 | 495 | 164 | 504 | 2.90E−48 | sp:[LN:KDTB_ECOLI] [AC:P23875] [GN:KDTB] [OR:*ESCHERICHIA COLI*] [DE:LIPOPOLYSACCHARIDE CORE BIOSYNTHESIS PROTEIN KDTB] [SP:P23875] |
| Contig076G | 23562717_f2_72 | 560 | 4686 | 1272 | 423 | 1169 | 9.70E−119 | pir:[LN:G70796] [AC:G70796] [PN:hypothetical protein Rv3726] [GN:Rv3726] [OR:*Mycobacterium tuberculosis*] |
| Contig076G | 23597507_f2_97 | 561 | 4687 | 1671 | 556 | 461 | 1.00E−43 | sp:[LN:RSTB_ECOLI] [AC:P18392] [GN:RSTB:USPT] [OR:*ESCHERICHIA COLI*] [EC:2.7.3.—] [DE:SENSOR PROTEIN RSTB,] [SP:P18392] |
| Contig076G | 23605200_f1_7 | 562 | 4688 | 1134 | 377 | | | NO-HIT |
| Contig076G | 23633590_f2_108 | 563 | 4689 | 1611 | 536 | 1624 | 5.90E−167 | sp:[LN:NUOM_ECOLI] [AC:P31978:P78248] [GN:NUOM] [OR:*ESCHERICHIA COLI*] [EC:1.6.5.3] [DE:OXIDOREDUCTASE CHAIN 13) (NUO13)] [SP:P31978:P78248] |
| Contig076G | 23679013_f3_168 | 564 | 4690 | 750 | 249 | 504 | 2.90E−48 | sp:[LN:RSTA_ECOLI] [AC:P52108] [GN:RSTA:URPT] [OR:*ESCHERICHIA COLI*] [DE:TRANSCRIPTIONAL REGULATORY PROTEIN RSTA] [SP:P52108] |
| Contig076G | 23729838_f2_120 | 565 | 4691 | 741 | 246 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig076G | 23868802_c2_344 | 566 | 4692 | 882 | 293 | 354 | 2.20E−32 | sp:[LN:OTSB_ECOLI] [AC:P31678] [GN:OTSB] [OR:*ESCHERICHIA COLI*] [EC:3.1.3.12] [DE:PHOSPHATASE) (TPP)] [SP:P31678] |
| Contig076G | 23989687_c3_472 | 567 | 4693 | 924 | 307 | 262 | 1.30E−22 | sp:[LN:IAID_PYRHO] [AC:O57809] [GN:PHBE027] [OR:*PYROCOCCUS HORIKOSHII*] [EC:4.1.99.4] [DE:(ACC DEAMINASE)] [SP:O57809] |
| Contig076G | 24017068_f1_30 | 568 | 4694 | 1689 | 562 | 617 | 3.00E−69 | sp:[LN:YGXB_BACSU] [AC:P37874] [GN:YGXB] [OR:BACILLUS SUBTILIS] [DE:HYPOTHETICAL 60.0 KD PROTEIN IN GLPD-SPOVR INTERGENIC REGION (ORF1)] [SP:P37874] |
| Contig076G | 24218793_c3_474 | 569 | 4695 | 900 | 299 | 565 | 9.80E−55 | sp:[LN:YEIE_ECOLI] [AC:P32484] [GN:YEIE] [OR:*ESCHERICHIA COLI*] [DE:HYPOTHETICAL TRANSCRIPTIONAL REGULATOR IN LYSP-NFO INTERGENIC REGION] [SP:P32484] |
| Contig076G | 24251077_f1_50 | 570 | 4696 | 675 | 224 | 193 | 8.40E−21 | sp:[LN:GPH_ECOLI] [AC:P32662] [GN:GPH] [OR:*ESCHERICHIA COLI*] [EC:3.1.3.18] [DE:PHOSPHOGLYCOLATE PHOSPHATASE, (PGP)] [SP:P32662] |
| Contig076G | 24252125_c1_269 | 571 | 4697 | 195 | 64 | | | NO-HIT |
| Contig076G | 24276952_c3_445 | 572 | 4698 | 246 | 81 | | | NO-HIT |
| Contig076G | 24305317_f1_2 | 573 | 4699 | 1248 | 415 | 1316 | 2.60E−134 | sp:[LN:GCDH_HUMAN] [AC:Q92947:O14719] [GN:GCDH] [OR:HOMO SAPIENS] [EC:1.3.99.7] [DE:GLUTARYL-COA DEHYDROGENASE PRECURSOR. (GCD)] [SP:Q92947:O14719] |
| Contig076G | 24408465_f1_64 | 574 | 4700 | 1128 | 375 | 1515 | 2.10E−155 | sp:[LN:YEAW_ECOLI] [AC:P76253] [GN:YEAW] [OR:*ESCHERICHIA COLI*] [EC:1.14.1.—] [DE:PUTATIVE DIOXYGENASE ALPHA SUBUNIT YEAW,] [SP:P76253] |
| Contig076G | 24414000_c1_243 | 575 | 4701 | 195 | 64 | | | NO-HIT |
| Contig076G | 24511587_f1_29 | 576 | 4702 | 243 | 80 | | | NO-HIT |
| Contig076G | 245912_f3_203 | 577 | 4703 | 1794 | 597 | 144 | 1.20E−06 | pir:[LN:B26696] [AC:B26696] [PN:hypothetical protein 1 (CYb-COII intergenic region)] [CL:hypothetical protein 1 (CYb-COII intergenic region)] [OR:*mitochondrion Leishmania tarentolae*] |
| Contig076G | 24644062_f1_23 | 578 | 4704 | 300 | 99 | 135 | 3.60E−09 | gp:[GI:e350466:g2440094] [LN:MLCB57] [AC:Z99494] [PN:small cold-shock protein] [GN:cspA] [OR:*Mycobacterium leprae*] [DE:*Mycobacterium leprae* cosmid B57.] [NT:MLCB57.11, cspA, small cold-shock protein, len:]. |
| Contig076G | 24644668_c1_306 | 579 | 4705 | 801 | 266 | 164 | 1.50E−10 | pir:[LN:A70040] [AC:A70040] [PN:molybdate-binding protein homolog yvgL] [GN:yvgL] [CL:molybdate-binding periplasmic protein] [OR:*Bacillus subtilis*] |
| Contig076G | 24645417_f1_188 | 580 | 4706 | 960 | 319 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig076G | 24652278_f2_100 | 581 | 4707 | 684 | 227 | 877 | 8.50E−88 | sp:[LN:NUOB_ECOLI] [AC:P33598:P78090] [GN:NUOB] [OR:*ESCHERICHIA COLI*] [EC:1.6.5.3] [DE:OXIDOREDUCTASE CHAIN 2) (NUO2)] [SP:P33598:P78090] |
| Contig076G | 24744002_c3_424 | 582 | 4708 | 480 | 159 | 478 | 1.60E−45 | sp:[LN:SMPB_ECOLI] [AC:P32052:P77011] [GN:SMPB] [OR:*ESCHERICHIA COLI*] [DE:SMALL PROTEIN B (18.3 KD PROTEIN)] [SP:P32052:P77011] |
| Contig076G | 24819067_c1_316 | 583 | 4709 | 435 | 144 | 290 | 2.70E−25 | pir:[LN:G64534] [AC:G64534] [PN:hypothetical protein HP0119] [OR:*Helicobacter pyloril* |
| Contig076G | 24819067_c2_407 | 584 | 4710 | 447 | 149 | 289 | 3.60E−25 | pir:[LN:G64534] [AC:G64534] [PN:hypothetical protein HP0119] [OR:*Helicobacter pylori*] |
| Contig076G | 24819692_c3_515 | 585 | 4711 | 432 | 143 | 281 | 2.90E−24 | pir:[LN:G64534] [AC:G64534] [PN:hypothetical protein HP0119] [OR:*Helicobacter pylori*] |
| Contig076G | 24824063_c1_307 | 586 | 4712 | 1422 | 473 | 442 | 3.10E−57 | gp:[GI:g3128345] [LN:AF010496] [AC:AF010496] [PN:hypothetical protein] [OR:*Rhodobacter capsulatus*] [DE:*Rhodobacter capsulatus* strain SB1003, partial genome.] |
| Contig076G | 24900375_f3_161 | 587 | 4713 | 3258 | 1085 | | | NO-HIT |
| Contig076G | 250136_c1_298 | 588 | 4714 | 1338 | 445 | 1071 | 2.40E−108 | gp:[GI:g4377313] [LN:AE001679] [AC:AE001679:AE001363] [PN:Ribonucleoside Reductase, Small Chain] [GN:nrdB] [OR:*Chlamydia pneumoniae*] [DE:*Chlamydia pneumoniae* section 95 of 103 of the complete genome.] |
| Contig0766 | 2525308_c1_241 | 589 | 4715 | 666 | 221 | 366 | 1.20E−33 | sp:[LN:YF63_HAEIN] [AC:P44255] [GN:H11563] [OR:*HAEMOPHILUS INFLUENZAE*] [DE:HYPOTHETICAL PROTEIN H11563] [SP:P44255] |
| Contig076G | 25402187_c3_459 | 590 | 4716 | 822 | 273 | 310 | 1.00E−27 | pir:[LN:F65039] [AC:F65039] [PN:hypothetical protein b2611] [OR:*Escherichia coli*] |
| Contig076G | 25438902_f2_122 | 591 | 4717 | 840 | 279 | 431 | 1.60E−40 | sp:[LN:Y902_HAEIN] [AC:P44070] [GN:H10902] [OR:*HAEMOPHILUS INFLUENZAE*] [DE:HYPOTHETICAL PROTEIN H10902] [SP:P44070] |
| Contig076G | 25484535_f3_159 | 592 | 4718 | 564 | 187 | 403 | 1.40E−37 | gp:[GI:d1036760:g4062561] [LN:D90737] [AC:D90737:AB001340] [PN:4-hydroxyphenylacetate 3-monooxygenase (EC] [GN:nmoB] [OR:*Escherichia coli*]. [SR:*Escherichia coli*(strain:K12) DNA, clone:Kohara clone #227] [DE:*Escherichia coli* genomic DNA. (22.8–23.1 min).] (NT:ORF_ID:o228#5; similar to PIR Accession Number] |
| Contig076G | 25672167_f1_46 | 593 | 4719 | 768 | 255 | 421 | 1.80E−39 | sp:[LN:BIOC_HAEIN] [AC:P45249] [GN:BIOC:HI1551] [OR:*HAEMOPHILUS INFLUENZAE*] [DE:PUTATIVE BIOTIN SYNTHESIS PROTEIN BIOC] [SP:P45249] |
| Contig076G | 25900342_f1_45 | 594 | 4720 | 1284 | 427 | 1412 | 1.70E−144 | sp:[LN:BIOA_HAEIN] [AC:P44426] [GN:BIOA:HI1554] [OR:*HAEMOPHILUS INFLUENZAE*] [EC:2.6.1.62] [DE:AMINOTRANSFERASE)] [SP:P44426] |

TABLE 2-continued

| Query | Orf | NT ID | AA ID | NT Lgth | AA Lgth | Score | P-value | Subject |
|---|---|---|---|---|---|---|---|---|
| Contig076G | 26258430_c1_246 | 595 | 4721 | 1455 | 484 | 889 | 4.50E−89 | pir:[LN:183402] [AC:183402:H64952:S33584] [PN:alpha,alpha-trehalose-phosphate synthase (UDP-forming).] [GN:otsA] [OR:*Escherichia coli*] [EC:2.4.1.15] |
| Contig076G | 26259635_c3_471 | 596 | 4722 | 1161 | 386 | 415 | 7.70E−39 | sp:[LN:EMRA_HAEIN] [AC:P44928] [GN:EMRA:HI0898] [OR:*HAEMOPHILUS INFLUENZAE*] [DE:MULTIDRUG RESISTANCE PROTEIN A HOMOLOG] [SP:P44928] |
| Contig076G | 26288430_c3_422 | 597 | 4723 | 1017 | 338 | 738 | 4.60E−73 | pir:[LN:G64940] [AC:G64940] [PN:hypothetical protein b1799] [CL:conserved hypothetical protein HI13641 [OR:*Escherichia coli*] |
| Contig076G | 26455056_f1_22 | 598 | 4724 | 1518 | 505 | 1084 | 9.90E−110 | sp:[LN:NUON_ECOLI] [AC:P33608:P78281] [GN:NUON] [OR:*ESCHERICHIA COLI*] [EC:1.6.5.3] [DE:OXIDOREDUCTASE CHAIN 14)(NUO14)] [SP:P33608:P7828 I] |
| Contig076G | 26757877_c2_338 | 599 | 4725 | 786 | 261 | 354 | 2.20E−32 | pir:[LN:E71057] [AC:E71057] [PN:probable thiamine biosynthesis protein] [GN:PH1155] [OR:*Pyrococcus horikoshii*] |
| Contig076G | 26797151_f3_151 | 600 | 4726 | 1350 | 449 | 1443 | 8.90E−148 | gp:[GI:1842056] [LN:ACU87258] [AC:U87258] [PN:cis,cis-muconate transport protein MucK] [GN:mucK] [OR:*Acinetobacter sp.* ADPI] [DE:*Acinetobacter sp.* ADPI cis,cis-muconate transport protein MucK(mucK) and electron transfer flavoprotein-ubiquinone oxidoreductasehomolog genes, complete cds.] |
| Contig076G | 26833413_f1_19 | 601 | 4727 | 561 | 186 | 773 | 8.90E−77 | sp:[LN:NUO1_ECOLI] [AC:P33604:P76488:P78183] [GN:NUO1] [OR:*ESCHERICHIA COLI*] [EC:1.6.5.3] [DE:OXIDOREDUCTASE CHAIN 9) (NUO9)] [SP:P33604:P76488:P78183] |
| Contig076G | 273452_c2_325 | 602 | 4728 | 1626 | 541 | 718 | 6.00E−116 | pir:[LN:H70382] [AC:H70382] [PN:NH(3)-dependent NAD+ synthetase] [GN:nadE] [OR:Aquifex aeolicus] |
| Contig076G | 292168_f3_195 | 603 | 4729 | 1263 | 420 | 437 | 3.60E−41 | sp:[LN:Y4WD_RHISN] [AC:P55682] [GN:Y4WD] [OR:RHIZOBIUM SP] [DE:HYPOTHETICAL TRANSPORT PROTEIN Y4WD] [SP:P55682] |
| Contig076G | 29298791_c3_460 | 604 | 4730 | 978 | 325 | 735 | 9.50E−73 | sp:[LN:YOHI_HAEIN] [AC:P44606] [GN:HI0270] [OR:*HAEMOPHILUS INFLUENZAE*] [DE:HYPOTHETICAL PROTEIN HI0270] [SP:P44606] |
| Contig076G | 29495466_f3_217 | 605 | 4731 | 390 | 129 | 563 | 1.60E−54 | pir:[LN:R3EC12] [AC:S13738:A02727:JH0808:A65128] [PN:ribosomal protein S12] [GN:rpsL:strA] [CL:*Escherichia coli* ribosomal protein S12] [OR:*Escherichia coli*] [MP:73 min] |
| Contig076G | 29582075_c3_504 | 606 | 4732 | 192 | 63 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig076G | 30267026_c3_456 | 607 | 4733 | 789 | 262 | 216 | 9.40E−18 | sp:[LN:BIRA__BACSU] [AC:P42975] [GN:BIRA] [OR:*BACILLUS SUBTILIS*] [EC:6.3.4.15] [DE:COA-CARBOXYLASE] SYNTHETASE), (BIOTIN--PROTEIN LIGASE)] [SP:P42975] |
| Contig076G | 30273568_c3_488 | 608 | 4734 | 366 | 121 | | | NO-HIT |
| Contig076G | 30289677_f1_53 | 609 | 4735 | 297 | 98 | 97 | 3.80E−05 | pir:[LN:F64801] [AC:F64801] [PN:hypothetical protein b0667] [OR:*Escherichia coli*] |
| Contig076G | 30335925_f2_125 | 610 | 4736 | 1185 | 394 | 1066 | 8.00E−108 | sp:[LN:BIOF__HAEIN] [AC:P44422] [GN:BIOF:H11553] [OR:*HAEMOPHILUS INFLUENZAE*] [EC:2.3.1.47] [DE:LIGASE)] [SP:P44422] |
| Contig076G | 30596937_c3_440 | 611 | 4737 | 816 | 271 | 252 | 1.40E−21 | sp:[LN:YPUG__BACSU] [AC:P35154] [GN:YPUG] [OR:*BACILLUS SUBTILIS*] [DE:HYPOTHETICAL 29.6 KD PROTEIN IN RIBT-DACB INTERGENIC REGION (ORFX7)] [SP:P35154] |
| Contig076G | 31366508_c3_493 | 612 | 4738 | 360 | 119 | | | NO-HIT |
| Contig076G | 31510793_f3_218 | 613 | 4739 | 546 | 181 | 570 | 2.90E−55 | pir:[LN:G64078] [AC:G64078] [PN:ribosomal protein S7] [CL:*Escherichia coli* ribosomal protein S7] [OR:*Haemophilus influenzae*] |
| Contig076G | 31656562_c2_346 | 614 | 4740 | 192 | 63 | | | NO-HIT |
| Contig076G | 32033402_c3_506 | 615 | 4741 | 1377 | 458 | 1424 | 9.20E−146 | pir:[LN:ZTEC3] [AC:A23103] [PN:citrate utilization determinant] [GN:cit] [CL:citrate utilization determinant] [OR:*Escherichia coli*] |
| Contig076G | 32113817_f2_102 | 616 | 4742 | 1389 | 462 | 1464 | 5.30E−150 | sp:[LN:NUOF__ECOLI] [AC:P31979:P78239] [GN:NUOF] [OR:*ESCHERICHIA COLI*] [EC:1.6.5.3] [DE:OXIDOREDUCTASE CHAIN 6) (NUO6)] [SP:P31979:P78239] |
| Contig076G | 3235158_c1_262 | 617 | 4743 | 588 | 195 | | | NO-HIT |
| Contig076G | 32453418_f3_193 | 618 | 4744 | 3456 | 1151 | 587 | 1.10E−93 | gp:[GI:e1359196:g4007736] [LN:SC7A1] [AC:AL034447] [PN:putative chromosome associated protein] [GN:SC7A1.21] [OR:*Streptomyces coelicolor*] [DE:*Streptomyces coelicolor* cosmid 7A1.] [NT:SC7A1.21, possible chromosome associated protein,] |
| Contig076G | 3301562_f1_63 | 619 | 4745 | 999 | 332 | 406 | 6.90E−38 | gp:[GI:g2853612] [LN:AF034088] [AC:AF034088] [PN:lipase] [GN:lipP] [OR:Pseudomonas sp. B11-1] [DE:Pseudomonas sp. B11-1 lipase (lipP) gene, complete cds.] |
| Contig076G | 33316292_c2_341 | 620 | 4746 | 627 | 208 | 224 | 1.30E−18 | sp:[LN:YPUH__BACSU] [AC:P35155] [GN:YPUH] [OR:*BACILLUS SUBTILIS*] [DE:HYPOTHETICAL 22.0 KD PROTEIN IN RIBT-DACB INTERGENIC REGION (ORFX8)] [SP:P35155] |
| Contig076G | 33366555_f1_8 | 621 | 4747 | 1065 | 354 | 263 | 1.90E−37 | pir:[LN:547051] [AC:S47051] [PN:hypothetical protein 1] [OR:Xanthobacter sp.] |
| Contig076G | 33555_c3_457 | 622 | 4748 | 750 | 249 | 186 | 2.70E−18 | gp:[GI:g4155360] [LN:AE001509] [AC:AE001509:AE001439] [PN:putative] [GN:jhp0796] [OR:*Helicobacter pylori* J99] [DE:*Helicobacter pylori*, strain J99 section 70 of 132 of the completegenome.] [NT:similar to *H. pylori* 26695 gene HP0862] |

TABLE 2-continued

| Query | Orf | NT ID | AA ID | NT Lgth | AA Lgth | Score | P-value | Subject |
|---|---|---|---|---|---|---|---|---|
| Contig076G | 3359783_f2_148 | 623 | 4749 | 834 | 277 | 855 | 1.80E−85 | sp:[LN:EFG_THICU] [AC:O50565] [GN:FUS] [OR:*THIOBACILLUS CUPRINUS*] [DE:ELONGATION FACTOR G (EF-G)] [SP:O50565] |
| Contig076G | 33620205_f2_124 | 624 | 4750 | 2088 | 695 | 1725 | 1.20E−177 | gp:[GI:g146615] [LN:ECOLIGA] [AC:M30255] [OR:*Escherichia coli*] [SR:*E.coli* (strain K12) DNA, clone pLG2520] [DE:*E.coli* lig gene encoding DNA ligase, complete cds.] [NT:lig peptide] |
| Contig076G | 33784817_c1_315 | 625 | 4751 | 1239 | 412 | 1285 | 4.90E−131 | 5p:[LN:ADD_ECOLI] [AC:P22333:P78240:P78163] [GN:ADD] [OR:*ESCHERICHIA COLI*] [EC:3.5.44] [DE:ADENOSINE DEAMINASE, (ADENOSINE AMINOHYDROLASE)] [SP:P22333:P78240:P78163] |
| Contig076G | 33839657_f2_105 | 626 | 4752 | 336 | 111 | 338 | 1.10E−30 | gp:[GI:d10.16835:g1799639] [LN:D90859] [AC:D90859:AB001340] [PN:NADH DEHYDROGENASE] CHAIN K (EC 1.6.5.3)] [GN:nuoK] [OR:*Escherichia coli*] [SR:*Escherichia coli* (strain:K12) DNA, clone_lib:Kohara lambda minise] [DE:*E.coli* genomic DNA, Kohara clone #403(51.5–51.9 min.).] [NT:similar to [SwissProt Accession Number P33606);] [RE: |
| Contig076G | 34022133_c2_374 | 627 | 4753 | 462 | 153 | | | NO-HIT |
| Contig076G | 34023312_f3_182 | 628 | 4754 | 195 | 64 | | | NO-HIT |
| Contig076G | 34087888_f1_10 | 629 | 4755 | 672 | 223 | 130 | 6.70E−07 | gp:[GI:g3123885] [LN:AF027206] [AC:AF027206] [PN:putative DNA-binding protein Bm1P1] [GN:bmtPt] [OR:*Bacillus megaterium*] [DE:*Bacillus megaterium* putative DNA-binding protein Bm1P1 gene, complete cds.] [NT:TetR/AcrR transcription regulator family] |
| Contig076G | 34116642_c2_376 | 630 | 4756 | 189 | 62 | | | NO-HIT |
| Contig076G | 34181542_c2_323 | 631 | 4757 | 864 | 287 | 393 | 1.70E−36 | gp:[GI:e274873:g1907076] [LN:HSPIRIN1] [AC:Y07867] [PN:pirin] [OR:Homo sapiens] [DE:*H. sapiens* mRNA for Pirin, isolate 1.] |
| Contig076G | 34412505_c2_336 | 632 | 4758 | 318 | 105 | 220 | 3.50E−18 | sp:[LN:RL25_HAEIN] [AC:P45281] [GN:RPLY:RPL25:H11630] [OR:*HAEMOPHILUS INFLUENZAE*] [DE:50S RIBOSOMAL PROTEIN L25] [SP:P45281] |
| Contig076G | 34416550_t2_115 | 633 | 4759 | 522 | 173 | 165 | 1.80E−11 | gp:[GI:c1354516:g3924824] [LN:CEK08H10] [AC:Z83113] [GN:K08H10.2a] [OR:*Caenorhabditis clegans*] [DE:*Caenorhabditis clegans* cosmid K08H10, complete sequence.] [NT:cDNA EST yk370a12.5 comes from this gene; cDNA EST] |
| Contig076G | 35156630_f3_185 | 634 | 4760 | 1251 | 416 | 773 | 8.90E−77 | sp:[LN:YCAB_PSEFR] [AC:P72190] [OR:*PSEUDOMONAS FRAGI*] [DE:HYPOTHETICAL 30.2 KD PROTEIN IN CAPB 3'REGION] [SP:P72190] |

TABLE 2-continued

| Query | Orf | NT ID | AA ID | NT Lgth | AA Lgth | Score | P-value | Subject |
|---|---|---|---|---|---|---|---|---|
| Contig076G | 35351463_f2_127 | 635 | 4761 | 789 | 262 | 705 | 1.40E-69 | sp:[LN:FABG_PSEAE] [AC:O54438] [GN:FABG] [OR:*PSEUDOMONAS AERUGINOSA*] [EC:1.1.1.100] [DE:ACYL CARRIER PROTEIN REDUCTASE)] [SP:O54438] |
| Contig076G | 35989530_c3_413 | 636 | 4762 | 471 | 156 | 299 | 1.50E-26 | gp:[GI:g4155986] [LN:AE001560] [AC:AE001560:AE001439] [PN:putative] [GN:jhp1377] [OR:*Helicobacter pylori* J99] [DE:*Helicobacter pylori*, strain J99 section 121 of 132 of the completegenome.] [NT:similar to *H. pylori* 26695 gene HP1484] |
| Contig076G | 36517312_f1_3 | 637 | 4763 | 1248 | 415 | 915 | 8.00E-92 | gp:[GI:g3378447] [LN:AF079317] [AC:AF079317] [PN:unknown] [GN:orf1338] [OR:*Sphingomonas aromaticivorans*] [DE:*Sphingomonas aromaticivorans* plasmid pNL1, complete plasmidsequence.] [NT:putative inner membrane protein similar to B.] |
| Contig076G | 3915877_c1_299 | 638 | 4764 | 2928 | 975 | 464 | 2.20E-41 | sp:[LN:PER_MOUSE] [AC:P08399] [GN:PHXR5:PER] [OR:MUS MUSCULUS] [DE:PERIOD CLOCK PROTEIN] [SP:P08399 |
| Contig076G | 3922677_c1_266 | 639 | 4765 | 2163 | 720 | 2086 | 6.50E-216 | sp:[LN:SYM_ECOLi] [AC:P00959] [GN:METG] [OR:*ESCHERICHIA COLI*] [EC:6.1.1.10] [DE:(METRS)] [SP:P00959] |
| Contig076G | 3932842_f3_213 | 640 | 4766 | 1122 | 373 | 1400 | 3.20E-143 | sp:[LN:TTUC_ECOLI] [AC:P76251:O08475:O08474] [GN:YEAU] [OR:*ESCHERICHIA COLI*] [EC:1.1.1.93] [DE:PROBABLE TARTRATE DEHYDROGENASE, (TDH)] [SP:P76251:O08475:O08474] |
| Contig076G | 4114188_f2_144 | 641 | 4767 | 1461 | 486 | 1623 | 7.50E-167 | sp:[LN:GABD_ECOLI] [AC:P25526] [GN:GABD] [OR:*ESCHERICHIA COLI*] [EC:1.2.1.16] [DE:SUCCINATE-SEMIALDEHYDE DEHYDROGENASE (NADP+), (SSDH)] [SP:P25526] |
| Contig076G | 413917_12_112 | 642 | 4768 | 318 | 105 | | | NO-HIT |
| Contig076G | 4164762_f2_143 | 643 | 4769 | 1698 | 565 | 1473 | 5.90E-151 | sp:[LN:YEAV_ECOLI] [AC:P76252:P97208] [GN:YEAV] [OR:*ESCHERICHIA COLI*] [DE:PROBABLE TRANSPORT PROTEIN YEAV] [SP:P76252:P97208] |
| Contig076G | 4332318_f3_199 | 644 | 4770 | 195 | 64 | 224 | 1.30E-18 | pir:[LN:G64051] [AC:G64051] [PN:ribosomal protein L32] [GN:rpmF:rpL32] [CL:*Escherichia coli* ribosomal protein L32] [OR:*Haemophilus influenzae*] |
| Contig076G | 4737825_c3_415 | 645 | 4771 | 1137 | 378 | | | NO-HIT |
| Contig076G | 4745225_c2_402 | 646 | 4772 | 1254 | 417 | 1235 | 9.80E-126 | gp:[GI:g1549751 [LN:TRNCITAB] [AC:M22041:M11992] [PN:citrate utilization protein B] [GN:citB] [OR:Transposon Tn3411] [SR:Transposon Tn3411 DNA] [DE:Transposon Tn4311 (from *E. coli* K-12) citrate utilization proteincitA and citB genes, complete cds.] |
| Contig076G | 4767018_f3_186 | 647 | 4773 | 603 | 200 | 229 | 3.90E-19 | ]gp:[GI:g3128260] [N:AF010496] [AC:AF010496] [PN:hypothetical protein] [OR:*Rhodobacter capsulatus*] [DE:*Rhodobacter capsulatus* strain SB1003, partial genome:] |

TABLE 2-continued

| Query | Orf | NT ID | AA ID | NT Lgth | AA Lgth | Score | P-value | Subject |
|---|---|---|---|---|---|---|---|---|
| Contig076G | 4784680_c1_237 | 648 | 4774 | 219 | 72 | | | NO-HIT |
| Contig076G | 4798403_f3_184 | 649 | 4775 | 633 | 210 | 255 | 6.90E−22 | sp:[LN:YIGJ_ECOLI] [AC:P27846] [GN:YIGJ] [OR:*ESCHERICHIA COLI*] [DE:HYPOTHETICAL 22.5 KD PROTEIN IN RECQ-PLDB INTERGENIC REGION] [SP:P27846] |
| Contig076G | 4822127_c2_332 | 650 | 4776 | 1869 | 622 | 682 | 8.90E−99 | sp:[LN:PRIM_ECOLI] [AC:P02923:P02922] [GN:DNAG:DNAP:PARB] [OR:*ESCHERICHIA COLI*] [EC:2.7.7.—] [DE:DNA PRIMASE,] [SP:P02923:P02922) |
| Contig076G | 4863157_c3_470 | 651 | 4777 | 588 | 195 | 110 | 8.50E−05 | gp:[GI:c1370362:g4154041] [LN:MLCB1450] [AC:AL035159] [PN:putative transcriptional regulator] [GN:MLCB1450.06c] [OR:*Mycobacterium leprae*] [DE:*Mycobacterium leprae* cosmid B1450.] [NT:MLCB1450.06c, probable transcriptional regulator,] |
| Contig076G | 4876637_f2_139 | 652 | 4778 | 591 | 196 | 139 | 1.20E−16 | pir:[LN:G69292] [AC:G69292] [PN:tryptophan repressor binding protein (wrbA) homolog] [CL:conserved hypothetical protein YCR004c] [OR:*Archaeoglobus fulgidus*] |
| Contig076G | 494010_c2_370 | 653 | 4779 | 1242 | 413 | 997 | 1.60E−100 | sp:[LN:YHIN_HAEIN] [AC:P44941] [GN:H10933] [OR:*HAEMOPHILUS INFLUENZAE*] [DE:HYPOTHETICAL PROTEIN H10933] [SP:P44941] |
| Contig076G | 4955002_f1_49 | 654 | 4780 | 585 | 194 | 175 | 2.10E−13 | sp:[LN:YCED_ECOLI] [AC:P14189] [GN:YCED:G30K] [OR:*ESCHERICHIA COLI*] [DE:*HYPOTHETICAL 19.3 KD* PROTEIN IN RNE-RPMF INTERGENIC REGION (G30K)] [SP:P14189] |
| Contig076G | 4968753_f1_6 | 655 | 4781 | 882 | 293 | 275 | 5.30E−24 | sp:[LN:GCVA_ECOLI] [AC:P32064] [GN:GCVA] [OR:*ESCHERICHIA COLI*] [DE:ACTIVATOR)] [SP:P32064] |
| Contig076G | 5104593_c1_291 | 656 | 4782 | 1431 | 476 | 387 | 7.10E−36 | pir:[LN:E64906] [AC:E64906] [PN:probable membrane protein b1522] [OR:*Escherichia coli*] |
| Contig076G | 5117166_f3_172 | 657 | 4783 | 516 | 171 | 470 | 1.10E−44 | sp:[LN:NUOE_ECOLI] [AC:P33601] [GN:NUOE] [OR:*ESCHERICHIA COLI*] [EC:1.6.5.3] [DE:OXIDOREDUCTASE CHAIN 5) (NUO5)] [SP:P33601] |
| Contig076G | 5270343_c1_302 | 658 | 4784 | 621 | 206 | 196 | 1.20E−15 | sp:[LN:YRHP_BACSU] [AC:O05406] [GN:YRHP] [OR:*BACILLUS SUBTILIS*] [DE:HYPOTHETICAL 23.4 KD PROTEIN IN AAPA-SIGV INTERGENIC REGION] [SP:O05406] |
| Contig076G | 5338513_f1_20 | 659 | 4785 | 1899 | 632 | 1709 | 5.80E−176 | sp:[LN:NUOL_ECOLI] [AC:P33607:P78254] [GN:NUOL] [OR:*ESCHERICHIA COLI*] [EC:1.6.5.3] [DE:OXIDOREDUCTASE CHAIN 12) (NUO12)] [SP:P33607:P78254] |
| Contig076G | 5859426_f3_194 | 660 | 4786 | 531 | 176 | 542 | 2.70E−52 | sp:[LN:BFRA_NEIGO] [AC:P72080] [GN:BFRA] OR:*NEISSERIA GONORRHOEAE*] [DE:BACTERIOFERRITIN A] [SP:P72080] |

TABLE 2-continued

| Query | Orf | NT ID | AA ID | NT Lgth | AA Lgth | Score | P-value | Subject |
|---|---|---|---|---|---|---|---|---|
| Contig076G | 5944678_f2_109 | 661 | 4787 | 645 | 214 | 718 | 6.00E−71 | pir:[LN:A65026] [AC:A65026:523412] [PN:uracil phosphoribosyltranslerase upp] [GN:upp] [CL:uracil phosphoribosyltransferase upp] [OR:*Escherichia coli*] [EC:2.4.2.9] |
| Contig076G | 5959677_f2_86 | 662 | 4788 | 300 | 99 | 162 | 4.50E−10 | gp:[GI:c258467:g1491621] [LN:BHTIUL] [AC:Z78205] [PN:UL36] [OR:*Bovine herpesvirus* 1] [DE:*Bovine herpesvirus* type 1 UL22-35 genes.] [NT:very large tegument protein] |
| Contig076G | 5986268_c1_244 | 663 | 4789 | 936 | 311 | 768 | 3.00E−76 | sp:[LN:YCIL_ECOLI] [AC:P37765] [GN:YCIL] [OR:*ESCHERICHIA COLI*] [DE:HYPOTHETICAL 32.7 KD PROTEIN IN TRPL-BTUR INTERGENIC REGION (ORF4)] [SP:P37765] |
| Contig076G | 6117202_c3_412 | 664 | 4790 | 1230 | 409 | 1120 | 1.50E−113 | gp:[GI:g2384564] [LN:PAU70470] [AC:U70470] [PN:beta-ketoacyl-ACP synthase I] [GN:fabB] [OR:*Pseudomonas aeruginosa*] [DE:*Pseudomonas aeruginosa* lemA-type sensor kinase/response regulatorhomolog gene, partial cds, beta-hydroxy-ACP dehydrase (fabA) andbeta-ketoacyl-ACP synthase I (fabB) genes, complete cds.] |
| Contig076G | 6269037_f3_209 | 665 | 4791 | 849 | 282 | 398 | 4.90E−37 | sp:[LN:YFIH_ECOLI] [AC:P33644:Q46989] [GN:YFIH] [OR:*ESCHERICHIA COLI*] [DE:HYPOTHETICAL 26.3 KD PROTEIN IN SFHB-CLPB INTERGENIC REGION] [SP:P33644:Q46989] |
| Contig076G | 6728176_f3_183 | 666 | 4792 | 210 | 69 | 91 | 0.00017 | pir:[LN:S01844] [AC:S01844] [PN:fibroin] [CL:silk fibroin] [OR:*Bombyx mori*] [SR:, silkworm] |
| Contig076G | 6754675_f2_141 | 667 | 4793 | 594 | 197 | | | NO-HIT |
| Contig076G | 6839843_f2_132 | 668 | 4794 | 573 | 190 | | | NO-HIT |
| Contig076G | 7225925_c3_507 | 669 | 4795 | 957 | 318 | 309 | 1.30E−27 | sp:[LN:NAC_ECOLI] [AC:Q47005] [GN:NAC] [OR:*ESCHERICHIA COLI*] [DE:CONTROL PROTEIN)] [SP:Q47005] |
| Contig076G | 782962_c3_513 | 670 | 4796 | 960 | 319 | 400 | 3.00E−37 | sp:[LN:GCVA_ECOLI] [AC:P32064] [GN:GCVA] [OR:*ESCHERICHIA COLI*] [DE:ACTIVATOR)] [SP:P32064] |
| Contig076G | 785952_c2_324 | 671 | 4797 | 561 | 186 | | | NO-HIT |
| Contig076G | 866252_c2_371 | 672 | 4798 | 183 | 60 | | | NO-HIT |
| Contig076G | 892208_c1_304 | 673 | 4799 | 945 | 314 | 294 | 5.10E−26 | gp:[GI:c1294004:g3152946] [LN:ACA6238] [AC:AJ006238] [GN:nac] [OR:*Azorhizobium caulinodans*] [DE:*Azorhizobium caulinodans* nac gene.] |
| Contig076G | 909552_f3_163 | 674 | 4800 | 618 | 205 | 122 | 1.30E−06 | pir:[LN:G70325] [AC:G70325] [PN:transcription regulator TetR/AcrR family] [GN:acrR3.] [OR:Aquifex aeolicus] |
| Contig076G | 959686_f1_61 | 675 | 4801 | 708 | 235 | | | NO-HIT |

| Query | Orf | NT ID | AA ID | NT Lgth | AA Lgth | Score | P-value | Subject |
|---|---|---|---|---|---|---|---|---|
| Contig076G | 9797752_c2_369 | 676 | 4802 | 1689 | 562 | 227 | 1.00E−15 | gp:[GI:g4139250] [LN:AF110185] [AC:AF110185] [PN: unknown] [OR:*Burkholderia pseudomallei*] [DE:*Burkholderia pseudomallei* strain 1026b DbhB (dbhB), generalsectetory pathway protein D (gspD), general secretory pathwayprotein E (gspE), general secretory pathway protein F (gspF), GspC(gspC), general secretory pathway protein G (gspG), generalsecretory pathway protein H (gspH), general secretory pathwayprotein I (gspI), general secretory pathway protein J (gspJ), general secretory pathway protein K (gspK), general secretorypathway protein L (gspL), general secretory pathway protein M(gspM), and general secretory pathway protein N (gspN) genes, complete cds; and unknown genes.] [NT:similar to *Escherichia coli* EmrB protein; orfF] |
| Contig076G | 9803385_f1_44 | 677 | 4803 | 771 | 256 | 202 | 2.90E−16 | sp:[LN:BIOH_ECOLI] [AC:P13001] [GN:BIOH:BIOB] [OR:*ESCHERICHIA COLI*] [DE:BIOH PROTEIN] [SP:P13001] |
| Contig076G | 9806577_c1_301 | 678 | 4804 | 192 | 63 | | | NO-HIT |
| Contig076G | 9979712_f1_65 | 679 | 4805 | 972 | 323 | 791 | 1.10E−78 | sp:[LN:YEAX_ECOLI] [AC:P76254:O07972:O07970] [GN:YEAX] [OR:*ESCHERICHIA COLI*] [EC:1,—,—,—] [DE:PUTATIVE DIOXYGENASE BETA SUBUNIT YEAX.] [SP:P76254:O07972:O07970] |
| Contig081G | 10055456_f3_142 | 680 | 4806 | 396 | 131 | | | NO-HIT |
| Contig081G | 10345150_f1_9 | 681 | 4807 | 780 | 259 | 557 | 6.90E−54 | sp:[LN:LLDR_ECOLI] [AC:P33233] [GN:LLDR:LCTR] [OR:*ESCHERICHIA COLI*] [DE:PUTATIVE L-LACTATE DEHYDROGENASE OPERON REGULATORY PROTEIN] [SP:P33233] |
| Contig081G | 1050637_f3_158 | 682 | 4808 | 474 | 157 | | | NO-HIT |
| Contig081G | 10587808_f3_163 | 683 | 4809 | 1701 | 566 | 2023 | 3.10E−209 | sp:[LN:SFCA_ECOLI] [AC:P26616:P78224] [GN:SFCA:MAEA] [OR:*ESCHERICHIA COLI*] [EC:1.1.1.38] [DE:PROBABLE MALATE OXIDOREDUCTASE (NAD), (MALIC ENZYME)] [SP:P26616:P78224] |
| Contig081G | 10633337_f1_56 | 684 | 4810 | 450 | 149 | 215 | 1.20E−17 | sp:[LN:ATPZ_PSEPU] [AC:P25760] [GN:ATPI:UNCI] [OR:PSEUDOMONAS PUTIDA] [DE:ATP SYNTHASE PROTEIN I] [SP:P25760] |
| Contig081G | 10658436_f2_98 | 685 | 4811 | 798 | 265 | 222 | 2.20E−18 | gp:[GI:g4097163] [LN:PMU46488] [AC:U46488] [PN:NrpG] [GN:nrpG] [OR:*Proteus mirabilis*] [DE:*Proteus mirabilis* NrpS (nrpS) gene, partial cds, NrpU (nrpU), NrpT(nrpT), NrpA (nrpA), NrpB (nrpB), NrpG (nrpG) and IrpP (irpP)genes, complete cds.] |

TABLE 2-continued

| Query | Orf | NT ID | AA ID | NT Lgth | AA Lgth | Score | P-value | Subject |
|---|---|---|---|---|---|---|---|---|
| Contig081G | 10818825_f1_17 | 686 | 4812 | 1269 | 422 | 1081 | 2.10E−109 | gp:[GI:g2384564] [LN:PAU70470] [AC:U70470] [PN:beta-ketoacyl-ACP synthase I] [GN:fabB] [OR:*Pseudomonas aeruginosa*] [DE:*Pseudomonas aeruginosa* lemA-type sensor kinase/response regulatorhomolog gene, partial cds, beta-hydroxy-ACP dehydrase (fabA) andbeta-ketoacyl-ACP synthase I (fabB) genes, complete cds.] |
| Contig081G | 10962890_f1_24 | 687 | 4813 | 414 | 137 | 264 | 7.70E−23 | gp:[GI:g2407234] [LN:AF017750] [AC:AF017750] [GN:hypo117] [OR:*Haemophilus ducreyi*] [DE:*Haemophilus ducreyi* cytochrome C-type biogenesis protein (ccmH),recombinational DNA repair protein (recR), manganese superoxidedismutase (sodA), and CitG protein homolog (citG) genes, completecds.] [NT:similar to *Haemophilus influenzae* product encoded] |
| Contig081G | 10972562_f3_151 | 688 | 4814 | 1800 | 599 | 229 | 2.70E−16 | pir:[LN:C70979] [AC:C70979] [PN:probable fadE25 protein] [GN:fadE25] [CL:acyl-COA dehydrogenase] [OR:*Mycobacterium tuberculosis*] |
| Contig081G | 1260915_c1_233 | 689 | 4815 | 342 | 113 | | | NO-HIT |
| Contig081G | 13790927_c1_242 | 690 | 4816 | 1374 | 457 | 1544 | 1.80E−158 | sp:[LN:RFBB_VIBCH] [AC:Q06951] [GN:RFBB] [OR:*VIBRIO CHOLERAE*] [EC:5.4.2.8] [DE:PHOSPHOMANNOMUTASE. (PMM)] [SP:Q06951] |
| Contig081G | 14333250_c2_256 | 691 | 4817 | 828 | 275 | 557 | 6.90E−54 | sp:[LN:ZNUC_HAEIN] [AC:P44692] [GN:ZNUC:H10408] [OR:*HAEMOPHILUS INFLUENZAE*] [DE:HIGH-AFFINITY ZINC UPTAKE SYSTEM ATP-BINDING PROTEIN ZNUC] [SP:P44692] |
| Contig081G | 14537687_f1_49 | 692 | 4818 | 336 | 111 | | | NO-HIT |
| Contig081G | 14645437_f1_29 | 693 | 4819 | 1389 | 462 | 892 | 2.20E−89 | gp:[GI:g903977] [LN:BCU29532] [AC:U29532] [PN:MopB] [GN:mopB] [FN:4-methyl-o-phthalatelphthalate permease] [OR:*Burkholderia cepacia*] [DE:*Burkholderia cepacia* plasmid pMOP PdxA homolog gene, partial cds,4-methyl-o-phthalate reductase (mopA) and 4-methyl-o-phthalatepermease (mopB) genes, complete cds.] |
| Contig081G | 14666275_c3_337 | 694 | 4820 | 1902 | 633 | 808 | 4.00E−121 | sp:[LN:SYR_BACSU] [AC:P46906] [GN:ARGS] [OR:*BACILLUS SUBTILIS*] [EC:6.1.1.19] [DE:ARGINYL-TRNA SYNTHETASE, (ARGININE--TRNA LIGASE) (ARGRS)] [SP:P46906] |
| Contig081G | 14721063_f1_36 | 695 | 4821 | 519 | 172 | | | NO-HIT |
| Contig081G | 15057877_f2_112 | 696 | 4822 | 1410 | 469 | 1934 | 8.30E−200 | pir:[LN:D64071] [AC:D64071] [PN:H+-transporting ATP synthase, beta chain] [CL:H+-transporting ATP synthase alpha chain:H+-transporting ATP synthase alpha chain homology] [OR:*Haemophilus influenzae*] [EC:36.1.34] |

TABLE 2-continued

| Query | Orf | NT ID | AA ID | NT Lgth | AA Lgth | Score | P-value | Subject |
|---|---|---|---|---|---|---|---|---|
| Contig081G | 15759625_f3_168 | 697 | 4823 | 879 | 292 | 796 | 3.30E−79 | sp:[LN:ATP6_ECOLI] [AC:P00855:Q47708] [GN:ATPB:UNCB:PAPD] [OR:*ESCHERICHIA COLI*] [EC:3.6.1.34] [DE:ATP SYNTHASE A CHAIN, (PROTEIN 6)] [SP:P00855:Q47708] |
| Contig081G | 15837750_f3_152 | 698 | 4824 | 396 | 131 | 89 | 0.00049 | sp:[LN:YCS3_HAEIN] [AC:P44139] [GN:H11253] [OR:*HAEMOPHILUS INFLUENZAE*] [DE:HYPOTHETICAL PROTEIN H11253] [SP:P44139] |
| Contig081G | 19548503_f2_107 | 699 | 4825 | 216 | 71 | | | NO-HIT |
| Contig081G | 19666715_f1_63 | 700 | 4826 | 612 | 203 | 506 | 1.80E−48 | pir:[LN:S23107] [AC:S23107:S41694:A49696:B65121] [PN:N-formylmethionylaminoacyl-tRNA deformylase,] [GN:def:fms] [CL:polypeptide deformylase] [OR:*Escherichia coli*] [EC:3.5.1.27] |
| Contig081G | 19727265_f1_46 | 701 | 4827 | 603 | 200 | 179 | 2.60E−16 | pir:[LN:C55543] [AC:C55543] [PN:cmaU protein] [GN:cmaU] [OR:*Pseudomonas syringae* pv. *syringae*] |
| Contig081G | 19742937_f2_93 | 702 | 4828 | 276 | 91 | 152 | 6.70E−09 | pir:[LN:G70944] [AC:G70944] [PN:probable polyketide synthase] [GN:pks12] [CL:[acyl-carrier-protein] S-malonyltransferase homology:3-oxoacyl-[acyl-carrier-protein] synthase 1 homology] [OR:*Mycobacterium tuberculosis*] |
| Contig081G | 2126693_f1_59 | 703 | 4829 | 432 | 143 | 334 | 2.90E−30 | sp:[LN:ATPE_ECOLI] [AC:P00832] [GN:ATPC:UNCC:PAPG] [OR:*ESCHERICHIA COLI*] [EC:3.6.1.34] [DE:ATP SYNTRASE EPSILON CHAIN,] [SP:P00832] |
| Contig081G | 21666540_c1_205 | 704 | 4830 | 696 | 231 | 1128 | 2.10E−114 | gp:[GI:g1119228] [LN:TRN15AAA] [AC:M12900] [GN:P12] [OR:Transposon Tn1525] [SR:Transposon Tn1525 DNA] [DE:Insertion sequence IS15-R, complete cds.] [NT:putative] [RE: |
| Contig081G | 21758260_c3_313 | 705 | 4831 | 339 | 112 | | | NO-HIT |
| Contig081G | 22079827_f3_128 | 706 | 4832 | 1731 | 576 | 1741 | 2.40E−179 | sp:[LN:LDHD_HAEIN] [AC:P45295] [GN:DLD:H11649] [OR:*HAEMOPHILUS INFLUENZAE*] [EC:1.1.1.28] [DE:D-LACTATE DEHYDROGENASE,] [SP:P45295] |
| Contig081G | 22187_c1_219 | 707 | 4833 | 1005 | 334 | 244 | 1.00E−20 | gp:[GI:d1013492:g1841365] [LN:D85415] [AC:D85415] [PN:LysR-type regulator] [GN:tdnR] [OR:*Pseudomonas putida*] [SR:*Pseudomonas putida* (strain:UCC22) DNA] [DE:*Pseudomonas putida* gene for conversion of aniline to catechol.] |
| Contig081G | 22369062_f1_65 | 708 | 4834 | 2124 | 707 | 1675 | 2.30E−172 | gp:[GI:d1006209:g1498191] [LN:PSEOPRC] [AC:D28119] [PN:outer membrane protein C] [OR:*Pseudomonas aeruginosa*] [SR:*Pseudomonas aeruginosa*, (strain PAOI). DNA, (clone pTN100)] [DE:*Pseudomonas aeruginosa* oprC gene for outer membrane protein C,complete cds.] |

TABLE 2-continued

| Query | Orf | NT ID | AA ID | NT Lgth | AA Lgth | Score | P-value | Subject |
|---|---|---|---|---|---|---|---|---|
| Contig081G | 22663952_f3_132 | 709 | 4835 | 999 | 332 | 1173 | 3.70E−119 | sp:[LN:CPPM_SALTY] [AC:Q56062] [GN:PRPB] [OR:*SALMONELLA TYPHIMURIUM*] [EC:2.7.8.—] [DE:(CPEP PHOSPHONOMUTASE)] [SP:Q56062] |
| Contig081G | 22679628_f1_44 | 710 | 4836 | 882 | 293 | 223 | 4.60E−29 | pir:[LN:B71346] [AC:B71346] [PN:probable SpoOJ regulator (soj)] [GN:TP0272] [CL:regulatory protein spoOJ] [OR:*Treponema pallidum* subsp. *pallidum*] [SR:, *syphilis spirochete*] |
| Contig081G | 22775313_f1_40 | 711 | 4837 | 1278 | 425 | | | NO-HIT |
| Contig081G | 23475707_f3_174 | 712 | 4838 | 690 | 229 | 329 | 1.00E−29 | pir:[LN:C55208] [AC:C55208] [PN:socA3 protein] [GN:socA3] [OR:*Myxococcus xanthus*] |
| Contig081G | 23555332_c3_338 | 713 | 4839 | 678 | 225 | 110 | 0.00061 | sp:[LN:FTSN_ECOLI] [AC:P29131] [GN:FTSN:MSGA] [OR:*ESCHERICHIA COLI*] [DE:CELL DIVISION PROTEIN FTSN] [SP:P29131] |
| Contig081G | 23627250_f2_169 | 714 | 4840 | 279 | 92 | 276 | 4.10E−24 | sp:[LN:ATPL_HAEIN] [AC:P43721] [GN:ATPE:H10484] [OR:HAEMOPHILUS INFLUENZAE] [EC:3.6.1.34] [DE:(DICYCLOHEXYLCARBOD IIMIDE-BINDING PROTEIN)] [SP:P43721] |
| Contig081G | 23628463_f2_92 | 715 | 4841 | 1038 | 345 | 651 | 7.60E−64 | gp:[GI:g2228238) [LN:PPU242#5] [AC:U24215] [PN:enoly-cocnzyme A hydratase] [OR:Pseudomonas putida] [DE:Pseudomonas putida p-cymene catabolism (cym) and p-cumatecatabolism (cmt) operons and enol-coenzyme A hydratase gene,complete cds.] |
| Contig081G | 23631308_f3_154 | 716 | 4842 | 459 | 152 | 336 | 1.80E−30 | sp:[LN:YQJF#ECOLI] [AC:P42619] [GN:YQJF] [OR:ESCHERICHIA COLI] [DE:HYPOTHETICAL 17.2 KD PROTEIN IN EXUR-TDCC INTERGENIC REGION] [SP:P42619] |
| Contig081G | 23632750_f3_135 | 717 | 4843 | 633 | 210 | | | NO-HIT |
| Contig081G | 23650250_f1_41 | 718 | 4844 | 1869 | 622 | 158 | 2.50E−08 | pir:[LN:507463] [AC:S07463] [PN:dihydroflavonol-4-reductase,] [OR:Petunia x hybrida] [SR:, garden petunia] [EC:1.-.-.-] |
| Contig081G | 23729800_f3_121 | 719 | 4845 | 891 | 296 | 820 | 9.30E−82 | sp:[LN:GALU_HAEIN] [AC:P44878] [GN:GALU:H10812] [OR:HAEMOPHILUS INFLUENZAE] [EC:2.7.7.9] [DE:URIDYLYLTRANSFERASE) (URIDINE DIPHOSPHOGLUCOSE PYROPHOSPHORYLASE)] [SP:P44878] |
| Contig081G | 2376012_f1_15 | 720 | 4846 | 909 | 302 | 243 | 1.30E−20 | pir:[LN:S76841] [AC:S76841] [PN:hypothetical protein] [OR:Synechocystis sp.] [SR:PCC 6803,, PCC 6803] [SR:PCC 6803,] |
| Contig081G | 24020292_f2_82 | 721 | 4847 | 396 | 131 | 118 | 2.30E−07 | sp:[LN:YIGD_ECOLI] [AC:P37163] [GN:YJGD] [OR:ESCHERICHIA COLI] [DE:HYPOTHETICAL 15.6 KD PROTEIN IN ARGI-VALS INTERGENIC REGION (0138)] [SP:P37163] |
| Contig081G | 24235302_f3_136 | 722 | 4848 | 336 | 111 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig081G | 24251558_f1_26 | 723 | 4849 | 1455 | 484 | 1422 | 1.50E−145 | sp:[LN:CYCA_ECOLI] [AC:P39312] [GN:CYCA:DAGA] [OR:*ESCHERICHIA COLI*] [DE:D-SERINEID-ALANINEIGLYCINE TRANSPORTER] [SP:P39312] |
| Contig081G | 24277167_f2_90 | 724 | 4850 | 1149 | 382 | 972 | 7.30E−98 | sp:[LN:ACDB_BACSU] [AC:P45857] [GN:MMGC] [OR:*BACILLUS SUBTILIS*] [EC:1.3.99.—] [DE:ACYL-COA DEHYDROGENASE,] [SP:P45857] |
| Contig081G | 2539043_c1_178 | 725 | 4851 | 204 | 67 | | | NO-HIT |
| Contig081G | 25391453_f1_42 | 726 | 4852 | 282 | 93 | | | NO-HIT |
| Contig081G | 25478463_f1_47 | 727 | 4853 | 792 | 263 | 389 | 4.40E−36 | sp:[LN:S3AD_KLEPN] [AC:P08881] [GN:AADA] [OR:*KLEBSIELLA PNEUMONIAE*] [EC:2.7.7.47] [DE:STREPTOMYCIN 3"-ADENYLYLTRANSFERASE,] SP:P08881] |
| Contig081G | 25552187_f2_77 | 728 | 4854 | 189 | 62 | | | NO-HIT |
| Contig081G | 25970928_c2_248 | 729 | 4855 | 1227 | 408 | | | NO-HIT |
| Contig081G | 26449075_c2_258 | 730 | 4856 | 939 | 312 | 490 | 8.70E−47 | pir:[LN:F65017] [AC:F65017] [PN:hypothetical protein b2431] [OR:*Escherichia coli*] |
| Contig081G | 26587800_c2_250 | 731 | 4857 | 1155 | 384 | 559 | 4.20E−54 | sp:[LN:SMF_HAEIN] [AC:P43862] [GN:SMF:DPRA:H10985] [OR:*HAEMOPHILUS INFLUENZAE*] [DE:SMF PROTEIN (DNA PROCESSING CHAIN A)] [SP:P43862] |
| Contig081G | 26601463_f1_32 | 732 | 4858 | 723 | 240 | 432 | 1.20E−40 | gp:[GI:g4103042] [LN:AF019654] [AC:AF019654] [PN:transcriptional activator] [GN:ccpR] [FN:transcriptional activator; involved in the] [OR:*Burkholderia cepacia*] [DE:*Burkholderia cepacia* putative acyl homoserine lactone synthase(cept) and transcriptional activator (cepR) genes, complete cds.] [NT:member of luxR family of transcriptional] |
| Contig081G | 26603408_c2_257 | 733 | 4859 | 813 | 270 | 454 | 5.70E−43 | sp:[LN:ZNUB_HAEIN] [AC:P44691] [GN:ZNUB:H10407] [OR:*HAEMOPHILUS INFLUENZAE*] [DE:HIGH-AFFINITY ZINC UPTAKE SYSTEM MEMBRANE PROTEIN ZNUB] [SP:P44691] |
| Contig081G | 26752186_c3_319 | 734 | 4860 | 1233 | 410 | 667 | 1.50E−65 | gp:[GI:g1498494] [LN:SLU63848] [AC:U63848] [OR:*Streptomyces lividans*] [DE:*Streptomyces lividans* sensor protein homolog gene, complete cds,and right LTR junction sequence.] [NT:ORF2; homolog to sensor protein of a putative] |
| Contig081G | 26758552_f2_73 | 735 | 4861 | 1176 | 391 | 1519 | 7.90E−156 | sp:[LN:CISZ_SALTY] [AC:Q56063] [GN:PRPC] [OR:*SALMONELLA TYPHIMURIUM*] [EC:4.1.3.7] [DE:POSSIBLE CITRATE SYNTHASE 2,] [SP:Q56063] |
| Contig081G | 2867328_c2_277 | 736 | 4862 | 567 | 188 | 362 | 3.20E−33 | gp:[GI:g4103043] [LN:AF019654] [AC:AF019654] [PN:putative acyl homoserine lactone synthase] [GN:cepl] [OR:*Burkholderia cepacia*] [DE:*Burkholderia* cepacia putative acyl homoserine lactone synthase(cepl) and transcriptional activator (cepR) genes, complete cds.] [NT:luxI homolog] |

TABLE 2-continued

| Query | Orf | NT ID | AA ID | NT Lgth | AA Lgth | Score | P-value | Subject |
|---|---|---|---|---|---|---|---|---|
| Contig081G | 29297325_c1_224 | 737 | 4863 | 723 | 240 | 187 | 1.10E−14 | pir:[LN:572165] [AC:572165] [PN:hypothetical protein 4] [CL:short-chain alcohol dehydrogenase homology] [OR:*Rhizobium leguminosarum* bv. *viciae*] |
| Contig081G | 29300142_f1_175 | 738 | 4864 | 948 | 315 | 363 | 2.50E−33 | gp:[GI:g3378276] [LN:AF079317] [AC:AF079317] [PN:unknown] [GN:orf114] [OR:*Sphingomonas aromaticivorans*] [DE:*Sphingomonas aromaticivorans* plasmid pNL1, complete plasmidsequence.] [NT:putative inner membrane lipocalin protein similar] |
| Contig081G | 29414008_f2_78 | 739 | 4865 | 1530 | 509 | | | NO-HIT |
| Contig081G | 30486665_f2_126 | 740 | 4866 | 1782 | 593 | 2145 | 3.60E−222 | sp:[LN:LLDP_ECOLI] [AC:P33231] [GN:LLDP:LCTP] [OR:*ESCHERICHIA COLI*] [DE:L-LACTATE PERMEASE] [SP:P33231] |
| Contig081G | 30650302_f2_91 | 741 | 4867 | 756 | 251 | 791 | 1.10E−78 | gp:[GI:g755067] [LN:RHMRPST] [AC:L39265] [PN:enoyl CoA hydratase] [GN:fadB1] [OR:*Rhizobium meliloti*] [SR:*Rhizobium meliloti* (strain 1021) DNA] [DE:*Rhizobium meliloti* 1021 ribosomal protein S20 (rpS20), enoyl CoAhydratase (fadB1), dnaA, orfX, genes, complete cds, and orfY,formamidopyrimidine-DNA glycosylase (fpg) genes, partial cds.] |
| Contig081G | 30737817_f3_122 | 742 | 4868 | 1278 | 425 | 496 | 2.00E−47 | pir:[LN:H70301] [AC:H70301] [PN:nucleotide sugar dehydrogenase] [GN:nsd] [CL:GDPmannose dehydrogenase] [CR:*Aquifex aeolicus*] |
| Contig081G | 31306881_c2_298 | 743 | 4869 | 216 | 71 | | | NO-HIT |
| Contig081G | 31679561_f3_149 | 744 | 4870 | 1677 | 558 | 940 | 1.80E−94 | sp:[LN:ACSA_BACSU] [AC:P39062] [GN:ACSA] [OR:*BACILLUS SUBTILIS*] [EC:6.2.1.1] [DE:ACTIVATING ENZYME) (ACETYL-COA SYNTHASE)] [SP:P39062] |
| Contig081G | 31807635_f3_144 | 745 | 4871 | 1179 | 392 | 895 | 1.10E−89 | sp:[LN:ALR2_KLEAE] [AC:O30746] [GN:DADB] [OR:*KLEBSIELLA AEROGENES*] [EC:5.1.1.1] [DE:ALANINE RACEMASE, CATABOLIC,] [SP:O30746] |
| Contig081G | 32225078_f1_4 | 746 | 4872 | 615 | 204 | 600 | 1.90E−58 | pir:[LN:D70037] [AC:D70037] [PN:capsular polysaccharide biosynthesis homolog yvfC] [GN:yvfC] [OR:*Bacillus subtilis*] |
| Contig081G | 32292_f1_18 | 747 | 4873 | 780 | 259 | 165 | 2.50E−12 | pir:[LN:B70509] [AC:B70509] [PN:hypothetical protein Rv1231c] [GN:Rv1231c] [OR:[Mycobacterium tuberculosis] |
| Contig081G | 32453175_c3_376 | 748 | 4874 | 2097 | 698 | 794 | 5.30E−79 | pir:[LN:S74457] [AC:S74457] [PN:ferrichrome-iron receptor 3:protein slr1490:protein slr1490] [GN:fbuA_3] [CL:ferrichrome-iron receptor 1:tonB-dependent receptor amino-terminal homology:tonB-dependent receptor carboxyl-terminal homology] [OR:Synechocystis sp.] [SR:PCC 6803, PCC 6803] ISR:PCC 6803,] |

TABLE 2-continued

| Query | Orf | NT ID | AA ID | NT Lgth | AA Lgth | Score | P-value | Subject |
|---|---|---|---|---|---|---|---|---|
| Contig081G | 32471007_f1_22 | 749 | 4875 | 1290 | 429 | 1393 | 1.80E−142 | sp:[LN:DADA_ECOLI] [AC:P29011] [GN:DADA:DADR] [OR:*ESCHERICHIA COLI*] [EC:1.4.99.1] [DE:D-AMINO ACID DEHYDROGENASE SMALL SUBUNIT,] [SP:P29011] |
| Contig081G | 33456381_c3_372 | 750 | 4876 | 216 | 7 | | | NO-HIT |
| Contig081G | 33786251_f2_95 | 751 | 4877 | 3018 | 1005 | 492 | 7.90E−74 | pir:[LN:E71280] [AC:E71280] [PN:probable antibiotic transport protein] [GN:TP0790] [OR:*Treponema pallidum* subsp. *pallidum*] [SR:, syphilis spirochete] |
| Contig081G | 3395002_f3_119 | 752 | 4878 | 687 | 228 | 605 | 5.70E−59 | gp:[GI:g3435182] [LN:AF061251] [AC:AF061251] [PN:WbdR] [GN:wbdR] [OR:*Escherichia coli*] [DE:*Escherichia coli* serotype 0157:H7 O antigen gene cluster.] |
| Contig081G | 33994625_f3_148 | 753 | 4879 | 912 | 303 | 745 | 8.30E−74 | sp:[LN:D3HI_RAT] [AC;P29266] [OR:*RATTUS NORVEGICUS*] [EC:1.1.1.31] [DE:(FRAGMENT)] [SP:P29266] |
| Contig081G | 34173382_f3_170 | 754 | 4880 | 1572 | 523 | 1979 | 1.40E−204 | sp:[LN:ATPA_VIBAL] [AC:P12985] [GN:ATPA:UNCA] [OR:*VIBRIO ALGINOLYTICUS*] [EC:3.6.1.34] [DE:ATP SYNTHASE ALPHA CHAIN,] [SP:P12985] |
| Contig081G | 34416562_f3_177 | 755 | 4881 | 603 | 200 | 125 | 8.90E−07 | pir:[LN:H69974] [AC:H69974] [PN:probable transcription regulator yrhl] [GN:yrhl] [CL:*Bacillus subtilis* probable transcription regulator yrhl] [OR:*Bacillus subtilis*] |
| Contig081G | 34579625_f3_176 | 756 | 4882 | 225 | 74 | | | NO-HIT |
| Contig081G | 34585928_f1_50 | 757 | 4883 | 966 | 321 | 348 | 9.70E−32 | gp:[GI:g4521959] [LN:AFACHRRA] [AC:J05278] [PN:pirin] [OR:*Ralstonia eutropha*] [DE:*Ralstonia eutropha* ChrB (chrB), ChrA (chrA), ChrC (chrC), ChrD(chrD), YbiB (ybiB), pirin, and heat shock protein sigma 32 (RP32)genes, complete cds.] |
| Contig081G | 35828407_f1_14 | 758 | 4884 | 2628 | 875 | 1065 | 5.30E−195 | pir:[LN:F70873] [AC:F70873] [PN:aconitate hydratase,] [GN:acn] [CL:iron-responsive element-binding protein] [OR:*Mycobacterium tuberculosis*] [EC:4.2.1.3] |
| Contig081G | 35969376_c3_345 | 759 | 4885 | 696 | 231 | 628 | 2.10E−61 | sp:[LN:DEDA_ECOLI] [AC:P09548] [GN:DEDA] [OR:*ESCHERICHIA COLI*] [DE:DEDA PROTEIN (DSG-1 PROTEIN)] [SP:P09548] |
| Contig081G | 36069753_f1_35 | 760 | 4886 | 3981 | 1326 | 1242 | 1.20E−165 | gp:[GI:g3510629] [LN:AF047828] [AC:AF047828] [PN:syringomycin synthetase] [GN:syrE] [OR:*Pseudomonas syringae* pv. *syringae*] [DE:*Pseudomonas syringae* pv. *syringae* syringomycin synthetase (syrE)gene, complete cds.] [NT:SyrE; peptide synthetase] |
| Contig081G | 36192627_f1_2 | 761 | 4887 | 585 | 194 | 134 | 2.70E−07 | pir:[LN:F22845] [AC:F22845] [PN:hypothetical protein 6] [OR:mitochondrion *Trypanosoma brucei*] |
| Contig081G | 36597656_f3_118 | 762 | 4888 | 213 | 70 | | | NO-HIT |
| Contig081G | 3786_c3_321 | 763 | 4889 | 711 | 236 | | | NO-HIT |
| Contig081G | 3924026_f2_99 | 764 | 4890 | 444 | 147 | | | NO-HIT |
| Contig081G | 3941891_f2_84 | 765 | 4891 | 1173 | 390 | 101 | 0.00064 | pir:[LN:D69315] [AC:D69315] [PN:*hypothetical protein AF0524*] [OR:*Archaeoglobus fulgidus*] |
| Contig081G | 4064132_c3_378 | 766 | 4892 | 336 | 111 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig081G | 4074128_f1_48 | 767 | 4893 | 555 | 184 | 296 | 3.10E−26 | sp:[LN:YQJI_ECOLI] [AC:Q46872] [GN:YQJI] [OR:*ESCHERICHIA COLI*] [DE:HYPOTHETICAL 23.4 KD PROTEIN IN RPOD-AER INTERGENIC REGIION] [SP:Q46872] |
| Contig081G | 4167128_f2_111 | 768 | 4894 | 879 | 292 | 938 | 2.90E−94 | sp:[LN:ATPG_VIBAL] [AC:P12990] [GN:ATPG:UNCG] [OR:*VIBRIO ALGINOLYTICUS*] [EC:3.6.1.34] [DE:ATP SYNTHASE GAMMA CHAIN,] [SP:P12990] |
| Contig081G | 4167575_c2_300 | 769 | 4895 | 1284 | 427 | 1346 | 1.70E−137 | sp:[LN:TYRB_ECOLI] [AC:P04693] [GN:TYRB] [OR:*ESCHERICHIA COLI*] [EC:2.6.1.57] [DE:AROMATIC-AMINO-ACID AMINOTRANSFERASE, (AROAT) (ARAT)] [SP:P04693] |
| Contig081G | 4179837_c1_181 | 770 | 4896 | 585 | 194 | 351 | 4.70E−32 | sp:[LN:YRDC_ECOLI] [AC:P45748] [GN:YRDC] [OR:*ESCHERICHIA COLI*] [DE:HYPOTHETICAL 20.8 KD PROTEIN IN AROE-SMG INTERGENIC REGION] [SP:P45748] |
| Contig081G | 4343840_f2_102 | 771 | 4897 | 1578 | 525 | 1887 | 8.00E−195 | sp:[LN:GUAA_HAEIN] [AC:P44335] [GN:GUAA:H10222] [OR:*HAEMOPHILUS INFLUENZAE*] [EC:6.3.5.2] [DE:AMIDOTRANSFERASE) (GMP SYNTHETASE)] [SP:P44335] |
| Contig081G | 4344465_f3_165 | 772 | 4898 | 849 | 282 | 134 | 7.30E−13 | sp:[LN:ZNUA_HAEIN] [AC:P44526] [GN:ZNUA:HI0119] [OR:*HAEMOPHILUS INFLUENZAE*] [DE:HIGH-AFFINITY ZINC UPTAKE SYSTEM PROTEIN ZNUA] [SP:P44526] |
| Contig081G | 4383392_c3_320 | 773 | 4899 | 774 | 257 | 286 | 3.60E−25 | sp:[LN:YEAM_ECOLI] [AC:P76241] [GN:YEAM] [OR:*ESCHERICHIA COLI*] [DE:HYPOTHETICAL TRANSCRIPTIONAL REGULATOR IN GAPA-RND INTERGENIC REGION] [SP:P76241] |
| Contig081G | 4426000_f3_140 | 774 | 4900 | 699 | 232 | 503 | 3.60E−48 | sp:[LN:RLUA_HAEIN] [AC:P44782] [GN:RLUA:H10617] [OR:*HAEMOPHILUS INFLUENZAE*] [EC:4.2.1.70] [DE:(*PSEUDOURIDYLATE SYNTHASE*) (URACIL HYDROLYASE)] [SP:P44782] |
| Contig081G | 4539067_f1_27 | 775 | 4901 | 1584 | 527 | 1594 | 8.90E−164 | sp:[LN:MMSA_RAT] [AC:Q02253] [GN:MMSDH] [OR:*RATTUS NORVEGICUS*] [EC:1.2.1.27] [DE:(EC 1.2.1.27) (MMSDH)] [SP:Q02253] |
| Contig081G | 4564808_c2_276 | 776 | 4902 | 426 | 141 | | | NO-HIT |
| Contig081G | 4721037_f2_104 | 777 | 4903 | 663 | 220 | 265 | 6.00E−23 | sp:[LN:YIGK_ECOLI] [AC:P27847] [GN:YIGK] [OR:*ESCHERICHIA COLI*] [DE:HYPOTHETICAL 15.4 KD PROTEIN IN RECQ-PLDB INTERGENIC REGION (F138)] [SP:P27847] |
| Contig081G | 4725811_c3_383 | 778 | 4904 | 201 | 66 | | | NO-HIT |
| Contig081G | 4804068_c3_344 | 779 | 4905 | 1239 | 412 | 115 | 3.50E−07 | pir:[LN:S74329] [AC:S74329] [PN:hypothetical protein sll0412] [OR:Synechocystis sp.] [SR:PCC 6803, , PCC 6803] [SR:PCC 6803.] |

TABLE 2-continued

| Query | Orf | NT ID | AA ID | NT Lgth | AA Lgth | Score | P-value | Subject |
|---|---|---|---|---|---|---|---|---|
| Contig081G | 4804175_f1_1 | 780 | 4906 | 441 | 146 | 508 | 1.10E−48 | gp:[GI:g3241975] [LN:55U85710] [AC:U85710] [PN:transposase] [OR:*Sulfolobus solfataricus*] [DE:*Sulfolobus solfataricus* insertion element ISC1041, transposasegene, complete cds.] |
| Contig081G | 48127_c2_286 | 781 | 4907 | 513 | 170 | 417 | 4.70E−39 | sp:[LN:LRP_ECOLI] [AC:P19494] [GN:LRP:ALSB:LIVR:IHB:OPPI] [OR:*ESCHERICHIA COLI:ENTEROBACTER AEROGENES*] [SR:,*AEROBACTER AEROGENES*] [DE:LEUCINE-RESPONSIVE REGULATORY PROTEIN] [SP:P19494] |
| Contig081G | 4812818_f2_109 | 782 | 4908 | 480 | 159 | 432 | 1.20E−40 | sp:[LN:ATPF_VIBAL] [AC:P12989] [GN:ATPF:UNCF] [OR:*VIBRIO ALGINOLYTICUS*] [EC:3.6.1.34] [DE:ATP SYNTHASE B CHAIN.] [SP:P12989] |
| Contig081G | 4875438_f1_5 | 783 | 4909 | 1185 | 394 | 505 | 2.20E−48 | gp:[GI:g191 1763] [LN:583460] [AC:583460] [GN:rfbE(EcO157:H7)] [OR:*Escherichia coli*] [SR:*Escherichia coli* 0157:H7 strain 86-24] [DE:rfbE(EcO157:H7)=perosamine synthetase homolog [*Escherichia coli*,O157:H7 strain 86-24, Genomic, 1287 nt].] [NT:*perosamine synthetase homolog*; This sequence comes] |
| Contig081G | 4883437_f1_51 | 784 | 4910 | 696 | 231 | 328 | 1.30E−29 | sp:[LN:YIV8_YEAST] [AC:P40582] [GN:YIR038C] [OR:*SACCHAROMYCES CEREVISIAE*] [SR:,BAKER'S YEAST] [DE:HYPOTHETICAL 26.8 KD PROTEIN IN HYRI 3'REGION] [SP:P40582] |
| Contig081G | 4892201_c1_196 | 785 | 4911 | 267 | 88 | | | NO-HIT |
| Contig081G | 4949083_f2_110 | 786 | 4912 | 549 | 182 | 290 | 1.40E−25 | sp:[LN:ATPD)VIBAL] [AC:P12987] [GN:ATPH:UNCH] [OR:*VIBRIO ALGINOLYTICUS*] [EC:3.6.1.34] ]DE:ATP SYNTHASE DELTA CHAIN.] [SP:P12987] |
| Contig081G | 4975000_c3_315 | 787 | 4913 | 1173 | 390 | 136 | 8.70E−07 | sp:[LN:XKDP_BACSU] [AC:P54355] [GN:XKDP] [OR:*BACILLUS SUBTILIS*] [DE:PHAGE-LIKE ELEMENT PBSX PROTEIN XKDP] [SP:P54355] |
| Contig081G | 5117150_f3_127 | 788 | 4914 | 1158 | 385 | 1733 | 1.70E−178 | sp:[LN:LDD_ECOLI] [AC:P33232] [GN:LLDD:LCTD] [OR:*ESCHERICHIA COLI*] [EC:1.1.2.3] [DE:L-LACTATE DEHYDROGENASE (CYTOCHROME).] [SP:P33232] |
| Contig081G | 56250_f1_64 | 789 | 4915 | 432 | 143 | | | NO-HIT |
| Contig081G | 5860643_f1_3 | 790 | 4916 | 1173 | 390 | 556 | 8.80E−54 | pir:[LN:S70157] [AC:S70157] [PN:cpsF protein, 40.6K] [GN:cpsF] [OR:*Proteus mirabilis*] |
| Contig081G | 5892837_f1_6 | 791 | 4917 | 1884 | 627 | 1338 | 1.20E−136 | gp:[GI:d1034611:g3721694] [LN:AB012957] [AC:AB012957] [GN:ORF22-30] [OR:*Vibrio cholerae*] [SR:*Vibrio cholerae* (strain:)22)DNA] [DE*Vibrio cholerae* genes for o-antigen synthesis, strain O22, completecds.] [NT:unknown] |

TABLE 2-continued

| Query | Orf | NT ID | AA ID | NT Lgth | AA Lgth | Score | P-value | Subject |
|---|---|---|---|---|---|---|---|---|
| Contig081G | 5898425_f2_72 | 792 | 4918 | 729 | 242 | 236 | 7.20E−20 | gp:[GI:e1202338g:g2661693] [GN:SC9B10] [ACAL0090204] [PN:transcriptional regulator] [GN:SC9B10.07] [OR:*Streptomyces coelicolor*] [DE:*Streptomyces coelicolor* cosmid 9B10.] [NT:SC9B10.07, probable transcriptional regulator, len:] |
| Contig081G | 5994003_f1_33 | 793 | 4919 | 1893 | 630 | 960 | 1.90E−95 | gp:[GI:g1171128] [LN:MXU24657] [AC:U24657] [PN :saframycin Mx1 synthetase B] [GN:safB] [OR:*Myxococcus xanthus*] [DE:*Myxococcus xanthus* saframycin Mx1 synthetase B (safB), saframycinMx1 synthetase A (safA), and safC genes, complete cds.] [NT:contains two putative amino acid activating] |
| Contig081G | 625092_f2_67 | 794 | 4920 | 1698 | 565 | 2193 | 3.00E−227 | sp:[LN:G6PI_ACICA] [AC:Q59088] [GN:PGI] [OR:*ACINETOBACTER CALCOACETICUS*] [EC:5.3.1.9] [DE:ISOMERASE) (PGI) (PHOSPHOHEXOSE ISOMERASE) (PHI)] [SP:Q59088] |
| Contig081G | 6523267_f1_43 | 795 | 4921 | 396 | 131 | 213 | 2.00E−17 | sp:[LN:BOLA_VIBAL] [AC:Q56585] [GN:BOLA] [OR:*VIBRIO ALGINOLYTICUS*] [DE:BOLA PROTEIN HOMOLOG] [SP:Q56585] |
| Contig081G | 676387_c3_363 | 796 | 4922 | 210 | 69 | | | NO-HIT |
| Contig081G | 6850665_f3_159 | 797 | 4923 | 294 | 97 | | | NO-HIT |
| Contig081G | 7234437_c3_331 | 798 | 4924 | 516 | 171 | 286 | 3.60E−25 | sp:[LN:ZUR_ECOLI] [AC:P32692:P76784] [GN:ZUR] [OR:*ESCHERICHIA COLI*] [DE:ZINC UPTAKE REGULATION PROTEIN (ZINC UPTAKE REGULATOR)] [SP:P32692:P76784] |
| Contig081G | 820807_c2_251 | 799 | 4925 | 630 | 209 | 460 | 1.30E−43 | sp:[LN:BTUE_ECOLI] [AC:P06610] [GN:BTUE] [OR:*ESCHERICHIA COLI*] [DE:VITAMIN B12 TRANSPORT PERIPLASMIC PROTEIN BTUE] [SP:P06610] |
| Contig081G | 9897566_c1_228 | 800 | 4926 | 246 | 81 | | | NO-HIT |
| Contig081G | 9959637_c2_275 | 801 | 4927 | 210 | 69 | | | NO-HIT |
| Contig081G | 9964686_f3_145 | 802 | 4928 | 1467 | 488 | 1444 | 7.00E−148 | sp:[LN:CYCA_ECOLI] [AC:P39312] [GN:CYCA:DAGA] [OR:*ESCHERICHIA COLI*] [DE:D-SERINE/D-ALANINE/GLYCINE TRANSPORTER] [SP:P39312] |
| Contig087G | 13835782_c3_102 | 803 | 4929 | 312 | 103 | 176 | 1.60E−13 | sp:[LN:YOHL_ECOLI] [AC:P76424] [GN:YOHL] [OR:*ESCHERICHIA COLI*] [DE:HYPOTHETICAL 10.1 KD PROTEIN IN THIM-MRP INTERGENIC REGION] [SP:P76424] |
| Contig087G | 14218830_f2_19 | 804 | 4930 | 1092 | 363 | 230 | 1.80E−34 | pir:[LN:C69612] [AC:C69612] [PN:cation-efflux system membrane protein czcD] [GN:czcD] [CL:zinc transporter ZnT-2] [OR:*Bacillus subtitis*] |
| Contig087G | 14625832_c1_53 | 805 | 4931 | 192 | 63 | | | NO-HIT |
| Contig087G | 14647936_c3_85 | 806 | 4932 | 1983 | 660 | 2348 | 1.10E−243 | sp:[LN:DNAK_FRATU] [AC:P48205] [GN:DNAK] [OR:*FRANCISELLA TULARENSIS*] [DE:DNAK PROTEIN (HEAT SHOCK PROTEIN 70) (HSP70)] [SP:P48205] |

TABLE 2-continued

| Query | Orf | NT ID | AA ID | NT Lgth | AA Lgth | Score | P-value | Subject |
|---|---|---|---|---|---|---|---|---|
| Contig087G | 181257_f3_45 | 807 | 4933 | 273 | 90 | 100 | 2.70E−05 | gp:[GI:g725475] [LN:PFU07002] [AC:U07002] [PN:merozoite surface antigen 2] [OR:*Plasmodium falciparum*] [SR:*malaria parasite*] [DE:*Plasmodium falciparum* WOS isolate 2 merozoite surface antigen 2gene, partial cds.] [RE: |
| Contig087G | 19562563_c3_86 | 808 | 4934 | 945 | 314 | 131 | 3.90E−08 | gp:[GI:g3445522] [LN:AF011391] [AC:AF011391] [PN:*collagenase-3*] [OR:*Cavia porcellus*] [SR:domestic guinea pig] [DE:*Cavia porcellus collagenase*-3 mRNA, partial cds.] [NT:matrix metalloproteinase] [RE: |
| Contig087G | 1969137_f1_3 | 809 | 4935 | 732 | 243 | 251 | 1.80E−21 | gp:[GI:g3135321] [LN:AF057031] [AC:AF057031] [PN:putative thiot:disulfide interchange protein] [GN:dsbC] [OR:*Pseudomonas aeruginosa*] [DE:*Pseudomonas aeruginosa* putative thiot:disulfide interchange proteinprecursor (dsbC) gene, complete cds.] [NT:DsbC] |
| Contig087G | 20437882_c2_68 | 810 | 4936 | 927 | 308 | 320 | 9.00E−29 | pir:[LN:577670] [AC:577670:S77669] [PN:probable transcription activator ptxR] [GN:ptxR] [OR:*Pseudomonas aeruginosa*] |
| Contig087G | 21488126_c1_48 | 811 | 4937 | 342 | 113 | | | NO-HIT |
| Contig087G | 21500392_f2_28 | 812 | 4938 | 897 | 298 | | | NO-HIT |
| Contig087G | 21589385_f3_39 | 813 | 4939 | 591 | 196 | 551 | 3.00E−53 | sp:[LN:PUR6_PSEAE] [AC:P72157] [GN:PURE] [OR:*PSEUDOMONAS AERUGINOSA*] [EC:4.1.1.21] [DE:(EC 4.1.1.21) (AIR CARBOXYLASE) (AIRC)] [SP:P72157] |
| Contig087G | 22359640_c3_96 | 814 | 4940 | 189 | 62 | | | NO-HIT |
| Contig087G | 23479687_c1_65 | 815 | 4941 | 240 | 80 | 101 | 0.00013 | sp:[LN:DNAA_MYCGE] [AC:P35888:Q49363] [GN:DNAA:MG469] [OR:*MYCOPLASMA GENITALIUM*] [DE:CHROMOSOMAL REPLICATION INITIATOR PROTEIN DNAA] [SP:P35888:Q49363] |
| Contig087G | 23707687_c3_93 | 816 | 4942 | 1428 | 475 | 1338 | 1.20E−136 | sp:[LN:MPL_ECOLI] [AC:P37773:P76804] [GN:MPL] [OR:*ESCHERICHIA COLI*] [EC:63.2.—] [DE:LIGASE.] [SP:P37773:P76804] |
| Contig087G | 23836713_f2_29 | 817 | 4943 | 1092 | 363 | 1465 | 4.20E−150 | pir:[LN:139510] [AC:139510:S50204] [PN:carboxylesterase,] [GN:estA] [CL:probable lipolytic protein ybaC] [OR:*Acinetobacter calcoaceticus*] [EC:3.1.1.1] |
| Contig087G | 23996076_c3_101 | 818 | 4944 | 1371 | 456 | 1501 | 6.40E−154 | sp:[LN:YGFP_ECOLI] [AC:P76641:Q46816] [GN:YGFP] [OR:*ESCHERICHIA COLI*] [DE:HYPOTHETICAL 50.2 KD PROTEIN IN KDUI-LYSS INTERGENIC REGION] [SP:P76641:Q46816] |
| Contig087G | 24009432_f3_30 | 819 | 4945 | 192 | 63 | 181 | 4.80E−14 | sp:[LN:RL34_ECOLI] [AC:P02437] [GN:RPMH:SSAF:RIMA] [OR:*ESCHERICHIA COLI*] [DE:50S RIBOSOMAL PROTEIN L34] [SP:P02437] |

TABLE 2-continued

| Query | Orf | NT ID | AA ID | NT Lgth | AA Lgth | Score | P-value | Subject |
|---|---|---|---|---|---|---|---|---|
| Contig087G | 242785_c1_56 | 820 | 4946 | 1029 | 342 | 892 | 2.20E−89 | sp:[LN:YGJT_ECOLI] [AC:P42601] [GN:YGJT] [OR:*ESCHERICHIA COLI*] [DE:HYPOTHETICAL 35.8 KD PROTEIN IN EBGC-UXAA INTERGENIC REGION] [SP:P42601] |
| Contig087G | 24304177_c1_50 | 821 | 4947 | 204 | 67 | | | NO-HIT |
| Contig087G | 24313256_c3_95 | 822 | 4948 | 261 | 86 | | | NO-HIT |
| Contig087G | 24392001_c2_76 | 823 | 4949 | 282 | 93 | 138 | 1.70E−09 | sp:[LN:YEAQ_ECOLI] [AC:P76246] [GN:YEAQ] [OR:*ESCHERICHIA COLI*] [DE:HYPOTHETICAL 8.7 KD PROTEIN IN GAPA-RND INTERGENIC REGION] [SP:P76246] |
| Contig087G | 24642168_f1_14 | 824 | 4950 | 564 | 187 | 675 | 2.20E−66 | sp:[LN:CYPH_ACICA] [AC:P42693] [GN:ROTA] [OR:*ACINETOBACTER CALCOACETICUS*] [EC:5.21.8] [DE:(ROTAMASE)] [SP:P42693] |
| Contig087G | 26172577_c1_55 | 825 | 4951 | 597 | 198 | 369 | 5.80E−34 | gp:[GI:g2460271] [LN:AF020809] [AC:AF020809] [PN:putative permease Mig-13] [GN:mig-13] [OR:*Salmonella typhimurium*] [DE:*Salmonella typhimurium* multidrug pump Cmr (cmr) gene, partial cds;putative permease Mig-13 (mig-13) and transcriptional activatorDeoR (deoR) genes, complete cds; and penicillin-binding protein 6(pbp-6) gene. partial cds.] [NT:lipoprotein similar to bacitracin permease (BcrC)] |
| Contig087G | 26602137_c2_70 | 826 | 4952 | 393 | 130 | | | NO-HIT |
| Contig087G | 31281286_f1_7 | 827 | 4953 | 1209 | 402 | 208 | 4.00E−14 | gp:[GI:g2270983] [LN:SMU90220] [AC:U90220] [OR:*Sinorhizobium meliloti*] [DE:*Sinorhizobium meliloti* SyrB gene, complete cds.] [NT:orf3] |
| Contig087G | 31306556_f3_31 | 828 | 4954 | 324 | 107 | 247 | 4.90E−21 | sp:[LN:YIDD_HAE[N] [AC:P44972] [GN:HI1000] [OR:*HAEMOPHILUS INFLUENZAE*] [DE:HYPOTHETICAL 9.5 KD PROTEIN IN RNPA 3'REGION] [SP:P44972] |
| Contig087G | 32454638_f2_27 | 829 | 4955 | 1299 | 432 | 445 | 5.10E−42 | gp:[GI:d1029070:g3132253] [LN:AB010415] [AC:A13010415] [OR:*Actinobacillus actinomycetemcomitans*] [SR:*Actinobacillus actinomycetemcomitans* (strain:NCTC9710) DNA] [DE:*Actinobacillus actinomycetemcomitans* gene cluster for6-deoxy-L-talan synthesis, complete cds.] [NT:ORF5] |
| Contig087G | 33643968_c1_58 | 830 | 4956 | 1095 | 364 | 267 | 3.70E−23 | pir:[LN:S75666] [AC:S75666] [PN:3-chlorobenzoate-3,4-dioxygenase:protein sll1869:protein sll1869] [GN:cbaB] [OR:Synechocystis sp] [SR:PCC 6803,, PCC 6803] [SR:PCC 6803,] |
| Contig087G | 34179086_c3_81 | 831 | 4957 | 348 | 115 | 111 | 2.20E−05 | gp:[GI:g4050087] [LN:DJ534K4] [AC:AF109907] [PN:S164] [OR:Homo sapiens] [DE:Homo sapiens S164 gene, partial cds; PSI and hypothetical proteingenes, complete cds; and S171 gene. partial cds.] [NT:unknown; intron-exon boundaries defined by ESTs] |

TABLE 2-continued

| Query | Orf | NT ID | AA ID | NT Lgth | AA Lgth | Score | P-value | Subject |
|---|---|---|---|---|---|---|---|---|
| Contig087G | 34412812_c3_87 | 832 | 4958 | 1017 | 338 | 114 | 3.30E−06 | gp:[GI:g3445522] [LN:AF011391] [AC:AF011391] [PN:collagenase-3] [OR:*Cavia porcellus*] [SR:domestic guinea pig] [DE:*Cavia porcellus* collagenase-3 mRNA, partial cds.] [NT:matrix metalloproteinase] [RE: |
| Contig087G | 34619137_c3_97 | 833 | 4959 | 390 | 129 | 70 | 0.00089 | sp:[LN:Y930_HAEIN] [AC:P44077] [GN:H10930] [OR:*HAEMOPHILUS INFLUENZAE*] [DE:HYPOTHETICAL PROTEIN H10930] [SP:P44077] |
| Contig087G | 36132665_c3_84 | 834 | 4960 | 606 | 201 | 304 | 4.50E−27 | sp:[LN:GRPE_HAEIN] [AC:P43732] [GN:GRPE:H10071] [OR:*HAEMOPHILUS INFLUENZAE*] [DE:GRPE PROTEIN] [SP:P43732] |
| Contig087G | 36332931_f2_16 | 835 | 4961 | 408 | 135 | 215 | 1.20E−17 | sp:[LN:RNPA_HAEIN] [AC:P44306] [GN:RNPA:H10999] [OR:*HAEMOPHILUS INFLUENZAE*] [EC:3.1.26.5] [DE:RIBONUCLEASE P PROTEIN COMPONENT, (PROTEIN C5) (RNASE P)] [SP:P44306] |
| Contig087G | 3937551_c2_69 | 836 | 4962 | 306 | 101 | | | NO-HIT |
| Contig087G | 406716_c2_74 | 837 | 4963 | 1206 | 401 | 1010 | 6.80E−102 | sp:[LN:YGIC_HAEIN] [AC:P44940] [GN:H10929] [OR:*HAEMOPHILUS INFLUENZAE*] [DE:HYPOTHETICAL PROTEIN H10929] [SP:P44940] |
| Contig087G | 4095328_f2_18 | 838 | 4964 | 1365 | 454 | 1189 | 7.40E−121 | sp:[LN:THDF_ECOLI] [AC:P25522] [GN:THDF:TRME] [OR:*ESCHERICHIA COLI*] [DE:THIOPHENE AND FURAN OXIDATION PROTEIN THDF] [SP:P25522] |
| Contig087G | 4422563_c1_60 | 839 | 4965 | 537 | 178 | 593 | 1.10E−57 | gp:[GI:g3046326] [LN:AF008931] [AC:AF008931] [PN:hypoxanthine phosphoribosyltransferase] [GN:hprt] [OR:*Salmonella typhimurium*] [DE:*Salmonella typhimurium* hypoxanthine phosphoribosyltransferase(hprt) gene, complete cds.] |
| Contig087G | 4475343_c3_106 | 840 | 4966 | 318 | 105 | 154 | 2.70E−10 | sp:[LN:DNAA_PROMI] [AC:P22837] [GN:DNAA] [OR:*PROTEUS MIRABILIS*] [DE:CHROMOSOMAL REPLICATION INITIATOR PROTEIN DNAA] [SP:P22837] |
| Contig087G | 4891713_f3_40 | 841 | 4967 | 1131 | 376 | 763 | 1.00E−75 | sp:[LN:PURK_PSEAE] [AC:P72158] [GN:PURK] [OR:*PSEUDOMONAS AERUGINOSA*] [EC:4.1.1.21] [DE:(AIR CARBOXYLASE) (AIRC)] [SP:P72158] |
| Contig087G | 54002_f3_38 | 842 | 4968 | 423 | 140 | | | NO-HIT |
| Contig087G | 6369078_c1_59 | 843 | 4969 | 183 | 60 | | | NO-HIT |
| Contig087G | 7312556_f2_17 | 844 | 4970 | 1779 | 592 | 987 | 5.20E−119 | sp:[LN:60IM_COXBU] [AC:P45650] [OR:*COXIELLA BURNETII*] [DE:60 KD INNER-MEMBRANE PROTEIN] [SP:P45650] |
| Contig087G | 975161_c2_77 | 845 | 4971 | 249 | 82 | 99 | 0.00016 | pir:[LN:JC4831] [AC:JC4831] [PN:adsorption protein:gIIIp protein] [GN:III] [OR:*Xanthomonas campestris* phage phi-Lf] |

TABLE 2-continued

| Query | Orf | NT ID | AA ID | NT Lgth | AA Lgth | Score | P-value | Subject |
|---|---|---|---|---|---|---|---|---|
| Contig089G | 10009758_c1_213 | 846 | 4972 | 387 | 128 | 238 | 4.40E−20 | sp:[LN:YFFB_ECOLI] [AC:P24178] [GN:YFFB] [OR:*ESCHERICHIA COLI*] [DE:HYPOTHETICAL 13.6 KD PROTEIN IN ACRD-DAPE INTERGENIC REGION] [SP:P24178] |
| Contig089G | 10032932_f2_117 | 847 | 4973 | 3387 | 1128 | 276 | 5.20E−28 | gp:[GI:g2920625] [LN:AF044499] [AC:AF044499] [PN:vgrE protein] [OR:*Escherichia coli*] [DE:*Escherichia coli* strain ec50 RhsE accessory genetic element vgrEprotein, core protein, and dsORF-c5 genes, complete cds.] |
| Contig089G | 10353950_c2_360 | 848 | 4974 | 1260 | 419 | 1304 | 4.80E−133 | pir:[LN:C64923] [AC:C64923] [PN:chloramphenicol resistance protein homolog b1657] [CL:*Streptomyces lividans* chloramphenicol resistance protein] [OR:*Escherichia coli*] |
| Contig089G | 1055287_f3_153 | 849 | 4975 | 843 | 280 | 882 | 2.50E−88 | sp:[LN:DAPB_PSESZ] [AC:Q52419] [GN:DAPB] [OR:*PSEUDOMONAS SYRINGAE*] [EC:1.3.1.26] [DE:DIHYDRODIPICOLINIATE REDUCTASE,] [SP:Q52419] |
| Contig089G | 10674042_c2_366 | 850 | 4976 | 255 | 84 | | | NO-HIT |
| Contig089G | 10744032_f1_15 | 851 | 4977 | 906 | 301 | 639 | 1.40E−62 | sp:[LN:YAFC_ECOLI] [AC:P30864] [GN:YAFC] [OR:*ESCHERICHIA COLI*] [DE:(ORF304)] [SP:P30864] |
| Contig089G | 10968887_f2_83 | 852 | 4978 | 465 | 154 | 406 | 6.90E−38 | gp:[GI:g3128302] [LN:AF010496] [AC:AF010496] [PN:hypothetical protein] [OR:*Rhodobacter capsulatus*] [DE:*Rhodobacter capsulatus* strain SB 1003, partial genome.] |
| Contig089G | 11751528_f1_6 | 853 | 4979 | 1920 | 639 | 2306 | 3.20E−239 | pir:[LN:DWECDA] [AC:A27310:D26570:S48894:S30669:F65180] [PN:dihydroxy-acid dehydratase,] [GN:ilvD] [CL:dihydroxy-acid dehydratase] [OR:*Escherichia coli*] [EC:4.2.1.9] [MP:85 min] |
| Contig089G | 11908467_f2_110 | 854 | 4980 | 1209 | 402 | 140 | 1.70E−06 | pir:[LN:B70543] [AC:B70543] [PN:hypothetical protein Rv1592c] [GN:Rv1592c] [OR:*Mycobacterium tuberculosis*] |
| Contig089G | 1267581_c2_307 | 855 | 4981 | 537 | 178 | 345 | 2.00E−31 | sp:[LN:YBBT_ECOLI] [AC:P77731] [GN.:YBBT:GLXA2] [OR:*ESCHERICHIA COLI*] [DE:HYPOTHETICAL 18.2 KD PROTEIN IN RHSD-GCL INTERGENIC REGION] [SP:P77731] |
| Contig089G | 12925076_c3_438 | 856 | 4982 | 1041 | 346 | 733 | 1.50E−72 | sp:[LN:MUTY_ECOLI] [AC:P17802] [GN:MUTY:MICA] [OR:*ESCHERICHIA COLI*] [EC:3.2.2.—] [DE:AIG-SPECIFIC ADENINE GLYCOSYLASE,] [SP:P17802] |
| Contig089G | 12930212_c1_251 | 857 | 4983 | 1128 | 375 | 992 | 5.50E−100 | sp;[LN:GCH2_PHOLE] [AC:Q02008] [GN:RIBA] [OR:PHOTOBACTERIUM LEIOGNATHI] [EC:3.5.4.25] [DE:PHOSPHATE SYNTHASE (DHBP SYNTHASE)] [SP:Q02008] |

TABLE 2-continued

| Query | Orf | NT ID | AA ID | NT Lgth | AA Lgth | Score | P-value | Subject |
|---|---|---|---|---|---|---|---|---|
| Contig089G | 12991693_f2_75 | 858 | 4984 | 1128 | 375 | 1189 | 7.40E-121 | gp:[GI:g1389759] [LN:STU58360] [AC:U58360] [PN:DnaJ] [GN:dnaJ] [OR:*Salmonella typhimurium*] [SR:*Salmonella typhimurium* strain=LT2] [DE:*Salmonella typhimurium* plasmid pRS1014 DnaK and DnaJ genes,complete cds.] |
| Contig089G | 13710942_f3_191 | 859 | 4985 | 1947 | 648 | 2238 | 5.10E-232 | gp:[GI:d1038142:g4176381] [LN:AB003429] [AC:A13003429] [PN:topoisomerase IV subunit] [GN:parE] [OR:*Pseudomonas aeruginosa*] [SR:*Pseudomonas aeruginosa* DNA] [DE:*Pseudomonas aeruginosa* DNA for topoisomcrase IV subunit, completecds.] |
| Contig089G | 13909652_f3_154 | 860 | 4986 | 705 | 234 | 111 | 0.00019 | sp:[LN:PPCT_BOVIN] [AC:P02720] [GN:PCTP] [OR:BOS TAURUS] [DE:PHOSPHATIDYLCHOLINE TRANSFER PROTEIN (PC-TP)] [SP:P02720] |
| Contig089G | 14242167_f3_173 | 861 | 4987 | 1074 | 357 | 406 | 6.90E-38 | sp:[LN:HUFG_KLEAE] [AC:P19452] [GN:HUTG] [OR:*KLEBSIELLA AEROGENES*] [EC:3.5.3.8] [DE:(HISTIDINE UTILIZATION PROTEIN G) (FRAGMENT)] [SP:P19452] |
| Contig089G | 14487542_c1_270 | 862 | 4988 | 1077 | 357 | 1114 | 6.50E-113 | pir:[LN:556495] [AC:S56495:H65239] [PN:probable zinc-containing dehydrogenase,:yjgB protein] [GN:yjgB] [CL:alcohol dehydrogenase:long-chain alcohol dehydrogenase homology] [OR:*Escherichia coli*] [EC:1.—.—.—] |
| Contig089G | 14564213_c1_269 | 863 | 4989 | 375 | 124 | 201 | 3.70E-16 | pir:[LN:D71092] [AC:D71092] [PN:hypothetical protein PH1001] [GN:PH1001] [CL:histidine triad homology] [OR:*Pyrococcus horikoshii*] |
| Contig089G | 1464837_f1_68 | 864 | 4990 | 209 | 70 | | | NO-HIT |
| Contig089G | 14734692_c1_268 | 865 | 4991 | 189 | 62 | | | NO-HIT |
| Contig089G | 15804142_f3_184 | 866 | 4992 | 885 | 294 | 612 | 1.00E-59 | pir:[LN:D70953] [AC:D70953] [PN:hypothetical protein Rv1245c] [GN:Rv1245c] [OR:*Mycobacterium tuberculosis*] |
| Contig089G | 16801303_c2_318 | 867 | 4993 | 729 | 242 | 163 | 3.90E-12 | pir:[LN:A70811[AC:A708111 [PN:hypothetical protein Rv0825c] [GN:Rv0825c] [OR:*Mycobacterium tuberculosis*] |
| Contig089G | 16828765_c3_412 | 868 | 4994 | 924 | 307 | 642 | 6.80E-63 | gp:[GI:d1022634:g2329840] [LN:D17333] [AC:D17333] [PN:thiamine-monophosphate kinase] [GN:thiL] [OR:*Escherichia coli*] [SR:*Escherichia coli* (strain:K 12) DNA. clone_lib:Clarke-Carbon gen] [EC:2.7.4.16] [DE:*E. Coli* thiL gene, complete cds.] |
| Contig089G | 182157_f2_97 | 869 | 4995 | 636 | 211 | 268 | 2.90E-23 | pir:[LN:JC5587] [AC:JC5587:PC4481] [PN:glutamate racemase,] [GN:murI] [CL:glutamate racemase] [OR:*Bacillus pumilus*] [EC:5.1.1.3] |
| Contig089G | 19538877_c3_404 | 870 | 4996 | 819 | 272 | 768 | 3.00E-76 | sp:[LN:PHOB_PSEAE] [AC:P23620] [GN:PHOB] [OR:*PSEUDOMONAS AERUGINOSA*] [DE:PHOSPHATE REGULON TRANSCRIPTIONAL REGULATORY PROTEIN PHOB] [SP:P23620] |

TABLE 2-continued

| Query | Orf | NT ID | AA ID | NT Lgth | AA Lgth | Score | P-value | Subject |
|---|---|---|---|---|---|---|---|---|
| Contig089G | 19704405_f1_45 | 871 | 4997 | 879 | 292 | 595 | 6.50E−58 | sp:[LN:DPSD_ECOLI] [AC:P10740] [GN:PSD] [OR:*ESCHERICHIA COLI*] [EC:4.1.1.65] [DE:PHOSPHATIDYLSERINE DECARBOXYLASE PROENZYME,] [SP:P10740] |
| Contig089G | 20115777_f2_120 | 872 | 4998 | 354 | 117 | | | NO-HIT |
| Contig089G | 20391317_c2_304 | 873 | 4999 | 1059 | 352 | 705 | 1.40E−69 | gp:[GI:e325402:g2239196] [LN:SPACI9G12] [AC:Z97209] [PN:hypothetical protein] [GN:SPACI9G12.03] [OR:*Schizosaccharomyces pombe*] [SR:fission yeast] [DE:*S.pombe* chromosome 1 cosmid c19G12.] [NT:SPAC19G12.03, unknown, len:32] |
| Contig089G | 20507967_f1_56 | 874 | 5000 | 594 | 197 | 271 | 1.40E−23 | sp:[LN:YQIA_ECOLI] [AC:P36653] [GN:YQIA] [OR:*ESCHERICHIA COLI*] [DE:HYPOTHETICAL 21.6 KD PROTEIN IN PARE-ICC INTERGENIC REGION (F193)] [SP:P36653] |
| Contig089G | 20522812_f3_174 | 875 | 5001 | 687 | 228 | 337 | 1.40E−30 | gp:[GI:g2687606] [LN:AF034854] [AC:AF034854] [GN:virP] [OR:*Agrobacterium tumefaciens*] [DE:*Agrobacterium tumefaciens* plasmid pTiA6NC (virO), phosphoglycolatephosphatase homolog (virP), (virQ), (virR), ORF3 transposasehomolog, and ORF4 transposase homolog genes, complete cds.] [NT:similar to phosphoglycolate phosphatase] |
| Contig089G | 20585826_c1_290 | 876 | 5002 | 747 | 248 | | | NO-HIT |
| Contig089G | 2150263_f1_150 | 877 | 5003 | 1104 | 367 | 271 | 1.40E−23 | pir:[LN:A70361] [AC:A70361] [PN:acriflavin resistance protein AcrE] [GN:acrE] [OR:Aquifex aeolicus] |
| Contig089G | 21572167_c3_411 | 878 | 5004 | 453 | 150 | 308 | 1.70E−27 | sp:[LN:NUSB_ECOLI] [AC:P04381] [GN:NUSB:SSYB] [OR:*ESCHERICHIA COLI*] [DE:N UTILIZATION SUBSTANCE PROTEIN B (NUSB PROTEIN)] [SP:P04381] |
| Contig089G | 21679702_c3_391 | 879 | 5005 | 1053 | 350 | 649 | 1.20E−63 | sp:[LN:ALC_YEAST] [AC:P25335] [GN:DAL2:ALC1:YIR029W] [OR:*SACCHAROMYCES CEREVISIAE*] [SR:,BAKER'S YEAST] [EC:3.5.3.4] [DE:ALLANTOICASE,] [SP:P25335] |
| Contig089G | 21876628_f2_78 | 880 | 5006 | 1497 | 498 | 660 | 8.40E−65 | gp:[GI:e1331956:g4106587] [LN:YP102KB] [AC:AL031866] [OR:*Yersinia pestis*] [DE:*Yersinia pestis* 102 kbases unstable region: from 1 to 119443.] [NT:ORF19, len: 473, similar to tyrosine] |
| Contig089G | 22003802_c2_317 | 881 | 5007 | 1410 | 469 | 1052 | 2.40E−106 | pir:[LN:A69905] [AC:A69905] [PN:conserved hypothetical protein yoeA] [GN:yoeA] [OR:*Bacillus subtilis*] |
| Contig089G | 22114142_f3_203 | 882 | 5008 | 210 | 69 | 104 | 5.70E−05 | sp:[LN:FTSZ_ENTHR] [AC:O08458] [GN:FTSZ] [OR:*ENTEROCOCCUS HIRAE*] [DE:CELL DIVISION PROTEIN FTSZ] [SP:O08458] |
| Contig089G | 2214050_f2_121 | 883 | 5009 | 840 | 279 | 592 | 1.30E−57 | pir:[LN:E70027] [AC:E70027] [PN:3-oxoacyl-acyl-carrier protein reductase homolog yvaG] [GN:yvaG] [CL:ribitol dehydrogenase:short-chain alcohol dehydrogenase homology] [OR:*Bacillus subtilis*] |

TABLE 2-continued

| Query | Orf | NT ID | AA ID | NT Lgth | AA Lgth | Score | P-value | Subject |
|---|---|---|---|---|---|---|---|---|
| Contig089G | 22304768__f3__151 | 884 | 5010 | 390 | 129 | | | NO-HIT |
| Contig089G | 23438506__c2__369 | 885 | 5011 | 183 | 60 | | | NO-HIT |
| Contig089G | 23445402__c2__352 | 886 | 5012 | 765 | 254 | 301 | 9.30E−27 | gp:[GI:g746513] [LN:CELD1022] [AC:U23517] [PN:D1022.4] [GN:D1022.4] [OR:*Caenorhabditis elegans*] [SR:*Caenorhabditis elegans* strain=Bristol N2] [DE:*Caenorhabditis elegans* cosmid D1022.] |
| Contig089G | 234750__c1__282 | 887 | 5013 | 717 | 238 | 132 | 3.30E−07 | pir:[LN:F69105] [AC:F69105] [PN:conserved hypothetical protein MTH1787] [GN:MTH1787] [OR:*Methanobacterium thenmoautotrophicum*] |
| Contig089G | 23479562__f1__12 | 888 | 5014 | 237 | 78 | | | NO-HIT |
| Contig089G | 23845308__c2__305 | 889 | 5015 | 576 | 191 | 163 | 3.90E−12 | gp:[GI:e1388169:g4455754] [LN:SC2G5] [AC:AL035478] [PN:hypothetical protein SC2G5.30] [GN:SC2G5.30] [OR:*Streptomyces coelicolor*] [DE:*Streptomyces coelicolor* cosmid 2G5] [NT:SC2G5.30, unknown, len: 19; limited similarity] |
| Contig089G | 23854640__f1__35 | 890 | 5016 | 1704 | 567 | 2706 | 1.30E−281 | gp:[GI:g409365] [LN:PSEHUTUU] [AC:M33923:M28362] [PN:urocanase] [GN:hutU] [OR:*Pseudomonas putida*] [SR:*Pseudomonas putida* (library: ATCC 12633) DNA] [DE:*Pseudomonas putida* urocanase (hutU) gene, complete cds.] |
| Contig089G | 23864051__c1__272 | 891 | 5017 | 906 | 301 | 903 | 1.50E−90 | pir:[LN:A64745] [AC:A64745:158331:JS0715] [PN:yafB protein] [GN:yafB] [CL:aldehyde reductase] [OR:*Escherichia coli*] [MP:5.2 min] |
| Contig089G | 23875442__c1__239 | 892 | 5018 | 555 | 184 | | | NO-HIT |
| Contig089G | 24001555__c3__410 | 893 | 5019 | 501 | 166 | 476 | 2.60E−45 | sp:[LN:RISB__HAEIN] [AC:P45149] [GN:RIBH:HI1303] [OR:*HAEMOPHILUS INFLUENZAE*] [EC:2.5.1.9] [DE:(LUMAZINE SYNTHASE) (RIBOFLAVIN SYNTHASE BETA CHAIN)] [SP:P45149] |
| Contig089G | 24226452__c3__390 | 894 | 5020 | 726 | 241 | 148 | 1.10E−08 | sp:[LN:OMPK__VIBPA] [AC:P51002] [GN:OMPK] [OR:*VIBRIO PARAHAEMOLYTICUS*] [DE:OUTER MEMBRANE PROTEIN OMPK PRECURSOR] [SP:P51002] |
| Contig089G | 2424187__c2__347 | 895 | 5021 | 732 | 243 | 808 | 1.70E−80 | sp:[LN:PUR7__ECOLI] [AC:P21155] [GN:PURC] [OR:*ESCHERICHIA COLI*] [EC:6.3.2.6] [DE:(SAICAR SYNTHETASE)] [SP:P21155] |
| Contig089G | 24313518__c2__300 | 896 | 5022 | 861 | 286 | 527 | 1.00E−50 | gp:[GI:g1079662] [LN:PAU38241] [AC:U38241:L12038] [PN:catabolite repression control protein] [GN:crc] [OR:*Pseudomonas aeruginosa*] [SR:*Pseudomonas aeruginosa* strain=PAOI] [DE:*Pseudomonas aeruginosa* orotate phophoribosyl transferase (pyrE),catabolite repression control protein (crc) and RNasePH (rph)genes, complete cds.] |

TABLE 2-continued

| Query | Orf | NT ID | AA ID | NT Lgth | AA Lgth | Score | P-value | Subject |
|---|---|---|---|---|---|---|---|---|
| Contig089G | 24313755_f1_64 | 897 | 5023 | 1479 | 492 | 1542 | 2.90E−158 | sp:[LN:MURC_ECOLI] [AC:P17952:007099] [GN:MURC] [OR:*ESCHERICHIA COLI*] [EC:6.3.2.8] [DE:ACETYLMURANOYL-L-ALANINE SYNTHETASE)] [SP:P17952:007099] |
| Contig089G | 24398387_f2_139 | 898 | 5024 | 969 | 322 | 780 | 1.60E−77 | sp:[LN:DDL_HAEIN] [AC:P44405] [GN:DDLB:HI1140] [OR:*HAEMOPHILUS INFLUENZAE*] [EC:6.3.24] [DE:D-ALANINE--D-ALANINE LIGASE, (D-ALANYLALANINE SYNTHETASE)] [SP:P44405] |
| Contig089G | 24412812_f3_181 | 899 | 5025 | 183 | 60 | | | NO-HIT |
| Contig089G | 24490943_c2_375 | 900 | 5026 | 291 | 96 | | | NO-HIT |
| Contig089G | 24500250_f1_33 | 901 | 5027 | 1431 | 476 | 1575 | 9.20E−162 | pir:[LN:QRECAA] [AC:H64733:JS0447:S10720:S45191] ]PN:aromatic amino acid transport protein aroP] [GN:aroP] [CL:arginine permease] [OR:*Escherichia coli*] [MP:2.6 min] |
| Contig089G | 24643827_f1_44 | 902 | 5028 | 486 | 161 | | | NO-HIT |
| Contig089G | 24646013_f3_163 | 903 | 5029 | 651 | 216 | 375 | 1.30E−34 | sp:[LN:YDJB_ECOLI] [AC:P21369:P76229:P76910] [GN:YDJB] [OR:*ESCHERICHIA COLI*] ]DE:HYPOTHETICAL 23.4 KD PROTEIN IN ANSA-GAPA INTERGEIC REGION] [SP:P21369:P76229:P76910] |
| Contig089G | 24844575_c2_326 | 904 | 5030 | 1308 | 435 | | | NO-HIT |
| Contig089G | 2537943_c2_349 | 905 | 6031 | 852 | 283 | 477 | 2.10E−45 | sp:[LN:YFDC_ECOLI] [AC:P37327] [GN:YFDC] [OR:*ESCHERICHIA COLI*] [DE:HYPOTHETICAL 34.5 KD PROTEIN IN VACJ-ARGW INTERGENIC REGION] [SP:P37327] |
| Contig089G | 25431530_f2_93 | 906 | 5032 | 579 | 192 | 368 | 7.40E−34 | sp:[LN:YHUT_PSEPU] [AC:P24696] [OR:*PSEUDOMONAS PUTIDA*] [DE:HYPOTHETICAL 21.2 KD PROTEIN IN HUTC 3'REGION] [SP:P24696] |
| Contig089G | 25601562_c3_442 | 907 | 5033 | 378 | 125 | | | NO-HIT |
| Contig089G | 25630385_c2_353 | 908 | 5034 | 561 | 186 | 225 | 1.40E−18 | pir:[LN:D70015] [AC:D70015] [PN:hypothetical protein yunA] [GN:yunA] [OR:*Bacillus subtilis*] |
| Contig089G | 25665953_f1_66 | 909 | 5035 | 1266 | 421 | 543 | 2.10E−52 | sp:[LN:FTSA_ECOLI] [AC:P06137:Q47229] [GN:FTSA:DIVA] [OR:*ESCHERICHIA COLI*] [DE:CELL DIVISION PROTEIN FTSA] [SP:P06137:Q47229] |
| Contig089G | 25900407_f2_137 | 910 | 5036 | 1101 | 366 | 793 | 6.80E−79 | sp:[LN:MURG_HAEIN] [AC:P45065] [GN:MURG:HI1138] [OR:*HAEMOPHILUS INFLUENZAE*] [EC:2.4.1.—] [DE:(EC 2.4.1.—)] [SP:P45065] |
| Contig089G | 26210288_f3_161 | 911 | 5037 | 1308 | 435 | 922 | 1.40E−92 | sp:[LN:YCAJ_HAEIN] [AC:P45262] [GN:HI1590] [OR:*HAEMOPHILUS INFLUENZAE*] [DE:HYPOTHETICAL PROTEIN HI1590] [SP:P45262] |
| Contig089G | 26375327_c1_262 | 912 | 5038 | 780 | 259 | 213 | 2.00E−17 | gp [GI:g3378263] [LN:AF079317] [AC:AF079317] [PN:regulator] [GN:orf007] [OR:*Sphingomonas aromaticivorans*] [DE:*Sphingomonas aromaticivorans* plasmid pNL1, complete plasmidsequence.] [NT:similar to *R. opacus* CatR putative regulator of] |

TABLE 2-continued

| Query | Orf | NT ID | AA ID | NT Lgth | AA Lgth | Score | P-value | Subject |
|---|---|---|---|---|---|---|---|---|
| Contig089G | 26379755_c2_302 | 913 | 5039 | 1236 | 411 | 320 | 1.60E−32 | pir:[LN:H70302] [AC:H70302] [PN:conserved hypothetical protein aq_35] [GN:aq_035] [OR:*Aquifex aeolicus*] |
| Contig089G | 26757712_f3_160 | 914 | 5040 | 1191 | 396 | 574 | 1.10E−55 | sp:[LN:YIHZ_ECOLI] [AC:P75804] [GN:YLII] [OR:*ESCHERICHIA COLI*] [DE:HYPOTHETICAL 41.1 KD PROTEIN IN MOEA-DACC INTERGENIC REGION PRECURSOR] [SP:P75804] |
| Contig089G | 275317_f1_54 | 915 | 5041 | 402 | 133 | | | NO-HIT |
| Contig089G | 29298767_f3_179 | 916 | 5042 | 408 | 135 | | | NO-HIT |
| Contig089G | 2932700_c3_408 | 917 | 5043 | 465 | 154 | 396 | 7.90E−37 | sp:[LN:YIHZ_ECOLI] [AC:P32147] [GN:YIHZ] [OR:*ESCHERICHIA COLI*] [DE:HYPOTHETICAL 15.9 KD PROTEIN IN RBN-FDHE INTERGENIC REGION (O145)] [SP:P32147] |
| Contig089G | 293_f2_87 | 918 | 5044 | 1356 | 451 | 435 | 5.80E−41 | sp:[LN:YDHE_HAEIN] [AC:P45272] [GN:HI1612] [OR:*HAEMOPHILUS INFLUENZAE*] [DE:HYPOTHETICAL PROTEIN HI1612] [SP:P45272] |
| Contig089G | 2992215_f2_132 | 919 | 5045 | 744 | 247 | 624 | 5.50E−61 | sp:[LN:PYRE_ECOLI] [AC:P00495] [GN:PYRE] [OR:*ESCHERICHIA COLI*] [EC:2.4.2.10] [DE:OROTATE PHOSPHORIBOSYLTRANSFERASE, (OPRT)(OPRTASE)] [SP:P00495] |
| Contig089G | 29938433_c1_220 | 920 | 5046 | 372 | 123 | 230 | 3.10E−19 | gp:[GI:g3511128] [LN:AF060858] [AC:AF060858] [PN:unknown] [OR:*Salmonella dublin*] [DE:*Salmonella dublin* regulatory protein CopR (copR), histidine kinase(copS), SPI-4 pathogenicity island containing dipeptidase homolog(pipD), SopB (sopB), PipC (pipC), PipB (pipB), and PipA (pipA)genes, complete cds; and tRNA-Ser gene, complete sequence; andunknown genes.] [NT:ORF3] |
| Contig089G | 29956561_f2_95 | 921 | 5047 | 1257 | 418 | 1298 | 2.10E−132 | gp:[GI:e1331945:g4106576] [LN:YP102KB] [AC:AL031866] [GN:hutl] [OR:*Yersinia pestis*] [DE:*Yersinia pestis* 102 kbases unstable region: from 1 to 119443.] [NT:ORF9, len:406, hutl, highly similar to imidazolone] |
| Contig089G | 30265917_c3_452 | 922 | 5048 | 1365 | 454 | 800 | 1.20E−79 | sp:[LN:SUN_ECOLI] [AC:P36929:P23866] [GN:SUN:FMU:FMV:RSMB] [OR:*ESCHERICHIA COLI*] [DE:SUN PROTEIN (FMU PROTEIN)] [SP:P36929:P23866] |
| Contig089G | 30270958_f1_51 | 923 | 5049 | 1590 | 529 | 887 | 7.40E−89 | pir:[LN:SYECEC] [AC:A65049:A24136] [PN:glutamate--cysteine ligase,:gamma-glutamylcysteine synthetase] [GN:gshA (gshI)] [CL:glutamate--cysteine ligase] [OR:*Escherichia coli*] [EC:6.3.2.2] [MP:58 min] |
| Contig089G | 30272213_f2_119 | 924 | 5050 | 789 | 262 | 92 | 0.00053 | gp:[GI:g3986497] [LN:AF091806] [AC:AF091806] [PN:M protein] [GN:emm] [OR:*Streptococcus pyogenes*] [DE:*Streptococcus pyogenes* strain cmuk16 M protein (emm) gene, partialcds.] [RE: |

TABLE 2-continued

| Query | Orf | NT ID | AA ID | NT Lgth | AA Lgth | Score | P-value | Subject |
|---|---|---|---|---|---|---|---|---|
| Contig089G | 31440668_c1_288 | 925 | 5051 | 1017 | 338 | 830 | 8.10E−83 | sp:[LN:FMT_ECOLI] [AC:P23882] [GN:FMT] [OR:*ESCHERICHIA COLI*] [EC:2.1.2.9] [DE:METHIONYL-TRNA FORMYLTRANSFERASE,] [SP:P23882] |
| Contig089G | 32952_f2_89 | 926 | 5052 | 1056 | 351 | 1331 | 6.60E−136 | sp:[LN:HPPD_PSESP] [AC:P80064] [OR:PSEUDOMONAS SP] [EC:1.13.11.27] [DE:4-HYDROXYPHENYLPYRUVATE DIOXYGENASE, (4HPPD) (HPD)] [SP:P80064] |
| Contig089G | 33255260_c2_372 | 927 | 5053 | 183 | 60 | | | NO-HIT |
| Contig089G | 33392325_f2_128 | 928 | 5054 | 780 | 259 | | | NO-HIT |
| Contig089G | 33409701_c3_426 | 929 | 5055 | 1170 | 389 | 205 | 1.50E−13 | gp:[GI:e1347586:g3878032] [LN:CEH12119] [AC:Z98851] [GN:H12119.5b] [OR:*Caenorhabditis elegans*] [DE:*Caenorhabditis elegans* cosmid H12119, complete sequence.] |
| Contig089G | 33724166_c2_343 | 930 | 1056 | 600 | 199 | 128 | 2.00E−08 | gp:[GI:g727361] [LN:NDU22355] [AC:U22355] [PN:2,3-dihydroxybiphenyl dioxygenase] [OR:naphthalenesulfonate-degrading bacterium BN6] [SR:Naphthalenesulfonate-degrading bacterium BN6] [DE:Naphthalenesulfonate degrading bacterium BN6 2,3-dihydroxybiphenyldioxygenase (bphC) gene, complete cds.] |
| Contig089G | 33789077_f1_38 | 931 | 5057 | 1827 | 608 | 120 | 1.20E−12 | gp:[GI:e1169573:g2584793] [LN:MHP120GEN] [AC:Y13476] [PN:P120' protein] [GN:p120'] [OR:*Mycoplasma hominis*] [DE:*Mycoplasma hominis* p120' gene.] |
| Contig089G | 33838187_f2_74 | 932 | 5058 | 3162 | 1053 | 461 | 4.20E−80 | pir:[LN:F71727] [AC:F71727] [PN:acriflavin resistance protein D (acrD) RP170] [GN:acrD:RP170] [OR:*Rickettsia prowazekii*] |
| Contig089G | 33867127_f3_197 | 933 | 5059 | 501 | 166 | | | NO-HIT |
| Contig089G | 33867293_f1_41 | 934 | 5060 | 219 | 72 | | | NO-HIT |
| Contig089G | 34265767_f3_200 | 935 | 5061 | 468 | 155 | 588 | 3.60E−57 | gp:[GI:g1209222] [LN:ACCEST] [AC:L38252] [OR:*Acinetobacter lwoffii*] [DE:*Acinetobacter lwoffii* orf1 and esterase (est) genes, complete cds.] [NT:orf1] |
| Contig089G | 34381287_c2_342 | 936 | 5062 | 1383 | 460 | 1243 | 1.40E−126 | sp:[LN:FAAA_HUMAN] [AC:P16930] [GN:FAH] [OR:HOMO SAPIENS] [EC:3.7.1.2] [DE:(BETA-DIKETONASE) (FAA)) [SP:P16930] |
| Contig089G | 34414052_f3_187 | 937 | 5063 | 534 | 177 | 300 | 1.20E−26 | sp:[LN:YA21_PSEAE] [AC:P21482] [OR:*PSEUDOMONAS AERUGINOSA*] [DE:HYPOTHETICAL 17.8 KD PROTEIN IN ALGR2 5'REGION] [SP:P21482] |
| Contig089G | 35192183_f1_65 | 938 | 5064 | 882 | 293 | 223 | 1.70E−18 | sp:[LN:FTSQ_ECOLI] [AC:P06136] [GN:FTSQ] [OR:*ESCHERICHIA COLI*] [DE:CELL DIVISION PROTEIN FTSQ] [SP:P06136] |

TABLE 2-continued

| Query | Orf | NT ID | AA ID | NT Lgth | AA Lgth | Score | P-value | Subject |
|---|---|---|---|---|---|---|---|---|
| Contig089G | 35391886_f3_170 | 939 | 5065 | 1326 | 441 | 722 | 1.10E−110 | gp:[GI:g4139234] [LN:AF110185] [AC:AF110185] [PN:unknown] [OR:*Burkholderia pseudomallei*] [DE:*Burkholderia pseudomallei* strain 1026b DbhB (dbhB), generalsecretory pathway protein D (gspD), general secretory pathwayprotein E (gspE), general secretory pathway protein F (gspF), GspC(gspC), general secretory pathway protein G (gspG), generalsecretory pathway protein H (gspH), general secretory pathwayprotein I (gspI), general secretory pathway protein ] (gspJ),general secretory pathway protein K (gspK), general secretorypathway protein L (gspL), general secretory pathway protein M(gspM), and general secretory pathway protein N (gspN) genes,complete cds; and unknown genes.] [NT:similar to *Bacillus subtilis* YciC and Pseudomonas] |
| Contig089G | 35400262_c2_330 | 940 | 5066 | 1842 | 613 | 1797 | 2.70E−185 | pir:[LN:D64067] [AC:D64067] [PN:glutamine--fructose-6-phosphate transaminase (isomerizing),] [CL:glutamine--fructose-6-phosphate aminotransferase (isomerizing)] [OR:*Haemophilus influenzae*] [EC:2.6.1.16] |
| Contig089G | 35721027_c3_381 | 941 | 5067 | 216 | 71 | | | NO-HIT |
| Contig089G | 36516267_c3_432 | 942 | 5068 | 495 | 164 | 439 | 2.20E−41 | pir:[LN:F69744] [AC:F69744] [PN:hypothetical protein ybbK] [GN:ybbK] [OR:*Bacillus subtilis*] |
| Contig089G | 36570266_c3_397 | 943 | 5069 | 1362 | 453 | | | NO-HIT |
| Contig089G | 3907508_c3_448 | 944 | 5070 | 1305 | 434 | 1453 | 7.80E−149 | sp:[LN:YCDG_ECOLI] [AC:P75892] [GN:YCDG] [OR:*ESCHERICHIA COLI*] [DE:HYPOTHETICAL 48.1 KD PROTEIN IN WRBA-PUTA INTERGENIC REGION] [SP:P75892] |
| Contig089G | 3907688_c2_354 | 945 | 5071 | 255 | 84 | | | NO-HIT |
| Contig089G | 3912762_f2_92 | 946 | 5072 | 693 | 230 | | | NO-HIT |
| Contig089G | 3913175_c2_299 | 947 | 5073 | 2232 | 743 | 541 | 1.20E−50 | pir:[LN:S74447] [AC:S74447] [PN:ferrichrome-iron receptor 1:protein sll1409:protein sll1409] [GN:fhuA_1] [CL:ferrichrome-iron receptor 1:tonB-dependent receptor amino-terminal homology:tonB-dependent receptor carboxyl-terminal homology] [OR:Synechocystis sp.] [SR:PCC 6803,, PCC 6803] [SR:PCC 6803,] |
| Contig089G | 3913963_c1_267 | 948 | 5074 | 615 | 204 | | | NO-HIT |
| Contig089G | 3914056_c3_405 | 949 | 5075 | 1368 | 455 | 734 | 1.20E−72 | gp:[GI:g3282775] [LN:AF043352] [AC:AF043352] [PN:histidine protein kinase PhoR] [GN:phoR] [OR:*Vibrio cholerae*] [DE:*Vibrio cholerae* response regulator homolog PhoB (phoB) andhistidine protein kinase PhoR (phoR) genes, complete cds.] |
| Contig089G | 3953178_f3_172 | 950 | 5076 | 762 | 253 | 783 | 7.80E−78 | sp:[LN:HUTC_PSEPU] [AC:P22773] [GN:HUTC] [OR:*PSEUDOMONAS PUTIDA*] [DE:HISTIDINE UTILIZATION REPRESSOR] [SP:P22773] |

TABLE 2-continued

| Query | Orf | NT ID | AA ID | NT Lgth | AA Lgth | Score | P-value | Subject |
|---|---|---|---|---|---|---|---|---|
| Contig089G | 3955213_f3_194 | 951 | 5077 | 1167 | 388 | 421 | 1.80E−39 | gp:[GI:g2290996] [LN:AF006000] [AC:AF006000] [PN:unknown] [OR:*Bordetella pertussis*] [DE:*Bordetella pertussis* D-3-phosphoglycerate dehydrogenase homolog(serA) and Brg1 (brg1) genes, complete cds.] [NT:orf4; similar to salicylate hydroxylase] |
| Contig089G | 3995388_c2_348 | 952 | 5078 | 213 | 70 | | | NO-HIT |
| Contig089G | 4025055_f2_107 | 953 | 5079 | 1224 | 407 | 833 | 3.90E−83 | sp:[LN:PNCB_ECOLI] [AC:P18133] [GN:PNCB] [OR:*ESCHERICHIA COLI*] [EC:2.4.2.11] [DE:NICOTINATE PHOSPHORIBOSYLTRANSFERASE, (NAPRTASE)] [SP:P18133] |
| Contig089G | 40626_c3_430 | 954 | 5080 | 666 | 221 | 457 | 2.70E−43 | gp:[GI:g4220435] [LN:AF036940] [AC:AF036940:AF081362] [PN:similar to glutathione-s-transferase] [GN:nagL] [OR:Pseudomonas sp. U2] [DE:Pseudomonas sp. U2 plasmid pWWU2, ferredoxin reductase (nagAa),salicylate-5-hydroxylase large oxygenase component (nagG),salicylate-5-hydroxylase small oxygenase component (nagH),ferredoxin (nagAb), naphthaiene dioxygenase large oxygenasecomponent (nagAc), naphthalene dioxygenase small oxygenasecomponent (nagAd), cis-naphthalene dihydrodiol dehydrogenase(nagB), salicylaldehyde dehydrogenase (nagF),1,2-dihydroxynaphthalene dioxygenase (nagC), putative aldolase(nagQ), hydrolaselaldolase (nagE), 2-hydroxychromene carboxylateisomerase (nagD), similar to glutathione S-transferase (nagJ).gentisate 1,2-dioxygenase (nagI), putative isomerase-decarboxylase(nagK), and similar to glutathione-s-transferase (nagL) genes,complete cds; and NagM (nagM) gene, partial cds.] [NT:GSTII] |
| Contig089G | 4064077_f1_39 | 955 | 5081 | 336 | 111 | | | NO-HIT |
| Contig089G | 4098463_c1_242 | 956 | 5082 | 1164 | 387 | 930 | 2.10E−93 | sp:[LN:YBDL_ECOLI] [AC:P77806] [GN:YBDL] [OR:*ESCHERICHIA COLI*] [EC:2.6.1.—] [DE:HYPOTHETICAL AMINOTRANSFERASE YBDL,] [SP:P77806] |
| Contig089G | 4101588_c1_221 | 957 | 5083 | 1377 | 458 | 813 | 5.10E−81 | sp:[LN:YUNK_BACSU] [AC:O32140] [GN:YUNK] [OR:*BACILLUS SUBTILIS*] [DE:HYPOTHETICAL 44.9 KD PROTEIN IN HOM-MRGA INTERGENIC REGION] [SP:O32140] |
| Contig089G | 4161013_c1_241 | 958 | 5084 | 1320 | 439 | 442 | 1.10E−41 | sp:[LN:YJIN_ECOLI] [AC:P39385] [GN:YJIN] [OR:*ESCHERICHIA COLI*] [DE:HYPOTHETICAL 48.2 KD PROTEIN IN IADA-MCRD INTERGENIC REGION (F426)] [SP:P39385] |
| Contig089G | 4304517_f2_106 | 959 | 5085 | 1233 | 410 | 648 | 1.60E−63 | pir:[LN:E70860] [AC:E70860] [PN:probable serB2 protein] [PN:serB2] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig089G | 4353463_f2_127 | 960 | 5086 | 555 | 184 | 117 | 0.0002 | sp:[LN:YIL2_YEAST] [AC:P40480] [6N:YIL112W] [OR:*SACCHAROMYCES CEREVISIAE*] [SR:,BAKER'S YEAST] [DE:HYPOTHETICAL 123.6 KD PROTEIN IN POR2-COX5B INTERGENIC REGION] [SP:P40480] |
| Contig089G | 4412937_f2_108 | 961 | 5087 | 1164 | 287 | 460 | 1.30E−43 | sp:[LN:THTR_AZOVI] [AC:P52197] [GN:RHDA] [OR:*AZOTOBACTER VINELANDII*] [EC:2.8.1.1] [DE:THIOSULFATE SULFURTRANSFERASE, (RHODANESE-LIKE PROTEIN)] [SP:P52197] |
| Contig089G | 4471037_f2_94 | 962 | 5088 | 1470 | 489 | 1711 | 3.60E−176 | gp:[61:g2642339] [LN:AF032970] [AC:AF032970] [PN:inducible histidine transporter] [GN:hutT] [OR:*Pseudomonas putida*] [DE:*Pseudomonas putida* inducible histidine transporter (hutT),imidazolone propionate hydrolase (hutI), and N-formylglutamateamidohydrolase (hutG) genes, complete cds; and prolineiminopeptidase (pipI) gene, partial cds.] |
| Contig089G | 4484380_f1_3 | 963 | 5089 | 1500 | 499 | 1233 | 1.60E−125 | sp:[LN:Y736_HAEIN] [AC:P44849] [GN:HI0736] [OR:*HAEMOPHILUS INFLUENZAE*] [DE:HYPOTHETICAL SODIUM-DEPENDENT TRANSPORTER H10736] [SP:P44849] |
| Contig089G | 4488563_f1_36 | 964 | 5090 | 1548 | 515 | 2053 | 2.00E−212 | sp:[LN:HUTH_PSEPU] [AC:P21310] [GN:HUTH] [OR:*PSEUDOMONAS PUTIDA*] [EC:4.3.1.3] [DE:HISTIDINE AMMONIA-LYASE, (HISTIDASE)] [SP:P21310] |
| Contig089G | 4571876_c1_252 | 965 | 5091 | 555 | 184 | 373 | 2.20E−34 | sp:[LN:PGPA_ECOLI] [AC:P18200:P77321] [GN:PGPA] [OR:*ESCHERICHIA COLI*] [EC:3.1.3.27] [DE:PHOSPHATIDYLGLYCERO PHOSPHATASE A,] [SP:P18200:P77321] |
| Contig089G | 4722305_c1_266 | 966 | 5092 | 1026 | 341 | 790 | 1.40E−78 | sp:[LN:DAPA_HAEIN] [AC:P43797] [GN:DAPA:H10255] [OR:*HAEMOPHILUS INFLUENZAE*] [EC:4.2.1.52] [DE:DIHYDRODIPICOLINATE SYNTHASE, (DHDPS)] [SP:P43797] |
| Contig089G | 4772183_c1_265 | 967 | 5093 | 330 | 109 | | | NO-HIT |
| Contig089G | 4884593_f1_53 | 968 | 5094 | 2157 | 718 | 119 | 3.00E−06 | gp:[GI:g1196687] [LN:P29G16A] [AC:M14431] [OR:Bacteriophage phi-29] [SR:Bacteriophage phi-29 (clone:.) DNA] [DE:Bacteriophage phi-29 gene-16 gene. complete cds.] [NT:pre gene-16 ORF protein; putative] |
| Contig089G | 4900258_c3_439 | 969 | 5095 | 408 | 135 | | | NO-HIT |
| Contig089G | 5084425_f3_199 | 970 | 5096 | 1824 | 607 | 654 | 1.30E−80 | pir:[LN:S56364] [AC:S56364:141028:141037:S42064:F65223:S57220:S47295] [PN:inner membrane copper tolerance protein cycZ:thiol:disulfide interchange protein dsbd] [GN:dsbD:cycZ:CutA2:dipZ] [OR:*Escherichia coli*] |

TABLE 2-continued

| Query | Orf | NT ID | AA ID | NT Lgth | AA Lgth | Score | P-value | Subject |
|---|---|---|---|---|---|---|---|---|
| Contig089G | 5110178_f1_2 | 971 | 5097 | 606 | 201 | 245 | 8.00E−21 | sp:[LN:GSTA_RHILE] [AC:Q52828] [GN:GSTA] [OR:*RHIZOBIUM LEGUMINOSARUM*] [DE:GSTA PROTEIN] [SP:Q52828] |
| Contig089G | 5269637_c2_355 | 972 | 5098 | 591 | 196 | 511 | 5.20E−49 | sp:[LN:3MGA_HAEIN] [AC:P44321] [GN:TAG:H10654] [OR:*HAEMOPHILUS INFLUENZAE*] [EC:3.2.2.20] [DE:GLYCOSYLASE) (TAG)] [SP:P44321] |
| Contig089G | 5272092_c2_298 | 973 | 5099 | 222 | 73 | | | NO-HIT |
| Contig089G | 603165_f3_164 | 974 | 5100 | 978 | 325 | 946 | 4.10E−95 | pir:[LN:E69902] [AC:E69902] [PN:sodium-dependent transporter homolog yocS] [GN:yocS] [OR:*Bacillus subtilis*] |
| Contig089G | 6255455_f3_157 | 975 | 5101 | 192 | 63 | | | NO-HIT |
| Contig089G | 6263_f2_70 | 976 | 5102 | 1314 | 437 | | | NO-HIT |
| Contig089G | 6327_c3_447 | 977 | 5103 | 2787 | 928 | 2264 | 9.00E−235 | sp:[LN:CAPP_ECOLI] [AC:P00864] [GN:PPC:GLU] [OR:*ESCHERICHIA COLI*] [EC:4.1.13A] [DE:PHOSPHOENOLPYRUVATE CARBOXYLASE, (PEPCASE) (PEPC)] [SP:P00864] |
| Contig089G | 6898438_f2_136 | 978 | 5104 | 1008 | 335 | 905 | 9.20E−91 | sp:[LN:GSHB_ECOLI] [AC:P04425] [GN:GSHB:GSH-II] [OR:*ESCHERICHIA COLI*] [EC:6.3.2.3] [DE:SYNTHETASE) (GSH-S) (GSHASE)] [SP:P04425] |
| Contig089G | 7089625_c3_414 | 979 | 5105 | 198 | 65 | | | NO-HIT |
| Contig089G | 79507_c1_232 | 980 | 5106 | 189 | 62 | | | NO-HIT |
| Contig089G | 867128_c2_329 | 981 | 5107 | 1386 | 461 | 1339 | 9.40E−137 | sp:[LN:GLMU_HAEIN] [AC:P43889] [GN:GLMU:H10642] [OR:*HAEMOPHILUS INFLUENZAE*] [EC:2.7.7.23] [DE:ACETYLGLUCOSAMINE-1-PHOSPHATE URIDYLTRANSFERASE)] [SP:P43889] |
| Contig089G | 900432_f2_71 | 982 | 5108 | 735 | 244 | 118 | 5.30E−05 | gp:[GI:g4204415] [LN:AF047001] [AC:AF047001] [PN:unknown] [OR:*Oenococcus oeni* temperate bactcriophage fOg44] [DE:*Oenococcus oeni* temperate bacteriophage fOg44 Lys44 and Int44genes complete cds; and unknown genes.] [NT:orf252] |
| Contig089G | 906252_c1_284 | 983 | 5109 | 918 | 305 | 457 | 2.70E−43 | gp:[GI:g3419687] [LN:ASU77659] [AC:U77659] [PN:unknown] [OR:*Acinetobacter lwoffii* K24] [DE:*Acinetobacter lwoffii* K24 cic,cis-muconate lactonizing enzyme 1(caTB), catechol 1,2-dioxygenase (catA), and muconolactoneisomerase (catC) genes, complete cds; and unknown genes.] |
| Contig089G | 975312_c1_214 | 984 | 5110 | 960 | 319 | 1292 | 9.00E−132 | gp:[GI:g1209223[LN:ACCEST] [AC:L38252] [PN:esterase] [GN:est] [OR:*Acinetobacter lwoffii*] [DE:*Acinetobacter lwoffii* orf1 and esterase (est) genes, complete cds.] |
| Contig089G | 9806537_c2_331 | 985 | 5111 | 627 | 208 | 248 | 3.80E−21 | sp:[LN:YEAS_ECOLI] [AC:P76249:O07971:O07969] [GN:YEAS] [OR:*ESCHERICHIA COLI*] [DE:HYPOTHETICAL 23.2 KD PROTEIN IN GAPA-RND INTERGENIC REGION] [SP:P76249:O07971:O07969] |
| Contig089G | 9878916_c2_306 | 986 | 5112 | 192 | 63 | | | NO-HIT |
| Contig089G | 9940916_c3_399 | 987 | 5113 | 600 | 199 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig090G | 10189410_c1_431 | 988 | 5114 | 1326 | 441 | 813 | 5.10E−81 | sp:[LN:FOLC_ECOLI] [AC:P08192:P78237] [GN:FOLC:DEDC] [OR:*ESCHERICHIA COLI*] [EC:6.3.2.17:6.3.2.12] [DE:SYNTHETASE) (FPGS)/ DIHYDROFOLATE SYNTHASE,] [SP:P08192:P78237] |
| Contig090G | 10316500_f3_369 | 989 | 5115 | 240 | 79 | 98 | 3.00E−05 | sp:[LN:TRAR_ECOLI] [AC:P41065] [GN:TRAR] [OR:*ESCHERICHIA COLI*] [DE:TRAR PROTEIN] [SP:P41065] |
| Contig090G | 10345013_f2_214 | 990 | 5116 | 1842 | 613 | 1174 | 2.90E−119 | gp:[GI:g3172117] [LN:ACCPCAOP] [AC:L05770:U04359:M33798:U20284:U11554:L13114:L03407] [PN:acyl-CoA dehydrogenase] [OR:Acinetobacter sp. ADPI] [DE:Acinetobacter sp. ADPI pca-qui-pob supraoperonic cluster, completesequence.] [NT:encodes protein similar to acyl-CoA dehydrogenase] |
| Contig090G | 10554502_f1_13 | 991 | 5117 | 564 | 187 | 88 | 0.00069 | pir:[LN:S60805] [AC:S60805] [PN:M protein precursor] [CL:M5 protein] [OR:*Streptococcus pyogenes*] [SR:serotype M27, serotype M27] [SR:serotype M27,] |
| Contig090G | 10682837_f2_259 | 992 | 5118 | 546 | 181 | 89 | 0.00049 | gp:[GI:g3064163] [LN:AF036417] [AC:AF036417] [PN:mucin-like protein] [GN:EMUCe-5] [OR:*Trypanosoma cruzi*] [DE:*Trypanosoma cruzi* mucin-like protein (EMUCe-5) mRNA, partial cds.] [RE: |
| Contig090G | 10742005_f3_365 | 993 | 5119 | 411 | 136 | 283 | 7.50E−25 | gp:[GI:d1037230:g4063790] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf17; similar to W gene of P2:baseplate] |
| Contig090G | 10820343_f1_295 | 994 | 5120 | 726 | 241 | 107 | 9.20E−10 | pir:[LN:C69266] [AC:C69266] [PN:AND(P)H-flavin oxidoreductase homolog] [OR:*Archaeoglobus fulgidus*] |
| Contig090G | 10976567_f1_375 | 995 | 5121 | 324 | 107 | | | NO-HIT |
| Contig090G | 11049077_c1_396 | 996 | 5122 | 1068 | 355 | 328 | 1.30E−29 | sp:[LN:YF72_HAEIN] [AC:P46495] [GN:HI1572] [OR:*HAEMOPHILUS INFLUENZAE*] [DE:PUTATIVE INTEGRASE/RECOMBINASE HI1572] [SP:P46495] |
| Contig090G | 11054658_f3_342 | 997 | 5123 | 207 | 68 | | | NO-HIT |
| Contig090G | 11213125_c2_631 | 998 | 5124 | 222 | 73 | | | NO-HIT |
| Contig090G | 115666_f3_305 | 999 | 5125 | 1740 | 579 | 2029 | 7.10E−210 | sp:[LN:SYP_HAEIN] [AC:P43830] [GN:PROS:H10729] [OR:*HAEMOPHILUS INFLUENZAE*](EC:6.1.1.15] [DE:PROLYL-TRNA SYNTHETASE, (PROLINE--TRNA LIGASE) (PRORS)] [SP:P43830] |

TABLE 2-continued

| Query | Orf | NT ID | AA ID | NT Lgth | AA Lgth | Score | P-value | Subject |
|---|---|---|---|---|---|---|---|---|
| Contig090G | 12500086_c2_616 | 1000 | 5126 | 1083 | 360 | 331 | 6.10E−30 | gp:[GI:g1657970] [LN:PAU73506] [AC:U73506] [PN:OruR] [GN:oruR] [OR:*Pseudomonas aeruginosa*] [DE:*Pseudomonas aeruginosa* ornithine utilization regulatory (oruR)gene, complete cds.] [NT:regulatory locus for ornithine utilization] |
| Contig090G | 12681708_c3_724 | 1001 | 5127 | 861 | 286 | 428 | 3.20E−40 | sp:[LN:MREC_HAEIN] [AC:P44475] [GN:MREC:H10038] [OR:*HAEMOPHILUS INFLUENZAE*] [DE:ROD SHAPE-DETERMINING PROTEIN MREC] [SP:P44475] |
| Contig090G | 12687800_f1_105 | 1002 | 5128 | 264 | 87 | 122 | 8.60E−08 | gp:[GI:d1037248:g4063808] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf34] |
| Contig090G | 127180_c1_398 | 1003 | 5129 | 366 | 121 | 87 | 0.00044 | pir:[LN:C69774] [AC:C69774] [PN:transcription regulator phage-related homolog ydcN] [GN:ydcN] [OR:*Bacillus subtilis*] |
| Contig090G | 12922207_f1_87 | 1004 | 5130 | 1788 | 595 | 725 | 1.10E−71 | gp:[GI:e1287203:g3063885] [LN:MLCB1883.21c] [PN:putative acyl-coA dehydrogenase] [GN:MLCB1883.21c] [OR:*Mycobacterium leprae*] [DE:*Mycobacterium leprae* cosmid B1883.] [NT:MLCB1883.21c, probable acyl-coA dehydrogenase, len:] |
| Contig090G | 13175068_c2_528 | 1005 | 5131 | 222 | 73 | | | NO-HIT |
| Contig090G | 132252_f3_298 | 1006 | 5132 | 804 | 267 | 177 | 9.90E−12 | gp:[GI:g3056882] LN:APU33059] [AC:U33059] [PN:unknown] OR:*Actinosynnema pretiosum suranticum*] [DE:*Actinosynnema pretiosum auranticum* diaminopimelate decarboxylase(lysA), 3-amino-5-hydroxybenzoic acid synthase, oxidoreductase,phosphatase, and aminodehydroquinate synthase genes, complete cds;transcription activator gene, partial cds; and unknown genes.] NT:ORF5; similar to transmembrane proteins EpiH and] |
| Contig090G | 134666_f2_240 | 1007 | 5133 | 522 | 173 | 530 | 5.00E−51 | gp:[GI:d1037236:g4063796] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf23;similar to F2 gene of P2] |
| Contig090G | 1361305_c1_467 | 1008 | 5134 | 402 | 133 | 418 | 3.70E−39 | sp:[LN:PILH_PSEAE] [AC:P43501] [GN:PILH] [OR:*PSEUDOMONAS AERUGINOSA*] [DE:PILH PROTEIN] [SP:P43501] |
| Contig090G | 13847000_c2_602 | 1009 | 5135 | 312 | 103 | | | NO-HIT |
| Contig090G | 13867202_f2_145 | 1010 | 5136 | 801 | 266 | 102 | 3.40E−05 | pir:[LN:C70826] [AC:C70826] [PN:hypothetical protein Rv0674] [GN:Rv0674] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig090G | 13949127_f2__108 | 1011 | 5137 | 831 | 276 | 286 | 3.60E−25 | pir:[LN:A57258] [AC:A57258] [PN:rha protein] [OR:phage phi-80] |
| Contig090G | 1415876_f2__177 | 1012 | 5138 | 3102 | 1033 | 1380 | 4.20E−141 | gp:[GI:g4155092] [LN:AE001487] [AC:AE001487:AE001439] [PN:putative efflux transporter] [GN:jhp0554] [OR:*Helicobacter pylori* J99] [DE:*Helicobacter pylori*, strain J99 section 48 of 132 of the completegenome.] [NT:similar to *H. pylori* 26695 gene HP0607] |
| Contig090G | 14172767_f1__101 | 1013 | 5139 | 288 | 95 | 111 | 1.30E−06 | gp:[GI:g3139111] [LN:AF063097] [AC:AF063097:J02474:X02300:X 02301:M58023:M13202:L29304: X87173:M6467 7] [PN:gpE+E'] [GN:E+E'] [FN:essential tail protein] [OR:Bactcriophage P2] [DE:Bacteriophage P2, complete genome.] [NT:shares amino terminus with gpE; −1 frameshift] |
| Contig090G | 14339426_f2__246 | 1014 | 5140 | 351 | 116 | | | NO-HIT |
| Contig090G | 14453592_f1__86 | 1015 | 5141 | 393 | 130 | 96 | 4.90E−05 | sp:[LN:ASR_ECOLI] [AC:P36560:P77267] [GN:ASR] [OR:*ESCHERICHIA COLI*9 [DE:ACID SHOCK PROTEIN] [SP:P36560:P77267] |
| Contig090G | 14509717_c1__491 | 1016 | 5142 | 888 | 295 | 836 | 1.90E−83 | sp:[LN:YEDU_ECOLI] [AC:P31658:P76338] [GN:YEDU] [OR:*ESCHERICHIA COLI*] [DE:31.1 KD PROTEIN IN DCM-SERU INTERGENIC REGION] [SP:P31658:P76338] |
| Contig090G | 14630390_f3__364 | 1017 | 5143 | 858 | 285 | 472 | 7.00E−45 | gp:[GI:d1037223:g4063783] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf11; similar to various lytic enzyme genes] |
| Contig090G | 14645260_c1__420 | 1018 | 5144 | 2115 | 704 | 137 | 8.60E−14 | gp:[GI:g151399] [LN:PSENOSA] [AC:M60717] [GN:nosA] [OR:*Pseudomonas stutzeri*] [SR:*Pseudomonas stutzeri* (strain JM604) DNA] [DE:*P.stutzeri* NosA protein (nosA) gene, complete cds.] |
| Contig090G | 14881510_c3__707 | 1019 | 5145 | 1416 | 471 | 322 | 4.40E−32 | pir:[LN:H70423] [AC:H70423] [PN:oxygen-independent coproporphyrinogen III oxidase] [GN:hemF] [CL:oxygen-independent coproporphyrinogen oxidase] [OR:*Aquifex aeoticus*] |
| Contig090G | 15057017_f3__337 | 1020 | 5146 | 1932 | 643 | 474 | 4.30E−45 | sp:[LN:BTUB_SALTY] [AC:P37409] [GN:BTUB] [OR:*SALMONELLA TYPHIMURIUM*] [DE:VITAMIN B12 RECEPTOR PRECURSOR] [SP:P37409] |
| Contig090G | 15799000_f2__239 | 1021 | 5147 | 1230 | 409 | 1378 | 6.90E−141 | gp:[GI:d1037235:g4063795] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf22; similar to F1 gene of P2] |
| Contig090G | 15801433_f3__267 | 1022 | 5148 | 627 | 208 | | | NO-HIT |
| Contig090G | 15818808_c1__437 | 1023 | 5149 | 492 | 163 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig090G | 15822157_f1_11 | 1024 | 5150 | 699 | 232 | 211 | 3.20E−17 | gp:[GI:g2668765] [LN:AF034975] [AC:AF034975] [PN:Roi] [GN:roi] [OR:Bacteriophage H-19B] [DE:Bacteriophage H-19B essential recombination function protein (erf),kil protein (kil), regulatory protein cIII (cIII), protein gp17(17), N protein (N), cI protein (cI), cro protein (cro), cIIprotein (cII), O protein (O), P protein (P), ren protein (ren), ninorf-58-A, nin orf-58-B, Roi (roi), nin orf-204, nin orf-59, Qprotein (Q), Shiga-like toxin A subunit (slt-IA), Shiga-like toxinB subunit (slt-IB), putative holin protein (S), R protein (R), andRz protein (Rz) genes, complete cds.] [NT:similar to Bacteriophage HK022 Roi, encoded by] |
| Contig090G | 15822215_f2_126 | 1025 | 5151 | 486 | 161 | 447 | 3.10E−42 | gp:[GI:e1154545:g2570059] [LN:NGMS11DNA] [AC:AJ004687] [PN:N-4 cytosine-speciticmMethyltransferase] [OR:*Neisseria gonorrhoeae*] [DE:*Neisseria gonorrheae* MS11 encoding N-4 cytosine-speciticmethyltransferase.] |
| Contig090G | 15836077_c2_590 | 1026 | 5152 | 384 | 127 | 500 | 7.60E−48 | sp:[LN:PILG_PSEAE] [AC:P46384] [GN:P[LG] [OR:*PSEUDOMONAS AERUGINOSA*] [DE:PILG PROTEIN] [SP:P46384] |
| Contig090G | 15877162_f2_255 | 1027 | 5153 | 1947 | 648 | 956 | 3.60E−96 | gp:[GI:g3983168] [LN:AF100611] [AC:AF100611] [PN:SecD] [GN:secD] [OR:*Salmonella choleraesuis*] [DE:*Salmonella choleraesuis* SecD (secD) gene, complete cds.] [NT:protein secretion system subunit] |
| Contig090G | 15892175_f3_279 | 1028 | 5154 | 195 | 64 | | | NO-HIT |
| Contig090G | 16102250_c3_739 | 1029 | 5155 | 630 | 209 | | | NO-HIT |
| Contig090G | 16208510_c2_635 | 1030 | 5156 | 600 | 199 | 155 | 2.70E−11 | sp:[LN:RUS_ECOLI] [AC:P40116] [GN:RUS] [OR:*ESCHERICHIA COLI*] [EC:3.1.22.—] [DE:JUNCTION NUCLEASE RUS) (HOLLIDAY JUCTION RESOLVASE RUS)] [SP:P40116] |
| Contig090G | 16212837_f3_333 | 1031 | 5157 | 879 | 292 | 240 | 2.70E−20 | pir:[LN:H70882] [AC:H70882] [PN:hypothetical protein Rv2777c] [GN:Rv2777c] [OR:*Mycobacterium tuberculosis*] |
| Contig090G | 16274187_c2_567 | 1032 | 5158 | 1062 | 353 | 205 | 1.90E−14 | gp:[GI:g1657970] [LN:PAU73506] [AC:U73506] [PN:OruR[GN:oruR] [OR:*Pseudomonas aeruginosa*] [PE:*Pseudomonas aeruginosa* ornithine utilization regulatory (oruR)gene, complete cds.] [NT:regulatory locus for ornithine utilization] |
| Contig090G | 16292755_f2_130 | 1033 | 5159 | 573 | 190 | | | NO-HIT |
| Contig090G | 16407527_f2_193 | 1034 | 5160 | 1368 | 455 | 1384 | 1.60E−141 | gp:[GI:c1420019:g4539192] [LN:SC6A5] [AC:AL049485] [PN:probable acetyl coA acetyltransferase] [GN:SC6A5.37] [OR:*Streptomyces coelicolor*] [DE:*Streptomyces coelicolor* cosmid 6A5.] [NT:SC6A5.37, probable acetyl coA acetyltransferase] |
| Contig090G | 16594066_c1_508 | 1035 | 5161 | 351 | 116 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig090G | 16598787_f1_97 | 1036 | 5162 | 318 | 105 | 142 | 6.50E−10 | gp:[GI:d1037222:g4063782] [LN:AB008550] [AC:AB008550] [OR:*Pseudomonas aeruginosa* phage.phi CTX1 [SR:*Pseudomonas aeruginosa* phage phi CTX (strain:phiCTX-c] [DE:*Pseudomonas aeruginosa* phage phi CTX, complete genome sequence.] [NT:orf10] |
| Contig090G | 16617183_c1_469 | 1037 | 5163 | 4539 | 1512 | 1590 | 3.70E−218 | gp:[GI:g3241969] [LN:PAU79580] [AC:U79580] [PN:ChpA] [GN:chpA] [OR:*Pseudomonas aeruginosa*] [DE:*Pseudomonas aeruginosa* pilK gene, partial cds; and PilL, ChpA,ChpB, ChpC, ChpD, and ChpE genes, complete cds.] [NT:CheAY homolog] |
| Contig090G | 16692040_c2_513 | 1038 | 5164 | 912 | 303 | 397 | 6.20E−37 | pir:[LN:B69445] [AC:B69445] [PN:conserved hypothetical protein AF1563] [OR:*Archaeoglobus fulgidus*] |
| Contig090G | 16697502_c3_637 | 1039 | 5165 | 438 | 145 | 324 | 3.40E−29 | sp:[LN:YCIA_HAEIN] [AC:P44886] [GN:HI0827] [OR:*HAEMOPHILUS INFLUENZAE*] [DE:HYPOTHETICAL PROTEIN HI0827 PRECURSOR] [SP:P44886] |
| Contig090G | 16808128_f2_211 | 1040 | 5166 | 663 | 220 | 319 | 2.10E−28 | pir:[LN:S71634] [AC:S71634] [PN:stearoyl-CoA desaturase.:delta-9 fatty acid desaturase] [GN:Ole1] [CL:yeast stearoyl-CoA desaturase:cytochrome b5 core homology:stearoyl-CoA desaturase homology] [OR:*Cryptococcus curvatus*] [EC:1.14.99.5] |
| Contig090G | 16828450_f1_89 | 1041 | 5167 | 225 | 74 | | | NO-HIT |
| Contig090G | 16848825_f3_376 | 1042 | 5168 | 693 | 230 | 544 | 1.60E−52 | sp:[LN:QUEA_ECOLI] [AC:P21516] [GN:QUEA] [OR:*ESCHERICHIA COLI*] [EC:5.—.—.—] [DE:(QUEUOSINE BIOSYNTHESIS PROTEIN QUEA)] [SP:P21516] |
| Contig090G | 17068813_c2_570 | 1043 | 5169 | 645 | 214 | 289 | 3.80E−24 | gp:[GI:g1256742] [LN:TRBR272P] [AC:L04603] [PN:R27-2 protein] [OR:*Trypanosoma cruzi*] [SR:*Trypanosoma cruzi* (strain Sylvio X-10) DNA] [DE:*Trypanosoma cruzi* R27-2 protein gene, complete cds.] |
| Contig090G | 188802_c3_668 | 1044 | 5170 | 972 | 323 | | | NO-HIT |
| Contig090G | 194702_f3_370 | 1045 | 5171 | 279 | 92 | | | NO-HIT |
| Contig090G | 19532757_c2_592 | 1046 | 5172 | 2130 | 709 | 1536 | 1.20E−157 | sp:[LN:PILJ_PSEAE] [AC:P42257] [GN:PILJ] [OR:*PSEUDOMONAS AERUGINOSA*] [DE:PIL] PROTEIN] [SP:P42257] |
| Contig090G | 19551516_c1_445 | 1047 | 5173 | 1293 | 430 | 1074 | 1.90E−125 | pir:[LN:542207] [AC:542207] [PN:*porin*] [CL:*Pseudomonas porin* oprB] [OR:*Pseudomonas aeruginosa*] |
| Contig090G | 19572327_c2_535 | 1048 | 5174 | 186 | 61 | | | NO-HIT |
| Contig090G | 19631330_c1_495 | 1049 | 5175 | 483 | 160 | | | NO-HIT |
| Contig090G | 197177_f1_100 | 1050 | 5176 | 609 | 202 | 302 | 7.30E−27 | gp:[GI:d1037232:g4063792] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf19; similar to 1 gene of P2] |

TABLE 2-continued

| Query | Orf | NT ID | AA ID | NT Lgth | AA Lgth | Score | P-value | Subject |
|---|---|---|---|---|---|---|---|---|
| Contig090G | 19940937_c3_662 | 1051 | 5177 | 1023 | 340 | 853 | 3.00E−85 | gp:[GI:d1037213:g4063773] [LN:AB3008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf1; similar to Q gene of P2:capsid packaging] |
| Contig090G | 20320913_c1_492 | 1052 | 5178 | 198 | 65 | | | NO-HIT |
| Contig090G | 20355325_f2_128 | 1053 | 5179 | 1371 | 456 | 986 | 2.40E−99 | gp:[GI:e1361778:g4071071] [LN:YPS9592] [ACA1009592] [PN:integrase] [GN:int] [OR:*Yersinia pseudotuberculosis*] [DE:*Yersinia pseudotuberculosis* DNA encoding the right hand border ofthe High Pathogenicity Island, including tRNA-Asn gene, int geneand ORF1, partial.] |
| Contig090G | 20401566_c3_699 | 1054 | 5180 | 381 | 126 | 370 | 4.50E−34 | pir:[LN:G64974] [AC:G64974] [PN:hypothetical protein b2080] [OR:*Escherichia coli*] |
| Contig090G | 20422137_f2_180 | 1055 | 5181 | 888 | 295 | 600 | 1.90E−58 | sp:[LN:FPG_HAEIN] [AC:P44948] [GN:MUTM:FPG:H10946] [OR:*HAEMOPHILUS INFLUENZAE*] [EC:32.2.23] [DE:GLYCOSYLASE)] [SP:P44948] |
| Contig090G | 20500052_c3_717 | 1056 | 5182 | 2073 | 690 | 1512 | 4.40E−155 | pir:[LN:C70838] [AC:C70838] [PN:probable zinc metalloproteinase Rv0198c] [GN:Rv0198c] [OR:*Mycobacterium tuberculosis*] |
| Contig090G | 20501716_c1_468 | 1057 | 5183 | 570 | 189 | 340 | 6.80E−31 | sp:[LN:PILI_PSEAE] [AC:P43502] [GN:PILI) [OR:*PSEUDOMONAS AERUGINOSA*] [DE:PILI PROTEIN] [SP:P43502] |
| Contig090G | 20505300_f1_64 | 1058 | 5184 | 1179 | 392 | 350 | 5.90E−32 | gp:[GI:g3978488] [LN:AF092918] [AC:AF092918] [PN:virulence regulating homolog] [OR:*Pseudomonas alcaligenes*] [DE:*Pseudomonas alcaligenes* outer membrane Xcp-secretion system genecluster.] [NT:OrfY2; similar to *Mycobacterium tuberculosis*] |
| Contig090G | 20509718_f1_8 | 1059 | 5185 | 327 | 108 | | | NO-HIT |
| Contig090G | 20600001_f2_241 | 1060 | 5186 | 360 | 119 | 205 | 1.40E−16 | gp:[GI:g3139110[LN:AF063097] [AC:AF063097:J02474:X02300:X 02301:M58023:M13202:L29304: X87173:M64677] [PN:gpE] [GN:E] [FN:essential tail protein) [OR:Bacteriophage P2] [DE:Bacteriophage P2, complete genome.] |
| Contig090G | 20734577_c1_415 | 1061 | 5187 | 1815 | 604 | 1899 | 4.30E−196 | gp:[GI:d1037214:g4063774] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf2; similar to P gene of P2:DNA-dependent ATPase] |
| Contig090G | 21484385_f1_56 | 1062 | 5188 | 195 | 64 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig090G | 21484637_f1_24 | 1063 | 5189 | 783 | 260 | 856 | 1.40E−85 | sp:[LN:CYSH_PSEAE] [AC:005927] [GN:CYSH] [OR:*PSEUDOMONAS AERUGINOSA*] [EC:1.8.99.4] [DE:PI-[OSPFIOADENYLYLSUL FATE REDUCTASF) (PAPS SULFOTRANSFERASE)] [SP:O05927] |
| Contig090G | 21522577_c1_470 | 1064 | 5190 | 543 | 180 | | | NO-HIT |
| Contig090G | 2165937_c3_740 | 1065 | 5191 | 291 | 96 | | | NO-HIT |
| Contig090G | 21671875_f2_140 | 1066 | 5192 | 888 | 295 | 134 | 1.50E−05 | gp:[GI:e1250342:g2853078] [LN:ATF24J7] [AC:AL021768] [PN:TMV resistance protein N-like] [GN:F24J7.70] [OR:*Arabidopsis thaliana*] [SR:thale cress) [DE:*Arabidopsis thaliana* DNA chromosome 4, BAC clone F24J7 (ESSAIIproject).] [NT:similarity to TMV resistance protein N, Nicotiana] |
| Contig090G | 21671952_f1_104 | 1067 | 5193 | 1314 | 437 | 872 | 2.90E−87 | gp:[GI:d1037241:g4063801] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf27; similar to D gene of P2] |
| Contig090G | 21678125_f3_380 | 1068 | 5194 | 834 | 277 | 236 | 7.20E−20 | gp:[GI:g902453] [LN:ECU24203] [AC:U24203] [GN:yciB] [OR:*Escherichia coli*] [DE:*Escherichia coli* ECOR 52 (yciD) gene, partial cds, and (yciC), (yciB), (yciA), membrane protein (tonB), (ycit), putative potassiumchannel (kch), and cardiolipin synthase (cls) genes, complete cds.] |
| Contig090G | 21688907_f2_245 | 1069 | 5195 | 243 | 80 | | | NO-HIT |
| Contig090G | 21759687_c2_586 | 1070 | 5196 | 390 | 129 | 420 | 2.30E−39 | sp:[LN:PHNA_ECOLI] [AC:P16680] [GN:PHNA] [OR:*ESCHERICHIA COLI*] [DE:PHNA PROTEIN] [SP:P16680] |
| Contig090G | 21891885_f3_297 | 1071 | 5197 | 2631 | 876 | 1584 | 1.00E−162 | gp:[Gt:g2981043] [LN:AF051690] [AC:AF051690] [PN:iron-uptake factor] [GN:piuB] [OR:*Pseudomonas aeruginosa*] [DE:*Pseudomonas aeruginosa* iron-uptake factor (piuC), hydroxamate-typeferrisiderophore receptor (piuA), and iron-uptake factor (piuB)genes, complete cds.] [NT:PiuB; contains phosphopantetheine attachment motif] |
| Contig090G | 22065688_c2_577 | 1072 | 5198 | 513 | 170 | | | NO-HIT |
| Contig090G | 22267550_f1_120 | 1073 | 5199 | 1929 | 642 | 641 | 2.50E−73 | pir:[LN:B65005] [AC:B65005] [PN:hypothetical protein b2324] [OR:*Escherichia coli*] |
| Contig090G | 22267787_f2_168 | 1074 | 5200 | 603 | 200 | | | NO-HIT |
| Contig090G | 22301433_f1_112 | 1075 | 5201 | 609 | 202 | | | NO-HIT |
| Contig090G | 22438818_c2_603 | 1076 | 5202 | 1209 | 402 | 1305 | 3.80E−133 | sp:[LN:BACA_RHIME] [AC:Q08120] [GN:BACA] [OR:*RHIZOBIUM MELILOTI*] [DE:BACA PROTEIN] [SP:Q08120] |
| Contig090G | 22458575_f2_258 | 1077 | 5203 | 753 | 250 | 404 | 1.10E−37 | sp:[LN:RADC_ECOLI] [AC:P25531] [GN:RADC] [OR:*ESCHERICHIA COLI*] [DE:DNA REPAIR PROTEIN RADC] [SP:P25531] |
| Contig090G | 22479662_c1_452 | 1078 | 5204 | 372 | 123 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig090G | 22678958_c1_391 | 1079 | 5205 | 1284 | 427 | 1056 | 9.10E−107 | sp:[LN:DFP_HAEIN] [AC:P44953] [GN:DFP:H10953] [OR:*HAEMOPHILUS INFLUENZAE*] [DE:DNA/PANTOTOTHENATE METABOLISM FLAVOPROTEIN HOMOLOG] [SP:P44953] |
| Contig090G | 22682840_f1_7 | 1080 | 5206 | 369 | 122 | | | NO-HIT |
| Contig090G | 22828452_c3_715 | 1081 | 5207 | 1236 | 411 | 670 | 7.30E−66 | gp:[GI:e1347711:g3878113] [LN:CEK01C8] [AC:Z49068] [GN:K01C8.1] [OR:*Caenorhabditis elegans*] [DE:*Caenorhabditis elegans* cosmid K01C8, complete sequence.] [NT:simitar to threonine dehydratase; cDNA EST] |
| Contig090G | 22890628_c3_687 | 1082 | 5208 | 2457 | 818 | 4177 | 0 | sp:[LN:DHGA_ACICA] [AC:P05465] [GN:GDHA] [OR:*ACINETOBACTER CALCOACETICUS*] [EC:1.1.99.17] [DE:(EC1.1.99.17) (QUINOPROTEIN GLUCOSE DH) (GDH-A)] [SP:P05465] |
| Contig090G | 2303_c3_737 | 1083 | 5209 | 270 | 89 | 158 | 1.30E−11 | sp:[LN:YDAS_ECOLI] [AC:P76663] [GN:YDAS] [OR:*ESCHERICHIA COLI*] [DE:HYPOTHETICAL 11.0 KD PROTEIN IN SIEB-TRKG INTERGENIC REGION PRECURSOR] [SP:P76063] |
| Contig090G | 23453776_c2_557 | 1084 | 5210 | 429 | 142 | 99 | 0.00018 | pir:[LN:B64978] [AC:B64978] [PN:hypothetical protein b2107] [OR:*Escherichia coli*] |
| Contig090G | 23458438_f3_308 | 1085 | 5211 | 321 | 106 | 246 | 6.20E−21 | sp:[LN:CYPC_ECOLI] [AC:P39159] [GN:PPIC:PARVA] [OR:*ESCHERICHIA COLI*] [EC:5.2.1.8] [DE:(ROTAMASE C) (PARVULIN)] [SP:P39159] |
| Contig090G | 23471010_c2_623 | 1086 | 5212 | 627 | 208 | | | NO-HIT |
| Contig090G | 23525262_f2_156 | 1087 | 5213 | 582 | 193 | 350 | 6.70E−41 | gp:[GI:g1134957] [LN:BCU4I 162] [AC:U41162] [OR:*Burkholderia cepacia*] [SR:*Burkholderia cepacia* strain=17616] [DE:*Burkholderia cepacia* D-serine deaminase (Dsd) gene, complete cds.] [NT:unidentified ORF] |
| Contig090G | 23593812_c1_485 | 1088 | 5214 | 1482 | 493 | 1360 | 5.60E−139 | pir:[LN:A65117] [AC:A65117:JQ1272:524199] [PN:cytosotic axial filament protein cafA] [GN:cafA] [OR:*Escherichia coli*] |
| Contig090G | 23632805_f2_196 | 1089 | 5215 | 657 | 218 | 483 | 4.80E−46 | pir:[LN:C65074] [AC:C65074] [PN:hypothetical protein b2899] [CL:hemolysin III yplQ] [OR:*Escherichia coli*] |
| Contig090G | 23634628_c2_554 | 1090 | 5216 | 771 | 256 | 360 | 5.20E−33 | pir:[LN:B70450] [AC:B70450] [PN:beta 1,4 glucosyltransferase] [GN:IgtF] [OR:*Aquifex aeolicus*] |
| Contig090G | 23642526_c3_719 | 1091 | 5217 | 561 | 186 | | | NO-HIT |
| Contig090G | 23729718_c1_471 | 1092 | 5218 | 345 | 114 | 104 | 7.00E−06 | gp:[GI:e328150:g2274993] [LN:HVJ000230] [AC:A1000230] [OR:*Hordeum vulgare*] [DE:*Hordeum vulgare* mRNA for expressed sequence tag.] [NT:unnamed protein product] |
| Contig090G | 23730035_c1_448 | 1093 | 5219 | 1140 | 379 | 348 | 2.70E−67 | pir:[LN:S39866] [AC:S39866] [PN:outer membrane protein CD precursor] [OR:*Moraxella catarrhalis*] |

TABLE 2-continued

| Query | Orf | NT ID | AA ID | NT Lgth | AA Lgth | Score | P-value | Subject |
|---|---|---|---|---|---|---|---|---|
| Contig090G | 23829052_f1_287 | 1094 | 5220 | 1536 | 511 | 1576 | 7.20E−162 | sp:[LN:AMID_MORCA] [AC:Q49091] [OR:*MORAXELLA CATARRHALIS*] [EC:3.5.1.4] [DE:PUTATIVE AMIDASE,] [SP:Q49091] |
| Contig090G | 23867217_c1_511 | 1095 | 5221 | 282 | 93 | | | NO-HIT |
| Contig090G | 23958387_f1_59 | 1096 | 5222 | 1398 | 465 | 1223 | 1.80E−124 | sp:[LN:YICE_ECOLI] [AC:P27432] [GN:YICE] [OR:*ESCHERICHIA COLI*] [DE:HYPOTHETICAL 48.9 KD PROTEIN IN GLTS-SELC INTERGENIC REGION] [SP:P27432] |
| Contig090G | 24016875_c2_553 | 1097 | 5223 | 951 | 316 | 945 | 5.30E−95 | gp:[GI:g3482882] [LN:PAU63816] [AC:U63816] [PN:unknown] [GN:ilvE] [OR:*Pseudomonas aeruginosa*] [DL:*Pseudomonas aeruginosa* glnE gene, partial cds; ilvE , ADP-heptose: LPS heptosyltransferase homolog (F), lipopolysaccharide heptosyltransferase I homolog (C), glucosyltransferase I homolog (G), RfaP protein (P), and unknown protein (X) genes, complete cds; and inaA gene, partial cds.] [NT:similar to ilvE from *Escherichia coli* and other] |
| Contig090G | 24019712_c2_565 | 1098 | 5224 | 1272 | 423 | 1979 | 1.40E−204 | sp:[LN:TRPB_ACICA] [AC:P16706] [GN:TRPB] [OR:*ACINETOBACTER CALCOACETICUS*] [EC:4.2.1.20] [DE:TRYPTOPHAN SYNTHASE BETA CHAIN.] [SP:P16706] |
| Contig090G | 24023933_f3_366 | 1099 | 5225 | 1995 | 664 | 316 | 5.90E−26 | gp:[GI:g3522881] [LN:B1U32222] [AC:U32222:X53318:X04449:U5 1471] [GN:K] [OR:Bacteriophage 186] [DE:Bacteriophage 186, complete sequence.] [NT:similar to P2 tail fiber protein H. PIR Accession] |
| Contig090G | 24042186_f2_244 | 1100 | 5226 | 210 | 69 | | | NO-HIT |
| Contig090G | 24094036_c1_478 | 1101 | 5227 | 1506 | 501 | 1276 | 4.40E−130 | sp:[LN:YAAJ_HAEIN] [AC:P44555] [GN:H10183] [OR:*HAEMOPHILUS INFLUENZAE*] [DE:HYPOTHETICAL PROTEIN H10183] [SP:P44555] |
| Contig090G | 24105316_c1_484 | 1102 | 5228 | 447 | 148 | 128 | 2.00E−08 | sp:[LN:MRED_ECOLI] [AC:P16927] [GN:MRED] [OR:*ESCHERICHIA COLI*] [DE:ROD SHAPE-DETERMINING PROTEIN MRED] [SP:P16927] |
| Contig090G | 24251318_f1_65 | 1103 | 5229 | 2148 | 715 | 1885 | 1.30E−194 | gp:[GI:e1420020:g4539193] [LN:SC6A5] [AC:AL049485] [PN:putative fatty oxidation protein] [GN:SC6A5.38] [OR:*Streptomyces coelicolor*] [DE:*Streptomyces coelicolor* cosmid 6A5.] [NT:SC6A5.38, possible fatty oxidation protein, len:] |
| Contig090G | 24260927_c3_667 | 1104 | 5230 | 1062 | 353 | 198 | 1.90E−13 | pir:[LN:F70346] [AC:F70346] [PN:mannosyltransferase C] [GN:mtfC] [OR:*Aquifex aeolicus*] |

TABLE 2-continued

| Query | Orf | NT ID | AA ID | NT Lgth | AA Lgth | Score | P-value | Subject |
|---|---|---|---|---|---|---|---|---|
| Contig090G | 24274160_f1_103 | 1105 | 5231 | 456 | 151 | 412 | 1.60E−38 | gp:[GI:d1037240:g4063800] [LN:A13008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf26; similar to U gene of P2] |
| Contig090G | 24276638_c1_497 | 1106 | 5232 | 2649 | 882 | | | NO-HIT |
| Contig090G | 24319702_f1_5 | 1107 | 5233 | 792 | 263 | 230 | 3.10E−19 | pir:[LN:F64859] [AC:F64859] [PN:hypothetical protein b1145] [OR:*Escherichia coli*] |
| Contig090G | 24323462_f2_247 | 1108 | 5234 | 216 | 71 | | | NO-HIT |
| Contig090G | 24329681_f3_362 | 1109 | 5235 | 522 | 173 | 305 | 3.50E−27 | gp:[GI:d1037218:g4063778] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX. complete genome sequence.] [NT:orf6; similar to L gene of P2:capsid completion] |
| Contig090G | 24412906_c2_618 | 1110 | 5236 | 912 | 303 | 424 | 8.60E−40 | sp:[LN:YQHC_ECOLI] [AC:Q46855] [GN:YQHC] [OR:*ESCHERICHIA COLI*] [DE:HYPOTHETICAL TRANSCRIPTIONAL REGULATOR IN METC-SUFI INTERGENIC REGION] [SP:Q46855] |
| Contig090G | 24416687_f2_252 | 1111 | 5237 | 603 | 200 | 426 | 5.30E−40 | sp:[LN:QUEA_HAEIN] [AC:P44595] [GN:QUEA:H10245] [OR:*HAEMOPHILUS INFLUENZAE*] [EC:5.—.—.—] [DE:(QUEUOSINE BIOSYNTHESIS PROTEIN QUEA)] [SP:P44595] |
| Contig090G | 24423317_c1_480 | 1112 | 5238 | 1080 | 359 | 111 | 7.30E−06 | sp:[LN:YPFG_ECOLI] [AC:P76559] [GN:YPFG] [OR:*ESCHERICHIA COLI*] [DE:HYPOTHETICAL 38.7 KD PROTEIN IN TKTB-NARQ INTERGENIC REGION PRECURSOR] [SP:P76559] |
| Contig090G | 24495255_f2_178 | 1113 | 5239 | 687 | 228 | 243 | 1.30E−20 | gp:[GI:g3135321] [LN:AF057031] [AC:AF057031] [PN:putative thiol:disulfide interchange protein] [GN:dsbC] [OR:*Pseudomonas aeruginosa*] [DE:*Pseudomonas aeruginosa* putative thiol:disulfide interchange proteinprecursor (dsbC) gene, complete cds.] [NT:DsbC] |
| Contig090G | 24642753_c2_568 | 1114 | 5240 | 903 | 300 | 756 | 5.60E−75 | sp:[LN:ACCD_ECOLI] [AC:P08193:P78251:P76937] [GN:ACCD:DEDB:USG] [OR:*ESCHERICHIA COLI*] [EC:6.4.1.2] [DE:(EC 6.4.1.2)] [SP:P08193:P78251:P76937] |
| Contig090G | 24644587_f1_98 | 1115 | 5241 | 456 | 151 | 334 | 2.90E−30 | gp:[GI:d1037227:g4063787] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf14; similar to S gene of P2:tail completion] |
| Contig090G | 24647202_f1_38 | 1116 | 5242 | 216 | 71 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig090G | 24648562_f2_179 | 1117 | 5243 | 831 | 276 | 179 | 6.50E−12 | sp:[LN:YBEQ_ECOLI] [AC:P77234] [GN:YBEQ] [OR:*ESCHERICHIA COLI*] [DE:HYPOTHETICAL 37.3 KD PROTEIN IN LEUS-GLTL INTERGENIC REGION] [SP:P77234] |
| Contig090G | 24813457_c3_680 | 1118 | 5244 | 2778 | 925 | 2774 | 8.10E−289 | gp:[GI:d1034369:g3649789] [LN:AB012226] [AC:AB012226] [PN:SecA] [OR:*Vibrio alginolyticus*] [SR:[*Vibrio alginolyticus* DNA] [DE:*Vibrio alginolyticus* gene for SecA, complete cds.] |
| Contig090G | 24823387_c1_457 | 1119 | 5245 | 465 | 154 | 98 | 0.00053 | gp:[GI:e1310302:g3294247] [LN:SC7C7] [AC:AL031031] [PN:hypothetical protein SC7C7.14] [GN:5C7C7.14] [OR:*Streptomyces coelicolor*] [DE:*Streptomyces coelicolor* cosmid 7C7.] [NT:SC7C7.14, unknown, ten: 161] |
| Contig090G | 2500953_f3_304 | 1120 | 5246 | 669 | 222 | | | NO-HIT |
| Contig090G | 25401577_f3_378 | 1121 | 5247 | 1134 | 377 | 1398 | 5.20E−143 | sp:[LN:TGT_SHIFL] [AC:Q54177] [GN:TGT:VACC] [OR:*SHIGELLA FLEXNERI*] [EC:2.4.2.29] [DE:PROTEIN VACC)] [SP:Q54177] |
| Contig090G | 25494032_c2_562 | 1122 | 5248 | 570 | 189 | | | NO-HIT |
| Contig090G | 25506252_f1_68 | 1123 | 5249 | 1335 | 444 | 1265 | 6.50E−129 | sp:[LN:YHJE_ECOLI] [AC:P37643] [GN:YHJE] [OR:*ESCHERICHIA COLI*] [DE:REGION (0440)] [SP:P37643] |
| Contig090G | 25522561_c3_678 | 1124 | 5250 | 501 | 166 | 116 | 5.50E−05 | sp:[LN:CALD_CHICK] [AC:P12957:Q90756:Q90761:Q92 018:Q99230:Q03698] [GN:CALDI:CAD] [OR:*GALLUS GALLUS*] [DE:CALDESMON (CDM)] [SP:P12957:Q90756:Q90761:Q92 018:Q99230:Q03698] |
| Contig090G | 25525311_f1_9 | 1125 | 5251 | 1155 | 384 | 173 | 2.10E−23 | pir:[LN:E64913] [AC:E64913] [PN:hypothetical protein b1579] [CL:hypothetical protein b1579] [OR:*Escherichia coli*] |
| Contig090G | 25585892_c3_673 | 1126 | 5252 | 1680 | 559 | 577 | 6.80E−61 | sp:[LN:BAES_ECOLI] [AC:P30847:P76401] [GN:BAES] [OR:*ESCHERICHIA COLI*] [EC:2.7.3.—] [DE:SENSOR PROTEIN BAFS,] [SP:P30847:P76401] |
| Contig090G | 25587511_c1_418 | 1127 | 5253 | 768 | 255 | 149 | 1.00E−08 | gp:[GI:g3821849] [LN:AF019747] [AC:AF019747] [PN:putative beta 1,4-galactosyltransferase X] [GN:X] [OR:*Escherichia coli*] [DE:*Escherichia coli* heptosyl I transferase C (C) gene, partialcds; lipid A-core:surface polymer ligase L (L), putativebeta1,4-galactosyltransferase X (X), UDP-galactose:(galactosyl) LPS alpha 1,2-galactosyltransferase W(W), Y (Y), UDP-galactose:(glucosyl) LPSalpha1,2-galactosyltransferase T (T), UDP-glucose:(glucosyl)LPS alpha1,3-glucosyltransferase O (O), P (P),UDP-glucose:(heptosyl) LPS alpha1,3-glucosyltransferase G(G), and Q (Q) genes, complete cds; and Kdo transferaseA (A) gene, partial cds.] |

TABLE 2-continued

| Query | Orf | NT ID | AA ID | NT Lgth | AA Lgth | Score | P-value | Subject |
|---|---|---|---|---|---|---|---|---|
| Contig090G | 25598192_f1_119 | 1128 | 5254 | 315 | 104 | 262 | 1.30E-22 | gp:[GI:g902447] [LN:ECU24202] [AC:U24202] [GN:yciI] [OR:*Escherichia coli*] [DE:*Escherichia coli* ECOR 50 (yciD) gene, partial cds, and (yciC),(yciB), (yciA), membrane protein (tonB), (yciI), putative potassiumchannel (kch), and cardiolipin synthase (cls) genes, complete cds.] |
| Contig090G | 2581667_c3_711 | 1129 | 5255 | 198 | 65 | | | NO-HIT |
| Contig090G | 26572806_c2_614 | 1130 | 5256 | 636 | 211 | 690 | 5.60E-68 | gp:[GI:e1364016:g4138297] [LN:PAAJ7615] [AC:AJ007615] [PN:homoscrine-kinase isozyme] [GN:thrH] [OR:*Pseudomonas aeruginosa*] [DE:*Pseudomonas aeruginosa* thrH gene.] |
| Contig090G | 26648313_f2_188 | 1131 | 5257 | 1197 | 398 | 1406 | 7.50E-144 | gp:[GI:g1857942] [LN:PAU88653] [AC:U88653] [PN:thiolase] [GN:phaA] [OR:*Pseudomonas aeruginosa*] [DE:*Pseudomonas aeruginosa* thiolase (phaA) gene, complete cds.] |
| Contig090G | 283402_f2_151 | 1132 | 5258 | 189 | 62 | | | NO-HIT |
| Contig090G | 2914050_f1_12 | 1133 | 5259 | 852 | 283 | | | NO-HIT |
| Contig090G | 2928165_f1_69 | 1134 | 5260 | 183 | 62 | | | NO-HIT |
| Contig090G | 29303276_f1_129 | 1135 | 5261 | 1263 | 420 | | | NO-HIT |
| Contig090G | 2947137_f2_250 | 1136 | 5262 | 225 | 74 | | | NO-HIT |
| Contig090G | 29977313_f2_125 | 1137 | 5263 | 279 | 92 | | | NO-HIT |
| Contig090G | 30134766_c3_696 | 1138 | 5264 | 597 | 198 | 302 | 7.30E-27 | sp:[LN:3MGH_BACSU] [AC:P94378] [GN:YXLJ] [OR:*BACILLUS SUBTILIS*] [EC:3.2.2.—] [DE:PUTATIVE 3-METHYLADENINE DNA GLYCOSYLASE,] [SP:P94378] |
| Contig090G | 30257687_f2_189 | 1139 | 5265 | 465 | 154 | 173 | 3.40E-13 | sp:[LN:PHNB_ECOLI] [AC:P16681] [GN:PHNB] [OR:*ESCHERICHIA COLI*] [DE:PHNB PROTEIN] [SP:P16681] |
| Contig090G | 30273587_c1_425 | 1140 | 5266 | 702 | 233 | 545 | 1.30E-52 | sp:[LN:BAER_ECOLI] [AC:P30846] [GN:BAER] [OR:*ESCHERICHIA COLI*] [DE:TRANSCRIPTIONAL REGULATORY PROTEIN BAER] [SP:P30846] |
| Contig090G | 30674188_c3_683 | 1141 | 5267 | 432 | 143 | 255 | 6.90E-22 | sp:[LN:YAT3_STAAU] [AC:P52080] [OR:*STAPHYLOCOCCUS AUREUS*] [DE:HYPOTHETICAL 16.6 KD PROTEIN IN ATL 5'REGION (ORF3)] [SP:P52080] |
| Contig090G | 31260776_f2_209 | 1142 | 5268 | 642 | 213 | 317 | 1.90E-28 | pir:[LN:D70046] [AC:D70046] [PN:conserved hypothetical protein yvqK] [GN:yvqK] [OR:*Bacillus subtilis*] |
| Contig090G | 31289087_c1_444 | 1143 | 5269 | 876 | 291 | 442 | 1.10E-41 | pir:[LN:H70553] [AC:H70553] [PN:probable mer protein] [GN:mer] [OR:*Mycobacterium tuberculosis*] |
| Contig090G | 3162512_f3_353 | 1144 | 5270 | 897 | 298 | | | NO-HIT |
| Contig090G | 31801653_f3_372 | 1145 | 5271 | 318 | 105 | | | NO-HIT |
| Contig090G | 32048963_f2_222 | 1146 | 5272 | 1362 | 453 | 1462 | 8.70E-150 | sp:[LN:SYD_ECOLI] [AC:P21889] [GN:ASPS:TLS] [OR:*ESCHERICHIA COLI*] [EC:6.1.1.12] [DE:(ASPRS)] [SP:P21889] |
| Contig090G | 32236093_c1_510 | 1147 | 5273 | 1368 | 455 | 698 | 7.90E-69 | sp:[LN:DNAB_ECOLI] [AC:P03005] [GN:DNAB:GROP:GRPA] [OR:*ESCHERICHIA COLI*] [EC:3.6.1.—] [DE:REPLICATIVE DNA HELICASE,] [SP:P03005] |

TABLE 2-continued

| Query | Orf | NT ID | AA ID | NT Lgth | AA Lgth | Score | P-value | Subject |
|---|---|---|---|---|---|---|---|---|
| Contig090G | 32453812_f2_210 | 1148 | 5274 | 720 | 239 | 221 | 2.80E−18 | gp:[GI:e204673:g1279200] [LN:AEODHABL] [AC:X91877] [GN :orf1] [OR:*Ralstonia eutropha*] [DE:*A. eutrophus* odhA, odhB odhL, ORF1 and ORF5 genes.] |
| Contig090G | 32455040_f2_176 | 1149 | 5275 | 1125 | 374 | 247 | 7.40E−20 | pir:[LN:C70415] [AC:C70415] [PN:cation efflux system (czcB-like)] [GN:czcB2] [OR:*Aquifex aeolicus*] |
| Contig090G | 32616267_f2_235 | 1150 | 5276 | 387 | 128 | 133 | 5.90E−09 | gp:[GI:d1037221:g4063781] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf9] |
| Contig090G | 32690927_f2_216 | 1151 | 5277 | 576 | 191 | 145 | 3.10E−10 | sp:[LN:YJBA_ECOLI] [AC:P23896] [GN:YJBA] [OR:*ESCHERICHIA COLI*] [DE:HYPOTHETICAL 15.6 KD PROTEIN IN PGI-XYLE INTERGENIC REGION] [SP:P23896] |
| Contig090G | 32930_f3_322 | 1152 | 5278 | 876 | 291 | 407 | 5.40E−38 | sp:[LN:YJJU_ECOLI] [AC:P39407] [GN:YJJU] [OR:*ESCHERICHIA COLI*] [DE:HYPOTHETICAL 39.8 KD PROTEIN IN OSMY-DEOC INTERGENIC REGION (O357)] [SP:P39407] |
| Contig090G | 33218968_f1_25 | 1153 | 5279 | 1422 | 473 | 881 | 3.20E−88 | pir:[LN:E70798] [AC:E70798] [PN:hypothetical protein Rv3740c] [GN:Rv3740c] [OR:*Mycobacterium tuberculosis*] |
| Contig090G | 33234587_f3_271 | 1154 | 5280 | 1389 | 462 | 666 | 1.90E−65 | sp:[LN:DNAB_HAEIN] [AC:P45256] [GN:DNAB:H11574] [OR:*HAEMOPHILUS INFLUENZAE*] [EC:3.6.1.—] [DE:REPLICATIVE DNA HELICASE,] [SP:P45256] |
| Contig090G | 3323515_f1_88 | 1155 | 5281 | 786 | 261 | | | NO-HIT |
| Contig090G | 33257707_c2_634 | 1156 | 5282 | 468 | 155 | | | NO-HIT |
| Contig090G | 3335943_c2_552 | 1157 | 5283 | 2769 | 922 | 924 | 1.70E−165 | sp:[LN:GLNE_HAEIN] [AC:P44419] [GN:GLNE:R10069] [OR:*HAEMOPHILUS INFLUENZAE*] [EC:2.7.7.42] [DE:SYNTHETASE ADENYLYLTRANSFERASE) (ATASE)] [SP:P44419] |
| Contig090G | 33370676_f1_82 | 1158 | 5284 | 1485 | 494 | 865 | 1.60E−86 | sp:[LN:YDIU_ECOLI] [AC:P77649:P76904] [GN:YDIU] [OR:*ESCHERICHIA COLI*] [DE:HYPOTHETICAL 54.4 KD PROTEIN IN AROH-NLPC INTERGENIC REGION] [SP:P77649:P76904] |

TABLE 2-continued

| Query | Orf | NT ID | AA ID | NT Lgth | AA Lgth | Score | P-value | Subject |
|---|---|---|---|---|---|---|---|---|
| Contig090G | 33766453_c3_728 | 1159 | 5285 | 1113 | 370 | 992 | 5.50E–100 | gp:[GI:g4378174] [LN:AF102543] [AC:AF102543] [PN:unknown] [OR:*Zymomonas mobilis*] [DE:*Zymomonas mobilis* 5,10-methylenetetrahydrofolate reductase (metF)gene, partial cds; lipoprotein precursor (vaci), ferredoxin-NADP+reductase (fpr), succinic semialdehyde dehydrogenase (gabD),thymidylate synthetase (thyA), gluconate permease (gntP), UTP-glucose-1-phosphate uridyltransferase. diaminopimelatedecarboxylase (lysA), arginosuccinate lyase (argH), NADH-dependentbutanol dehydrogenase (yugJ), and morphine 6-dehydrogenase (mdh)genes, complete cds tRNA-Ala gene, complete sequence; aminopeptidase N (pepN) gene, complete cds; and unknown genes.] [NT:zm4orf8] |
| Contig090G | 33832938_f2_236 | 1160 | 5286 | 540 | 179 | 360 | 5.20E–33 | gp:[GI:d1037226:g4063786] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf13; similar to R gene of P2:tail completion] |
| Contig090G | 34020910_f3_383 | 1161 | 5287 | 375 | 124 | 156 | 2.10E–11 | gp:[GI:g2564977] [LN:RCU23145] [AC:U23145] [OR:*Rhodobacter capsulatus*] [DE:*Rhodobacter capsulatus* Calvin cycle carbon dioxide fixation operon:fructose-1,6-/sedoheptulose-1,7-bisphosphate aldolase (cbbA) gene, partial cds, Form II ribulose-1,5-bisphosphatecarboxytaseloxygenase (cbbM) gene, complete cds, and Calvin cycleoperon: pentose-5-phosphate-3-epimerase (cbbE), phosphoglycolatephosphatase (cbbZ), and cbbY genes, complete cds.] [NT:hypothetical protein] |
| Contig090G | 34032202_f1_113 | 1162 | 5288 | 297 | 98 | | | NO-HIT |
| Contig090G | 34064055_f2_131 | 1163 | 5289 | 423 | 140 | | | NO-HIT |
| Contig090G | 34103428_c2_632 | 1164 | 5290 | 378 | 125 | | | NO-HIT |
| Contig090G | 34189375_c2_533 | 1165 | 5291 | 309 | 102 | | | NO-HIT |
| Contig090G | 34260885_c3_710 | 1166 | 5292 | 522 | 173 | 102 | 0.00075 | pir:[LN:S76259] [AC:S76259] [PN:hypothetical protein] [OR:Synechocystis sp.] [SR:PCC 6803, , PCC 6803] [SR:PCC 6803,] |
| Contig090G | 34384625_f2_234 | 1167 | 5293 | 750 | 249 | 415 | 7.70E–39 | gp:[GI:d1037217:g4063777] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf5; similar to M of P2:terminase subunit] |
| Contig090G | 34411542_c3_731 | 1168 | 5294 | 2532 | 843 | | | NO-HIT |
| Contig090G | 34453377_f1_41 | 1169 | 5295 | 930 | 309 | | | NO-HIT |
| Contig090G | 34563513_c1_387 | 1170 | 5296 | 372 | 123 | 119 | 3.40E–07 | pir:[LN:E70526] [AC:E70526] [PN:hypothetical protein Rv0324] [GN:Rv0324] [OR:*Mycobacterium tuberculosis*] |
| Contig090G | 34567177_f3_268 | 1171 | 5297 | 903 | 300 | | | NO-HIT |
| Contig090G | 34568762_c3_738 | 1172 | 5298 | 522 | 173 | | | NO-HIT |
| Contig090G | 34614066_c2_633 | 1173 | 5299 | 843 | 280 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig090G | 34626_f3_384 | 1174 | 5300 | 1218 | 405 | | | NO-HIT |
| Contig090G | 35196965_c1_451 | 1175 | 5301 | 219 | 72 | | | NO-HIT |
| Contig090G | 35396891_c2_609 | 1176 | 5302 | 675 | 224 | 381 | 3.10E−35 | gp:[GI:g606188] [LN:ECOUW67] [AC:U18997] [OR:*Escherichia coli*] [DE:*Escherichia coli* K-12 chromosomal region from 67.4 to 76.0 minutes.] [NT:ORF_f217; orfE of ECMRED, uses 2nd start] |
| Contig090G | 35442750_c1_477 | 1177 | 5303 | 213 | 70 | | | NO-HIT |
| Contig090G | 35963136_f3_314 | 1178 | 5304 | 1257 | 418 | 1088 | 3.70E−110 | sp:[LN:RTCB_ECOLI] [AC:P46850:P76690] [GN:RTCB] [OR:ESCHERICHIA COLI] [DE:RTCB PROTEIN] [SP:P46850:P76690] |
| Contig090C | 36024002_f2_248 | 1179 | 5305 | 375 | 124 | 316 | 2.40E−28 | sp:[LN:SSB_ECOLI] [AC:P02339] [GN:SSB:EXRB:LEXC] [OR:*ESCHERICHIA COLI*] [DE:SINGLE-STRAND BINDING PROTEIN (SSB) (HELIX-DESTABILIZING PROTEIN)] [SP:P02339] |
| Contig090G | 36109677_c3_677 | 1180 | 5306 | 828 | 275 | 588 | 3.60E−57 | sp:[LN:TRPA_PSESY] [AC:P34816] [GN:TRPA] [OR:*PSEUDOMONAS SYRINGAE*] [EC:4.2.1.20] [DE:TRYPTOPHAN SYNTHASE ALPHA CHAIN,] [SP:P34816] |
| Contig090G | 361 19087_c1_389 | 1181 | 5307 | 855 | 284 | 441 | 1.40E−41 | sp:[LN:YCIV_HAEIN] [AC:P44176] [GN:H11400] [OR:*HAEMOPHILUS INFLUENZAE*] [DE:HYPOTHETICAL PROTEIN H11400] [SP:P44176] |
| Contig090G | 36203563_f2_253 | 1182 | 5308 | 615 | 204 | 208 | 6.60E−17 | pir:[LN:G64496] [AC:G64496] [PN:hypothetical protein MJ1576] [OR:*Methanococcus jannaschi*] [MP:FOR 1551599–1552168] |
| Contig090G | 3906268_f2_171 | 1183 | 5309 | 1221 | 406 | 1138 | 1.90E−115 | sp:[LN:DAPE_HAEIN] [AC:P44514] [GN:DAPE:H10102] [OR:*HAEMOPHILUS INFLUENZAE*] [EC:3.5.1.18] [DE:SUCCINYL-DIAMINOPIMELATE DESUCCINYLASE, (SDAP)] [SP:P44514] |
| Contig090G | 3906278_c1_421 | 1184 | 5310 | 1473 | 490 | 102 | 5.20E−05 | gp:[GI:d1038520:g42400001] [LN:AB017186] [AC:AB017186] [PN:cardiolipin synthase] [GN:cls] [OR:*Clostridium perfringens*] [SR:*Clostridium perfringens* (strain:NCTC 8237) vegitative cell DNA] [DE:*Clostridium perfringens* genes of hem operon, complete cds.] |
| Contig090G | 3907318_c3_665 | 1185 | 5311 | 900 | 299 | 118 | 5.60E−12 | pir:[LN:F71721] [AC:F71721] [PN:hypothetical protein RP120] [GN:RP120] [OR:*Rickettsia prowazekii*] |
| Contig090G | 3907517_c3_682 | 1186 | 5312 | 1284 | 427 | | | NO-HIT |
| Contig090G | 3907587_f3_294 | 1187 | 5313 | 198 | 65 | | | NO-HIT |
| Contig090G | 391551_c1_488 | 1188 | 5314 | 840 | 279 | 544 | 1.60E−52 | sp:[LN:BACA_ECOLI] [AC:P31054:P39203] [GN:BACA] [OR:*ESCHERICHIA COLI*] [EC:2.7.1.66] [DE:(EC 2.7.1.66)] [SP:P31054:P39203] |
| Contig090G | 3931302_f1_95 | 1189 | 5315 | 1014 | 337 | 879 | 5.20E−88 | gp:[GI:d1037216:g4063776] [LN:AB008550] [AC:AB008550] [OR:*Pseudomonas aeruginosa* phage phi CTX] [SR:*Pseudomonas aeruginosa* phase phi CTX (strain:phiCTX-c] [DE:*Pseudomonas aeruginosa* phage phi CTX, complete genome sequence.] [NT:orf4; similar to N of P2:major capsid protein] |

TABLE 2-continued

| Query | Orf | NT ID | AA ID | NT Lgth | AA Lgth | Score | P-value | Subject |
|---|---|---|---|---|---|---|---|---|
| Contig090G | 3939702_c2_582 | 1190 | 5316 | 432 | 143 | 314 | 3.90E−28 | sp:[LN:MSCL_ECOLI] [AC:P23867] [GN:MSCL] [OR:*ESCHERICHIA COLI*] [DE:LARGE CONDUCTANCE MECHANOSENSITIVE CHANNEL] [SP:P23867] |
| Contig090G | 3944068_f2_249 | 1191 | 5317 | 747 | 248 | 185 | 1.80E−14 | pir:[LN:D64946] [AC:D64946] [PN:probable DNA polymerase III epsilon chain] [OR:*Escherichia coli*] |
| Contig090G | 3956512_c2_600 | 1192 | 5318 | 1224 | 407 | 570 | 2.90E−55 | pir:[LN:E69783] [AC:E69783] [PN:bicyclomycin resistance protein homolog ydgK] [GN:ydgK] [CL:bicyclomycin resistance protein] [OR:*Bacillus subtilis*] |
| Contig090G | 4063132_f1_78 | 1193 | 5319 | 246 | 81 | | | NO-HIT |
| Contig090G | 4068768_c3_709 | 1194 | 5320 | 378 | 125 | 168 | 1.10E−12 | gp:[GI:g1002863] [LN:PDU34346] [AC:U34346] [PN:unknown] [OR:*Paracoccus denitrificans*] [DE:*Paracoccus denitrificans* NAD-GSH-dependent formaldehydedehydrogenase (flhA), ClpP (clpP), S-formylglutathione hydrolase(fghA), PQQ-dependent dehydrogenase large subunit (xoxF), cytochrome c553i (cycB), XoxJ (xoxJ), and XoxI (xoxI) genes, complete cds.] [NT:orf1] |
| Contig090G | 4079527_f3_309 | 1195 | 5321 | 195 | 64 | | | NO-HIT |
| Contig090G | 4103382_c2_620 | 1196 | 5322 | 306 | 101 | | | NO-HIT |
| Contig090G | 4116327_f3_373 | 1197 | 5323 | 2739 | 912 | 1612 | 1.10E−165 | gp:[GI:d1037251:g4063811] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf37] |
| Contig090G | 411683_f2_238 | 1198 | 5324 | 945 | 314 | 706 | 1.10E−69 | sp:[LN:VPJ_BPP2] [AC:P51767] [GN:J] [OR:BACTERIOPHAGE P2] [DE:BASEPLATE ASSEMBLY PROTEIN J (GPJ)] [SP:P51767] |
| Contig090G | 4117138_c1_458 | 1199 | 5325 | 366 | 121 | 271 | 1.40E−23 | sp:[LN:YEAO_ECOLI] [AC:P76243] [GN:YEAO] [OR:*ESCHERICHIA COLI*] [DE:HYPOTHETICAL 14.2 KD PROTEIN IN GAPA-RND INTERGENIC REGION] [SP:P76243] |
| Contig090G | 4144067_f2_218 | 1200 | 5326 | 498 | 165 | | | NO-HIT |
| Contig090G | 4301677_f3_321 | 1201 | 5327 | 300 | 99 | | | NO-HIT |
| Contig090G | 4328193_f2_200 | 1202 | 5328 | 651 | 216 | 909 | 3.50E−91 | gp:[GI:g3420603] [LN:AF075709] [AC:AF0755709] [PN:LsfA] [GN:lsfA] [OR:*Pseudomonas putida*] [DE:*Pseudomonas putida* LsfA (lsfA), complete cds; and ssu locus, complete sequence.] |
| Contig090G | 433768_c3_706 | 1203 | 5329 | 474 | 157 | | | NO-HIT |
| Contig090G | 4378443_f3_313 | 1204 | 5330 | 1470 | 489 | 1638 | 1.90E−168 | sp:[LN:LYSP_ECOLI] [AC:P25737] [GN:LYSP:CADR] [OR:*ESCHERICHIA COLI*] [DE:LYSINE-SPECIFIC PERMEASE] [SP:P25737] |
| Contig090G | 439062_f2_150 | 1205 | 5331 | 1464 | 487 | 555 | 1.10E−53 | gp:[GI:g598251] [LN:MBOOMPE] [AC:L31788] [PN:outer membrane protein E] [OR:*Moraxella catarrhalis*] [SR:*Moraxella catarrhalis* (strain 25240) DNA] [DE:*Moraxella catarrhalis* outer membrane protein E gene, complete cds.] |
| Contig090G | 4392143_f1_121 | 1206 | 5332 | 504 | 167 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig090G | 4426306_c1_446 | 1207 | 5333 | 1653 | 550 | 1880 | 4.40E−194 | gp:[GI:g2565334] [LN:AF026066] [AC:AF026066] [PN:sulfite reductase] [GN cysI] [OR:*Pseudomonas aeruginosa*] [DE:*Pseudomonas aeruginosa* sulfite reductase (cysI) gene, complete cds.] [NT:hemoprotein subunit] |
| Contig090G | 4462838_f3_312 | 1208 | 5334 | 1023 | 340 | 475 | 3.40E−45 | sp:[LN:YJJT_HAEIN] [AC:P44453] [GN:H10012] [OR:*HAEMOPHILUS INFLUENZAE*] [DE:HYPOTHETICAL PROTEIN H10012] [SP:P44453] |
| Contig090G | 4503776_f1_21 | 1209 | 5335 | 750 | 249 | 446 | 4.00E−42 | pir:[LN:A32667] [AC:A32667:A54055] [PN:NAD(P)H dehydrogenase (quinone), 2] [GN:NMOR2] [CL:NAD(P)H dehydrogenase (quinone) 2] [OR:Homo sapiens] [SR:, man] [EC:1.6.99.2] [MP:6pter-6q12] |
| Contig090G | 4537518_c3_666 | 1210 | 5336 | 765 | 254 | 234 | 1.20E−19 | pir:[LN:A70081] [AC:A70081] [PN:conserved hypothetical protein yxkH] [GN:yxkH] [OR:*Bacillus subtilis*] |
| Contig090G | 4539193_f2_155 | 1211 | 5337 | 1482 | 493 | 1470 | 1.20E−150 | sp:[LN:YBL3_MORCA] [AC:Q49092] [OR:*MORAXELLA CATARRHALIS*] [DE:HYPOTHETICAL 46.4 KD PROTEIN IN BLOR-1 3'REGION (ORF3)] [SP:Q49092] |
| Contig090G | 4687518_f2_187 | 1212 | 5338 | 525 | 174 | 125 | 4.10E−08 | sp:[LN:ECPB_EIKCO] [AC:P35646] [GN:ECPB] [OR:*EIKENELLA CORRODENS*] [DE:FIMBRIAL PROTEIN ECPB PRECURSOR (PILIN)] [SP:P35646] |
| Contig090G | 4689202_c3_676 | 1213 | 5339 | 996 | 331 | | | NO-HIT |
| Contig090G | 4724168_f2_192 | 1214 | 5340 | 195 | 64 | | | NO-HIT |
| Contig090G | 47642_f1_106 | 1215 | 5341 | 342 | 113 | | | NO-HIT |
| Contig090G | 4788267_f2_242 | 1216 | 5342 | 2460 | 819 | 515 | 8.10E−47 | gp:[GI:g3139112] [LN:AF063097] [AC:AF063097:J02474:X02300:X02301:M58023:M13202:L29304:X87173:M6467 7] [PN:gpT] [GN:T] [FN:essential tail protein; putative tail length] [OR:Bacteriophage P2] [DE:Bacteriophage P2, complete genome.] |
| Contig090G | 4798588_c2_566 | 1217 | 5343 | 522 | 173 | | | NO-HIT |
| Contig090G | 4875313_f2_254 | 1218 | 5344 | 339 | 112 | 243 | 1.30E−20 | sp:[LN:YAJC_ECOLI] [AC:P19677] [GN:YAJC] [OR:*ESCHERICHIA COLI:SHIGELLA FLEXNERI*] [DE:HYPOTHETICAL 11.9 KD PROTEIN IN TGT-SECD INTERGENIC REGION (ORF12)] [SP:P19677] |
| Contig090G | 4881313_c3_698 | 1219 | 5345 | 1119 | 372 | 666 | 1.90E−65 | gp:[GI:e1362560:g4106687] [LN:SPBC23G7] [AC:AL035065] [PN:putative nadh-dependent flavin oxidoreductase] [GN:SPBC23G7.10c] [OR:*Schizosaccharomyces pombe*] [SR:fission yeast] [DE:S pombe chromosome II cosmid c23G7.] [NT:SPBC23G7.10c, len:395, SIMILARITY:Bacillus] |
| Contig090G | 4881567_c3_688 | 1220 | 5346 | 363 | 120 | 150 | 9.30E−11 | pir:[LN:A48905] [AC:A48905:S32181:S25583] [PN:small multidrug export protein qacE:multidrug importer] [GN:qacE] [CL:sugE protein] [OR:*Klebsiella pneumoniae*] |

TABLE 2-continued

| Query | Orf | NT ID | AA ID | NT Lgth | AA Lgth | Score | P-value | Subject |
|---|---|---|---|---|---|---|---|---|
| Contig090G | 4901552_c3_697 | 1221 | 5347 | 2145 | 714 | 1617 | 3.30E−166 | pir:[LN:F64897] [AC:F64897] [PN:hypothetical protein b1451 precursor] [CL:tonB-dependent receptor amino-terminal homology] [OR:*Escherichia coli*] |
| Contig090G | 4937583_c2_581 | 1222 | 5348 | 1851 | 616 | 2223 | 2.00E−230 | sp:[LN:TYPA_HAEIN] [AC:P44910] [GN:TYPA:H10864] [OR:*HAEMOPHILUS INFLUENZAE*] [DE:GTP-BINDING PROTEIN TYPA/BIPA HOMOLOG] [SP:P44910] |
| Contig090G | 4964750_f3_284 | 1223 | 5349 | 1008 | 335 | 159 | 1.60E−21 | gp:[GI:g2541936] [LN:PSU27310] [AC:U27310] [PN:unknown] [OR:*Pseudomonas syringae*] [DE:*Pseudomonas syringae* phaseolotoxin gene cluster, complete sequence.] [NT:ORF6; similar to *Pseudomonas syringae* fatty acid] |
| Contig090G | 5078336_f2_127 | 1224 | 5350 | 447 | 148 | | | NO-HIT |
| Contig090G | 5115902_c3_664 | 1225 | 5351 | 1341 | 446 | 328 | 8.80E−29 | pir:[LN:S75662] [AC:S75662] [PN:sensor transduction histidine kinase sl11871:protein sl11871:protein sl11871] [OR:Synechocystis sp.] [SR:PCC 6803, , PCC 6803] [SR:PCC 6803,] |
| Contig090G | 5117137_f3_379 | 1226 | 5352 | 918 | 305 | 508 | 1.10E−48 | pir:]LN:C64906] [AC:C64906] [PN:probable membrane protein b1520] [OR:*Escherichia coli*] |
| Contig090G | 523382_c1_388 | 1227 | 5353 | 348 | 115 | | | NO-HIT |
| Contig090G | 5261500_c1_427 | 1228 | 5354 | 672 | 223 | 945 | 5.30E−95 | sp:[LN:TRPF_ACICA] [AC:P16923] [GN:TRPF] [OR:*ACINETOBACTER CALCOACETICUS*] [EC:5.3.1.24] [DE:N-(5'-PHOSPHORIBOSYL)ANTHRANILATE ISOMERASE, (PRA1)] [SP:P16923] |
| Contig090G | 5289077_f3_363 | 1229 | 5355 | 210 | 69 | 199 | 6.00E−16 | gp:[GI:d1037220:g4063780] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf8; similar to X gene of P2] |
| Contig090G | 548502_f2_158 | 1230 | 5356 | 768 | 255 | | | NO-HIT |
| Contig090G | 551553_c3_730 | 1231 | 5357 | 2004 | 667 | | | NO-HIT |
| Contig090G | 56317_f1_81 | 1232 | 5358 | 654 | 217 | 340 | 6.80E−31 | pir:[LN:S52745] [AC:S52745] [PN:stearoyl-CoA desaturase,:delta 9-fatty acid desaturase] [GN:Ole1] [CL:yeast stearoyl-CoA desaturase:cytochrome b5 core homology:stearoyl-CoA desaturase homology] [OR:*Ajellomyces capsulata*:*Histoplasma capsulatum*] [EC:1.14.99.5] |
| Contig090G | 56630_c2_584 | 1233 | 5359 | 927 | 308 | 228 | 5.00E−19 | sp:[LN:YWKB_BACSU] [AC:P45869] [GN:YWKB] [OR:*BACILLUS SUBTILIS*] [DE:HYPOTHETICAL 33.6 KD PROTEIN IN TDK-PRFA INTERGENIC REGION] [SP:P45869] |
| Contig090G | 5890952_c2_514 | 1234 | 5360 | 438 | 145 | 665 | 2.50E−65 | sp:[LN:THI3_CORNE] [AC:P52228] [OR:*CORYNEBACTERIUM NEPHRIDII*] [DE:THIOREDOXIC C-3] [SP:P52228] |

TABLE 2-continued

| Query | Orf | NT ID | AA ID | NT Lgth | AA Lgth | Score | P-value | Subject |
|---|---|---|---|---|---|---|---|---|
| Contig090G | 5995666_f1_37 | 1235 | 5361 | 2325 | 774 | 1871 | 4.00E−193 | sp:[LN:YCCS_ECOLI] [AC:P75870] [GN:YCCS] [OR:*ESCHERICHIA COLI*] [DE:HYPOTHETICAL 82.0 KD PROTEIN IN SULA-HEAD INTERGENIC REGION] [SP:P75870] |
| Contig090G | 6054750_c3_659 | 1236 | 5362 | 186 | 61 | | | NO-HIT |
| Contig090G | 6064800_f1_29 | 1237 | 5363 | 327 | 108 | 145 | 3.10E−10 | pir:[LN:D70484] [AC:D70484] [PN:glutamyl-tRNA (Gln) amidotransferase subunit C] [GN:gatC] [CL:probable glu-tRNA amidotransferase C chain] [OR:*Aquifex aeolicus*] |
| Contig090G | 6367688_c2_608 | 1238 | 5364 | 1050 | 349 | 1161 | 6.80E−118 | sp:[LN:MREB_ECOLI] [AC:P13519:P76678] [GN:MREB:ENVB:RODY] [OR:*ESCHERICHIA COLI*] [DE:ROD SHAPE-DETERMINING PROTEIN MREB] [SP:P13519:P76678] |
| Contig090G | 6437638_f2_169 | 1239 | 5365 | 189 | 62 | | | NO-HIT |
| Contig090G | 6542752_c3_651 | 1240 | 5366 | 891 | 296 | 161 | 1.20E−09 | gp:[GI:g4530501] [LN:AF125163] [AC:AF125163] [PN:unknown] [FN:involved in phage exclusion] [OR:Bacteriophage K139] [DE:Bacteriophage K139 lysogenic/lytic control region.] [NT:orf2] |
| Contig090G | 6646903_f3_377 | 1241 | 5367 | 1164 | 387 | | | NO-HIT |
| Contig090G | 683411_c1_512 | 1242 | 5368 | 192 | 64 | | | NO-HIT |
| Contig090G | 6836001_f1_117 | 1243 | 5369 | 996 | 331 | 621 | 1.10E−60 | sp:[LN:SECF_HAEIN] [AC:P44590] [GN:SECF:H10239] [OR:*HAEMOPHILUS INFLUENZAE*] [DE:PROTEIN-EXPORT MEMBRANE PROTEIN SECF] [SP:P44590] |
| Contig090G | 7063812_f1_10 | 1244 | 5370 | 237 | 78 | | | NO-HIT |
| Contig090G | 7161341_f2_221 | 1245 | 5371 | 474 | 157 | 400 | 5.40E−37 | sp:[LN:SYD_AQUAE] [AC:O67589] [GN:ASPS] [OR:*AQUIFEX AEOLICUS*] [EC:6.1.1.12] [DE:(ASPRS)] [SP:O67589] |
| Contig090G | 7166258_f2_201 | 1246 | 5372 | 597 | 198 | 104 | 0.00092 | gp:[GI:g2702271] [LN:ATAC003033] [AC:AC003033] [GN:T21L14.10] [OR:*Arabidopsis thaliana*] [SR:thale cress] [DE:*Arabidopsis thaliana* chromosome II BAC T21L14 genomic sequence, complete sequence.] [NT:unknown protein] |
| Contig090G | 800_c3_663 | 1247 | 5373 | 264 | 87 | | | NO-HIT |
| Contig090G | 817192_f1_49 | 1248 | 5374 | 750 | 249 | 150 | 2.00E−16 | sp:[LN:Y466_HAEIN] [AC:P44000] [GN:HI0466] [OR:*HAEMOPHILUS INFLUENZAE*] [DE:HYPOTHETICAL PROTEIN HI0466] [SP:P44000] |
| Contig090G | 820327_c1_417 | 1249 | 5375 | 1029 | 342 | | | NO-HIT |
| Contig090G | 865628_f2_141 | 1250 | 5376 | 315 | 104 | | | NO-HIT |
| Contig090G | 956885_c1_494 | 1251 | 5377 | 213 | 70 | | | NO-HIT |
| Contig090G | 975063_c3_729 | 1252 | 5378 | 1404 | 467 | | | NO-HIT |
| Contig090G | 8767963_f2_262 | 1253 | 5379 | 1428 | 475 | 484 | 3.80E−46 | sp:[LN:MERA_STAAU] [AC:P08663] [GN:MERA] [OR:*STAPHYLOCOCCUS AUREUS*] [EC:1.16.1.1] [DE:MERCURIC REDUCTASE, (HG(II) REDUCTASE)] [SP:P08663] |

TABLE 2-continued

| Query | Orf | NT ID | AA ID | NT Lgth | AA Lgth | Score | P-value | Subject |
|---|---|---|---|---|---|---|---|---|
| Contig090G | 9772687_f1_99 | 1254 | 5380 | 693 | 230 | 261 | 1.60E−22 | gp:[GI:d1037229:g4063789] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf16; similar to V gene of P2:baseplate] |
| Contig090G | 9798433_f3_328 | 1255 | 5381 | 936 | 311 | 434 | 7.50E−41 | sp:[LN:YU09_MYCTU] [AC:Q50665] [GN:MTCY339.09] [OR:*MYCOBACTERIUM TUBERCULOSIS*] [DE:HYPOTHETICAL 34.4 KD PROTEIN CY339.09] [SP:Q50665] |
| Contig090G | 9806532_c2_555 | 1256 | 5382 | 1095 | 364 | 350 | 4.90E−35 | pir:[LN:S42434] [AC:S42434] [PN:hypothetical protein] [OR:*Neisseria meningitidis*] |
| Contig090G | 9869007_f2_260 | 1257 | 5383 | 492 | 163 | 419 | 2.90E−39 | sp:[LN:YAJQ_HAEIN] [AC:P44096] [GN:H11034] [OR:*HAEMOPHILUS INFLUENZAE*] [DE:HYPOTHETICAL PROTEIN H11034] [SP:P44096] |
| Contig090G | 9958137_c1_479 | 1258 | 5384 | 1014 | 337 | 427 | 4.10E−40 | pir:[LN:H69874] [AC:H69874] [PN:conserved hypothetical protein ylbK] [GN:ylbK] [OR:*Bacillus subtilis*] |
| Contig090G | 9979557_f3_361 | 1259 | 5385 | 843 | 280 | 542 | 2.70E−52 | gp:[GI:d1037215:g4063775] [LN:AB008550] [AC:AB008550] [OR:*Pseudomonas aeruginosa* phage phi CTX] [SR:*Pseudomonas aeruginosa* phage phi CTX (strain:phiCTX-c] [DE:*Pseudomonas aeruginosa* phage phi CTX, complete genome sequence.] [NT:orf3; similar to O gene of P2:presumed capsid] |
| Contig092G | 10276687_f2_84 | 1260 | 5386 | 894 | 297 | 427 | 4.10E−40 | sp:[LN:DAPA_BACSU] [AC:Q0496] [GN:DAPA] [OR:*BACILLUS SUBTILIS*] [EC:4.2.1.52] [DE:PROTEIN 81) (VEG81)] [SP:Q04796] |
| Contig092G | 10740637_c3_246 | 1261 | 5387 | 222 | 73 | 84 | 0.00092 | sp:[LN:YSMA_BACSU] [AC:P11469] [GN:YSMA] [OR:*BACILLUS SUBTILIS*] [DE:HYPOTHETICAL 17.1 KD PROTEIN IN SDHB-GERE INTERGENIC REGION] [SP:P11469] |
| Contig092G | 1178518_c2_203 | 1262 | 5388 | 951 | 316 | 942 | 1.10E−94 | sp:[LN:HEM3_PROM1] [AC:Q59684] [GN:HEMC] [OR:*PROTEUS MIRABILIS*] [EC:4.3.1.8] [DE:SYNTHASE) (HMBS) (PRE-UROPORPHYRINOGEN SYNTHASE)] [SP:Q59684] |
| Contig092G | 1182842_f1_18 | 1263 | 5389 | 933 | 310 | 742 | 1.70E−73 | sp:[LN:XERD_ECOLI] [AC:P21891] [GN:XERD:XPRB] [OR:*ESCHERICHIA COLI*] [DE:INTEGRASE/RECOMBINASE XERD] [SP:P21891] |
| Contig092G | 13675842_c3_245 | 1264 | 5390 | 786 | 261 | 207 | 8.50E−17 | sp:[LN:HEM4_PSEAE] [AC:P48246] [GN:HEMD] [OR:*PSEUDOMONAS AERUGINOSA*] [*EC:4.2.1.75*] [DE:III COSYNTHETASE] (HYDROXYMETHYLBILANE HYDROLYASE [CYCLIZING])] [SP:P48246] |

TABLE 2-continued

| Query | Orf | NT ID | AA ID | NT Lgth | AA Lgth | Score | P-value | Subject |
|---|---|---|---|---|---|---|---|---|
| Contig092G | 13681533_c3_221 | 1265 | 5391 | 663 | 220 | 619 | 1.90E−60 | sp:[LN:RISA_PHOPO] [AC:P51961] [GN:RIBE] [OR:*PHOTOBACTERIUM PHOSPHOREUM*] [EC:2.5.1.9] [DE:RIBOFLAVIN SYNTHASE ALPHA CHAIN.] [SP:P51961] |
| Contig092G | 13836555_c3_220 | 1266 | 5392 | 1335 | 444 | 279 | 1.00E−21 | sp:[LN:MTFl_FLAOK] [AC:P14871] [GN:MFOKI] [OR:*FLAVOBACTERIUM OKEANOKOITES*] [EC:2.1.1.72] [DE:METHYLTRANSFERASE FOKI) (M. FOKI)] [SP:P14871] |
| Contig092G | 13866012_f2_79 | 1267 | 5393 | 669 | 222 | 121 | 0.00013 | sp:[LN:NFM_CHICK] [AC:P16053] [GN:NEFM] [OR:*GALLUS GALLUS*] [DE:NEUROFILAMENT TRIPLET M PROTEIN (160 KD NEUROFILAMENT PROTEIN) (NF-M)] [SP:P16053] |
| Contig092G | 1460875_c3_247 | 1268 | 5394 | 459 | 152 | 233 | 1.50E−19 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |
| Contig092G | 14647126_f2_83 | 1269 | 5395 | 864 | 287 | 208 | 8.70E−15 | sp:[LN:HTS_DROME] [AC:Q02645] [GN:HTS] [OR:*DROSOPHILA MELANOGASTER*] [SR:,FRUIT FLY] [DE:HU-LI TAI SHAO PROTEIN] [SP:Q02645] |
| Contig092G | 14879033_f3_103 | 1270 | 5396 | 1440 | 479 | 1269 | 2.50E−129 | pir:[LN:C69589] [AC:C69589] [PN:argininosuccinate lyase argH] [GN:argH] [CL:argininosuccinate lyase] [OR:*Bacillus subtilis*] |
| Contig092G | 15136268_c2_185 | 1271 | 5397 | 1413 | 470 | 1347 | 1.30E−137 | gp:[GI:g3136068] [LN:AF005275] [AC:AF00527] [PN:AmtB] [GN:amtB] [FN:ammonium transporter] [OR:*Azospirillum brasilense*] [DE:*Azospirillum brasilense*ammonium transporter AmtB (amtB) gene, complete cds.] |
| Contig092G | 15823527_c1_170 | 1272 | 5398 | 921 | 306 | 340 | 6.80E−31 | sp:[LN:YWFM_BACSU] [AC:P39649] [GN:YMFM:IPA-91D] [OR:*BACILLUS SUBTILIS*] [DE:HYPOTHETICAL 31.3 KD PROTEIN IN PTA 3'REGION] [SP:P39649] |
| Contig092G | 16046937_c2_204 | 1273 | 5399 | 894 | 297 | | | NO-HIT |
| Contig092G | 16101051_f1_23 | 1274 | 5400 | 219 | 72 | | | NO-HIT |
| Contig092G | 16484587_f3_139 | 1275 | 5401 | 231 | 77 | | | NO-HIT |
| Contig092G | 16495635_f1_53 | 1276 | 5402 | 228 | 75 | | | NO-HIT |
| Contig092G | 16836428_f3_117 | 1277 | 5403 | 414 | 137 | 174 | 2.70E−13 | gp:[GI:g2984772] [LN:AF054622] [AC:AF054622] [PN:DNA polymerase holoenzyme chi subunit] [GN:holC] [OR:*Pseudomonas aeruginosa*] [DE:*Pseudomonas aeruginosa* PhpA (phpA) and DNA polymerase holoenzymechi subunit (holC) genes, complete cds.] [NT:HolC; similar to *Escherichia coli* HolC] |
| Contig092G | 16909683_f2_78 | 1278 | 5404 | 1464 | 487 | 1145 | 3.40E−116 | gp:[GI:g2984771] [LN:AF054622] [AC:AF054622] [PN:PhpA] [GN:phpA] [OR:*Pseudomonas aeruginosa*] [DE:*Pseudomonas aeruginosa* PhpA (phpA) and DNA polymerase holoenzymechi subunit (holC) genes, complete cds.] [NT:alternative putative start codon indicated at nt] |
| Contig092G | 17165_f1_6 | 1279 | 5405 | 1140 | 379 | | | NO-HIT |
| Contig092G | 20714717_c1_165 | 1280 | 5406 | 264 | 87 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig092G | 21507890_f3_131 | 1281 | 5407 | 789 | 262 | 353 | 2.90E−32 | sp:[LN:YEGX_ECOLI] [AC:P76421:O08480] [GN:YEGX] [OR:*ESCHERICHIA COLI*] [DE:HYPOTHETICAL 32.0 KD PROTEIN IN FBAB-THID INTERGENIC REGION] [SP:P76421:O08480] |
| Contig092G | 21520937_c2_196 | 1282 | 5408 | 1416 | 471 | 860 | 5.40E−86 | sp:[LN:MURD_ECOLI] [AC:P14900] [[GN:MURD] [OR:*ESCHERICHIA COLI*] [EC:6.3.2.9] [DE:ADDING ENZYME)] [SP:P14900] |
| Contig092G | 22447077_c3_224 | 1283 | 5409 | 1185 | 394 | 484 | 3.80E−46 | pir:[LN:F64688] [AC:F64688] [PN:proteinase,] [CL:carboxyl-terminal processing proteinase] [OR:*Helicobacter pylori*] [EC:3.4.—.—] |
| Contig092G | 22864757_f3_122 | 1284 | 5410 | 267 | 88 | 88 | 0.00035 | sp:[LN:YQIC_ECOLI] [AC:Q46868] [GN:YQIC] [OR:*ESCHERICHIA COLI*] [DE:HYPOTHETICAL 13.8 KD PROTEIN IN RIBB-GLGS INTERGENIC REGION] [SP:Q46868] |
| Contig092G | 23454376_c2_181 | 1285 | 5411 | 690 | 229 | 614 | 6.30E−60 | pir:[LN:H65165] [AC:H65165] [PN:hypothetical 22.0 kD protein in rph-gmk intergenic region] [GN:yicG] [CL:hypothetical protein b1832] [OR:*Escherichia coli*] |
| Contig092G | 23460285_c3_213 | 1286 | 5412 | 2262 | 753 | 2288 | 2.60E−237 | gp:[GI:d1038141:g4176379] [LN:AB003428] [AC:AB003428] [PN:topoisomerase IV subunit] [GN:parC] [OR:*Pseudomonas aeruginosa*] [SR:*Pseudomonas aeruginosa* DNA] [DE:*Pseudomonas aeruginosa* parC gene for topoisomerase IV subunit, complete cds.] |
| Contig092G | 23536555_f3_112 | 1287 | 5413 | 1590 | 529 | 538 | 7.10E−52 | sp:[LN:PILS_PSEAE] [AC:P33639] [OR:*PSEUDOMONAS AERUGINOSA*] [EC:2.7.3.—] [DE:SENSOR PROTEIN PILS,] [SP:P33639] |
| Contig092G | 23629587_f1_44 | 1288 | 5414 | 1068 | 355 | 697 | 1.00E−68 | sp:[LN:DINP_ECOLI] [AC:Q47155:Q47683] [GN:DINP] [OR:*ESCHERICHIA COLI*] [DE:DNA-DAMAGE-INDUCIBLE PROTEIN P] [SP:Q47155:Q47683] |
| Contig092G | 23629715_f2_81 | 1289 | 5415 | 1500 | 499 | 1201 | 3.90E−122 | sp:[LN:YIFB_ECOLI] [AC:P22787] [GN:YIFB] [OR:*ESCHERICHIA COLI*] [DE:(F516) [CONTAINS: ORF I]] [SP:P22787] |
| Contig092G | 23632893_f2_93 | 1290 | 5416 | 639 | 212 | 425 | 6.70E−40 | pir:[LN:D70033] [AC:D70033] [PN:conserved hypothetical protein yvdD] [GN:yvdD] [CL:yeast conserved hypothetical protein YJL055w] [OR:*Bacillus subtilis*] |
| Contig092G | 23709417_c3_217 | 1291 | 5417 | 876 | 291 | | | NO-HIT |
| Contig092G | 23834430_f1_35 | 1292 | 5418 | 192 | 63 | | | NO-HIT |
| Contig092G | 24219393_f2_85 | 1293 | 5419 | 1329 | 442 | 738 | 4.60E−73 | gp:[GI:d1023129:g2425172] [LN:AB006797] [AC:AB006797] [PN:OprE3] [GN:oprQ] [OR:*Pseudomonas aeruginosa*] [SR:*Pseudomonas aeruginosa* (strain:PAO1) DNA] [DE:*Pseudomonas aeruginosa* oprQ gene for OprE3, complete cds.] |

TABLE 2-continued

| Query | Orf | NT ID | AA ID | NT Lgth | AA Lgth | Score | P-value | Subject |
|---|---|---|---|---|---|---|---|---|
| Contig092G | 24257888_f1_8 | 1294 | 5420 | 660 | 219 | 347 | 1.20E−31 | sp:[LN:YQIE_ECOLI] [AC:P36651] [GN:YQIE] [OR:*ESCHERICHIA COLI*] [DE:HYPOTHETICAL 23.7 KD PROTEIN IN ICC-TOLC INTERGENIC REGION (F209)] [SP:P36651] |
| Contig092G | 24395386_f1_1 | 1295 | 5421 | 186 | 61 | | | NO-HIT |
| Contig092G | 24611093_c1_172 | 1296 | 5422 | 1152 | 383 | 493 | 4.20E−47 | gp:[GI:g1542980] [LN:PAU52431] [AC:U52431] [PN:AlgZ] [GN:algZ] [FN:AlgR-cognate sensor, negative regulator of] [OR:*Pseudomonas aeruginosa*] [SR:*Pseudomonas aeruginosa* strain=PAO568] [DE:*Pseudomonas aeruginosa* AlgR-cognate sensor AlgZ (algZ) gene, complete cds.] [NT:Sensor of two-component system; homologous to S.] |
| Contig092G | 24820307_c3_223 | 1297 | 5423 | 1566 | 521 | 1710 | 4.60E−176 | sp:[LN:PMGI_PSESM] [AC:P52832] [GN:PGM] [OR:*PSEUDOMONAS SYRINGAE*] [*EC:5.4.2.1*] [DE:(EC 5.4.2.1) (PHOSPHOGLYCEROMUTASE) (BPG-INDEPENDENT PGAM)] [SP:P52832] |
| Contig092G | 25407843_c2_199 | 1298 | 5424 | 252 | 83 | | | NO-HIT |
| Contig092G | 25556660_f2_65 | 1299 | 5425 | 564 | 187 | 495 | 2.60E−47 | sp:[LN:DKSA_ECOLI] [AC:P18274] [GN:DKSA] [OR:*ESCHERICHIA COLI*] [DE:DNAK SUPPRESSOR PROTEIN] [SP:P18274] |
| Contig092G | 25595275_f1_21 | 1300 | 5426 | 1326 | 441 | 1141 | 9.00E−116 | sp:[LN:DHOM_PSEAE] [AC:P29365] [GN:HOM] [OR:*PSEUDOMONAS AERUGINOSA*] [*EC:1.1.1.3*] [DE:HOMOSERINE DEHYDROGENASE, (HDH)] [SP:P29365] |
| Contig092G | 258_c2_180 | 1301 | 5427 | 495 | 164 | 397 | 6.20E−37 | sp:[LN:YCHJ_HAEIN] [AC:P44609] [GN:H10277] [OR:*HAEMOPHILUS INFLUENZAE*] [DE:HYPOTHETICAL PROTEIN H10277] [SP:P44609] |
| Contig092G | 26843753_f2_74 | 1302 | 5428 | 1434 | 477 | 1153 | 4.80E−117 | pir:[LN:S26601] [AC:S33674:S26601] [PN:transcription activator pilR] [CL:nitrogen assimilation regulatory protein ntrC:response regulator homology:RNA polymerase sigma factor interaction domain homology] [OR:*Pseudomonas aeruginosa*] |
| Contig092G | 29464153_c2_192 | 1303 | 5429 | 1062 | 353 | 534 | 1.90E−51 | sp:[LN:PBP5_PSEAE] [AC:P72161] [GN:PBPG] [OR:*PSEUDOMONAS AERUGINOSA*] [EC:3.4.99.—] [DE:ENDOPEPTIDASE), (DD-ENDOPEPTIDASE)] [SP:P72161] |

TABLE 2-continued

| Query | Orf | NT ID | AA ID | NT Lgth | AA Lgth | Score | P-value | Subject |
|---|---|---|---|---|---|---|---|---|
| Contig092G | 31796917_f2_73 | 1304 | 5430 | 771 | 256 | 614 | 6.30E-60 | gp:[GI:g472403] [LN:PSEMETH] [AC:L29642] [PN:response regulator/transcription activator] [OR:*Pseudomonas fluorescens*] [SR:*Pseudomonas fluorescens* (strain BL915) DNA] [DE:*Pseudomonas fluorescens* methyltransferase gene, sensor kinase gene, phosphatidylglycerophosphate synthse (pgsA) gene, UVR excinucleasesubunit C (uvrC) gene, response regulator/transcription activatorgene, complete cds.] [NT:homology with uvrY of *E. coli* and gacA of P.] |
| Contig092G | 3182827_c1_173 | 1305 | 5431 | 741 | 246 | 570 | 2.90E-55 | sp:[LN:ALGR_PSEAE] [AC:P26275] [GN:ALGR] [OR:*PSEUDOMONAS AERUGINOSA*] [DE:POSITIVE ALGINATE BIOSYNTHESIS REGULATORY PROTEIN] [SP:P26275] |
| Contig092G | 31910816_f1_46 | 1306 | 5432 | 339 | 112 | | | NO-HIT |
| Contig092G | 33694512_c2_179 | 1307 | 5433 | 1620 | 539 | 1193 | 2.80E-121 | pir:[LN:F64972] [AC:F64972] [PN:hypothetical protein b2063] [OR:*Escherichia coli*] |
| Contig092G | 3376637_c2_175 | 1308 | 5424 | 2439 | 812 | 1425 | 3.60E-148 | sp:[LN:YGIQ_ECOLI] [AC:Q46861] [GN:YGIQ] [OR:*ESCHERICHIA COLI*] [DE:HYPOTHETICAL 46.9 KD PROTEIN IN METC-SUFI INTERGENIC REGION] [SP:Q46861] |
| Contig092G | 3412750_f2_87 | 1309 | 5435 | 399 | 132 | | | NO-HIT |
| Contig092G | 34265631_c2_190 | 1310 | 5436 | 1119 | 372 | 420 | 2.30E-39 | sp:[LN:YJGP_ECOLI] [AC:P39340] [GN:YJGP] [OR:*ESCHERICHIA COLI*] [DE:HYPOTHETICAL 40.4 KD PROTEIN IN PEPA-GNTV INTERGENIC REGION (O366)] [SP:P39340] |
| Contig092G | 3526587_c2_184 | 1311 | 5437 | 375 | 124 | 482 | 6.10E-46 | gp:[GI:g2735324] [LN:AVU91902] [AC:U91902] [PN:PII-protein] [GN:glnB] [OR:*Azotobacter vinelandii*] [DE:*Azotobacter vinelandii* PII-protein (glnB) and methylammoniumtransport protein (amtB) genes, complete cds.] |
| Contig092G | 35272812_c3_218 | 1312 | 5438 | 1476 | 491 | 495 | 2.60E-47 | pir:[LN:G69825] [AC:G69825] [PN:transcription regulator GntR family homolog yhdl] [GN:yhdl] [CL:hypothetical protein b1439] [OR:*Bacillus subtilis*] |
| Contig092G | 35820917_c2_195 | 1313 | 5439 | 1902 | 633 | 1654 | 3.90E-170 | gp:[GI:g3128348] [LN:AF010496] [AC:AF010496] [PN:ferrous iron transport protein b] [OR:*Rhodobacter capsulatus*] [DE:*Rhodobacter capsulatus* strain SB1003, partial genome.] |
| Contig092G | 36211402_f2_64 | 1314 | 5440 | 831 | 276 | 441 | 1.40E-41 | sp:[LN-ICC_HAEIN] [AC:P44685] [GN:ICC:H10399] [OR:*HAEMOPHILUS INFLUENZAE*] [DE:ICC PROTEIN HOMOLOG] [SP:P44685] |
| Contig092G | 36348800_c1_141 | 1315 | 5441 | 243 | 80 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig092G | 36538892_c1_144 | 1316 | 5442 | 420 | 139 | 151 | 7.30E−11 | sp:[LN:YBBI_ECOLI] [AC:P77565] [GN:YBBI] [OR:*ESCHERICHIA COLI*] [DE:HYPOTHETICAL TRANSCRIPTIONAL REGULATOR IN USHA-TESA INTERGENIC REGION] [SP:P77565] |
| Contig092G | 3906542_f3_132 | 1317 | 5443 | 363 | 120 | 235 | 9.10E−20 | gp:[GI:g2407234] [LN:AF017750] [AC:AF017750] [GN:hypol 17] [OR:*Haemophilus ducreyi*] [DE:*Haemophilus ducreyi* cytochrome C-type biogenesis protein (ccmH), recombinational DNA repair protein (rccR), manganese superoxidedismutase (sodA), and CitG protein homolog (citG) genes, completecds.] [NT:simiiar to *Haemophilus influenzae* product encoded] |
| Contig092G | 3990718_f1_109 | 1318 | 5444 | 825 | 274 | 376 | 1.00E−34 | gp:[GI:g3135321] [LN:AF057031] [AC:AF057031] [PN:putative thiol:disulfide interchange protein] [GN:dsbC] [OR:*Pseudomonas aeruginosa*] [DE:*Pseudomonas aeruginosa* putative thiol:disulfide interchange proteinprecursor (dsbC) gene, complete cds.] [NT:DsbC] |
| Contig092G | 4039053_c3_236 | 1319 | 5445 | 591 | 196 | 211 | 3.20E−17 | gp:[GI:g3293540] [LN:AF072709] [AC:AF072709] [PN:putative transcriptional regulator] [OR:*Streptomyces lividans*] [DE:*Streptomyces lividans* amplifiable element AUD4: putativetranscriptional regulator, putative ferredoxin, putative cytochromeP450 oxidoreductase, and putative oxidoreductase genes, completecds; and unknown genes.] [NT:ORF2; similar to transcriptional repressor] |
| Contig092G | 4065686_c3_212 | 1320 | 5446 | 1371 | 456 | 546 | 1.90E−104 | pir:[LN:C69757] [AC:C69757] [PN:transporter homolog ycel] [GN:ycel] [OR:*Bacillus subtilis*] |
| Contig092G | 4086693_c2_205 | 1321 | 5447 | 1203 | 400 | | | NO-HIT |
| Contig092G | 4173813_c2_197 | 1322 | 5448 | 1206 | 401 | 804 | 4.60E−80 | sp:[LN:FTSW_ECOLI] [AC:P16457] [GN:FTSW] [OR:*ESCHERICHIA COLI*] [DE:CELL DIVISION PROTEIN FTSW] [SP:P16457] |
| Contig092G | 4182816_c2_182 | 1323 | 5449 | 543 | 180 | 642 | 6.80E−63 | pir:[LN:PWEC] [AC:A27648:S56452:E65234] [PN:inorganic pyrophosphatase,:pyrophosphate phosphohydrotase] [GN:ppa] [CL:inorganic pyrophosphatase] [OR:*Escherichia coli*] [EC:3.6.1.1] [MP:100 min] |
| Contig092G | 4485693_c3_208 | 1324 | 5450 | 1008 | 335 | 1061 | 2.70E−107 | sp:[LN:SRPG_SYNP7] [AC:Q59966] [GN:SRPG] [OR:SYNECHOCOCCUS SP] [SR:PCC 7942,ANACYSTIS NIDULANS R2] [EC:4.2.99.8] [DE:SULFHYDRYLASE) (O-ACETYLSERINE (THIOL)-LYASE) (CSASE)] [SP:Q59966] |
| Contig092G | 4509688_f3_118 | 1325 | 5451 | 222 | 73 | | | NO-HIT |
| Contig092G | 4687890_c3_240 | 1326 | 5452 | 777 | 258 | 704 | 1.80E−69 | pir:[LN:565576] [AC:S68596:S65576] [PN:negative regulator PhoU] [GN:phoU] [CL:phoU protein] [OR:*Pseudomonas aeruginosa*] |
| Contig092G | 4692502_c1_145 | 1327 | 5453 | 1293 | 430 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig092G | 4742153_c1_154 | 1328 | 5454 | 489 | 162 | 449 | 1.90E−42 | sp:[LN:YBAD_ECOLI] [AC:P25538] [GN:YBAD] [OR:*ESCHERICHIA COLI*] [DE:HYPOTHETICAL 17.2 KD PROTEIN IN TSX-RIBG INTERGENIC REGION (ORF1)] [SP:P25538] |
| Contig092G | 4859802_c1_140 | 1329 | 5455 | 567 | 188 | 158 | 1.30E−11 | sp:[LN:AAC2_MYCFO] [AC:Q49157] [GN:AAC] [OR:*MYCOBACTERIUM FORTUITUM*] [EC:2.3.1.—] [DE:AMINOGLYCOSIDE 2'-N-ACETYLTRANSFERASE, (AAC(2')-IB)] [SP:Q49157] |
| Contig092G | 4879443_f3_104 | 1330 | 5456 | 279 | 92 | 216 | 9.40E−18 | sp:[LN:YGGX_HAEIN] [AC:P44048] [GN:H10760] [OR:*HAEMOPHILUS INFLUENZAE*] [DE:HYPOTHETICAL PROTEIN H10760] [SP:P44048] |
| Contig092G | 4880255_c3_210 | 1331 | 5457 | 540 | 179 | | | NO-HIT |
| Contig092G | 4884682_c3_239 | 1332 | 5458 | 1350 | 449 | 471 | 9.00E−45 | pir:[LN:MMECTC] [AC:A65091:A03430:S11457:153 455] [PN:outer membrane protein tolC precursor] [GN:tolC] [CL:outer membrane protein tolC] [OR:*Escherichia coli*] [MP:66 min] |
| Contig092G | 4892833_c1_157 | 1333 | 5459 | 1086 | 361 | 492 | 5.30E−47 | sp:[LN:YJGQ_HAEIN] [AC:P45332] [GN:H11703] [OR:*HAEMOPHILUS INFLUENZAE*] fDE:HYPOTHETICAL PROTEIN H11703] [SP:P45332] |
| Contig092G | 4943818_c3_214 | 1334 | 5460 | 1707 | 568 | 1518 | 1.00E−155 | sp:[LN:LCFA_ECOLI] [AC:P29212] [GN:FADD:OLDD] [OR:*ESCHERICHIA COLI*] [EC:6.2.1.3] [DE:SYNTHETASE)] [SP:P29212] |
| Contig092G | 5161387_f2_71 | 1335 | 5461 | 1212 | 403 | 698 | 1.50E−102 | sp:[LN:THRC_SYNY3] [AC:P74193] [GN:THRC:SLL1172] [OR:SYNECHOCYSTIS SP] [SR:PCC 6803,] [EC:4.2.99.2] [DE:THREONINE SYNTHASE,] [SP:P74193] |
| Contig092G | 5281305_c1_155 | 1336 | 5462 | 1101 | 366 | 815 | 3.20E−81 | sp:[LN:RIBD_HAEIN] [AC:P44326] [GN:RIBD:RIBG:H10944] [OR:*HAEMOPHILUS INFLUENZAE*] [EC:3.5.4.—] [DE:RIBOFLAVIN-SPECIFIC DEAMINASE,] [SP:P44326] |
| Contig092G | 5896966_f1_9 | 1337 | 5463 | 942 | 313 | 587 | 4.60E−57 | sp:[LN:YADB_ECOLI] [AC:P27305:P75662] [GN:YADB] [OR:*ESCHERICHIA COLI*] [DE:HYPOTHETICAL 34.9 KD PROTEIN IN PCNB-DKSA INTERGENIC REGION] [SP:P27305:P75662] |
| Contig092G | 602137_c1_152 | 1338 | 5464 | 243 | 80 | | | NO-HIT |
| Contig092G | 6053750_f1_42 | 1339 | 5465 | 1404 | 467 | 1112 | 1.10E−112 | sp:[LN:YEGB_ECOLI] [AC:P36554:P76400] [GN:YEGB] [OR:*ESCHERICHIA COLI*] [DE:HYPOTHETICAL 50.9 KD PROTEIN IN ALKA-BAES INTERGENIC REGION] [SP:P36554:P76400] |
| Contig092G | 6062900_f1_7 | 1340 | 5466 | 1908 | 635 | 2263 | 1.10E−234 | sp:[LN:THIC_ECOLI] [AC:P30136] [GN:THIC] [OR:*ESCHER[CHIA COLI*] [DE:THIAMIN BIOSYNTHESIS PROTEIN THIC] [SP:P30136] |
| Contig092G | 6148337_f1_50 | 1341 | 5467 | 501 | 166 | | | NO-HIT |
| Contig092G | 6647257_f2_68 | 1342 | 5468 | 216 | 71 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig092G | 7032506_c3_231 | 1343 | 5469 | 327 | 108 | 94 | 8.00E−05 | pir:[LN:S75293] [AC:S75293] [PN:hypothetical protein ssr2333] [OR:Syncchocystis sp.] [SR:PCC 6803, PCC 6803] [SR:PCC 6803,] |
| Contig092G | 835305_c1_150 | 1344 | 5470 | 429 | 142 | | | NO-HIT |
| Contig092G | 866427_f1_51 | 1345 | 5471 | 624 | 207 | 176 | 2.60E−12 | pir:[LN:A69911] [AC:A69911] [PN:hypothetical protein yoml] [GN:yoml] [GR:*Bacillus subtilis*] |
| Contig092G | 9882967_f2_99 | 1346 | 5472 | 579 | 192 | 192. | 2.70E−18 | pir:[LN:G69292] [AC:G69292] [PN:tryptophan repressor binding protein (wrbA) homolog] [CL:conserved hypothetical protein YCR004c] [OR:*Archaeoglobus fulgidus*] |
| Contig099G | 10657262_c2_197 | 1347 | 5473 | 543 | 180 | 559 | 4.20E−54 | sp:[LN:GREB_ECOLI] [AC:P30128:P78114] [GN:GREB] [OR:*ESCHERICHIA COLI*] [DE:GREB)] [SP:P30128:P78114] |
| Contig099G | 10666550_c1_170 | 1348 | 5474 | 3120 | 1039 | 2524 | 2.50E−262 | sp:[LN:MEXB_PSEAE] [AC:P52002] [GN:MEXB] [OR:*PSEUDOMONAS AERUGINOSA*] [DE:MULTIDRUG RESISTANCE PROTEIN MEXB (MULTIDRUG EFFLUX TRANSPORTER MEXB)] [SP:P52002] |
| Contig099G | 13884627_f2_74 | 1349 | 5475 | 636 | 211 | 402 | 1.80E−37 | gp:[GI:e1329705:g3688416] [LN:LSAJ6274] [AC:AJ006274] [PN:acetyltransferase-like protein] [GN:orfy] [OR:*Lactobacillus sakei*] [DE:*Lactobacillus sakei* orfy, hrcA, grpE, dnaK, dnaJ genes.] |
| Contig099G | 14083552_f2_60 | 1350 | 5476 | 1845 | 614 | 1929 | 2.80E−199 | sp:[LN:PPCK_CHLLI] [AC:Q08262] [GN:PCKA] [OR:*CHLOROBIUM LIMICOLA*] [EC:4.1.1.32] [DE:(PHOSPHOENOLPYRUVATE CARBOXYLASE) (PEPCK)] [SP:Q08262] |
| Contig099G | 14463161_c3_221 | 1351 | 5477 | 186 | 61 | | | NO-HIT |
| Contig099G | 14540927_c1_154 | 1352 | 5478 | 345 | 114 | 188 | 8.70E−15 | sp:[LN:YBAZ_ECOLI] [AC:P75707] [GN:YBAZ] [OR:*ESCHERICHIA COLI*] [DE:HYPOTHETICAL 14.4 KD PROTEIN IN TESB-HHA INTERGENIC REGION] [SP:P75707] |
| Contig099G | 14587753_c1_159 | 1353 | 5479 | 654 | 2111 | 585 | 7.40E−57 | sp:[LN:FTSJ_ECOLI] [AC:P28692] [GN:FTSJ:MRSF] [OR:*ESCHERICHIA COLI*] [DE:CELL DIVISION PROTEIN FTSJ] [SP:P28692] |
| Contig099G | 1460875_c3_230 | 1354 | 5480 | 1038 | 345 | 834 | 3.10E−83 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |
| Contig099G | 1460875_f2_103 | 1355 | 5481 | 387 | 129 | 233 | 1.50E−19 | gp:[GI:g3241975] [LN:55U85710] [AC:U85710] [PN:transposase] [OR:*Sulfolobus solfataricus*] [DE:*Sulfolobus solfataricus* insertion element ISC1041, transposasegene, complete cds.] |
| Contig099G | 15646917_c2_183 | 1356 | 5482 | 897 | 298 | 679 | 8.10E−67 | sp:[LN:DHPS_ECOLI] [AC:P26282:P78110] [GN:FOLP:DHPS] [OR:*ESCHERICHIA COLI*] [EC:2.5.1.15] [DE:PYROPHOSPHORYLASE)] [SP:P26282:P78110] |
| Contig099G | 16828301_f1_23 | 1357 | 5483 | 543 | 180 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig099G | 1955076_f2_73 | 1358 | 5484 | 507 | 168 | 562 | 2.00E-54 | sp:[LN:GREA_ECOLI] [AC:P21346:P78111] [GN:GREA] [OR:*ESCHERICHIA COLI*] [DE:GREA)] [SP:P21346:P78111] |
| Contig099G | 19562510_f2_50 | 1359 | 5485 | 933 | 310 | 676 | 1.70E-66 | sp:[LN:HTPX_HAEIN] [AC:P44840] [GN:HTPX:H10720] [OR:*HAEMOPHILUS INFLUENZAE*] [DE:HEAT SHOCK PROTEIN HTPX HOMOLOG] [SP:P44840] |
| Contig099G | 19563153_c2_190 | 1360 | 5486 | 9873 | 3290 | 483 | 2.50E-48 | pir:[LN:S76109] [AC:S76109] [PN:hypotheticai protein] [OR:Synechocystis sp.] [SR:PCC 6803., PCC 6803] [SR:PCC 6803,] |
| Contig099G | 19798577_f2_53 | 1361 | 5487 | 375 | 124 | 271 | 1.40E-23 | sp:[LN:KDGL_HAEIN] [AC:P44424] [GN:DGKA:H10335] [OR:*HAEMOPHILUS INFLUENZAE*] [EC:2.7.1.107] [DE:(DGK)] [SP:P44424] |
| Contig099G | 20391513_f3_126 | 1362 | 5488 | 456 | 151 | | | NO-HIT |
| Contig099G | 21564165_c1_176 | 1363 | 5489 | 969 | 322 | 891 | 2.30E-91 | sp:[LN:YDAO_HAEIN] [AC:Q57184:O05059] [GN:H11371.1] [OR:*HAEMOPHILUS INFLUENZAE*] [DE:HYPOTHETICAL PROTEIN H11371.1] [SP:Q57184:O05059] |
| Contig099G | 22383555_c2_180 | 1364 | 5490 | 1785 | 594 | 268 | 3.50E-21 | sp:[LN:CAPA_BACAN] [AC:P19579] [GN:CAPA] [OR:*BACILLUS ANTHRACIS*] [DE:CAPA PROTEIN] [SP:P19579] |
| Contig099G | 2258_f1_20 | 1365 | 5491 | 378 | 125 | | | NO-HIT |
| Contig099G | 22698458_c3_211 | 1366 | 5492 | 945 | 314 | 648 | 1.60E-63 | sp:[LN:FOLD_BACSU] [AC:P54382] [GN:FOLD] [OR:*BACILLUS SUBTILIS*] [EC:1.5.1.5:3.5.4.9] [DE:METHENYLTETRAHYDRO FOLATE CYCLOHYDROLASE,] [SP:P54382] |
| Contig099G | 23475432_f2_72 | 1367 | 5493 | 3252 | 1083 | 4166 | 0 | gp:[GI:g1750387] [LN:PAU81259] [AC:U81259:L27528] [PN:carbamoylphosphate synthetase large subunit] [GN:carB] [OR:*Pseudomonas aeruginosa*] [DE:*Pseudomonas aeruginosa* dihydrodipicolinate reductase (dapB) gene, partial cds, carbamoylphosphate synthetase small subunit(carA) andcarbamoylphosphate synthetase large subunit (carB) genes, completecds, and FtsJ homolog (itsJ) gene, partial cds.] |
| Contig099G | 23520032_f1_24 | 1368 | 5494 | 750 | 249 | | | NO-HIT |
| Contig099G | 23636635_c3_210 | 1369 | 5495 | 1911 | 636 | 1844 | 2.90E-190 | gp:[GI:g746401] [LN:U01376] [AC:U01376:M93423:M93424] [PN:ATP-binding protein] [GN:mrsC] [OR:*Escherichia coli*] [DE:*Escherichia coli* K12 ampicillin-binding protein (dacB),transcription elongation factor (greA), regulatory protein (mrsF), ATP-binding protein (mrsC), dihydropteroate synthase, regulatoryprotein (mrsA), and membrane protein genes, complete cds.] [NT:TTG start codon] |
| Contig099G | 23645001_c1_167 | 1370 | 5496 | 954 | 317 | 198 | 3.10E-14 | sp:[LN:BMRU_BACSU] [AC:P39074] [GN:BMRU] [OR:*BACILLUS SUBTILIS*] [DE:BMRU PROTEIN] [SP:P39074] |

TABLE 2-continued

| Query | Orf | NT ID | AA ID | NT Lgth | AA Lgth | Score | P-value | Subject |
|---|---|---|---|---|---|---|---|---|
| Contig099G | 23678427_f1_18 | 1371 | 5497 | 1389 | 462 | 1114 | 6.50E−113 | sp:[LN:KGTP_ECOLI] [AC:P17448] [GN:KGTP:WITA] [OR:*ESCHERICHIA COLI*] [DE:ALPHA-KETOGLUTARATE PERMEASE] [SP:P17448] |
| Contig099G | 23704680_c3_212 | 1372 | 5498 | 702 | 233 | 149 | 4.70E−09 | pir:[LN:B70480] [AC:B70480] [PN:ribosomal protein L11 methyltransferase] [GN:prmA] [CL:bioC homology] [OR:*Aquifex aeolicus*] |
| Contig099G | 23725037_c1_162 | 1373 | 5499 | 1779 | 592 | 658 | 1.50E−75 | sp:[LN:PPBD_BACSU] [AC:P42251] [GN:PHOD] [OR:*BACILLUS SUBTILIS*] [EC:3.1.3.1] [DE:ALKALINE PHOSPRATASE D PRECURSOR, (APASED) (RANI) (BC6)] [SP:P42251] |
| Contig099G | 24252213_c3_229 | 1374 | 5500 | 4011 | 1336 | 918 | 3.50E−90 | sp:[LN:DHBF_BACSU] [AC:P45745] [GN:DHBF] [OR:*BACILLUS SUBTILIS*] [DE:PROBABLE SERINE ACTIVATING ENZYME] [SP:P45745] |
| Contig099G | 24648386_f3_111 | 1375 | 5501 | 870 | 289 | 382 | 2.40E−35 | pir:[LN:B69844] [AC:B69844] [PN:lytic transglycosylase homolog yjbJ] [GN:yjbJ] [OR:*Bacillus subtilis*] |
| Contig099G | 24812790_c3_201 | 1376 | 5502 | 1707 | 568 | | | NO-HIT |
| Contig099G | 24882760_c1_151 | 1377 | 5503 | 11679 | 3892 | 1342 | 3.40E−132 | pir:[LN:576109] [AC:S76109] [PN:hypothetical protein] [OR:Synechocystis sp.] [SR:PCC 6803, , PCC 6803] [SR:PCC 6803,] |
| Contig099G | 26054003_f3_136 | 1378 | 5504 | 1245 | 414 | 1413 | 1.40E−144 | sp:[LN:CARA_ECOLI] [AC:P00907] [GN:CARA:PYRA] [OR:*ESCHERICHIA COLI*] [EC:6.3.5.5] [DE:PHOSPHATE SYNTHETASE GLUTAMINE CHAIN)] [SP:P00907] |
| Contig099G | 26257177_f2_102 | 1379 | 5505 | 384 | 127 | 107 | 5.80E−05 | sp:[LN:AGAI_YEAST] [AC:P32323] [GN:AGAI:YNR044W:N3431] [OR:*SACCHAROMYCES CEREVISIAE*] [SR:,BAKER'S YEAST] [DE:A-AGGLUTININ ATTACHMENT SUBUNIT PRECURSOR] [SP:P32323] |
| Contig099G | 26438901_c1_169 | 1380 | 5506 | 981 | 326 | 157 | 2.50E−09 | pir:[LN:G69997] [AC:G69997] [PN:hypothetical protein ytnP] [GN:ytnP] [OR:*Bacillus subtilis*] |
| Contig099G | 26611327_c3_213 | 1381 | 5507 | 1539 | 512 | 1930 | 2.20E−199 | sp:[LN:GLPK_PSEAE] [AC:Q51390] [GN:GLPK] [OR:*PSEUDOMONAS AERUGINOSA*] [EC:2.7.1.30] [DE:(GLYCEROKINASE) (GK)] [SP:Q51390] |
| Contig099G | 26642312_c3_220 | 1382 | 5508 | 1653 | 550 | 2137 | 2.60E−221 | gp:[GI:g576779] [LN:PAU17072] [AC:U17072] [PN:GroEL] [GN:mopA] [FN:chaperone] [OR:*Pseudomonas aeruginosa*] [DE:*Pseudomonas aeruginosa* GroEL (mopA) gene, complete cds.] |
| Contig099G | 272958_c1_161 | 1383 | 5509 | 348 | 115 | | | NO-HIT |
| Contig099G | 3007805_c2_191 | 1384 | 5510 | 321 | 106 | 352 | 3.70E−32 | sp:[LN:CH10_PSEAE] [AC:P30720] [GN:MOPB:GROES] [OR:*PSEUDOMONAS AERUGINOSA*] [DE:10 KD CHAPERONIN (PROTEIN CPN10) (PROTEIN GROES)] [SP:P30720] |

TABLE 2-continued

| Query | Orf | NT ID | AA ID | NT Lgth | AA Lgth | Score | P-value | Subject |
|---|---|---|---|---|---|---|---|---|
| Contig099G | 30709427_c2_189 | 1385 | 5511 | 774 | 257 | 170 | 7.10E−13 | pir:[LN:F69104] [AC:F69104] [PN:3',5'-cyclic-nucleotide phosphodiesterase, cpdA homolog MTH178:Icc related protein] [GN:MTHI78] [CL:3',5'-cyctic-nucleotidc phosphodiesterase cpdA:3',5'-cyclic-nuclcolide phosphodicsterase cpdA homotogy:phosphocsterase core homology] [OR:*Methanobacterium thermoautotrophicum*] [EC:31.4.17] |
| Contig099G | 3126567_c1_179 | 1386 | 5512 | 354 | 117 | 108 | 2.60E−06 | pir:[LN:H70429] [AC:H70429] [PN:conserved hypothetical protein aq_1494] [GN:aq_1494] [OR:*Aquifex acolicus*] |
| Contig099G | 32425087_f1_7 | 1387 | 5513 | 1047 | 348 | 296 | 7.50E−33 | sp:[LN:YFHD_HAEIN] [AC:P44587] [GN:H10232] [OR:*HAEMOPHILUS INFLUENZAE*] [DE:HYPOTHETICAL PROTEIN H10232] [SP:P44587] |
| Contig099G | 34407787_f3_114 | 1388 | 5514 | 1161 | 386 | 361 | 4.10E−33 | sp:[LN:GLPQ_ECOLI] [AC:P09394] [GN:GLPQ] [OR:*ESCHERICHIA COLI*] [EC:3.1.4.46] [DE:(EC 3.1.4.46) (GLYCEROPHOSPHODIESTER PHOSPHODIESTERASE)] [SP:P09394] |
| Contig099G | 36194057_c3_209 | 1389 | 5515 | 627 | 208 | 148 | 1.40E−08 | gp:[GI:e1259776:g3714410] [LN:A58934] [AC:A58934] [OR:unidentified] [DE:Sequence 3 from Patent WO9641877.] [NT:unnamed protein product] [RE: |
| Contig099G | 393751_c1_171 | 1390 | 5516 | 600 | 199 | | | NO-HIT |
| Contig099G | 4332177_f3_138 | 1391 | 5517 | 468 | 155 | 248 | 3.80E−21 | sp:[LN:Y531_METJA] [AC:Q57951] [GN:MJ0531] [OR:*METHANOCOCCUS JANNASCHII*] [DE:HYPOTHETICAL PROTEIN MJ0531] [SP:Q57951] |
| Contig099G | 4336568_c3_226 | 1392 | 5518 | 393 | 130 | | | NO-HIT |
| Contig099G | 5370843_c2_185 | 1393 | 5519 | 237 | 78 | | | NO-HIT |
| Contig099G | 57937_c2_199 | 1394 | 5520 | 909 | 302 | | | NO-HIT |
| Contig099G | 5946877_c3_231 | 1395 | 5521 | 375 | 124 | 168 | 1.10E−12 | gp:[GI:g2661174] [LN:RSU76671] [AC:U76671] [PN:photosynthetic regulatory protein] [GN:spb] [OR:*Rhodobacter sphaeroides*] [DE:*Rhodobacter sphaeroides* photosynthetic regulatory; protein (spb)gene and S-adenosyl L-homocystein hydrolase gene, complete cds.] [NT:trans-acting factor] |
| Contig099G | 6671882_f1_4 | 1396 | 5522 | 810 | 269 | 120 | 3.40E−05 | gp:[GI:g3883061] [LN:AF074611] [AC:AF074611] [PN:unknown] [GN:Y1061] [OR:*Yersinia pestis*] [DE:*Yersinia pestis* plasmid pMT-1, complete plasmid sequence.] [NT:o240; 24 pct identical (0 gaps) to 81 residues of] |
| Contig099G | 6837813_c1_166 | 1397 | 5523 | 1521 | 506 | 1630 | 1.40E−167 | gp:[GI:d1032510:g3299806] [LN:ABOI 5976] [AC:ABOI 5976] [PN:sn-glycerol-3-phosphate dehydrogenase] [GN:gtpD] [OR:*Pseudomonas tosii*] [SR:*Pseudomonas tosii* (strain:PT814) DNA, clone_lib:pHHM105] [DE:*Pseudomonas tosii* glpD gene for sn-glycerol-3-phosphatedehydrogenase, complete cds] |
| Contig099G | 7272253_f3_109 | 1398 | 5524 | 558 | 185 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig099G | 79083_f1_135 | 1399 | 5525 | 273 | 90 | | | NO-HIT |
| Contig099G | 838887_f2_69 | 1400 | 5526 | 339 | 112 | 233 | 1.50E−19 | sp:[LN:YHBY_PSEAE] [AC:P95453] [OR:*PSEUDOMONAS AERUGINOSA*] [DE:HYPOTHETICAL 11.7 KD PROTEIN IN FTSJ-GREA INTERGENIC REGION] [SP:P95453] |
| Contig101G | 10036552_f2_15 | 1401 | 5527 | 2589 | 862 | | | NO-HIT |
| Contig101G | 1068827_c3_77 | 1402 | 5528 | 1359 | 452 | 1969 | 1.60E−203 | sp:[LN:ASSY_HAEIN] [AC:P44315] [GN:ARGG:H11727] [OR:*HAEMOPHILUS INFLUENZAE*] [EC:6.3.4.5] [DE:LIGASE)] [SP:P44315] |
| Contig101G | 1204377_f1_29 | 1403 | 5529 | 321 | 106 | | | NO-HIT |
| Contig101G | 12944418_f3_33 | 1404 | 5530 | 246 | 81 | | | NO-HIT |
| Contig101G | 1360400_c1_48 | 1405 | 5531 | 252 | 83 | | | NO-HIT |
| Contig101G | 1460875_c1_50 | 1406 | 5532 | 420 | 139 | 233 | 1.50E−19 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |
| Contig101G | 14634678_f1_36 | 1407 | 5533 | 495 | 164 | | | NO-HIT |
| Contig101G | 16132050_c3_84 | 1408 | 5534 | 189 | 62 | | | NO-HIT |
| Contig101G | 21679680_c3_79 | 1409 | 5535 | 702 | 233 | 575 | 8.50E−56 | sp:[LN:RNT_VIBPA] [AC:P46232] [GN:RNT] [OR:*VIBRIO PARAHAEMOLYTICUS*] [EC:3.1.13.—] [DE:RIBONUCLEASE T, (EXORIBONUCLEASE T) (RNASE T)] [SP:P46232] |
| Contig101G | 23447203_f3_35 | 1410 | 5536 | 3198 | 1065 | 300 | 1.80E−32 | gp:[GI:g2920625] [LN:AF044499] [AC:AF044499] [PN:vgrE protein] [OR:*Escherichia coli*] [DE:*Escherichia coli* strain ec50 RhsE accessory genetic element vgrEprotein, core protein, and dsORF-e5 genes, complete cds.] |
| Contig101G | 23454827_c1_46 | 1411 | 5537 | 2115 | 704 | 950 | 4.10E−98 | pir:[LN:S74457] [AC:S74457] [PN:ferrichrome-iron receptor 3:protein slr1490:protein slr1490] [GN:fhuA_3] [CL:ferrichrome-iron receptor 1:tonB-dependent receptor amino-terminal homology:tonB-dependent receptor carboxyl-terminal homology] [OR:Synechocystis sp.] [SR:PCC 6803, , PCC 6803] [SR:PCC 6803,] |
| Contig101G | 23601063_f2_24 | 1412 | 5538 | 207 | 68 | | | NO-HIT |
| Contig101G | 24257630_f2_20 | 1413 | 5539 | 810 | 269 | 682 | 3.90E−67 | pir:[LN:G70875] [AC:G70875] [PN:probable 2] [GN:fadH] [CL:NADH oxidase] [OR:*Mycobacterium tuberculosis*] |
| Contig101G | 24495926_f3_28 | 1414 | 5540 | 1065 | 354 | 141 | 2.00E−06 | gp:[GI:g1843460] [LN:ECORHSEX] [AC:L19083] [OR:*Escherichia coli*] [DE:*Escherichia coli* RhsE genetic element; defective RhsE core protein,complete cds; complete ORF-E2; H-rpt subelement; complete ORF-H] [NT:RhsE core peptide with unique 158 amino acid] |
| Contig101G | 24613507_c1_44 | 1415 | 5541 | 1041 | 346 | 1114 | 6.50E−113 | gp:[GI:g3868712] [LN:PAU73505] [AC:U73505] [PN:dihydroorotase] [GN:pyrC] [OR:*Pseudomonas aeruginosa*] [DE:*Pseudomonas aeruginosa* dihydroorotase (pyrC) gene, complete cds.] [NT:encodes the 'active' dihydroorotase enzyme] |

TABLE 2-continued

| Query | Orf | NT ID | AA ID | NT Lgth | AA Lgth | Score | P-value | Subject |
|---|---|---|---|---|---|---|---|---|
| Contig101G | 289002_f1_11 | 1416 | 5542 | 4791 | 1596 | 472 | 1.40E−63 | sp:[LN:RHSD_ECOLI] [AC:P16919:P77232] [GN:RHSD] [OR:*ESCHERICHIA COLI*] [DE:RHSD PROTEIN PRECURSOR] [SP:P16919:P77232] |
| Contig101G | 30117790_f3_32 | 1417 | 5543 | 1287 | 428 | 391 | 2.70E−36 | pir:[LN:S74991] [AC:S74991] [PN:pleD-2 protein:protein slr1047:protein slr1047] [GN:pleD 2] [OR:Synccchocystis sp.] [SR:PCC 6803, , PCC 6803] [SR:PCC 6803,] |
| Contig101G | 33369017_f3_26 | 1418 | 5544 | 333 | 110 | | | NO-HIT |
| Contig101G | 33757765_f1_1 | 1419 | 5545 | 2415 | 804 | 228 | 2.20E−16 | sp:[LN:WAPA_BACSU] [AC:Q07833] [GN:WAPA:NI7G] [OR:*BACILLUS SUBTILIS*] [DE:WALL-ASSOCIATED PROTEIN PRECURSOR] [SP:Q07833] |
| Contig101G | 34023343_f2_25 | 1420 | 5546 | 453 | 150 | | | NO-HIT |
| Contig101G | 34158137_f1_5 | 1421 | 5547 | 1437 | 478 | 1308 | 1.80E−133 | pir:[LN:G70875] [AC:G70875] [PN:probable 2] [GN:fadH] [CL:NADH oxidase] [OR:*Mycobacterium tuberculosis*] |
| Contig101G | 35985180_f1_8 | 1422 | 5548 | 720 | 239 | 122 | 7.90E−06 | gp:[GI:e1287197:g3063879] [LN:MLCB1883] [AC:AL022486] [LN:putative transcriptional regulator] [GN:MLCB1883.15] [OR:*Mycobacterium leprae* [DE:*Mycobacterium leprae* cosmid B1883.] [NT:MLCBI883.15, probable transcriptional regulator,] |
| Contig101G | 3912763_f1_6 | 1423 | 5549 | 885 | 294 | 378 | 6.40E−35 | sp:[LN:PLPB_PASHA] [AC:Q08869:Q07364] [GN:PLPB] [OR:*PASTEURELLA HAEMOLYTICA*] [DE:OUTER MEMBRANE LIPOPROTEIN 2 PRECURSOR (PLP2)] [SP:Q08869:Q07364] |
| Contig101G | 3937818_c1_49 | 1424 | 5550 | 333 | 110 | | | NO-HIT |
| Contig101G | 3961688_f1_13 | 1425 | 5551 | 222 | 73 | | | NO-HIT |
| Contig101G | 4410010_c2_51 | 1426 | 5552 | 192 | 63 | | | NO-HIT |
| Contig101G | 4767181_c3_83 | 1427 | 5553 | 351 | 116 | | | NO-HIT |
| Contig101G | 4876700_f3_38 | 1428 | 5554 | 219 | 72 | | | NO-HIT |
| Contig101G | 4885927_f1_12 | 1429 | 5555 | 267 | 88 | | | NO-HIT |
| Contig101G | 5109627_f3_37 | 1430 | 5556 | 264 | 87 | | | NO-HIT |
| Contig101G | 626042_c1_39 | 1431 | 5557 | 309 | 102 | 376 | 1.00E−34 | gp:[GI:g3241975] [LN:SSU85710] [AC:U85710] [PN:transposasc] [OR:*Sulfolobus solfataricus*] [DE:*Sulfolobus solfataricus* insertion element ISC1041, transposasegene, complete cds.] |
| Contig101G | 630305_c1_41 | 1432 | 5558 | 228 | 75 | | | NO-HIT |
| Contig123G | 10550901_c2_68 | 1433 | 5559 | 816 | 271 | 451 | 1.20E−42 | sp:[LN:YMDC_ECOLI] [AC:P75919] [GN:YMDC] [OR:*ESCHERICHIA COLI*] [DE:HYPOTHETICAL 55.9 KD PROTEIN IN CSGC-MDOG INTERGENIC REGION] [SP:P75919] |
| Contig123G | 10970390_c1_54 | 1434 | 5560 | 435 | 144 | 342 | 4.20E−31 | sp:[LN:SSPB_ECOLI] [AC:P25663] [GN:SSPB] [OR:*ESCHERICHIA COLI*] [DE:STRINGENT STARVATION PROTEIN B] [SP:P25663] |
| Contig123G | 13675305_f3_34 | 1435 | 5561 | 1200 | 399 | 946 | 4.10E−95 | gp:[GI:g1943792] [LN:CELC37A2] [AC:U97194] [GN:C37A2.3] [OR:*Caenorhabditis elegans*] [SR:*Caenorhabditis elegans* strain=Bristol N2] [DE:*Caenorhabditis elegans* cosmid C37A2.] [NT:Similar to acyl-CoA dehydrogenase; coded for by C.] |

TABLE 2-continued

| Query | Orf | NT ID | AA ID | NT Lgth | AA Lgth | Score | P-value | Subject |
|---|---|---|---|---|---|---|---|---|
| Contig123G | 13869000_c3_90 | 1436 | 5562 | 324 | 107 | 117 | 2.90E−07 | sp:[LN:YFIB_ECOLI] [AC:P07021] [GN:YFIB] [OR:*ESCHERICHIA COLI*] [DE:PUTATIVE 15.3 KD LIPOPROTEIN IN AROF-RPLS INTERGENIC REGION PRECURSOR] [SP:P07021] |
| Contig123G | 14234706_c1_53 | 1437 | 5563 | 681 | 226 | 359 | 6.60E−33 | sp:[LN:SSPA_HAEIN] [AC:P45207] [GN:SSPA:H11441] [OR:*HAEMOPHILUS INFLUENZAE*] [DE:STRINGENT STARVATION PROTEIN A HOMOLOG] [SP:P45207] |
| Contig123G | 14579775_f2_27 | 1438 | 5564 | 315 | 104 | 98 | 3.00E−05 | gp:[GI:g208931] [LN:SYNORFLAC] [AC:M15619] [OR:artificial sequence] [SR:*E.coli* (strain SE5000) synthetic DNA, clone pKB1] [DE:Synthetic *E.coli* ORF16/lacZ fusion protein, partial cds.] [NT:ORF16-lacZ fusion protein] [RE: |
| Contig123G | 14657952_f1_4 | 1439 | 5565 | 927 | 308 | 444 | 6.50E−42 | sp:[LN:YKUF_BACSU] [AC:O34717] [GN:YKUF] [OR:*BACILLUS SUBTILIS*] [EC.1.—.—.—] [DE:(EC 1.—.—.—)] [SP:O34717] |
| Contig123G | 14875012_f1_13 | 1440 | 5566 | 816 | 271 | 268 | 2.90E−23 | gp:[GI:g3135672] [LN:AF064070] [AC:AF064070] [PN:putative 1-acyl-sn-glycerol-3-phosphate] [GN:plsC] [OR:*Burkholderia pseudomallei*] [DE:*Burkholderia pseudomallei* putative dihydroorotase (pyrC) gene,partial cds; putative 1-acyl-sn-glycerol-3-phosphateacyltransferase (plsC), putative diadenosine tetraphosphatase(apaH), complete cds; type II O-antigen biosynthesis gene cluster,complete sequence; putative undecaprenyl phosphateN-acetylglucosaminyltransferase, and putative UDP-glucose4-epimerase genes, complete cds; and putative galactosyltransferase gene, partial cds.] [NT:PlsC] |
| Contig123G | 1712_c1_5I | 1441 | 5567 | 459 | 152 | 265 | 600E−23 | gp:[GI:g1209222] [LN:ACCEST] [AC:L38252] [OR:*Acinetobacter lwoffii*] [DE:*Acinetobacter lwoffii* orf1 and esterase (est) genes, complete cds] [NT:orf1] |
| Contig123G | 192203_c2_60 | 1442 | 5568 | 192 | 63 | | | NO-HIT |
| Contig123G | 20316433_c1_50 | 1443 | 5569 | 738 | 245 | 272 | 1.10E−23 | sp:[LN:YWBG_BACSU] [AC:P39590] [GN:YWBG:IPA-22R] [OR:*BACILLUS SUBTILIS*] [DE:HYPOTHETICAL 25.8 KD PROTEIN IN EPR-GALK INTERGENIC REGION] [SP:P39590] |
| Contig123G | 20485917_f3_40 | 1444 | 5570 | 981 | 326 | 700 | 4.80E−69 | sp:[LN:KSGA_ECOLI] [AC:P06992] [GN:KSGA:RSMA] [OR:*ESCHERICHIA COLI*] [EC:2.1.1.—] [DE:DIMETHYLTRANSFERASE )] [SP:P06992] |
| Contig123G | 2070327_c2_70 | 1445 | 5571 | 429 | 142 | 555 | 1.10E−53 | sp:[LN:RL13_ECOLI] [AC:P02410] [GN:RPLM] [OR:*ESCHERICHIA COLI*] [DE:50S RIBOSOMAL PROTEIN L13] [SP:P02410] |
| Contig123G | 22479677_c2_83 | 1446 | 5572 | 621 | 206 | 184 | 2.30E−14 | pir:[LN:C70604] [AC:C70604] [PN:probable transcription repressor Rv3557c] [GN:Rv3557c] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig123G | 22834718_c2_71 | 1447 | 5573 | 399 | 132 | 504 | 2.90E−48 | pir:[LN:R3EC9] [AC:H651 14:177537:A02719] [PN:ribosomal protein S9:30S ribosomal subunit protein S9] [GN:rpsI] [CL:Escherichia coli ribosomal protein S9] [OR:Escherichia coli] [MP:70 min] |
| Contig123G | 24037500_f3_32 | 1448 | 5574 | 291 | 96 | 121 | 1.30E−06 | pir:[LN:F70719] [AC:F70719] [PN:hypothetical protein Rv0976c] [GN:Rv0976c] [OR:Mycobacterium tuberculosis] |
| Contig123G | 24275326_f2_17 | 1449 | 5575 | 1227 | 408 | 710 | 4.20E−70 | pir:[LN:E70719] [AC:E70719] [PN:probable fadE13 protein] [GN:fadE13] [OR:Mycobacterium tuberculosis] |
| Contig123G | 24298387_f1_9 | 1450 | 5576 | 1005 | 334 | 909 | 3.50E−91 | sp:[LN:PDXA_ECOLI] [AC:P19624] [GN:PDXA] [OR:ESCHERICHIA COLI] [DE:PYRIDOXAL PHOSPHATE BIOSYNTHETIC PROTEIN PDXA] [SP:P19624] |
| Contig123G | 24484687_f3_29 | 1451 | 5577 | 375 | 124 | 88 | 0.00035 | gp:[GI:g1458283] [LN:CELF25B4] [AC:V64842] [GN:F25B4.8] [OR:Caenorhabditis elegans] [SR:Caenorhabditis elegans strain=Bristol N2] [DE:Caenorhabditis elegans cosmid F25B4.] |
| Contig123G | 29381590_f1_7 | 1452 | 5578 | 876 | 291 | 324 | 3.40E−29 | pir:[LN:C69304] [AC:C69304] [PN:enoyl-CoA hydratase (fad-1) homolog] [CL:naphthoate synthase:enoyl-CoA hydratase homology] [OR:Archaeoglobus fulgidus] |
| Contig123G | 30504026_c2_66 | 1453 | 5579 | 510 | 169 | 228 | 5.00E−19 | sp:[LN:YFIR_ECOLI] [AC:P76597] [GN:YFIR] [OR:ESCHERICHIA COLI] [DE:HYPOTHETICAL 19.0 KD PROTEIN IN AROF-RPLS INTERGENIC REGION PRECURSOR] [SP:P76597] |
| Contig123G | 31687550_f2_19 | 1454 | 5580 | 1677 | 558 | 623 | 7.00E−61 | pir:[LN:F70719] [AC:F70719] [PN:hypothetical protein Rv0976c] [GN:Rv0976c] [OR:Mycobacterium tubercutosis] |
| Contig123G | 32610327_f1_41 | 1455 | 5581 | 840 | 279 | 570 | 2.90E−55 | sp:[LN:APAH_SALTY] [AC:Q5601 8] [GN:APAH] [OR:SALMONELLA TYPHIMURIUM] [EC:3.6.1.41] [DE:(DIADENOSINE TETRAPHOSPHATASE)] [SP:Q56018] |
| Contig123G | 34415662_c3_93 | 1456 | 5582 | 405 | 134 | | | NO-HIT |
| Contig123G | 34464013_f1_14 | 1457 | 5583 | 1029 | 342 | 252 | 1.40E−21 | pir:[LN:B69865] [AC:1369865] [PN:probable phosphoesterase, ykuE] [GN:ykuE] [CL:probable phosphoesterase yael:phosphoesterase core homology] [OR:Bacillus subtilis] [EC:3.1.—.—] |
| Contig123G | 35574025_f3_33 | 1458 | 5584 | 1641 | 546 | 1173 | 3.70E−119 | pir:[LN:D70719] [AC:D70719] [PN:probable propionyl-COA carboxylase] [GN:accD2] [OR:Mycobacterium tuberculosis] |
| Contig123G | 500017_c3_92 | 1459 | 5585 | 1365 | 454 | 1130 | 1.30E−114 | sp:[LN:HFLX_ECOLI] [AC:P255 19] [GN:HFLX] [OR:ESCHERICHIA COLI] [DE:GTP-BINDING PROTEIN HFLX] [SP:P25519] |
| Contig123G | 5078377_f1_1 | 1460 | 5586 | 609 | 202 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig123G | 5350338_f1_8 | 1461 | 5587 | 1959 | 652 | 741 | 1.30E−131 | gp:[GI:g533707] [LN:ATU12536] [AC:U12536] [PN:3-methylcrotonyl-COA carboxylase precursor] [FN:carboxylation of 3-methylcrotonyl-COA] [OR:*Arabidopsis thaliana*] [SR:thale cress] [EC:6.4.1.4] [DE:*Arabidopsis thaliana* 3-methylcrotonyl-CoA carboxylase precursormRNA, complete cds.] |
| Contig123G | 6742001_c3_87 | 1462 | 5588 | 354 | 117 | | | NO-HIT |
| Contig123G | 6927063_c1_48 | 1463 | 5589 | 1242 | 413 | 434 | 7.50E−41 | sp:[LN:YFIN_ECOLI] [AC:P46139:P76598] [GN:YFIN] [OR:*ESCHERICHIA COLI*] [DE:HYPOTHETICAL 46.0 KD PROTEIN IN AROF-RPLS INTERGENIC REGION] [SP:P46139:P76598] |
| Contig123G | 915892_c3_97 | 1464 | 5590 | 660 | 219 | | | NO-HIT |
| Contig123G | 960812_c1_49 | 1465 | 5591 | 828 | 275 | 440 | 1.70E−41 | sp:[LN:YMDC_ECOLI] [AC:P75919] [GN:YMDC] [OR:*ESCHERICHIA COLI*] [DE:HYPOTHETICAL 55.9 KD PROTEIN IN CSGC-MDOG INTERGENIC REGION] [SP:P75919] |
| Contig124G | 10048176_f2_37 | 1466 | 5592 | 732 | 243 | 190 | 4.10E−21 | sp:[LN:GPH_ECOLI] [AC:P32662] [GN:GPH] [OR:*ESCHERICHIA COLI*] [EC:3.1.3.18] [DE:PHOSPHOGLYCOLATE PHOSPHATASE, (PGP)] [SP:P32662] |
| ContigI24G | 12923438_f1_23 | 1467 | 5593 | 537 | 178 | 397 | 6.20E−37 | sp:[LN:LSPA_PSEFL] [AC:P17942] [GN:LSPA] [OR:*PSEUDOMONAS FLUORESCENS*] [EC:3.4.23.36] [DE:PEPTIDASE) (SIGNAL PEPTIDASE II) (SPASE II)] [SP:P17942] |
| Contig124G | 14065952_f2_38 | 1468 | 5594 | 489 | 162 | | | NO-HIT |
| Contig124G | 1460875_c2_129 | 1469 | 5595 | 435 | 145 | 242 | 1.70E−20 | gp:[GI:g3241975] [LN:SSU85710] [AC:U85710] [PN:transposase] [OR:*Sulfolobus solfataricus*] [DE:*Sulfolobus solfataricus* insention element ISC1041, transposasegene, complete cds.] |
| Contig124G | 16495635_f1_77 | 1470 | 5596 | 228 | 75 | | | NO-HIT |
| Contig124G | 16992212_f1_12 | 1471 | 5597 | 735 | 244 | 127 | 3.20E−07 | pir:[LN:B70391] [AC:B70391] [PN:transcription regulator TetR/AcrR family] [GN:acrR1] [OR:*Aquifex aeolicus*] |
| Contig124G | 19610002_f2_39 | 1472 | 5598 | 438 | 145 | | | NO-HIT |
| Contig124G | 210791_f1_3 | 1473 | 5599 | 2202 | 733 | 2872 | 3.30E−299 | gp:[GI:e1240524:g2808460] [LN:AJPTPPTK] [AC:Y15162] [GN :ptk] [OR:*Acinetobacter johnsonii*] [DE:*Acinctobacter johnsonii* ptp, ptk genes.] |
| Contig124G | 22273562_c1_99 | 1474 | 5600 | 1173 | 390 | 831 | 6.40E−83 | pir:[LN:G70590] [AC:G70590] [PN:probable desA3 protein] [GN:desA3] [OR:*Mycobacterium tuberculosis*] |
| Contig124G | 22517018_f1_6 | 1475 | 5601 | 870 | 289 | 755 | 7.20E−75 | sp:[LN:NADC_SALTY] [AC:P30012] [GN:NADC] [OR:*SALMONELLA TYPHIMURIUM*] [EC:2.4.2.19] [DE:(QUINOLINATE PHOSPHORIBOSYLTRANSFERASE [DECARBOXYLATING]) (QAPRTASE)] [SP:P30012] |
| Contig124G | 22831410_f1_26 | 1476 | 5602 | 222 | 73 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig124G | 22837750_f1_19 | 1477 | 5603 | 624 | 207 | 459 | 1.70E−43 | sp:[LN:YCDC_ECOLI] [AC:P75899] [GN:YCDC] [OR:*ESCHERICHIA COLI*] [DE:HYPOTHETICAL TRANSCRIPTIONAL REGULATOR IN WRBA-PUTA INTERGENIC REGION] [SP:P75899] |
| Contig124G | 23438806_f2_47 | 1478 | 5604 | 1017 | 338 | 512 | 3.30E−59 | sp:[LN:RIBF_ECOLI] [AC:P08391:P75621] [GN:RIBF] [OR:*ESCHERICHIA COLI*] [EC:2.7.1.26:2.7.7.2] [DE:SYNTHETASE)] [SP:P08391:P75621] |
| Contig124G | 23453183_c1_105 | 1479 | 5605 | 1224 | 407 | 433 | 9.50E−41 | sp:[LN:CAPF_STAAU] [AC:P39855] [GN:CAPF] [OR:*STAPHYLOCOCCUS AUREUS*] [DE:CAPF PROTEIN] [SP:P39855] |
| Contig124G | 23476692_c3_150 | 1480 | 5606 | 1077 | 358 | 551 | 3.00E−53 | pir:[LN:S51264] [AC:S51264:S70740] [PN:probable galactosyltransferase trsE] [GN:trsE] [OR:*Yersinia enterocolitica*] |
| Contig124G | 23538252_f1_57 | 1481 | 5607 | 384 | 127 | | | NO-HIT |
| Contig124G | 24017137_f1_5 | 1482 | 5608 | 750 | 249 | 469 | 1.50E−44 | gp:[GI:g2231680] [LN:LAU91606] [AC:U91606] [PN:macrophage infectivity potentiator] [GN:mip] [OR:*Legionella adelaidensis*] [DE:*Legionella adelaidensis* macrophage infectivity potentiator (mip)gene, complete cds.] [NT:MIP; peptidyl-prolyl cis/trans isomerase; PPIase;] |
| Contig124G | 24336056_c1_98 | 1483 | 5609 | 1047 | 348 | 359 | 6.60E−33 | pir:[LN:1170590] [AC:H70590] [PN:hypothetical protein Rv3230c] [GN:Rv3230c] [OR:*Mycobacterium tuberculosis*] |
| Contig124G | 24337762_f2_44 | 1484 | 5610 | 804 | 267 | 633 | 6.10E−62 | gp:[GI:g3420608] [LN:AF075709] [AC:AF075709] [PN:ABC transporter ATP-binding subunit] [GN:ssuB] [OR:*Pseudomonas putida*] [DE:*Pseudomonas putida* LsfA (lsfA), complete cds; and ssu locus,complete sequence.] [NT:SsuB] |
| Contig124G | 24848425_f3_75 | 1485 | 5611 | 2859 | 952 | 2787 | 3.40E−290 | sp:[LN:SYI_ECOLI] [AC:P00956:P78038:Q59429] [GN:ILES:ILVS] [OR:*ESCHERICHIA COLI*] [EC:6.1.1.5] [DE:(ILERS)] [SP:P00956:P78038:Q59429] |
| Contig124G | 26285952_c3_135 | 1486 | 5612 | 567 | 188 | 107 | 4.20E−06 | gp:[GI:g2738160] [LN:BFU91841] [AC:U91841] [PN:purine nucleoside phosphorylase] [OR:*Bacillus firmus*] [DE:*Bacillus firmus* MotA homolog gene, partial cds, MotB homolog gene,complete cds, and purine nucleoside phoshorylase gene, partial cds.] [NT:orf3] [RE: |
| Contig124G | 26562550_f3_62 | 1487 | 5613 | 741 | 246 | 404 | 1.10E−37 | gp:[GI:g2160523] [LN:AHU56832] [AC:U56832] [PN:FK506 binding protein] [GN:tkpA] [FN:converts prolyl-imidic bonds from cis to trans] [OR:*Aeromonas hydrophila*] [EC:5.2.1.8] [DE:*Aeromonas hydrophila* FK506 binding protein (fkpA) gene, completecds in 3.9 kb fragment.] [NT:ORF3; immunophilin; peptidyl prolyl isomerase;] |

TABLE 2-continued

| Query | Orf | NT ID | AA ID | NT Lgth | AA Lgth | Score | P-value | Subject |
|---|---|---|---|---|---|---|---|---|
| Contig124G | 26754718_f1_16 | 1488 | 5614 | 1002 | 333 | 732 | 200E−72 | sp:[LN:SSUA_ECOLI] [AC:P75853] [GN:SSUA] [OR:*ESCHERICHIA COLI*] [DE:PUTATIVE ALIPHATIC SULFONATES BINDING PROTEIN PRECURSOR] [SP:P75853] |
| Contig124G | 26798527_f1_2 | 1489 | 5615 | 450 | 149 | 635 | 3.70E−62 | gp:[GI:e1240523:g2808459] [LN:AJPTPPTK] [AC:Y15162] [GN:ptp] [OR:*Acinetobacter johnsonii*] [DE:*Acinetobacter johnsonii* ptp, ptk genes.] |
| Contig124G | 2830010_c1_104 | 1490 | 5616 | 189 | 62 | | | NO-HIT |
| Contig124G | 29303928_f2_49 | 1491 | 5617 | 552 | 183 | 334 | 2.90E−30 | sp:[LN:FKBX_PSEFL] [AC:P21863] [GN:YAAD] [OR:*PSEUDOMONAS FLUORESCENS*] [EC:5.2.18] [DE:(EC 5.2.1.8) (PPIASE) (ROTAMASE)] [SP:P21863] |
| Contig124G | 29457790_f2_43 | 1492 | 5618 | 414 | 137 | 439 | 2.20E−41 | gp:[GI:g2582422] [LN:AF026067] [AC AF026067] [PN:putative FMN H2-dependent monooxygenase] [GN:slfB] [OR:*Pseudomonas aeruginosa*] [DE:*Pseudomonas aeruginosa* putative reductase (slfA), putativeFMNH2-dependent monooxygenase (slfB), and putative FMNH2-dependentmonooxygenase (slfC) genes, complete cds.] |
| Contig124G | 29562692_c3_138 | 1493 | 5619 | 246 | 81 | | | NO-HIT |
| Contig124G | 31270208_f2_51 | 1494 | 5620 | 192 | 63 | | | NO-HIT |
| Contig124G | 31283_f2_33 | 1495 | 5621 | 192 | 63 | | | NO-HIT |
| Contig124G | 33214031_f3_70 | 1496 | 5622 | 735 | 244 | 805 | 3.60E−80 | sp:[LN:UBIG_ECOLI] [AC:P17993:P76924] [GN:UBIG:PUFX] [OR:*ESCHERICHIA COLI*] [EC:2.1.1.64] [DE:METHYLTRANSFERASE)] [SP:P17993:P76924] |
| Contig124G | 33229701_f3_79 | 1497 | 5623 | 201 | 66 | | | NO-HIT |
| Contig124G | 3397193_c3_149 | 1498 | 5624 | 1293 | 430 | 1593 | 1.10E−163 | sp:[LN:VIPA_SALTI] [AC:Q04972] [GN:VIPA:TVIB] [OR:*SALMONELLA TYPHI*] [EC:1.1.1.—] [DE:VI POLYSACCHARIDE BIOSYNTHESIS PROTEIN VIPA/TVIB,] [SP:Q04972] |
| Contig124G | 34384385_c2_128 | 1499 | 5625 | 1041 | 346 | 1281 | 1.30E−130 | gp:[GI:g1143204] [LN:SSU34305] [AC:U34305] [OR:*Shigella sonnei*] [SR:*Shigella sonnei* strain=53G] [DE:*Shigella sonnei* form I operon ORF protein genes, complete cds,insertion sequence IS630 protein gene, complete cds.] [NT:ORF2; Method: conceptual translation supplied by] |
| Contig124G | 35589150_f2_40 | 1500 | 5626 | 1368 | 455 | 1121 | 1.20E−113 | sp:[LN:ARGA_ECOLI] [AC:P08205:O68009:O68010:O68011:O68012:O68013] [GN:ARGA] [GR:*ESCHERICHIA COLI*] [EC:2.3.1.1] [DE:SYNTHASE) (AGS)] [SP:P08205:O68009:O68010:O68011:O68012:O68013] |
| Contig124G | 35815802_f2_35 | 1501 | 5627 | 258 | 85 | | | NO-HIT |
| Contig124G | 35939088_c3_144 | 1502 | 5628 | 735 | 244 | 791 | 1.10E−78 | sp:[LN:RNPH_HAEIN] [ACP44444] [GN:RPH:H10273] [OR:*HAEMOPHILUS INFLUENZAE*] [EC:2.7.7.56] [DE:NUCLEOTIDYLTRANSFERASE)] [SP:P44444] |

TABLE 2-continued

| Query | Orf | NT ID | AA ID | NT Lgth | AA Lgth | Score | P-value | Subject |
|---|---|---|---|---|---|---|---|---|
| Contig124G | 36111400_f1_17 | 1503 | 5629 | 816 | 271 | 872 | 2.90E−87 | sp:[LN:SSUC_ECOLI] [AC:P75851] [GN:SSUC] [OR:*ESCHERICHIA COLI*] [DE:PUTATIVE ALIPRATIC SULFONATES TRANSPORT PERMEASE PROTEIN SSUC] [SP:P75851] |
| Contig124G | 36129552_f3_61 | 1504 | 5630 | 1119 | 372 | 494 | 3.30E−47 | sp:[LN:EPSA_BURSO] [AC:Q45407] [GN:EPSA] [OR:*BURKHOLDERIA SOLANACEARUM*] [SR:,*PSEUDOMONAS SOLANACEARUM*] [DE:EPS 1 POLYSACCHARIDE EXPORT OUTER MEMBRANE PROTEIN EPSA PRECURSOR] [SP:Q45407] |
| Contig124G | 36203311_c1_96 | 1505 | 5631 | 642 | 213 | 436 | 4.60E−41 | sp:[LN:DSBA_PSEAE] [AC:P95460] [GN:DSBA] [OR:*PSEUDOMONAS AERUGINOSA*] [DE:THIOL:DISULFIDE INTERCHANGE PROTEIN DSBA PRECURSOR] [SP:P95460] |
| Contig124G | 36226687_f1_15 | 1506 | 5632 | 765 | 254 | 619 | 1.90E−60 | sp:[LN:YCIK_ECOLI] [AC:P31808:P77516] [GN:YCIK] [OR:*ESCHERICHIA COLI*] [SP:P31808:P77516] |
| Contig124G | 4062561_f3_55 | 1507 | 5633 | 216 | 71 | | | NO-HIT |
| Contig124G | 4085938_f3_76 | 1508 | 5634 | 552 | 183 | 245 | 8.00E−21 | gp:[GI:g2613073] [LN:AF030288] [AC:AF030288] [OR:*Brevibacterium linens*] [DE:*Brevibacterium linens* strain OC2 putative efflux protein (tmpA)gene, complete cds.] [NT:hypothetical protein; ORFI] |
| Contig124G | 4103317_f2_41 | 1509 | 5635 | 1065 | 354 | 853 | 3.00E−85 | gp:[GI:g3420605] [LN:AF075709] [AC AF075709] [PN:putative sulfonate binding protein precursor] [GN:ssuA] [OR:*Pseudomonas putida*] [DE:*Pseudomonas putida* LsfA (lsfA), complete cds; and ssu locus,complete sequence.] [NT:SsuA] |
| Contig124G | 4478428_f3_71 | 1510 | 5636 | 903 | 300 | 920 | 2.40E−92 | pir:[LN:F64833] [AC:F64833:S78622] [PN:sulfate starvation-induced protein SSI6] [GN:ycbN] [OR:*Escherichia coli*] |
| Contig124G | 4687503_f3_68 | 1511 | 5637 | 648 | 215 | 300 | 1.20E−26 | sp:[LN:YIJC_ECOLI] [AC:P27307] [GN:YIJC] [OR:*ESCHERICHIA COLI*] [DE:HYPOTHETICAL 26.6 KD PROTEIN IN UDHA-TRMA INTERGENIC REGION (ORFA)] [SP:P27307] |
| Contig124G | 4804632_c1_101 | 1512 | 5638 | 606 | 201 | 514 | 2.50E−49 | sp:[LN:AMPD_HAEIN] [AC:P44624] [GN:AMPD:H10300] [OR:*HAEMOPHILUS INFLUENZAE*] [DE:AMPD PROTEIN HOMQLOG] [SP:P44624] |
| Contig124G | 5189703_c1_102 | 1513 | 5639 | 1551 | 516 | 1052 | 2.40E−106 | sp:[LN:MVIN_SALTY] [AC:P37169] [GN:MVIN] [OR:*SALMONELLA TYPHIMURIUM*] [DE:VIRULENCE FACTOR MVIN] [SP:P37169] |

TABLE 2-continued

| Query | Orf | NT ID | AA ID | NT Lgth | AA Lgth | Score | P-value | Subject |
|---|---|---|---|---|---|---|---|---|
| Contig124G | 5265817_c1_88 | 1514 | 5640 | 1143 | 380 | 381 | 3.10E−35 | gp:[GI:e1319713:g3581872] [LN:5C135] [AC:AL031541] [PN:putative integral membrane protein] [GN:SC13S.39] [OR:*Streptomyccs coelicolor*] [DE:*Streptomyces coelicolor* cosmid 135.] [NT:SC135.39, probable integral membrane protein, len:] |
| Contig124G | 5265952_c3_151 | 1515 | 5641 | 1158 | 385 | 165 | 2.00E−09 | gp:[GI:g2072446] [LN:LLU93364] [AC:U93364] [PN:EpsI] [GN:epsI] [OR:*Lactococcus lactis cremoris*] [DE:*Lactococcus lactis cremoris* plasmid pNZ4000 insertion sequenceIS982 putative transposase gene and eps gene cluster(epsRXABCDEFGHIJKL), complete cds.] [NT:similar to O-antigen polymerase of] |
| Contig124G | 5347063_c1_100 | 1516 | 5642 | 2187 | 728 | 1007 | 8.40E−186 | sp:[LN:PHLN_PSEAE] [AC:P15713] [GN:PLCN] [OR:*PSEUDOMONAS AERUGINOSA*] [EC:3.1.4.3] [DE:(PHOSPHATIDYLCHOLINE CHOLINEPHOSPHOHYDROLASE)] [SP:P15713] |
| Contig124G | 9806913_f2_54 | 1517 | 5643 | 282 | 94 | | | NO-HIT |
| Contig124G | 9937817_c2_106 | 1518 | 5644 | 420 | 139 | 125 | 4.10E−08 | gp:[GI:g2627294] [LN:AC003110] [AC:AC003110] [PN:F14150_1] [OR:*Homo sapiens*] [DE:Human DNA from chromosome 19-specific cosmid F14150, genomicsequence, complete sequence.] [NT: Hypothetical partial protein; Hypotthetical partial] |
| Contig133G | 10976587_c3_29 | 1519 | 5645 | 549 | 182 | 199 | 9.30E−27 | sp:[LN:GPH_ECOLI] [AC:P32662] [GN:GPH] [OR:*ESCHERICHIA COLI*] [EC:3.1.3.18] [DE:PHOSPHOGLYCOLATE PHOSPHATASE, (PGP)] [SP:P32662] |
| Contig133G | 114001_f1_2 | 1520 | 5646 | 195 | 64 | | | NO-HIT |
| Contig133G | 1193925_f3_18 | 1521 | 5647 | 288 | 95 | | | NO-HIT |
| Contig133G | 24417202_c2_26 | 1522 | 5648 | 744 | 247 | 108 | 0.00083 | sp:[LN:GSPN_AERHY] [AC:P41852] [GN:EXEN] [OR:*AEROMONAS HYDROPHILA*] [DE:GENERAL SECRETION PATHWAY PROTEIN N] [SP:P41852] |
| Contig133G | 2457010_c3_27 | 1523 | 5649 | 315 | 104 | 161 | 6.30E−12 | gp:[GI:g2661174] [LN:R5U76671] [AC:U76671] [PN:photosynthetic regulatory protein] [GN:spb] [OR:*Rhodobacter sphaeroides*] [DE:*Rhodobacter sphaeroides* photosynthetic regulatory protein (spb)gene and S-adenosyl L-homocystein hydrolase gene, complete cds.] [NT:trans-acting factor] |
| Contig133G | 32506563_c3_28 | 1524 | 5650 | 2286 | 761 | 702 | 2.40E−123 | gp:[GI:g3978475] [LN:AF092918] [AC:AF092918] [PN:outer membrane secretion protein Q] [GN:xcpQ] [OR:*Pseudomonas alcaligenes*] [DE:*Pseudomonas alcaligenes* outer membrane Xcp-secretion system genecluster.] [NT:XcpQ] |

TABLE 2-continued

| Query | Orf | NT ID | AA ID | NT Lgth | AA Lgth | Score | P-value | Subject |
|---|---|---|---|---|---|---|---|---|
| Contig133G | 4305317_c1_25 | 1525 | 5651 | 1503 | 500 | 2237 | 6.50E−232 | sp:[LN:TRPE_ACICA] [AC:P23315] [GN:TRPE] [OR ACINETOBACTER CALCOACETICUS] [EC:4.1.3.27] [DE:ANTHRANILATE SYNTHASE COMPONENT 1,] [SP:P23315] |
| Contig133G | 4584663_c1_24 | 1526 | 5652 | 639 | 212 | 150 | 7.60E−09 | gp:[GI:d1014699:g1754644] [LN:D89626] [AC:D89626] [PN:adenylate cyclase] [GN:cyaD] [OR:Anabaena sp.] [SR:Anabaena sp. (strain:PCC7120) DNA] [EC:4.6.1.1] [DE:Anabaena sp. cyaD gene for adenylate cyclase, complete cds.] |
| Contig133G | 6837801_c1_22 | 1527 | 5653 | 840 | 279 | 123 | 3.40E−07 | sp:[LN:GSPC_VIBCH] [AC:P45777] [GN:EPSC] [OR:VIBRIO CHOLERAE] [DE:EPSC)] [SP:P45777] |
| Contig138G | 10003162_f2_193 | 1528 | 5654 | 243 | 80 | | | NO-HIT |
| Contig138G | 10203550_c1_590 | 1529 | 5655 | 492 | 163 | | | NO-HIT |
| Contig138G | 10271880_c3_853 | 1530 | 5656 | 210 | 69 | | | NO-HIT |
| Contig138G | 10439013_f3_433 | 1531 | 5657 | 186 | 61 | | | NO-HIT |
| Contig138G | 10548762_f3_336 | 1532 | 5658 | 867 | 288 | 695 | 1.60E−68 | sp:[LN:YRAL_ECOLI] [AC:P45528] [GN:YRAL] [OR:ESCHERICHIA COLI] [DE:HYPOTHETICAL 31.3 KD PROTEIN IN AGAI-MTR INTERGENIC REGION (F286)] [SP:P45528] |
| Contig138G | 10579458_f1_42 | 1533 | 5659 | 522 | 173 | 473 | 5.SOE−45 | gp:[GI:e1154545:g2570059] [LN:NGMSIIDNA] [AC:AJ004687] [PN:N-4 cytosine-specificmMethyltransferase] [OR:Neisseria gonorrhoeae] [DE:Neisseria gonorrheae MS11 encoding N-4 cytosine-specificmethyltransferase.] |
| Contig138G | 10601002_f1_31 | 1534 | 5660 | 279 | 92 | | | NO-HIT |
| Contig138G | 10664682_f2_199 | 1535 | 5661 | 255 | 84 | | | NO-HIT |
| Contig138G | 1071927_f2_200 | 1536 | 5662 | 1836 | 611 | 382 | 4.90E−38 | pir:[LN:141293] [AC:141293] [PN:EcoE type 1 restriction modification enzyme M subunit] [OR:Escherichia coli] |
| Contig138G | 10823437_c2_679 | 1537 | 5663 | 189 | 62 | | | NO-HIT |
| Contig138G | 10968913_f2_248 | 1538 | 5664 | 1014 | 337 | | | NO-HIT |
| Contig138G | 10970252_c1_597 | 1539 | 5665 | 225 | 74 | | | NO-HIT |
| Contig138G | 10979035_c1_482 | 1540 | 5666 | 2046 | 681 | 1757 | 4.80E−181 | sp:[LN:REP_ECOLI] [AC:P09980] [GN:REP] [OR:ESCHERICHIA COLI] [EC:3.6.1.—] [DE:ATP-DEPENDENT DNA HELICASE REP,] [SP:P09980] |
| Contig138G | 11035936_c2_667 | 1541 | 5667 | 1272 | 423 | 559 | 4.20E−54 | sp:[LN:HCAD_ECOLI] [AC:P77650:O08100] [GN:HCAD:HCAA4] [OR:ESCHERICHIA COLI] [EC:1.18.1.3] [DE:(EC 1.18.1.3)] [SP:P77650:O08100] |
| Contig138G | 11115766_f1_14 | 1542 | 5668 | 207 | 68 | | | NO-HIT |
| Contig138G | 11117265_f2_247 | 1543 | 5669 | 666 | 221 | 376 | 1.00E−34 | sp:[LN:ESTE_VIBMI] [AC:Q07792] [OR:VIBRIO MIMICUS] [EC:3.1.1.2] [DE:ARYLESTERASE PRECURSOR, (ARYL-ESTER HYDROLASE)] [SP:Q07792] |
| Contig138G | 11148927_c1_567 | 1544 | 5670 | 1329 | 442 | | | NO-HIT |
| Contig138G | 11149160_c2_682 | 1545 | 5671 | 183 | 60 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig138G | 11179000_f2_240 | 1546 | 5672 | 1251 | 416 | 1684 | 2.60E−173 | gp:[GI:g2462046] [LN:ACRBDOXN] [AC:Z46863] [PN:rubredoxin reductase] [GN:rubB] [FN:necessary for growth on alkane] [OR:Acinetobacter sp. ADP1] [DE:Acinetobacter sp. cysD, cobQ, sodM, lysS, rubA, rubB, estB, oxyR,ppk, rntgA, ORF2 and ORF3 genes.] [SP:P42454] |
| Contig138G | 11739518_c1_477 | 1547 | 5673 | 1155 | 384 | 1626 | 3.60E−167 | sp:[LN:EFTU_ECOLI] [AC:P02990] [GN:TUFA,TUFB] [OR:*ESCHERICHIA COLI*] [DE:ELONGATION FACTOR TU (EF-TU) (P-43)] [SP:P02990] |
| Contig138G | 1210327_c3_821 | 1548 | 5674 | 852 | 283 | 1006 | 1.80E−101 | sp:[LN:Y4MO_RHISN] [AC:P55574] [GN:Y4MO] [OR:RHIZOBIUM SP] [DE:HYPOTHETICAL TRANSKETOLASE FAMILY PROTEIN Y4MO] [SP:P55574] |
| Contig138G | 1214702_c3_845 | 1549 | 5675 | 669 | 222 | 730 | 3.20E−72 | gp:[GI:d1039559:g4520134] [LN:AB024426] [AC:AB024426] [PN:adenylate kinase] [GN:adk (ak)] [OR:*Pseudomonas putida*] [SR:*Pseudomonas putida* (strain:mt-2) DNA] [EC:2.7.4.3] [DE:*Pseudomonas putida* adk gene for adenylate kinase, complete cds.] |
| Contig138G | 1229767_c3_311 | 1550 | 5676 | 1119 | 372 | 1487 | 1.90E−152 | sp:[LN:PILT_PSEAE] [AC:P24559] [GN:PILT] [OR:*PSEUDOMONAS AERUGINOSA*] [DE:TWITCHING MOBILITY PROTEIN] [SP:P24559] |
| Contig138G | 12397817_c2_740 | 1551 | 5677 | 393 | 130 | 95 | 6.30E−05 | pir:[LNB64887] [AC:B64887] [PN:hypothetical protein b1367] [OR:*Escherichia coli*] |
| Contig138G | 12542802_f1_150 | 1552 | 5678 | 963 | 320 | 1133 | 6.30E−115 | sp:[LN:TRXB_ECOLI] [AC:P09625] [GN:TRXB] [OR:*ESCHERICHIA COLI*] [EC:1.6.4.5] [DE:THIOREDOXIN REDUCTASE,] [SP:P09625] |
| Contig138G | 12672057_f2_287 | 1553 | 5679 | 1737 | 578 | 2345 | 2.30E−243 | sp:[LN:BETA_ECOLI] [AC:P17444:P77861] [GN:BETA] [OR:*ESCHERICHIA COLI*] [EC:1.1.99.1] [DE:CHOLINE DEHYDROGENASE, (CHD)] [SP:P17444:P77861] |
| Contig138G | 12714406_c2_657 | 1554 | 5680 | 666 | 221 | 163 | 3.90E−12 | sp:[LN:YG77_METJA] [AC:Q59071] [GN:MJ1677] [OR:*METHANOCOCCUS JANNASCHII*] [DE:HYPOTHETICAL PROTEIN MJ1677] [SP:Q59071] |
| Contig138G | 12765890_c2_715 | 1555 | 5681 | 483 | 160 | | | NO-HIT |
| Contig138G | 12792336_f3_474 | 1556 | 5682 | 831 | 276 | 187 | 3.90E−17 | gp:[GI:g3806090] [LN:AF079096] [AC:AF079096] [PN:arginine-tRNA-protein transferase 1-lp] [GN:Ate1] [OR:*Mus musculus*] [SR:house mouse] [DE:*Mus musculus* arginine-tRNA-protein transferase 1-lp (Ate1) mRNA,alternative spliced product, complete cds.] [NT:alternatively spliced; ATE1-lp] |

TABLE 2-continued

| Query | Orf | NT ID | AA ID | NT Lgth | AA Lgth | Score | P-value | Subject |
|---|---|---|---|---|---|---|---|---|
| Contig138G | 12928417_f3_422 | 1557 | 5683 | 864 | 287 | 1155 | 3.00E−117 | gp:[GI:g2261504] [LN:AF009672] [AC:AF009672] [PN:unknown] [OR:Acinetobacter sp. ADP1] [DE:Acinetobacter sp. ADP1 vanillate demethylase region, vanillatedemethylase (vanB) and vanillate demethylase (vanA) genes, completecds.] [NT:putative regulatory protein; similar to pcaU; ORF8] |
| Contig138G | 12970082_c1_607 | 1558 | 5684 | 1236 | 411 | 552 | 2.30E−53 | sp:[LN:UB1H_ECOLI] [AC:P25534] [GN:UB1H:VISB] [OR:*ESCHERICHIA COLI*] [EC:1.14.13.—] [DE:UBIH PROTEIN,] [SP:P25534] |
| Contig138G | 13001588_c1_558 | 1559 | 5685 | 549 | 182 | | | NO-HIT |
| Contig138G | 132337_f3_398 | 1560 | 5686 | 204 | 67 | 310 | 1.00E−27 | sp:[LN:RUBR_ACICA] [AC:P42453] [OR:*ACINETOBACTER CALCOACETICUS*] [DE:RUBREDOXIN (RD)] [SP:P42453] |
| Contig138G | 135260_c3_782 | 1561 | 5687 | 774 | 257 | 577 | 5.20E−56 | sp:[LN:YPT5_PSEAE] [AC:P24562] [OR:*PSEUDOMONAS AERUGINOSA*] [DE:HYPOTHETICAL 24.5 KD PROTEIN IN PILT 5'REGION (ORF5)] [SP:P24562] |
| Contig138G | 1362551_c1_591 | 1562 | 5688 | 1323 | 440 | 360 | 5.20E−33 | gp:[GI:g3883031] [LN:AF074611] [AC:AF074611] [PN:unknown] [GN:Y1030] [OR:*Yersinia pestis*] [DE:*Yersinia pestis* plasmid pMT-1, complete plasmid sequence.] [NT:o418; 37 pct identical (5 gaps) to 75 residues of] |
| Contig138G | 13678800_c1_504 | 1563 | 5689 | 924 | 307 | 278 | 2.50E−24 | gp:[GI:g146791] [LN:ECOMCR] [AC:M24927] [GN:mcrB] [OR:*Escherichia coli*] [SR:*E.coli* (strain K12) CR63 DNA clone pRAB13] [DE:*E.coli* McrB and McrC protein genes, complete cds.] [NT:33kD protein (put.); putative] |
| Contig138G | 13680167_c3_855 | 1564 | 5690 | 312 | 103 | | | NO-HIT |
| Contig138G | 13775278_c2_658 | 1565 | 5691 | 519 | 172 | 392 | 2.10E−36 | sp:[LN:VDLD_HELPY] [AC:O05729] [GN:VDLD:HP0891] [OR:*HELICOBACTER PYLORI*] [SR:,*CAMPYLOBACTER PYLORI*] [DE:PROTEIN VDLD] [SP:O05729] |
| Contig138G | 13790937_c1_522 | 1566 | 5692 | 525 | 174 | | | NO-HIT |
| Contig138G | 13862712_f1_146 | 1567 | 5693 | 1092 | 363 | | | NO-HIT |
| Contig138G | 13865942_f3_438 | 1568 | 5694 | 1347 | 448 | 1207 | 9.10E−123 | sp:[LN:ARCD_ECOLI] [AC:P77429] [GN:YDGI] ]OR:*ESCHERICHIA COLI*] [DE:PUTATIVE ARGININE/ORNITHINE ANTIPORTER] [SP:P77429] |
| Contig138G | 13944077_c1_596 | 1569 | 5695 | 408 | 135 | | | NO-HIT |
| Contig138G | 14334686_f2_201 | 1570 | 5696 | 501 | 166 | | | NO-HIT |
| Contig138G | 14345012_c2_640 | 1571 | 5697 | 1428 | 475 | 218 | 5.20E−15 | sp:[LN:TISK_ECOLI] [AC:P05719] [GN:HSDS:HSS] [OR:*ESCHERICHIA COLI*] [DE:TYPE I RESTRICTION ENZYME ECOKI SPECIFICITY PROTEIN (S PROTEIN)] [SP:P05719] |
| Contig138G | 1444837_c2_721 | 1572 | 5698 | 330 | 109 | | | NO-HIT |
| Contig138G | 14459777_f3_373 | 1573 | 5699 | 789 | 262 | 114 | 1.90E−06 | sp:[LN:DICA_ECOLI] [AC:P06966] [GN:DICA] [OR:*ESCHERICHIA COLI*] [DE:REPRESSOR PROTEIN OF DIVISION INHIBITION GENE DICB] [SP:P06966] |

TABLE 2-continued

| Query | Orf | NT ID | AA ID | NT Lgth | AA Lgth | Score | P-value | Subject |
|---|---|---|---|---|---|---|---|---|
| Contig138G | 14464712_c2_765 | 1574 | 5700 | 1257 | 418 | 624 | 5.50E−61 | gp:[GI:g2291144] [LN:CELF17A9] [AC:AF016417] [GN:F17A9.4] [OR:*Caenorhabditis elegans*] [SR:*Caenorhabditis elegans* strain=Bristol N2] [DE:*Caenorhabditis elegans* cosmid F17A9.] [NT:similar to NADH oxidases] |
| Contig138G | 14502251_c1_581 | 1575 | 5701 | 201 | 66 | | | NO-HIT |
| Contig138G | 14587527_f3_327 | 1576 | 5702 | 405 | 134 | 508 | 1.10E−48 | gp:[GI:g3241975] [LN:SSU85710] [AC:U85710] [PN:transposase] [OR:*Sulfotobus solfataricus*] [DE:*Sulfolobus solfataricus* insertion element ISC1041, transposasegene, complete cds.] |
| Contig138G | 14626452_c1_518 | 1577 | 5703 | 801 | 266 | 384 | 1.50E−35 | gp:[Gt:g2228232] [LN:PPU24215] [AC:U24215] [PN:p-cumic alcohol dehydrogenase] [GN:cymB] [FN:converts p-cumic alcohol + NAD to p-cumic] [OR:*Pseudomonas putida*] [DE:*Pseudomonas putida* p-cymene catabolism (cym) and p-cumatecatabotism (cmt) operons and enol-coenzyme A hydratase gene,complete cds.] [NT:CymB] |
| Contig138G | 1463192_f2_258 | 1578 | 5704 | 3702 | 1233 | 3976 | 0 | pir:[LN:XYECMH] [AC:B65209:JH0096:A32644:B54337:A54337:506691] [PN:5-methyltetrahydrofotate--homocysteine S-methyltransferase,:methionine synthase:tetrahydropteroylglutamate methyltransferase] [GN:metH] [CL:cobatamin-dependent methionine synthase] [OR:*Escherichia coli*] [EC:2.1.1.13] [MP:91 min] |
| Contig138G | 14642250_c1_595 | 1579 | 5705 | 423 | 140 | | | NO-HIT |
| Contig138G | 14645287_f2_293 | 1580 | 5706 | 1428 | 475 | 302 | 1.10E−43 | pir:[LN:C69757] [AC:C69757] [PN:transporter homolog ycel] [GN:ycel] [OR:*Bacillus subtilis*] |
| Contig138G | 14647187_c2_634 | 1581 | 5707 | 219 | 72 | | | NO-HIT |
| Contig138G | 14926875_f1_44 | 1582 | 5708 | 624 | 207 | 577 | 5.20E−56 | gp:[GI:e1264023:g2959334] [LN:ASA224767] [AC:AJ224767] [PN:hypothetical protein] [GN:ORFA] [OR:Acinetobacter sp. ADPI] [DE:Acinetobacter sp. ADPI Ion gene and ORFs.] [NT:31% identical to YgfA (hypothetical protein)] |
| Contig138G | 15105040_c3_793 | 1583 | 5709 | 2403 | 800 | 384 | 4.60E−33 | sp:[LN:YZ42_METJA] [AC:Q60297] [GN:MJECL42] [OR:*METHANOCOCCUS JANNASCHII*] [DE:HYPOTHETICAL PROTEIN MJECL42] [SP:Q60297] |
| Contig138G | 15110677_c2_689 | 1584 | 5710 | 714 | 237 | 544 | 1.60E−52 | sp:[LN:YBBA_ECOLI] [AC:P31219:P77322] [GN:YBBA] [OR:*ESCHERICHIA COLI*] [DE:HYPOTHETICAL ABC TRANSPORTER ATP-BINDING PROTEIN YBBA] [SP:P31219:P77322] |
| Contig138G | 156292_f3_387 | 1585 | 5711 | 552 | 183 | 148 | 1.60E−10 | sp[LN:CUTF_ECOLI] [AC:P40710] [GN:CUTF:NLPE] [OR:*ESCHERICHIA COLI*] [DE:COPPER HOMEOSTASIS PROTEIN CUTF PRECURSOR (LIPOPROTEIN NLPE)] [SP:P40710] |

TABLE 2-continued

| Query | Orf | NT ID | AA ID | NT Lgth | AA Lgth | Score | P-value | Subject |
|---|---|---|---|---|---|---|---|---|
| Contig138G | 15663580_f2_217 | 1586 | 5712 | 411 | 136 | 141 | 8.30E−10 | gp:[GI:g3650031] [LN :ATAC005396] [AC:AC005396] [PN:putative proline-rich cell wall protein] [GN:T26120.5] [OR:*Arabidopsis thaliana*] [SR:thale cress] [DE:*Arabidopsis thaliana* chromosome II BAC T26120 genomic sequence,complete sequence.] |
| Contig138G | 15900312_c1_585 | 1587 | 5713 | 480 | 159 | | | NO-HIT |
| Contig138G | 15913177_c3_817 | 1588 | 5714 | 807 | 268 | 301 | 9.30E−27 | pir:[LN:C69230] [AC:C69230] [PN:conserved hypothetical protein MTH973] [GN:MTH973] [CL:hypothetical protein MJ0915] [OR:*Methanobacterium thermoautotrophicum*] |
| Contig138G | 16140665_c2_704 | 1589 | 5715 | 708 | 235 | 758 | 3.50E−75 | sp:[LN:UREG_SYNY3] [AC:P72955] [GN:UREG:SLL0643] [OR:SYNECHOCYSTIS SP] [SR:PCC 6803,] [DE:UREASE ACCESSORY PROTEIN UREG] [SP:P72955] |
| Contig138G | 16406250_c1_481 | 1590 | 5716 | 186 | 61 | | | NO-HIT |
| Contig138G | 164127_c3_805 | 1591 | 5717 | 2106 | 701 | 2444 | 7.50E−254 | sp:[LN:BETT_ECOLI] [AC:P17447] [GN:BETT] [OR:*ESCHERICRIA COLI*] [DE:HIGH-AFFINITY CHOLINE TRANSPORT PROTEIN] [SP:P17447] |
| Contig138G | 16454437_f3_391 | 1592 | 5718 | 564 | 187 | | | NO-HIT |
| Contig138G | 16582252_c2_631 | 1593 | 5719 | 210 | 69 | | | NO-HIT |
| Contig138G | 16829038_f2_242 | 1594 | 5720 | 915 | 304 | 1342 | 4.50E−137 | sp:[LN:ESTR_ACICA] [AC:P52667] [GN:ESTR] [OR:*ACINETOBACTER CALCOACETICUS*] [DE:ESTERASE OPERON TRANSCRIPTIONAL REGULATOR] [SP:P52667] |
| Contig138G | 16834542_c1_594 | 1595 | 5721 | 957 | 318 | 807 | 2.20E−80 | pir:[LN:S58142] [AC:S58142] [PN:coat protein] [OR:phage SPPI] |
| Contig138G | 17037502_c2_698 | 1596 | 5722 | 945 | 314 | 1240 | 2.90E−126 | gp:[GI:g2665721] [LN:AF035608] [AC:AF035608] [PN:ATP sulfurylase small subunit] [GN:cysD] [OR:*Pseudomonas aeruginosa*] [DE:*Pseudomonas aeruginosa* ATP sulfurylase small subunit (cysD) and ATPsulfurylase GTP-binding subunit/APS kinase (cysN) genes, completecds.] |
| Contig138G | 17040643_c1_615 | 1597 | 5723 | 3267 | 1088 | 578 | 6.20E−66 | sp:[LN:MLTD_ECOLI] [AC:P23931:P32982:P77350] [GN:MLTD:DNIR] [OR:*ESCHERICHIA COLI*] [EC:3.21.—] [DE:(MUREIN HYDROLASE D) (REGULATORY PROTEIN DNIR)] [SP:P23931:P32982:P77350] |
| Contig138G | 175276_f2_294 | 1598 | 5724 | 1425 | 474 | 134 | 1.20E−05 | sp:[LN:YBFM_ECOLI] [AC:P75733] [GN:YBFM] [OR:*ESCHERICHIA COLI*] [DE:HYPOTHETICAL 52.8 KD PROTEIN IN GLNS-FUR INTERGENIC REGION] [SP:P75733] |

TABLE 2-continued

| Query | Orf | NT ID | AA ID | NT Lgth | AA Lgth | Score | P-value | Subject |
|---|---|---|---|---|---|---|---|---|
| Contig138G | 181577_c2_708 | 1599 | 5725 | 1404 | 467 | 1693 | 2.90E-174 | sp:[LN:DHE4_HAEIN] [AC:P43793] [GN:GDHA:H10189] [OR:*HAEMOPHILUS INFLUENZAE*] [EC:1.4.1.4] [DE:NADP-SPECIFIC GLUTAMATE DEHYDROGENASE, (NADP-GDH)] [SP:P43793] |
| Contig138G | 19570327_c2_703 | 1600 | 5726 | 483 | 160 | 301 | 9.30E-27 | sp:[LN:UREE_KLEAE] [AC:P18317] [GN:UREE] [OR:*KLEBSIELLA AEROGENES*] [DE:UREASE ACCESSORY PROTEIN UREE] [SP:P18317] |
| Contig138G | 19628893_f2_288 | 1601 | 5727 | 1653 | 550 | 1577 | 5.60E-162 | sp:[LN:MQO_ECOLI] [AC:P33940:P76454:O08017] [GN:YOJH] [OR:*ESCHERICHIA COLI*] [EC:1.1.99.16] [DE:DEHYDROGENASE (ACCEPTOR)) (MQO)] [SP:P33940:P76454:O08017] |
| Contig138G | 19694667_f3_473 | 1602 | 5728 | 753 | 250 | 467 | 2.40E-44 | sp:[LN:LPTP_ECOLI] [AC:P23885] [GN:AAT] [OR:*ESCHERICHIA COLI*] [EC:2.3.2.—] [DE:LEUCYL/PHENYLALANYL-TRNA--PROTEIN TRANSFERASE,] [SP:P23885] |
| Contig138G | 19720457_c1_588 | 1603 | 5729 | 192 | 63 | | | NO-HIT |
| Contig138G | 19922807_f3_467 | 1604 | 5730 | 966 | 321 | 477 | 2.10E-45 | gp:[GI:g2558847] [LN:AF019110] [AC:AF019110] [PN:PapII homolog] [GN:papII] [OR:*Salmonetla typhimurium*] [DE:*Salmonella typhimurium* disulfide oxidoreductase (dsbA) and PapIIhomolog (papII) genes, complete cds.] [NT:similar to *E. coli* PapII] |
| Contig138G | 2032308_c2_664 | 1605 | 5731 | 594 | 197 | 124 | 2.30E-14 | sp:[LN:PNUC_SALTY] [AC:P24520] [GN:PNUC] [OR:*SALMONELLA TYPHIMURIUM*] [DE:PNUC PROTEIN] [SP:P24520] |
| Contig138G | 20343801_c3_831 | 1606 | 5732 | 1587 | 528 | 1132 | 8.10E-115 | gp:[GI:g4512004] [LN:AF104912] [AC:AF10491 2] [OR:*Escherichia coli*] [DE:*Escherichia coli* K30 capsule biosynthesis cluster, partialsequence.] [NT:OrfX; Klebsiella K2 Orf3 homologue] |
| Contig138G | 204437_f2_308 | 1607 | 5733 | 396 | 131 | 94 | 0.00093 | pir:[LN:670581] [AC:G70581] [PN:hypothetical protein Rv0911] [GN:Rv0911] [OR:*Mycobacterium tuberculosis*] |
| Contig138G | 20506287_f3_443 | 1608 | 5734 | 348 | 115 | | | NO-HIT |
| Contig138G | 20599128_c2_636 | 1609 | 5735 | 606 | 201 | 207 | 8.50E-17 | gp:[GI:g148219] [LN:ECOUW85] [AC:M87049] [GN:f161] [FN:unknown] [OR:*Escherichia coli*] [DE:*E. coli* genomic sequence of the region from 84.5 to 86.5 minutes.] |
| Contig138G | 20837751_c3_778 | 1610 | 5736 | 405 | 134 | 182 | 3.80E-14 | sp:[LN:YFJF_ECOLI] [AC:P52119:P76603] [GN:YFJF] [OR:*ESCHERICHIA COLI*] [DE:HYPOTHETICAL 10.8 KD PROTEIN IN SMPA-SMPB INTERGENIC REGION (F102)] [SP:P52119:P76603] |
| Contig138G | 2128900_f3_337 | 1611 | 5737 | 636 | 211 | 419 | 2.90E-39 | sp:[LN:YGGA_ECOLI] [AC:P11667] [GN:YGGA] [OR:*ESCHERICHIA COLI*] [DE:HYPOTHETICAL 23.2 KD PROTEIN IN SBM-FBA INTERGENIC REGION (ORF 5)] [SP:P11667] |

TABLE 2-continued

| Query | Orf | NT ID | AA ID | NT Lgth | AA Lgth | Score | P-value | Subject |
|---|---|---|---|---|---|---|---|---|
| Contig138G | 21500003_f1_56 | 1612 | 5738 | 837 | 278 | 380 | 3.90E-35 | pir:[LN:F64919] [AC:F64919] [PN:probable iron-sulfur protein b1628 precursor:rnfB protein homolog] [CL:conserved hypothetical protein H11684:ferredoxin 2[4Fe-45] homology] [OR:*Escherichia coli*] |
| Contig138G | 21503178_f2_241 | 1613 | 5739 | 969 | 322 | 1413 | 1.40E-144 | pir:[LN:S57530] [AC:S57530] [PN:carboxyl esterase] [CL:carboxyl esterase] [OR:*Acinetobacter calcoaccticus*] |
| Contig138G | 21506527_c3_780 | 1614 | 5740 | 501 | 166 | 768 | 3.00E-76 | gp:[GI:e1371365:g4164224] [LN:ABDNAFUR] [AC:Y14980] [PN:ferric uptake regulator] [GN:fur] [OR:*Acinetobacter baumannii*] [DE:*Acinetobacter baumannii* fur gene.] |
| Contig138G | 21572183_c2_699 | 1615 | 5741 | 1617 | 538 | 1558 | 1.40E-161 | gp:[GI:g2665722] [LN:AF035608] [AC:AF035608] [PN:ATP sulfurylase GTP-binding subunitlAPS kinase] [GN:cysN] [OR:*Pseudomonas acruginosa*] [DE:*Pseudomonas aeruginosa* ATP sulfurylase small subunit (cysD) and ATPsulfutylase GTP-binding subunit/APS kinase (cysN) genes, completecds.] [NT:fusion of the ATP sulfurylase GTP-binding subunit] |
| Contig138G | 21602153_c2_675 | 1616 | 5742 | 789 | 262 | 780 | 1.60E-77 | sp:[LN:Y4MP_RHISN) [AC:P55575] [GN:Y4MP] [OR:RHIZOBIUM SP] [EC:1.—.—.—] [DE:PUTATIVE SHORT-CHAIN TYPE DEHYDROGENASE/REDUCTASE Y4MP,] [SP:P55575] |
| Contig138G | 21604540_f3_381 | 1617 | 5743 | 186 | 61 | | | NO-HIT |
| Contig138G | 21650252_c3_873 | 1618 | 5744 | 462 | 153 | | | NO-HIT |
| Contig138G | 21679750_c1_568 | 1619 | 5745 | 264 | 87 | | | NO-HIT |
| Contig138G | 21697187_f1_90 | 1620 | 5746 | 1302 | 433 | 568 | 1.30E-92 | pir:[LN:H64636] [AC:H64636] [PN:proline/betaine transporter] [OR:*Helicobacter pylori*] |
| Contig138G | 21913267_c2_647 | 1621 | 5747 | 2004 | 667 | | | NO-HIT |
| Contig138G | 2228500_f3_389 | 1622 | 5748 | 1329 | 442 | 1306 | 2.90E-133 | sp:[LN:YTFL_ECOLI] [AC:P39319) IGN:YTFL] [OR:*ESCHERICHIA COLI*] [DE:HYPOTHETICAL 49.8 KD PROTEIN IN CYSQ-MSRA INTERGENIC REGION] [SP:P39319] |
| Contig138G | 2241012_c3_770 | 1623 | 5749 | 3087 | 1028 | 1489 | 1.70E-178 | gp:[GI:g4063380] [LN:AF095845] [AC:AF095845] [PN:cell division/stress response protein] [GN:ftsK] [FN:required for growth and pathogenicity on bean] [OR:*Pseudomonas syringae*] [DE:*Pseudomonas syringae* cell division/stress response protein (ftsK)and periplasmic chaperone protein (lolA) genes, complete cds.] [NT:FtsK] |
| Contig138G | 22656250_f1_332 | 1624 | 5750 | 1680 | 559 | 218 | 6.30E-14 | gp:[GI:g3549118] [LN:AF083252] [AC:AF083252] [PN:pilin biosynthetic protein] [GN:fimL] [OR:*Pseudormonas aeruginosa*] [DE:*Pseudormonas aeruginosa* enoyl-CoA hydratase gene, partial cds; pilinbiosynthetic protein (fimL) gene, complete cds; and unknown gene.] [NT:FimL: similar to *Pseudomonas acruginosa* PilL] |
| Contig138G | 22682686_c2_733 | 1625 | 5751 | 456 | 151 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig138G | 22687535_c1_616 | 1626 | 5752 | 1842 | 613 | 1109 | 2.20E−112 | gp:[GI:g4155770] [LN:AE001544] [AC:AE001544:AE001439] [PN:putative] [GN:jhp1173] [OR:*Helicobacter pylori* J99] [DE:*Helicobacter pylori*, strain J99 section 105 of 132 of the completegenome.] [NT:similar to *H. pylori* 26695 gene HP1252] |
| Contig138G | 22692536_f2_306 | 1627 | 5753 | 1122 | 373 | 751 | 1.90E−74 | sp:[LN:YFIT_PSEAE] [AC:P33642:Q51527] [OR:*PSEUDOMONAS AERUGINOSA*] [DE:HYPOTHETICAL 39.5 KD OXIDOREDUCTASE IN FIMT 3'REGION (DADA*) (ORFZ)] [SP:P33642:Q51527] |
| Contig138G | 22897812_f1_52 | 1628 | 5754 | 2469 | 822 | 3669 | 0 | gp:[GI:e1264024:g2959335] [LN:ASA224767] [AC:AJ224767] [PN:Lon-protease] [GN:lon] [OR:Acinetobacter sp. ADPI] [DE:Acinetobacter sp. ADPI lon gene and ORFs.] |
| Contig138G | 22900251_f1_107 | 1629 | 5755 | 1266 | 421 | 1250 | 2.50E−127 | gp:[GI:g4545128] [LN:AF079997] [AC:AF079997] [PN:DctA] [GN:dctA] [OR:*Pseudomonas putida*] [DE:*Pseudormonas putida* aerotaxis receptor Aer (aer) and DctA (dctA)genes, complete cds; and unknown gene.] [NT:similar to C4 dicarboxylate transporters.] |
| Contig138G | 23443837_c3_838 | 1630 | 5756 | 201 | 66 | | | NO-HIT |
| Contig138G | 23476577_f2_222 | 1631 | 5757 | 1110 | 369 | 173 | 7.60E−11 | pir:[LN:S75791] [AC:S75791] [PN:hypothetical protein slr0841] [OR:Synechocystis sp.] [SR:PCC 6803, , PCC 6803] [SR:PCC 6803,] |
| Contig138G | 23492887_c1_502 | 1632 | 5758 | 3276 | 1091 | 772 | 5.50E−79 | gp:[GI:g551948] [LN:PTITETLMOB] [AC:M63891:X15670] [OR:Plasmid pTB19] [SR:Plasmid pTB19 DNA] [DE:Plasmid pTB19 (from *Bacillus stearothermophilus*) replicationprotein (rep), tetracycline-resistance protein (tetL), mobilizableproteins (mob), and bleomycin-resistance (bleO) genes, completecds.] [NT:ORF] |
| Contig138G | 23515760_c2_736 | 1633 | 5759 | 549 | 182 | | | NO-HIT |
| Contig138G | 23594052_c2_641 | 1634 | 5760 | 978 | 325 | | | NO-HIT |
| Contig138G | 23618752_f2_160 | 1635 | 5761 | 429 | 142 | 116 | 3.70E−07 | gp:[GI:g1871365] [LN:H1U68399] [AC:U68399] [PN:haemocin immunity protein] [GN:hmcI] [FN:confers immunity to *H. influenzae* bacteriocin] [OR:*Haemophilus influenzae*] [DE:*Haemophilus influenzae* hmcD, putative haemocin processing protein(hmcC), putative ABC transporter (hmcB). putative haemocinstructural protein (hmcA), and haemocin immunity protein (hmcI)genes, complete cds.] [NT:bacteriocin immunity protein] |
| Contig138G | 23620625_f3_379 | 1636 | 5762 | 825 | 274 | 926 | 5.50E−93 | gp:[GI:e1264026:g2959337] [LN:ASA224767] [AC:AJ224767] [PN:hypothetical protein] [GN:ORFD] [OR:Acinetobacter sp ADPI] [DE:Acinctobacter sp. ADPI lon gene and ORFs.] [NT:39% identical to YgiD (hypothetical protein)] [RE: |
| Contig138G | 23625438_c1_587 | 1637 | 5763 | 564 | 187 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig138G | 23650067_c2_757 | 1638 | 5764 | 648 | 215 | 165 | 2.40E-12 | sp:[LN:YGFB_ECOLI] [AC:P25533] [GN:YGFB] [OR:ESCHERICHIA COLI] [DE:(F194)] [SP:P25533] |
| Contig138G | 23692568_f2_279 | 1639 | 5765 | 213 | 70 | | | NO-HIT |
| Contig138G | 23697132_c2_690 | 1640 | 5766 | 2463 | 820 | 1086 | 6.10E-110 | gp:[GI:e352365:g2462050] [LN:ACRBDOXN] [AC:Z46863] [PN:hypothetical protein] [GN:ORF3] [OR:Acinetobacter sp. ADP1] [DE:Acinetobacter sp. cysD, cobQ, sodM, lysS, rubA, rubB, estB, oxyR,ppk, mtgA, ORF2 and ORF3 genes] ]NT:putative] [RE: |
| Contig138G | 23707033_c2_633 | 1641 | 5767 | 558 | 185 | 113 | 7.70E-07 | pir:[LN:F69883] [AC:F69883] [PN:conserved hypothetical protein ymaD] [GN:ymaD] [OR:Bacillus subtilis] |
| Contig138G | 23712786_c2_668 | 1642 | 5768 | 1227 | 408 | 216 | 1.40E-28 | sp:[LN:GUDT_ECOLI] [AC:Q46916] [GN:YGCZ] [OR:ESCHERICHIA COLI] [DE:PROBABLE GLUCARATE TRANSPORTER] [SP:Q46916] |
| Contig138G | 23829193_c3_766 | 1643 | 5769 | 894 | 297 | 297 | 2.40E-21 | pir:[LN:H70882] [AC:H70882] [PN:hypothetical protein Rv2777c] [GN:Rv2777c] [OR:Mycobacterium tuberculosis] |
| Contig138G | 23879202_f1_57 | 1644 | 5770 | 693 | 230 | 774 | 7.00E-77 | sp:[LN:END3_HAEIN] [AC:P44319] [GN:NTH:H11689] [OR:HAEMOPHILUS INFLUENZAE] [EC:4.2.99.18] [DE:LYASE)] [SP:P44319] |
| Contig138G | 24042052_c2_700 | 1645 | 5771 | 1620 | 539 | 1571 | 2.40E-161 | gp:[GI:d1024559:g2662054] [LN:AB004651] [AC:AB004651] [PN:isocitrate lyase] [OR:Hyphomicrobium methylovorum] [SR:Hyphomicrobium methylovorum (strain:GML2) DNA] [DE:Hyphomicrobium methylovorum gene for isocitrate lyase,inorganicphosphate transporter,methionine synthase,complete and partial cds.] |
| Contig138G | 24095908_c2_649 | 1646 | 5772 | 216 | 71 | | | NO-HIT |
| Contig138G | 24218840_c1_605 | 1647 | 5773 | 1659 | 552 | 1143 | 5.50E-116 | pir:[LN:S56342] [AC:S56342:A65221] [PN:hypothetical 61.7K protein (basS-adiY intergenic region):yidB protein] [GN:yjdB] [OR:Escherichia coli] |
| Contig138G | 24251275_c1_601 | 1648 | 5774 | 759 | 252 | | | NO-HIT |
| Contig138G | 24304142_c3_772 | 1649 | 5775 | 780 | 259 | 418 | 3.70E-39 | sp:[LN:YIAD_ECOLI] [AC:P37665] [GN:YIAD] [OR:ESCHERICHIA COLI] [DE:PRECURSOR (O219)] [SP:P37665] |
| Contig138G | 24304528_c3_841 | 1650 | 5776 | 687 | 228 | 366 | 1.20E-33 | gp:[GI g2130643] [LN:AF000579] [AC:AF000579] [PN:urease accessory protein EF] [GN:ureEF] [OR:Bordetella bronchiseptica] [DE:Bordetella bronchiseptica LysR transcriptional activator homolog(bbuR), urease accessory protein D (ureD), urease structuralsubunit A (ureA), urease accessory protein J (ureJ), ureasestructural subunits B (ureB) and C (ureC), urease accessory,proteins EF (ureEF) and G (ureG) genes, complete cds.] [NT:UreEF] |
| Contig138G | 24390712_c3_795 | 1651 | 5777 | 1356 | 451 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig138G | 24406337_c2_627 | 1652 | 5778 | 864 | 287 | 746 | 6.50E−74 | sp:[LN:YAFJ_HAEIN] [AC:P44098] [GN:H11037] [OR:*HAEMOPHILUS INFLUENZAE*] [DE:HYPOTHETICAL PROTEIN H11037] [SP:P44098] |
| Contig138G | 24415877_f3_345 | 1653 | 5779 | 492 | 163 | | | NO-HIT |
| Contig138G | 24415927_f3_382 | 1654 | 5780 | 555 | 184 | 367 | 9.40E−34 | sp:[LN:YHHF_HAEIN] [AC:P44869] [GN:H10767] [OR:*HAEMOPHILUS INFLUENZAE*] [DE:HYPOTHETICAL PROTEIN H10767] [SP:P44869] |
| Contig138G | 24422692_c3_792 | 1655 | 5781 | 2055 | 684 | 1509 | 9.10E−155 | pir:[LN:E70682] [AC:E70682] [PN:probable gamma-glutamyltranspeptidase precursor] [GN:ggtB] [OR:*Mycobacterium tuberculosis*] |
| Contig138G | 24469437_c2_719 | 1656 | 5782 | 1347 | 448 | 517 | 1.20E−49 | sp:[LN:DNAB_ECOLI] [AC:P03005] [GN:DNAB:GROP:GRPA] [OR:*ESCHERICHIA COLI*] [EC:3.6.1.—] [DE:REPLICATIVE DNA HELICASE,] [SP:P03005] |
| Contig138G | 24506250_c3_773 | 1657 | 5783 | 468 | 155 | 584 | 9.50E−57 | sp:[LN:DUT_ECOLI] [AC:P06968] [GN:DUT:DNAS:SOF] [OR:*ESCHERICHIA COLI*] [EC:3.6.1.23] [DE:(DUTPASE) (DUTP PYROPHOSPHATASE)] [SP:P06968] |
| Contig138G | 24617316_c2_729 | 1658 | 5784 | 654 | 217 | | | NO-HIT |
| Contig138G | 24640832_c3_791 | 1659 | 5785 | 1530 | 509 | 1348 | 1.00E−137 | gp:[GI:g3378277] [LN:AF079317] [AC:AF079317] [PN:putative aromatic efflux pump inner membrane] [GN:orf121] [OR:*Sphingomonas aromaticivorans*] [DE:*Sphingomonas aromaticivorans* plasmid pNL1, complete plasmidsequence.] [NT:putative inner membrane component efflux pump] |
| Contig138G | 24640902_c3_879 | 1660 | 5786 | 1329 | 442 | 1039 | 5.80E−105 | pir:[LN:S76440] [AC:S76440] [PN:hypothetical protein] [CL:aminopeptidase P] [OR:Synechocystis sp.] [SR:PCC 6803, , PCC 6803] [SR:PCC 6803,] |
| Contig138G | 24648291_f3_407 | 1661 | 5787 | 1014 | 3337 | 369 | 1.80E−44 | pir:[LN:C70643] [AC:C70643] [PN:hypothetical protein Rv0712] [GN:Rv0712] [OR:*Mycobacterium tuberculosis*] |
| Contig138G | 24648408_c1_561 | 1662 | 5788 | 882 | 293 | 425 | 6.70E−40 | gp:[GI:e331505:g2340842] [LN:AEY13732] [AC:Y13732] [PN:urease accessory protein] [GN:ureD1] [OR:*Ralstonia eutropha*] [DE:*Alcatigenes eutrophus* genes for ureases, ureD1, ureD2, ureA, ureB,and ORF1, ORF2] |
| Contig138G | 24648567_c3_808 | 1663 | 5789 | 426 | 141 | | | NO-HIT |
| Contig138G | 24666561_c2_741 | 1664 | 5790 | 696 | 231 | | | NO-HIT |
| Contig138G | 24785932_c3_858 | 1665 | 5791 | 492 | 163 | | | NO-HIT |
| Contig138G | 24803450_f2_291 | 1666 | 5792 | 309 | 102 | | | NO-HIT |
| Contig138G | 24804626_c1_600 | 1667 | 5793 | 4365 | 1454 | 207 | 3.70E−18 | gp:[GI:g1256742] [LN:TRBR272P] [AC:L04603] [PN:R27-2 protein] [OR:*Trypanosoma cruzi*] [SR:*Trypanosoma cruzi* (strain Sylvio X-10) DNA] [DE:*Trypanosoma cruzi* R27-2 protein gene, complete cds.] |

TABLE 2-continued

| Query | Orf | NT ID | AA ID | NT Lgth | AA Lgth | Score | P-value | Subject |
|---|---|---|---|---|---|---|---|---|
| Contig138G | 24895332_c2_661 | 1668 | 5794 | 357 | 118 | 319 | 1.10E−28 | sp:[LN:FKBP_NEIME] [AC:P25138] [GN:FBP] [OR:*NEISSERIA MENINGITIDIS*] [EC:5.2.1.8] [DE:(EC 5.21.8) (ROTAMASE)] [SP:P25138] |
| Contig138G | 2522140_f1_408 | 1669 | 5795 | 1593 | 530 | | | NO-HIT |
| Contig138G | 2525305_c1_592 | 1670 | 5796 | 1380 | 459 | | | NO-HIT |
| Contig138G | 2540887_c2_761 | 1671 | 5797 | 867 | 288 | 147 | 3.60E−08 | gp:[GI:g1086620] [LN:CELD2024] [AC:U4101 I] [GN:D2024.2] [OR:*Caenorhabditis elegans*] [SR:*Caenorhabditis elegans* strain=Bristol N2] [DE:*Caenorhabditis elegans* cosmid D2024.] |
| Contig138G | 25524217_c3_857 | 1672 | 5798 | 192 | 63 | | | NO-HIT |
| Contig138G | 25581250_f1_104 | 1673 | 5799 | 843 | 280 | 334 | 2.90E−30 | sp:[LN:PAAF_ECOLI] [AC:P76082:P78288:053014] [GN:PAAF] [OR:*ESCHERICHIA COLI*] [EC:4.2.1.17] [DE:PROBABLE ENOYL-COA HYDRATASE PAAF,] [SP:P76082:P78288:053014] |
| Contig138G | 256952_f1_43 | 1674 | 5800 | 264 | 87 | | | NO-HIT |
| Contig138G | 25869000_f1_87 | 1675 | 5801 | 792 | 263 | 323 | 4.30E−29 | sp:[LN:YEAM_ECOLI] [AC:P7624] [GN:YEAM] [OR:*ESCHERICHIA COLI*] [DE:HYPOTHETICAL TRANSCRIPTIONAL REGULATOR IN GAPA-RND INTERGENIC REGION] [SP:P76241] |
| Contig138G | 25907318_c1_589 | 1676 | 5802 | 468 | 155 | | | NO-HIT |
| Contig138G | 26047037_f3_376 | 1677 | 5803 | 1092 | 363 | | | NO-HIT |
| Contig138G | 26048436_f2_312 | 1678 | 5804 | 1140 | 379 | 1313 | 5.30E−134 | pir:[LN:S54702] [AC:S54702] [PN:pilU protein] [CL:pilT protein] [OR:*Pseudomonas aeruginosa*] |
| Contig138G | 26266678_f3_338 | 1679 | 5805 | 423 | 140 | 224 | 1.30E−18 | gp:[GI:e301541:g2995418] [LN:BCMOSMRGI] [AC:Y09027] [PN:regulatory protein] [GN:merR] [OR:*Bacillus cereus*] [DE:*Bacillus cereus* merR gene and 2 ORF's.] |
| Contig138G | 26304712_c1_516 | 1680 | 5806 | 348 | 115 | | | NO-HIT |
| Contig138G | 26350715_c2_676 | 1681 | 5807 | 1347 | 448 | 985 | 3.10E−99 | sp:[LN:TUB3_AGRV] [AC:P70786] [GN:TTUB] [OR:*AGROBACTERIUM VITIS*] [DE:PUTATIVE TARTRATE TRANSPORTER] [SP:P70786] |
| Contig138G | 26355013_c2_722 | 1682 | 5808 | 768 | 255 | | | NO-HIT |
| Contig138G | 26375143_c2_758 | 1683 | 5809 | 306 | 101 | | | NO-HIT |
| Contig138G | 265662_f3_468 | 1684 | 5810 | 891 | 296 | 904 | 1.20E−90 | pir:[LN:CCECID] [AC:B31877:D64863] [PN:cell division inhibitor minD:septum site-determining protein minD] [GN:minD] [CL:cell division inhibitor minD] [OR:*Escherichia coli*] [MP:26 min] |
| Contig138G | 26579437_c3_876 | 1685 | 5811 | 324 | 107 | | | NO-HIT |
| Contig138G | 26601538_c2_725 | 1686 | 5813 | 273 | 90 | | | NO-HIT |
| Contig138G | 26641283_c1_479 | 1687 | 5813 | 750 | 249 | 592 | 1.30E−57 | sp:[LN:YIGJ_ECOLI] [AC:P27846] [GN:YIGJ] [OR:*ESCHERICHIA COLI*] [DE:HYPOTHETICAL 22.5 KD PROTEIN IN RECQ-PLDB INTERGENIC REGION] ]SP:P27846] |
| Contig138G | 26672781_c1_534 | 1688 | 5814 | 1032 | 343 | 1208 | 7.10E−123 | sp:[LN:Y4MN_RHISN] [AC:P55573] [GN:Y4MN] [OR:RHIZOBIUM SP] [DE:HYPOTHETICAL TRANSKETOLASE FAMILY PROTEIN Y4MN] [SP:P55573] |
| Contig138G | 273937_c3_819 | 1689 | 5815 | 1266 | 421 | | | NO-HIT |
| Contig138G | 2790637_c1_586 | 1690 | 5816 | 234 | 77 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig138G | 2822340_c2_626 | 1691 | 5817 | 807 | 268 | 144 | 4.30E−08 | pir:[LN:F70858] [AC:F70858] [PN:hypothetical protein Rv3027c] [GN:Rv3027c] [OR:*Mycobacterium tuberculosis*] |
| Contig138G | 2837758_c2_697 | 1692 | 5818 | 1566 | 521 | 2420 | 2.60E−251 | sp:[LN:SYK_ACICA] [AC:Q43990] [GN:LYSS] [OR:*ACINETOBACTER CALCOACETICUS*] [EC:6.1.1.6] [DE:LYSYL-TRNA SYNTHETASE, (LYSINE--TRNA LIGASE) (LYSRS)] [SP:Q43990] |
| Contig138G | 2927291_c1_484 | 1693 | 5819 | 1188 | 395 | 87 | 0.00078 | pir:[LN:F69825] [AC:F69825] [PN:sodium-dependent transporter homolog yhdH] [GN:yhdH] [CL:gamma-aminoburyric acid transporter] [OR:*Bacillus subtitis*] |
| Contig138G | 29308375_c1_609 | 1694 | 5820 | 903 | 300 | 497 | 1.60E−47 | sp:[LN:YW34_MYCTU] [AC:Q10872] [GN:MTCY39.34] [OR:*MYCOBACTERIUM TUBERCULOSIS*] [DE:HYPOTHETICAL TRANSCRIPTIONAL REGULATOR CY39.34] [SP:Q10872] |
| Contig138G | 29330062_c1_572 | 1695 | 5821 | 7515 | 2504 | 514 | 2.20E−44 | gp:[GI:g1666683] [LN:U41852] [AC:U41852] [GN:hsf] [OR:*Haemophilus influenzae*] [DE:*Haemophilus influenzae* hsf gene, complete cds.] |
| Contig138G | 29390930_f1_74 | 1696 | 5822 | 1752 | 583 | 1174 | 2.90E−119 | sp:[LN:ARS_PSEAE] [AC:P51691] [GN:ATSA] [OR:*PSEUDOMONAS AERUGINOSA*] [EC:3.1.6.1] [DE:ARYLSULFATASE, (ARYL-SULPHATE SULPHOHYDROLASE)] [SP:P51691] |
| Contig138G | 29489562_f3_435 | 1697 | 5823 | 1518 | 505 | 1917 | 5.30E−198 | pir:[LN:S15181] [AC:S15181:JQ1230:H64757:S10900] [PN:betaine-aldehyde dehydrogenase, :betB protein] [GN:betB] [CL:aldehyde dehydrogenase (NAD+):aldehyde dehydrogenase homology] [OR:*Escherichia coli*] [EC: 1.21.8] [MP:7.5 min] |
| Contig138G | 29579063_c1_573 | 1698 | 5824 | 837 | 278 | 181 | 1.20E−25 | gp:[GI:g3283200] [LN:AF058703] [AC:AF058703] [PN:Iipoprotein Plp4] [GN:plpD] [OR:*Pasteurella haemolytica*] [DE:*Pasteurella haemolytica* lipoprotein Plp4 (plpD) gene, complete cds.] |
| Contig138G | 29773467_c3_887 | 1699 | 5825 | 1068 | 355 | 906 | 2.70E−105 | sp:[LN:YEJB_ECOLI] [AC:P33914:P76448] [GN:YEJB] [OR:*ESCHERICHIA COLI*] [DE:HYPOTHETICAL ABC TRANSPORTER PERMEASE PROTEIN YEJB] [SP:P33914:P76448] |
| Contig138G | 29892966_c1_598 | 1700 | 5826 | 1113 | 370 | | | NO-HIT |
| Contig138G | 29960063_c3_862 | 1701 | 5827 | 225 | 74 | | | NO-HIT |
| Contig138G | 30100678_f1_374 | 1702 | 5828 | 480 | 159 | | | NO-HIT |
| Contig138G | 30117027_c2_726 | 1703 | 5829 | 336 | 111 | | | NO-HIT |
| Contig138G | 30166312_c1_582 | 1704 | 5830 | 348 | 115 | | | NO-HIT |
| Contig138G | 30369077_c2_737 | 1705 | 5831 | 372 | 123 | | | NO-HIT |
| Contig138G | 31262_c2_678 | 1706 | 5832 | 639 | 212 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig138G | 31268_f3_388 | 1707 | 5833 | 1014 | 337 | 441 | 1.40E−41 | gp:[GI:g3643996] [LN:AF087482] [AC:AF087482] [PN:putative regulatory protein] [GN:ohbR] [OR:*Pseudomonas aeruginosa*] [DE:*Pseudomonas aeruginosa* clcC and ohbH genes, Lys-R type regulatoryprotein (clcR), chlorocatechol-1,2-dioxygenase (clcA),chloromuconate cycloisomerase (clcB), dienelactone hydrolase(clcD), maleylacetate reductase (clcE), transposase (tnpA),ATP-binding protein (tnpB), putative regulatory protein (ohbR), o-halobenzoate dioxygenase reductase (ohbA), o-halobenzoatedioxygenase alpha subunit (ohbB), o-halobenzoate dioxygenase betasubunit (ohbC), o-halobenzoate dioxygenase ferredoxin (ohbD),putative membrane spanning protein (ohbE), ATP-binding protein(ohbF), putative substrate binding protein (ohbG), and putativedioxygenase genes, complete cds; and unknown gene.] [NT:similar to Lys-R type regulatory proteins.] |
| Contig138G | 3131505_c1_515 | 1708 | 5834 | 2022 | 673 | 1280 | 1.70E−130 | gp:[GI:e1331963:g4106594] [LN:YP102KB] [AC:AL031866] [GN:hmsF] [OR:*Yersinia pestis*] [DE:*Yersinia pestis* 102 kbases unstable region: from 1 to 119443.] [NT:ORF26, len: 673, hmsF, 96.9% identity with hmsF] |
| Contig138G | 31423428_f1_40 | 1709 | 5835 | 1041 | 346 | | | NO-HIT |
| Contig138G | 31440628_c3_868 | 1710 | 5836 | 879 | 292 | 119 | 0.00025 | pir:[LN:F70350] [AC:F70350] [PN:recombination protein RecN] [GN:recN] [OR:*Aquifex aeolicus*] |
| Contig138G | 3151941_c2_759 | 1711 | 5837 | 381 | 126 | 123 | 6.70E−08 | gp:[GI:e258655:g1628369] [LN:DNINTREG] [AC:X98546] [GN:gepB] [OR:*Dichelobacter nodosus*] [DE:*D.nodosus* intB, regA gepA. gepB, and gepC genes.] |
| Contig138G | 3229750_c3_806 | 1712 | 5838 | 1011 | 336 | 502 | 4.60E−48 | sp:[LN:YEIR_ECOLI] [AC:P33030:P76444] [GN:YEIR] [OR:*ESCHERICHIA COLI*] [DE:HYPOTHETICAL 36.1 KD PROTEIN IN FRUB-SPR INTERGENIC REGION] [SP:P33030:P76444] |
| Contig138G | 32546887_c2_672 | 1713 | 5839 | 1368 | 455 | 578 | 4.10E−56 | sp:[LN:GLSK_RAT] [AC:P13264] [OR:*RATTUS NORVEGICUS*] [EC:3.5.1.2] [DE:AMIDORYDROLASE)] [SP:P13264] |
| Contig138G | 3307762_f1_59 | 1714 | 5840 | 2064 | 687 | 1257 | 4.60E−128 | sp:[LN:PBP2_HAEIN] [AC:P44469] [GN:MRDA:PBP2:H10032] [OR:*HAEMOPHILUS INFLUENZAE*] [DE:PENICILLIN BINDING PROTEIN 2 (PBP-2)] [SP:P44469] |
| Contig138G | 33259592_f2_321 | 1715 | 5841 | 306 | 101 | 110 | 1.60E−06 | sp:[LN:MINE_ECOLI] [AC:P18198] [GN:MINE] [OR:*ESCHERICHIA COLI*] [DE:CELL DIVISION TOPOLOGICAL SPECIFICITY FACTOR] [SP:P18198] |

TABLE 2-continued

| Query | Orf | NT ID | AA ID | NT Lgth | AA Lgth | Score | P-value | Subject |
|---|---|---|---|---|---|---|---|---|
| Contig138G | 3325_c3_768 | 1716 | 5842 | 537 | 178 | 274 | 6.70E−24 | sp:[LN:RIMI_ECOLI] [AC:P09453] [GN:RIMI] [OR:*ESCHERICHIA COLI*] [EC:2.3.1.128] [DE:(ACETYLATING ENZYME FOR N-TERMINAL OF RIBOSOMAL PROTEIN 518)] [SP:P09453] |
| Contig138G | 33385936_f2_243 | 1717 | 5843 | 822 | 273 | 881 | 3.20E−88 | gp:[GI:e352209:g2462049] [LN:ACRBDOXN] [AC:Z46863] [PN:hypothetical protein] [GN :ORF2] [OR:Acinetobacter sp. ADPI] [DE:Acinetobacter sp. cysD, cobQ, sodM, lysS, rubA, rubB, estB, oxyR,ppk, mtgA, ORF2 and ORF3 genes.] [NT:putative] |
| Contig138G | 33396880_c3_774 | 1718 | 5844 | 1440 | 479 | 668 | 1.20E−65 | sp:[LN:PGMU_NEIGO] [AC:P40390] [GN:PGM] [OR:*NEISSERIA GONORRHOEAE*] [*EC:5.4.2.2*] [DE:PHOSPHOGLUCOMUTASE (GLUCOSE PHOSPHOMUTASE) (PGM)] [SP:P40390] |
| Contig138G | 33400250_c3_794 | 1719 | 5845 | 1632 | 543 | | | NO-HIT |
| Contig138G | 33480301_c3_812 | 1720 | 5846 | 945 | 314 | 200 | 2.20E−14 | gp:[GI:g3644005] [LN:AF087482] [AC:AF087482] [PN:putative dioxygenase] [OR:*Pseudomonas aeruginosa*] [DE:*Pseudomonas aeruginosa* clcC and ohbH genes, Lys-R type regulatoryprotein (clcR), chlorocatechol-1,2-dioxygenase (clcA),chloromuconate cycloisomerase (clcB), dienelactone hydrolase(clcD), maleylacctate reductase (clcE), transposase (tnpA),ATP-binding protein (tnpB). putative regulatory protein (ohbR),o-halobenzoate dioxygenase reductase (ohbA), o-halobenzoatedioxygenase alpha subunit (ohbB), o-halobenzoate dioxygenase betasubunit (ohbC), o halobenzoate dioxygenase ferredoxin (ohbD),putative membrane spanning protein (ohbE), ATP-binding protein(ohbF), putative substrate binding protein (ohbG), and putativedioxygenase genes, complete cds; and unknown gene.] [NT:similar to *Alcaligenes cutrophus catcchol*] |
| Contig138G | 33757712_c1_524 | 1721 | 5847 | 1497 | 498 | 924 | 8.90E−93 | gp:[GI:e1169874:g2598029] [LN:PSSTYCATA] [AC:AJ000330] [PN:Phenylacetaldehyde dehydrogenase] [GN:styD] [OR:Pseudomonas sp.] [SR:Pseudomonas sp] [DE:Pseudomonas sp. DNA for styrene catabolism genes.] |
| Contig138G | 3395902_c3_872 | 1722 | 5848 | 300 | 99 | | | NO-HIT |
| Contig138G | 33992838_c3_816 | 1723 | 5849 | 810 | 269 | 291 | 1.10E−25 | gp:[GI:g4160474] [LN:AF109909] [AC:AF109909] [PN:3-ketoacyl-CoA reductase PhaB] [GN:phaB] [OR:*Bacillus megaterium*] [DE:*Bacillus megatecrium* polyhydroxyalkanoate gene cluster, completesequence.] |

TABLE 2-continued

| Query | Orf | NT ID | AA ID | NT Lgth | AA Lgth | Score | P-value | Subject |
|---|---|---|---|---|---|---|---|---|
| Contig138G | 34022043_c2_625 | 1724 | 5850 | 930 | 309 | 777 | 3.40E−77 | sp:[LN:ARGB_METJA] [AC:Q60382] [GN:ARGB:MJ0069] [OR:*METHANOCOCCUS JANNASCHII*] [EC:2.7.2.8] [DE:(N-ACETYLGLUTAMATE 5-PHOSPHOTRANSFERASE)] [SP:Q60382] |
| Contig138G | 34024091_c1_555 | 1725 | 5851 | 459 | 152 | | | NO-HIT |
| Contig138G | 34027202_f3_375 | 1726 | 5852 | 255 | 84 | | | NO-HIT |
| Contig138G | 3406693_c3_866 | 1727 | 5853 | 243 | 80 | | | NO-HIT |
| Contig138G | 34156588_c1_527 | 1728 | 5854 | 495 | 164 | 273 | 8.60E−24 | sp:[LN:DEF_THEMA] [AC:P96113] [GN:DEF] [OR:*THERMOTOGA MARITIMA*] [EC:3.5.1.31] [DE:DEFORMYLASE)] [SP:P96113] |
| Contig138G | 34175262_f1_114 | 1729 | 5855 | 543 | 180 | | | NO-HIT |
| Contig138G | 34237702_c2_755 | 1730 | 5856 | 189 | 62 | | | NO-HIT |
| Contig138G | 34414037_c2_665 | 1731 | 5857 | 327 | 108 | 473 | 5.50E−45 | gp:[GI:g2271505] [LN:AF009672] [AC:AF009672] [PN:unknown] [OR:Acinetobacter sp. ADPI] [DE:Acinetobacter sp. ADPI vanillate demethylase region, vanillatedemethylase (vanB) and vanillate demethylase (vanA) genes, completecds.] [NT:putative ferredoxin; ORF9] |
| Contig138G | 34417127_c3_874 | 1732 | 5858 | 270 | 89 | | | NO-HIT |
| Contig138G | 34460925_C3_807 | 1733 | 5859 | 576 | 191 | 361 | 4.10E−33 | sp:[LN:YAEQ_ECOLI] [AC:P52100:P77620] [GN:YAEQ] [OR:*ESCHERICHIA COLI*] [DE:HYPOTHETICAL 20.9 KD PROTEIN IN MESJ-CUTF INTERGENIC REGION] [SP:P52100:P77620] |
| Contig138G | 34610687_c2_673 | 1734 | 5860 | 1242 | 413 | 1105 | 5.90E−112 | sp:[LN:FSR_ECOLI] [AC:P52067] [GN:FSR] [OR:*ESCHERICHIA COLI*] [DE:FOSMIDOMYCIN RESISTANCE PROTEIN] [SP:P52067] |
| Contig138G | 3467791_c2_764 | 1735 | 5861 | 1029 | 342 | 1024 | 2.20E−103 | sp:[LN:YEJE_ECOLI] [AC:P33915] [GN:YEJE] [OR:*ESCHERICHIA COLI*] [DE:HYPOTHETICAL ABC TRANSPORTER PERMEASE PROTEIN YEJE] [SP:P33915] |
| Contig138G | 35213437_c3_869 | 1736 | 5862 | 480 | 159 | | | NO-HIT |
| Contig138G | 35244752_f1_80 | 1737 | 5863 | 201 | 66 | | | NO-HIT |
| Contig138G | 35265675_f2_202 | 1738 | 5864 | 321 | 106 | | | NO-HIT |
| Contig138G | 35437936_f1_39 | 1739 | 5865 | 345 | 114 | | | NO-HIT |
| Contig138G | 35438213_c2_760 | 1740 | 5866 | 720 | 239 | 209 | 5.20E−17 | sp:[LN:YRAP_HAEIN] [AC:P45301] [GN:H11658] [OR:*HAEMOPHILUS INFLUENZAE*] [DE:HYPOTHETICAL PROTEIN H11658 PRECURSOR] [SP:P45301] |
| Contig138G | 35626390_c3_880 | 1741 | 5867 | 1287 | 428 | 528 | 8.20E−51 | pir:[LN:B65075] [AC:B65075:D47020:JQ0845] [PN:visC protein] [GN:visC] [CL:ubiH protein] [OR:*Escherichia coli*] [MP:63 min] |
| Contig138G | 36017827_c3_870 | 1742 | 5868 | 918 | 305 | | | NO-HIT |
| Contig138G | 36115707_c2_720 | 1743 | 5869 | 327 | 108 | | | NO-HIT |
| Contig138G | 36129801_c3_865 | 1744 | 5870 | 534 | 177 | 108 | 0.00041 | gp:[GI:g473595] [LN:DMU08218] [AC:U082J8] [GN:Moe] [OR:*Drosophila melanogaster*] [SR:fruit fly] [DE:*Drosophiia melanogaster* moesin/ezrin/radixin homolog mRNA, partialcds.] [NT:moesin/ezrin/radixin homolog] |
| Contig138G | 36140715_c3_875 | 1745 | 5871 | 381 | 126 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig138G | 36140791_f2_320 | 1746 | 5872 | 741 | 246 | 222 | 2.20E−18 | sp:[LN:MINC_ECOLI] [AC:P18196] [GN:MINC] [OR:*ESCHERICHIA COLI*] [DE:CELL DIVISION INHIBITOR MINC] [SP:P18196] |
| Contig138G | 36207563_c1_542 | 1747 | 5873 | 1668 | 555 | 1000 | 7.90E−101 | sp:[LN:PITB_ECOLI] [AC:P43676] [GN:PITB] [OR:*ESCHERICHIA COLI*] [DE:PROBABLE LOW-AFFINITY INORGANIC PHOSPHATE TRANSPORTER 2] [SP:P43676] |
| Contig138G | 36228193_c1_603 | 1748 | 5874 | 522 | 173 | | | NO-HIT |
| Contig138G | 36334625_c3_888 | 1749 | 5875 | 1614 | 537 | 1147 | 2.10E−116 | sp:[LN:YEJF_ECOLI] [AC:P33916] [GN:YEJF] [OR:*ESCHERICHIA COLI*] [DE:HYPOTHETICAL ABC TRANSPORTER ATP-BINDING PROTEIN YEJF] [SP:P33916] |
| Contig138G | 36570465_c1_604 | 1750 | 5876 | 3456 | 1151 | 153 | 1.00E−07 | gp:[GI:e1388752:g4455821] [LN:BMB18133] [AC:Y18133] [PN:hypothetical protein] [OR:Bacteriophage MB78] [DE:Bacteriophage MB78 ORF1, ORF2, ORF3, and ORF4.] [NT:ORF4] [RE: |
| Contig138G | 37537_c3_867 | 1751 | 5877 | 366 | 121 | | | NO-HIT |
| Contig138G | 39001_c1_543 | 1752 | 5878 | 1386 | 461 | 1559 | 4.60E−160 | sp:[LN:SDHD_ECOLI] [AC:P00926:P78303] [GN:DSDA] [OR:*ESCHERICHIA COLI*] [EC:4.2.1.14] [DE:D-SERINE DEHYDRATASE, (D-SERINE DEAMINASE)] [SP:P00926:P78303] |
| Contig138G | 3906508_c2_674 | 1753 | 5879 | 456 | 151 | | | NO-HIT |
| Contig138G | 3921927_f2_253 | 1754 | 5880 | 627 | 208 | 179 | 7.80E−14 | pir:[LN:D71258] [AC:D71258] [PN:probable glpG protein] [GN:TP0982] [OR:*Treponema pallidum* subsp. *pallidum*] [SR:, syphilis spirochete] |
| Contig138G | 3928813_c2_738 | 1755 | 5881 | 360 | 119 | | | NO-HIT |
| Contig138G | 3939592_c3_767 | 1756 | 5882 | 951 | 316 | 262 | 1.30E−22 | pir:[LN:H70882] [AC:H70882] [PN:hypothetical protein Rv2777c] [GN:Rv2777c] [OR:*Mycobacterium tuberculosis*] |
| Contig138G | 3960967_c2_747 | 1757 | 5883 | 408 | 135 | | | NO-HIT |
| Contig138G | 4006303_c3_864 | 1758 | 5884 | 216 | 71 | | | NO-HIT |
| Contig138G | 4022318_c2_705 | 1759 | 5885 | 579 | 192 | 207 | 8.50E−17 | pir:[LN:E70358] [AC:E70358] [PN:HupE hydrogenase related function] [GN:hupE] [OR:*Aquifex aeolicus*] |
| Contig138G | 4095328_c1_552 | 1760 | 5886 | 600 | 199 | | | NO-HIT |
| Contig138G | 4117813_c3_840 | 1761 | 5887 | 312 | 103 | 415 | 7.70E−39 | sp:[LN:URE3_SYNY3] [AC:P73796] [GN:UREA:SLR1256] [OR:SYNECHOCYSTIS SP] [SR:PCC 6803,] [EC:3.5.1.5] [DE:UREASE GAMMA SUBUNIT, (UREA AMIDOHYDROLASE)] [SP:P73796] |
| Contig138G | 4120888_c1_574 | 1762 | 5888 | 327 | 108 | | | NO-HIT |
| Contig138G | 4145175_f1_119 | 1763 | 5889 | 969 | 322 | 274 | 6.70E−24 | sp:[LN:YJHH_ECOLI] [AC:P39359] [GN:YJHH] [OR:*ESCHERICHIA COLI*] [DE:HYPOTHETICAL 34.9 KD PROTEIN IN FECI-FIMB INTERGENIC REGION (F319)] [SP:P39359] |
| Contig138G | 4345068_f2_310 | 1764 | 5890 | 3606 | 1201 | 488 | 1.60E−77 | gp:[GI:g3128266] [LN:AF010496] [AC:AF010496] [PN:potential exonuclease] [GN:sbcC] [OR:*Rhodobacter capsulatus*] [DE:*Rhodobacter capsulatus* strain SB1003, partial genome.] |

TABLE 2-continued

| Query | Orf | NT ID | AA ID | NT Lgth | AA Lgth | Score | P-value | Subject |
|---|---|---|---|---|---|---|---|---|
| Contig138G | 4345260_f2__157 | 1765 | 5891 | 1509 | 502 | 552 | 2.30E−53 | sp:[LN:DP3E_ECOLI] [AC:P03007] [GN:DNAQ:MUTD] [OR:*ESCHERICHIA COLI*] [EC:2.7.7.7] [DE:DNA POLYMERASE III, EPSILON CHAIN,] [SP:P03007] |
| Contig138G | 4390627_f3__386 | 1766 | 5892 | 333 | 110 | | | NO-HIT |
| Contig138G | 4407688_c2__637 | 1767 | 5893 | 186 | 61 | | | NO-HIT |
| Contig138G | 4489177_t2__221 | 1768 | 5894 | 489 | 162 | 800 | 1.20E−79 | gp:[GI:e1264025:g2959336] [LN:ASA224767] [AC:AJ224767] [PN:hypothetical protein] [GN:ORFC] [OR:Acinetobacter sp. ADPI] [DE:Acinetobacter sp. ADPI Ion gene and ORFs.] [NT:48% identical to YbeA (hypothetical protein)] |
| Contig138G | 4501465_f3__385 | 1769 | 5895 | 273 | 90 | | | NO-HIT |
| Contig138G | 4507193_c3__818 | 1770 | 5896 | 1650 | 549 | 515 | 1.90E−49 | gp:[GI:g2981021] [LN:AF047822] [AC:AF047822] [PN:catabolic acetolactate synthase] [GN:alsS] [FN:involved in acetoin synthesis; condensce two] [OR:*Clostridium acetobutylicum*] [DE:*Clostridium acetobutylicum* catabolic acetolactate synthase (alsS)gene, complete cds.] [NT:AHAS] |
| Contig138G | 4536500_c3__856 | 1771 | 5897 | 858 | 285 | | | NO-HIT |
| Contig138G | 4539040_c2__752 | 1772 | 5898 | 2226 | 741 | 134 | 8.70E−08 | gp:[GI:g33351421] [LN:AF047484] [AC:AF047484] [PN:heme receptor] [GN:hupA] [OR:*Vibrio vulnificus*] [DE:*Vibrio vulnificus* heme receptor (hupA) gene, complete cds.] |
| Contig138G | 4565716_c1__599 | 1773 | 5899 | 348 | 115 | | | NO-HIT |
| Contig138G | 4567500_c3__828 | 1774 | 5900 | 2133 | 710 | 3313 | 0 | gp:[GI:e245927:g2462047] [LN:ACRBDOXN] [AC:Z46863] [PN:polyphosphate kinase] [GN:ppk] [OR:Acinetobacter sp. ADPI] [DE:Acinetobacter sp. cysD, cobQ, sodM, lysS, rubA, rubB, estB, oxyR,ppk, mtgA, ORF2 and ORF3 genes.] [NT:putative; transcription of ppk is induced by] |
| Contig138G | 4569017_f2__263 | 1775 | 5901 | 1155 | 384 | 1949 | 2.10E−201 | sp:[LN:GALM_ACICA] [AC:P05149] [GN:MRO] [OR:*ACINETOBACTER CALCOACETICUS*] [EC:5.1.33] [DE:ALDOSE 1-EPIMERASE PRECURSOR, (MUTAROTASE)] [SP:P05149] |
| Contig138G | 4585885_c1__546 | 1776 | 5902 | 669 | 222 | 459 | 1.70E−43 | sp:[LN:YHGI_ECOLI] [AC:P46847] [GN:YHGI] [OR:*ESCHERICHIA COLI*] [DE:HYPOTHETICAL 21.0 KD PROTEIN IN BIOH-GNTT INTERGENIC REGION (O191)] [SP:P46847] |
| Contig138G | 4713942_f1__32 | 1777 | 5903 | 183 | 60 | | | NO-HIT |
| Contig138G | 4718758_c1__602 | 1778 | 5904 | 717 | 238 | | | NO-HIT |
| Contig138G | 4722682_f1__134 | 1779 | 5905 | 128 | 375 | 1100 | 2.00E−11 | sp:[LN:HEM2_PSEAE] [AC:Q59643] [GN:HEMB] [OR:*PSEUDOMONAS AERUGINOSA*] [EC:42.1.24] [DE:SYNTHASE) (ALAD) (ALADH)] [SP:Q59643] |
| Contig138G | 4801693_f3__344 | 1780 | 5906 | 297 | 98 | 97 | 3.80E−05 | sp:[LN:YGFE_ECOLI] [AC:P45580] [GN:YGFE] [OR:*ESCHERICHIA COLI*] [DE:HYPOTHETICAL 12.6 KD PROTEIN IN PEPP-SSR INTERGENIC REGION (O109)] [SP:P45580] |

TABLE 2-continued

| Query | Orf | NT ID | AA ID | NT Lgth | AA Lgth | Score | P-value | Subject |
|---|---|---|---|---|---|---|---|---|
| Contig138G | 4806537_c2_662 | 1781 | 5907 | 1263 | 420 | 1170 | 7.60E−119 | gp:[GI:g1185391] [LN:YPU22837] [AC:U22837] [PN:HmsR] [GN:hmsR] [FN:involved the regulation of the hms locus hemin] [OR:*Yersinia pestis*] [DE:*Yersinia pestis* HmsH (hmsH), HmsF (hmsF), HmsR (hmsR), and HmsS(hmsS) genes, complete cds.] [NT:possible integral inner membrane protein; 52 kDa,] |
| Contig138G | 4876568_c1_608 | 1782 | 5908 | 387 | 128 | 120 | 6.50E−07 | gp:[GI:d1020364:g1944409] [LN:D87026] [AC:D87026:D28136] [PN:membrane protein] [OR:*Bacillus stearothermophilus*] [SR:*Bacillus stearothermophilus* (strain:TRBE14) DNA] [DE:*Bacillus stearothermophilus* glycogen operon genes, complete cds.] [NT:The OkF is similar to the *Alkaligenes eutrophus*] |
| Contig138G | 4880265_f2_313 | 1783 | 5909 | 408 | 135 | 182 | 3.80E−14 | gp:[GI:g2961I86] [LN:AF050677] [AC:AF050677] [PN:lipoprotein] [GN oprX] [OR:*Pseudomonas fluorescens*] [DE:*Pseudomonas fluorescens* ferric uptake regulator (fur) gene, partialcds; and lipoprotein (oprX) gene, complete cds.] [NT:OprX] |
| Contig138G | 4882791_c3_790 | 1784 | 5910 | 1077 | 358 | 990 | 9.00E−100 | gp:[GI:g3378278] [LN:AF079317] [AC:AF079317] [PN:putative aromatic efflux pump membrane protein] [GN:orf132] [OR:*Sphingomonas aromaticivorans*] [DE:*Sphingomonas aromaticivorans* plasmid pNL1, complete plasmidsequence.] [NT:putative transmembrane fusion component efflux pump] |
| Contig138G | 4884625_f1_115 | 1785 | 5911 | 882 | 293 | 266 | 2.00E−45 | pir:[LN:S77571] [AC:S77571] [PN:conserved hypothetical protein msh:methionine synthase homolog] [GN:msh] [OR:*Agrobacterium tumefaciens*] |
| Contig138G | 4884628_c2_702 | 1786 | 5912 | 1704 | 567 | 2275 | 6.10E−236 | sp:[LN:UREI_KLEAE] [AC:P18314] [GN:UREC] [OR:*KLEBSIELLA AEROGENES*] [EC:3.5.1.5] [DE:UREASE ALPHA SUBUNIT. (UREA AMIDOHYDROLASE)] [SP:P18314] |
| Contig138G | 4884640_c2_628 | 1787 | 5913 | 459 | 152 | 179 | 7.80E−14 | pir:[LN:C64393] [AC:C64393] [PN:hypothetical protein MJ0747] [OR:*Methanococcus jannaschii*] [MP:REV673469-672960] |
| Contig138G | 4884677_f1_67 | 1788 | 5914 | 492 | 163 | 560 | 3.30E−54 | gp:[GI:e352633:g2462045] [LN:ACRBDOXN] [AC:Z46863] [PN:hypothetical protein] [GN:ORFX] [OR:*Acinetobacter sp.* ADPI] [DE:*Acinetobacter sp.* cysD, cobQ,.sodM, tysS, rubA, rubB, estB, oxyR,ppk, mtgA, ORF2 and ORF3 genes.] [NT:putative] |
| Contig138G | 4893840_c2_701 | 1789 | 5915 | 360 | 119 | 374 | 1.70E−34 | gp:[GI:e331509:g2340846] [LN:AEY13732] [AC:Y13732] [PN:urease, structural subunit] [GN:ureB] [OR:*Ralstonia eutropha*] [DE:*Alcaligenes eutrophus* genes for ureases, urcD1, urcD2, ureA, ureB,and ORF1, ORE2.] |

TABLE 2-continued

| Query | Orf | NT ID | AA ID | NT Lgth | AA Lgth | Score | P-value | Subject |
|---|---|---|---|---|---|---|---|---|
| Contig138G | 506375_c1_547 | 1790 | 5916 | 648 | 215 | 320 | 9.00E−29 | pir:[LN:S74353] [AC:S74353] [PN:carbonic anhydrase icfA:hypothetical protein slr0051:hypothetical protein slr0051] [GN:icfA] [OR:Synechocystis sp.] [SR:PCC 6803, , PCC 6803] [SR:PCC 6803,] |
| Contig138G | 5164063_c2_644 | 1791 | 5917 | 900 | 299 | 242 | 1.70E−20 | sp:[LN:NAC_KLEAE] [AC:Q08597] [GN:NAC] [OR:*KLEBSIELLA AEROGENES*] [DE:CONTROL PROTEIN)] [SP:Q08597) |
| Contig138G | 5292052_c1_550 | 1792 | 5918 | 699 | 232 | 896 | 8.20E−90 | sp:[LN:MTGA_ACICA] [AC:O24849] [GN:MTGA] [OR:*ACINETOBACTER CALCOACETICUS*] [EC:2.4.2.—] [DE:(EC 2.4.2—) (MONOFUNCTIONAL TGASE)] [SP:O24849] |
| Contig138G | 5292262_f1_147 | 1793 | 5919 | 303 | 100 | | | NO-HIT |
| Contig138G | 5348462_c2_646 | 1794 | 5920 | 726 | 241 | 307 | 2.10E−27 | pir:[LN:S76413] [AC:S76413] [PN:hypothetical protein] [OR:Synechocystis sp.] [SR:PCC 6803, , PCC 6803] [SR:PCC 6803,] |
| Contig138G | 5350683_f1_404 | 1795 | 5921 | 1044 | 347 | 431 | 1.60E−40 | sp:[LN:LIPI_PSYIM] [AC:Q02104] [GN:LIP1] [OR:*PSYCHROBACTER IMMOBILIS*] [EC:3.1.1.3] [DE LIPASE I PRECURSOR, (TRIACYLGLYCEROL LIPASE)] [SP:Q02104] |
| Contig138G | 5351467_f3_390 | 1796 | 5922 | 1356 | 451 | 1244 | 1.10E−126 | sp:[LN:YXIQ_BACSU] [AC:P42308] [GN:YXIQ:N15CR] [OR:*BACILLUS SUBTILIS*] [DE:HYPOTHETICAL 45.5 KD PROTEIN IN BGLS-KATB INTERGENIC REGION] [SP:P42308] |
| Contig138G | 5365628_f1_84 | 1797 | 5923 | 933 | 310 | 445 | 5.10E−42 | sp:[LN:PERR_ECOLI] [AC:Q57083] [GN:PERR] [OR:*ESCHERICHIA COLI*] [DE:PEROXIDE REStSTANCE PROTEIN PERR] [SP:Q57083] |
| Contig138G | 558278_c3_804 | 1798 | 5924 | 1680 | 559 | 1163 | 4.20E−118 | sp:[LN:BETT_ECOLI] [AC:P17447] [GN:BETT] [OR:*ESCHERICHIA COLI*] [DE:HIGH-AFFINITY CHOLINE TRANSPORT PROTEIN) [SP:P17447] |
| Contig138G | 574067_c3_861 | 1799 | 5925 | 372 | 123 | | | NO-HIT |
| Contig138G | 5898437_f2_295 | 1800 | 5926 | 351 | 116 | | | NO-HIT |
| Contig138G | 5917762_c3_844 | 1801 | 5927 | 564 | 187 | | | NO-HIT |
| Contig138G | 601465_c2_630 | 1802 | 5928 | 288 | 95 | | | NO-HIT |
| Contig138G | 6015652_c3_835 | 1803 | 5929 | 270 | 89 | | | NO-HIT |
| Contig138G | 6038155_c2_666 | 1804 | 5930 | 327 | 108 | | | NO-HIT |
| Contig138G | 6097141_f2_309 | 1805 | 5931 | 1293 | 430 | 471 | 9.00E−45 | sp:[LN:SBCD_RHOCA] [AC:O68033] [GN:SBCD] [OR:*RHODOBACTER CAPSULATUS*] [SR:*RHODOPSEUDOMONAS CAPSULATA*] [DE:EXONUCLEASE SBCD HOMOLOG] [SP:O68033] |
| Contig138G | 6366043_c2_745 | 1806 | 5932 | 189 | 62 | | | NO-HIT |
| Contig138G | 665900_c2_734 | 1807 | 5933 | 384 | 127 | | | NO-HIT |
| Contig138G | 6692825_c3_863 | 1808 | 5934 | 279 | 92 | | | NO-HIT |
| Contig138G | 6728432_c3_884 | 1809 | 5935 | 525 | 174 | 183 | 3.00E−14 | sp:[LN:YRAN_ECOLI] [AC:P45465] [GN:YRAN] [OR:*ESCHERICHIA COLI*] [DE:HYPOTHETICAL 14.8 KD PROTEIN IN AGAI-MTR INTERGENIC REGION (O131)] [SP:P45465] |
| Contig138G | 6746067_c2_723 | 1810 | 5936 | 192 | 63 | | | NO-HIT |
| Contig138G | 6812942_f1_19 | 1811 | 5937 | 189 | 62 | | | NO-HIT |
| Contig138G | 7047291_c1_521 | 1812 | 5938 | 183 | 60 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig138G | 7241312_c3_871 | 1813 | 5939 | 531 | 176 | | | NO-HIT |
| Contig138G | 7244063_c2_746 | 1814 | 5940 | 660 | 219 | | | NO-HIT |
| Contig138G | 797067_f1_76 | 1815 | 5941 | 246 | 81 | | | NO-HIT |
| Contig138G | 814027_c2_687 | 1816 | 5942 | 2286 | 761 | 1760 | 6.00E−183 | gp:[GI:g2738252] [LN:SEU97227] [AC:U97227] [PN:TonB dependent outer membrane siderophore] [GN:iroN] [FN:receptor for 4-(3,4-dihydroxybenzyliden-amino)] [OR:*Salmonella enterica*] [DE:Salmonella enterica ferric entcrochelin esterase homolog (iroD),IroE (iroE) and TonB dependent outer membrane siderophore receptorprotein (iroN) genes, complete cds.] [NT:IroN] |
| Contig138G | 817083_c3_775 | 1817 | 5943 | 198 | 65 | | | NO-HIT |
| Contig138G | 832300_f2_220 | 1818 | 5944 | 234 | 77 | | | NO-HIT |
| Contig138G | 859550_f3_445 | 1819 | 5945 | 246 | 81 | | | NO-HIT |
| Contig138G | 892308_c1_485 | 1820 | 5946 | 213 | 70 | | | NO-HIT |
| Contig138G | 899128_c2_724 | 1821 | 5947 | 432 | 143 | 93 | 0.0001 | gp:[GI:g3893841] [LN:AF029362] [AC:AF029362] [OR:*Neisseria gonorrhoeae*] [DE:*Neisseria gonorrhoeae* strain FA1090 carbarnoyl-phosphate synthasesubunit A (carA) and subunit B (carB) genes, partial cds.] [NT:similar to E. coli ORF, encoded by GenBank] |
| Contig138G | 954426_c3_786 | 1822 | 5948 | 948 | 315 | 509 | 8.40E−49 | pir:[LN:F65002] [AC:F65002] [PN:hypothetical protein b2304] [CL:cell division inhibitor yfhF] [OR:*Escherichia coli*] |
| Contig138G | 957253_f1_103 | 1823 | 5949 | 198 | 65 | | | NO-HIT |
| Contig138G | 960007_f1_13 | 1824 | 5950 | 1431 | 476 | 121 | 3.10E−11 | sp:[LN:INTF_ECOLI] [AC:P71298] [GN:INTF] [OR:*ESCHERICHIA COLI*] [DE:PUTATIVE INTEGRASE INTF] [SP:P71298] |
| Contig138G | 970157_c2_635 | 1825 | 5951 | 474 | 157 | | | NO-HIT |
| Contig138G | 9786415_c2_751 | 1826 | 5952 | 588 | 195 | | | NO-HIT |
| Contig138G | 9813430_f2_154 | 1827 | 5953 | 255 | 84 | | | NO-HIT |
| Contig138G | 985386_f2_285 | 1828 | 5954 | 669 | 222 | 387 | 7.10E−36 | sp:[LN:BETI_ECOLI] [AC:P17446] [GN:BETI] [OR:*ESCHERICHIA COLI*] [DE:REGULATORY PROTEIN BETI] [SP:P17446] |
| Contig138G | 9876063_f3_356 | 1829 | 5955 | 207 | 68 | | | NO-HIT |
| Contig138G | 9882180_f2_158 | 1830 | 5956 | 771 | 256 | 462 | 8.10E−44 | sp:[LN:YIAD_ECOLI] [AC:P32664] [GN:YIAD] [OR:*ESCHERICHIA COLI*] [DE:HYPOTHETICAL 29.8 KD PROTEIN IN THIC-HEME INTERGENIC REGION] [SP:P32664] |
| Contig138G | 9900291_c1_593 | 1831 | 5957 | 110 | 369 | | | NO-HIT |
| Contig138G | 992342_c3_815 | 1832 | 5958 | 840 | 279 | 232 | 1.90E−19 | pir:[LN:A69463] [AC:A69463] [PN:2-hydroxy-6-oxo-6-phenylhexa-2,4-dienoic acid hydrolase (pcbD) homolog] [OR:*Archaeoglobus fulgidus*] |
| Contig138G | 9940708_f1_12 | 1833 | 5959 | 663 | 220 | 151 | 2.90E−08 | gp:[GI:g2246532] [LN:U93872] [AC:U93872] [OR:Kaposi's sarcoma-associated herpesvirus] [SR:Kaposi's sarcoma-associated herpesvirus - Human herpesvirus 8] [DE:Kaposi's sarcoma-associated herpesvirus glycoprotein M, DNAreplication protein, glycoprotein, DNA replication protein, FLlCEinhibitory protein and v-cyclin genes, complete cds, and tegumentprotein gene, partial cds.] [NT:ORF 73, contains large complex repeat CR 73] |

TABLE 2-continued

| Query | Orf | NT ID | AA ID | NT Lgth | AA Lgth | Score | P-value | Subject |
|---|---|---|---|---|---|---|---|---|
| Contig138G | 9964688_c3_860 | 1834 | 5960 | 414 | 137 | | | NO-HIT |
| Contig138G | 9969003_c3_811 | 1835 | 5961 | 1092 | 363 | 1502 | 5.00E−154 | gp:[GI:g2271506] [LN:AF009672] [AC:AF009672] [PN:unknown] [OR:Acinetobacter sp. ADPI] [DE:Acinetobacter sp. ADPI vanillate demethylase region, vanillatedemethylase (vanB) and vanillate demethylase (vanA) genes, completecds.] [NT:similar to vanillate demethylase (vanA subunit);] [RE: |
| Contig139G | 14226652_c3_51 | 1836 | 5962 | 225 | 74 | | | NO-HIT |
| Contig139G | 14478192_f2_5 | 1837 | 5963 | 807 | 268 | 546 | 1.00E−52 | sp:[LN:DNAA_SERMA] [AC:P29440] [GN:DNAA] [OR:*SERRATIA MARCESCENS*] [DE:CHROMOSOMAL REPLICATION INITIATOR PROTEIN DNAA] [SP:P29440] |
| Contig139G | 19531393_f2_12 | 1838 | 5964 | 384 | 127 | 361 | 4.10E−33 | sp:[LN:YADR_HAEIN] [AC:P45344] [GN:H11723] [OR:*HAEMOPHILUS INFLUENZAE*] [DE:HYPOTHETICAL PROTEIN H11723] [SP:P45344] |
| Contig139G | 21673176_c2_34 | 1839 | 5965 | 240 | 79 | 114 | 1.20E−06 | pir:[LN:A54517] [AC:A54517] [PN:variable antigen (clone Ag7)] [OR:*Plasmodium falciparum*] |
| Contig139G | 23557662_f2_10 | 1840 | 5966 | 1026 | 341 | | | NO-HIT |
| Contig139G | 244076_f3_18 | 1841 | 5967 | 1236 | 411 | 1153 | 4.80E−117 | sp:[LN:SYY_HAEIN] [AC:P43836] [GN:TYRS:H11610] [OR:*HAEMOPHILUS INFLUENZAE*] [EC:6.1.1.1] [DE:TYROSYL-TRNA SYNTHETASE, (TYROSINE--TRNA LIGASE) (TYRRS)] [SP:P43836] |
| Contig139G | 25823266_f1_16 | 1842 | 5968 | 606 | 201 | 541 | 3.40E−52 | sp:[LN:DNAA_PSEPU] [AC:P13454] [GN:DNAA] [OR:*PSEUDOMONAS PUTIDA*] [DE:CHROMOSOMAL REPLICATION INITIATOR PROTEIN DNAA] [SP:P13454] |
| Contig139G | 259777_f1_1 | 1843 | 5969 | 1152 | 383 | 883 | 2.00E−88 | sp:[LN:DP3B_PSEPU] [AC:P13455] [GN:DNAN] [OR:*PSEUDOMONAS PUTIDA*] [EC:27.7.7] [DE:DNA POLYMERASE III, BETA CHAIN,] [SP:P13455] |
| Contig139G | 30098556_f1_17 | 1844 | 5970 | 1131 | 376 | 553 | 1.80E−53 | sp:[LN:RECF_ACTPL] [AC:P24718] [GN:RECF] [OR:*ACTINOBACILLUS PLEUROPNEUMONIAE*] [SR:,*HAEMOPHILUS PLEUROPNEUMONIAE*] [DE:RECF PROTEIN] [SP:P24718] |
| Contig139G | 33593761_c3_50 | 1845 | 5971 | 1161 | 386 | 766 | 4.90E−76 | sp:[LN:Y753_HAEIN] [AC:P44861] [GN:H10753] [OR:*HAEMOPHILUS INFLUENZAE*] [DE:HYPOTHETICAL PROTEIN H10753] [SP:P44861] |
| Contig139G | 3365885_c3_47 | 1846 | 5972 | 237 | 78 | 150 | 1.70E−09 | sp:[LN:SSP2_PLAYO] [AC:Q01443] [GN:SSP2] [OR:*PLASMODIUM BERGHEI YOELII*] [DE:SPOROZOITE SURFACE PROTEIN 2 PRECURSOR] [SP:Q01443] |
| Contig139G | 3907827_c2_38 | 1847 | 5973 | 558 | 185 | 448 | 2.50E−42 | sp:[LN:DEDA_ECOLI] [AC:P09548] [GN:DEDA] [OR:*ESCHERICHIA COLI*] [DE:DEDA PROTEIN (DSG-1 PROTEIN)] [SP:P09548] |

TABLE 2-continued

| Query | Orf | NT ID | AA ID | NT Lgth | AA Lgth | Score | P-value | Subject |
|---|---|---|---|---|---|---|---|---|
| Contig139G | 4414193_f1_2 | 1848 | 5974 | 2478 | 825 | 2750 | 2.80E−286 | sp:[LN:GYRB_ECOLI] [AC:P06982:O08438] [GN:GYRB:PAPA:NALC:ACRB: PCBA:HIMB:HISU] [OR:*ESCHERICHIA COLI*] [EC:5.99.1.3] [DE:DNA GYRASE SUBUNIT B.] [SP:P06982:O08438] |
| Contig139G | 5081262_f1_3 | 1849 | 5975 | 1053 | 350 | | | NO-HIT |
| Contit139G | 5120288_c1_28 | 1850 | 5976 | 1938 | 645 | 1704 | 2.00E−175 | sp:[LN:YHES_ECOLI] [AC:P45535] [GN:YHES] [OR:*ESCHERICHIA COLI*] [DE:HYPOTHETICAL ABC TRANSPORTER ATP-BINDING PROTEIN YHES] [SP:P45535] |
| Contig139G | 5276693_f2_6 | 1851 | 5977 | 402 | 133 | 195 | 1.60E−15 | sp:[LN:C562_ECOLI] [AC:P00192:P76805] [GN:CYBC] [OR:*ESCHERICHIA COLI*] [DE:SOLUBLE CYTOCHROME B562 PRECURSOR] [SP:P00192:P76805] |
| Contig139G | 5944050_f2_11 | 1853 | 5978 | 1071 | 356 | | | NO-HIT |
| Contig139G | 6042803_c1_23 | 1853 | 5979 | 855 | 284 | 360 | 5.20E−33 | pir:[LN:F69801] [AC:F69801] [PN:epoxide hydrolase homolog yfhM] [GN:yfhM] [OR:*Bacillus subtilis*] |
| Contig139G | 7128917_f3_19 | 1854 | 5980 | 183 | 60 | | | NO-HIT |
| Contig140G | 11892931_c3_103 | 1855 | 5981 | 702 | 233 | 896 | 8.20E−90 | sp:[LN:RPE_ECOLI] [AC:P32661] [GN:RPE:DOD] [OR:*ESCHERICHIA COLI*] [EC:5.1.3.1] [DE:EPIMERASE) (PPE) (RSP3E)] [SP:P32661] |
| Contig140G | 12603382_f1_14 | 1856 | 5982 | 1392 | 463 | 637 | 2.30E−62 | sp:[LN:PABB_ECOLI] [AC:P05041] [GN:PABB] [OR:*ESCHERICHIA COLI*] [EC:4.1.3.—] [DE:PARA-AMINOBENZOATE SYNTHASE COMPONENT I, (ADC SYNTHASE)] [SP:P05041] |
| Contig140G | 1361583_c1_62 | 1857 | 5983 | 696 | 231 | 468 | 1.90E−44 | sp:[LN:HISI_BACSU] [AC:O34520] [GN:HISG] [OR:*BACILLUS SUBTILIS*] [EC:2.4.2.17] [DE:ATP PHOSPHORIBOSYLTRANSFER ASE,] [SP:O34520] |
| Contig140G | 1443927_c1_72 | 1858 | 5984 | 681 | 226 | 343 | 3.30E−31 | sp:[LN:YEAZ_ECOLI] [AC:P76256:O08476:O08477] [GN:YEAZ] [OR:*ESCHERICHIA COLI*] [DE:HYPOTHETICAL 25.2 KD PROTEIN IN FADD-PABB INTERGENIC REGION] [SP:P76256:O08476:O08477] |
| Contig140G | 19800062_f1_9 | 1859 | 5985 | 591 | 196 | 425 | 6.70E−40 | gp:[GI:g1871177] [LN:ATU90439] [AC:U90439] [GN:T06D20.4] [OR:*Arabidopsis thaliana*] [SR:thale cress] [DE:*Arabidopsis thaliana* chromosome II BAC T06D20 genomic sequence,complete sequence.] [NT:unknown protein] |
| Contig140G | 20744002_c2_85 | 1860 | 5986 | 534 | 177 | 481 | 7.80E−46 | sp:[LN:FBP_PSEAE] [AC:P40882] [GN:FBP] [OR:*PSEUDOMONAS AERUGINOSA*] [DE:FERRIPYOCHELIN BINDING PROTEIN] [SP:P40882] |
| Contig140G | 22689193_c3_97 | 1861 | 5987 | 1677 | 558 | 80 | 9.30E−05 | pir:[LN:H70355] [AC:H70355] [PN:hypothetical protein aq_627] [GN:aq_627] [OR:*Aquifex acolicus*] |
| Contig140G | 23703138_c2_88 | 1862 | 5988 | 849 | 282 | 581 | 2.00E−56 | pir:[LN:F64819] [AC:F64819] [PN:hypothetical protein b0822] [OR:*Escherichia coli*] |

TABLE 2-continued

| Query | Orf | NT ID | AA ID | NT Lgth | AA Lgth | Score | P-value | Subject |
|---|---|---|---|---|---|---|---|---|
| Contig140G | 23853200_c2_90 | 1863 | 5989 | 837 | 278 | 223 | 1.80E−18 | pir:[LN:B36868] [AC:B36868] [PN:copB homolog:hypotheticalprotein 2] [OR:*Xanthomonas campestris*] |
| Contig140G | 24407827_c3_99 | 1864 | 5990 | 1926 | 641 | | | NO-HIT |
| Contig140G | 24431540_c3_102 | 1865 | 5991 | 843 | 280 | 294 | 5.10E−26 | sp:[LN:YHIQ_NEIGO] [AC:P72077] [OR:*NEISSERIA GONORRHOEAE*] [DE:HYPOTHETICAL 27.3 KD PROTEIN] [SP:P72077] |
| Contig140G | 24662562_c2_91 | 1866 | 5992 | 336 | 111 | 301 | 9.30E−27 | sp:[LN:SUGE_CITFR] [AC:O69279] [GN:SUGE] [OR:*CITROBACTER FREUNDII*] [DE:SUGE PROTEIN HOMOLOG] [SP:O69279] |
| Contig140G | 258442_c1_76 | 1867 | 5993 | 1056 | 352 | 1240 | 2.90E−126 | sp:[LN:NADA_ECOLI] [AC:P11458:P77373] [GN:NADA:NICA] [OR:*ESCHERICHIA COLI*] [DE:QUINOLINATE SYNTHETASE A] [SP:P11458:P77373] |
| Contig140G | 26259753_c2_79 | 1868 | 5994 | 273 | 90 | 373 | 2.20E−34 | sp:[LN:YRPM_ACICA] [AC:P33989] [OR:*ACINETOBACTER CALCOACETICUS*] [DE:HYPOTHETICAL 9.2 KD PROTEIN IN RPON-MURA INTERGENIC REGION (ORF3)] [SP:P33989] |
| Contig140G | 26350790_c1_63 | 1869 | 5995 | 1353 | 450 | 1024 | 2.20E−103 | pir:[LN:E70368] [AC:E70368] [PN:histidinol dehydrogenase] [GN:hisD] [CL:histidinol dehydrogenase:histidinol dehydrogenase homology] [OR:*Aquifex aeolicus*] |
| Contig140G | 26579061_c2_93 | 1870 | 5996 | 1242 | 413 | 1013 | 3.30E−102 | sp:[LN:ARGJ_NEIGO] [AC:P38434] [GN:ARGJ] [OR:*NEISSERIA GONORRHOEAE*] [EC:2.3.1.35:2.3.1.1] [DE:ACETYLTRANSFERASE, (N-ACETYLGLUTAMATE SYNTHASE)(AGS)] [SP:P38434] |
| Contig140G | 26600052_c2_80 | 1871 | 5997 | 1263 | 420 | 1928 | 3.60E−199 | sp:[LN:MURA_ACICA] [AC:P33986] [GN:MURA:MURZ] [OR:*ACINETOBACTER CALCOACETICUS*] [EC:2.5.1.7] [DE:TRANSFERASE)(EPT)] [SP:P33986] |
| Contig140G | 2853452_c3_104 | 1872 | 5998 | 399 | 132 | | | NO-HIT |
| Contig140G | 29485012_c3_106 | 1873 | 5999 | 1032 | 343 | 174 | 8.50E−13 | gp:[GI:e258655:g1628369] [LN:DNINTREG] [AC:X98546] [GN:gepB] [OR:*Dichelobacter nodosus*] [DE:*D.nodosus* intB, regA, gepA, gepB, and gepC genes.] |
| Contig140G | 30704408_c1_75 | 1874 | 6000 | 573 | 190 | 356 | 1.40E−32 | gp:[GI:e1370607:g4158208] [LN:SC9B5] [AC:AL035206] [PN:putative methylated-DNA-protein-cysteine] [GN:SC9B5.29] [OR:*Streptomyces coelicolor*] [DE:*Streptomyces coelicolor* cosmid 9B5.] [NT:SC9B5.29, ogt2, methylated-DNA-protein-cysteine] |
| Contig140G | 31822052_c3_98 | 1875 | 6001 | 192 | 63 | 112 | 9.90E−07 | pir:[LN:S66936] [AC:S66936:S662927] [PN:probable membrane protein YOR053w:hypothetical protein O2799] [OR:*Saccharomyces cerevisiae*] [MP:15R] |

TABLE 2-continued

| Query | Orf | NT ID | AA ID | NT Lgth | AA Lgth | Score | P-value | Subject |
|---|---|---|---|---|---|---|---|---|
| Contig140G | 33618802_c2_87 | 1876 | 6002 | 882 | 293 | 725 | 1.10E−71 | sp:[LN:ESTD_HUMAN] [AC:P1O768] [GN:ESD] [OR:*HOMO SAPIENS*] [EC:3.1.1.1] [DE:ESTERASE D,] [SP:P 0768] |
| Contig140G | 35267331_c1_74 | 1877 | 6003 | 2016 | 671 | 1238 | 4.70E−126 | pir:[LN:A36868] [AC:A36868] [PN:copA homolog:hypothetical protein 1] [CL:laccase] [OR:*Xanthomonas campestris*] |
| Contig140G | 35781253_f1_10 | 1878 | 6004 | 261 | 86 | 119 | 1.80E−07 | pir:[LN:S56703] [AC:S56703] [PN:glycine-rich cell wall protein precursor:CEM6 protein] [OR:*Daucus carota*] [SR:, carrot] |
| Contig140G | 35948293_c3_95 | 1879 | 6005 | 867 | 288 | 128 | 6.80E−08 | pir:[LN:H69061] [AC:H69061] [PN:ABC transporter related protein] [GN:MTH1463] [OR:*Methanobacterium thermoautotrophicum*] |
| Contig140G | 36331452_c1_65 | 1880 | 6006 | 909 | 302 | 145 | 9.00E−07 | pir:[LN:A56143] [AC:A56143] [PN:surface-array protein homolog sapA2] [GN:sapA2] [OR:*Campylobacter fetus*] |
| Contig140G | 3906412 c1_73 | 1881 | 6007 | 1461 | 486 | | | NO-HIT |
| Contig140G | 4026513_c1_64 | 1882 | 6008 | 1095 | 364 | 1000 | 7.90E−101 | sp:[LN:H158_ACEXY] [AC:P45358] [GN:HISC:HISI] [OR:*ACETOBACTER XYLINUM*] [SR:*ACETOBACTER PASTEURIANUS*] [EC:2.6.1.9] [DE:PHOSPHATE TRANSAMINASE)] [SP:P45358] |
| Contig140G | 4189078_c1_71 | 1883 | 6009 | 627 | 208 | 281 | 1.20E−24 | sp:[LN:YEAB_ECOLI] [AC:P43337] [GN:YEAB] [OR:*ESCHERICHIA COLI*] [DE:HYPOTHETICAL 21.4 KD PROTEIN IN PABB-SDAA INTERGENIC REGION] [SP:P43337] |
| Contig140G | 4728188_f3_46 | 1884 | 6010 | 282 | 93 | | | NO-HIT |
| Contig140G | 5884375_c2_77 | 1885 | 6011 | 1479 | 492 | 1926 | 5.90E−199 | sp:[LN:RP54_ACICA] [AC:P33983] [GN:RPON:NTRA] [OR:*ACINETOBACTER CALCOACETICUS*] [DE:RNA POLYMERASE SIGMA-54 FACTOR] [SP:P33983] |
| Contig140G | 7070412_c2_84 | 1886 | 6012 | 1356 | 451 | 202 | 1.50E−15 | gp:[GI:g2293509] [LN:AF010463] [AC:AF010463] [PN:merozoite surface protein 2] [GN:MSP2] [OR:*Plasmodium falciparum*] [SR:malaria parasite] [DE:*Plasmodium falciparum* merozoite surface protein 2 (MSP2) gene,partial cds.] [RE: |
| Contig140G | 7226531_c2_78 | 1887 | 6013 | 363 | 120 | 439 | 2.20E−41 | sp:[LN:RP5M_ACICA] [AC:P33987] [OR:*ACINETOBACTER CALCOACETICUS*] [DE:PROBABLE SIGMA(54) MODULATION PROTEIN (ORF2)] [SP:P33987] |
| Contig140G | 7267177_c3_96 | 1888 | 6014 | 1227 | 408 | | | NO-HIT |
| Contig143G | 10394625_c2_717 | 1889 | 6015 | 198 | 65 | | | NO-HIT |
| Contig143G | 1041660_c2_669 | 1890 | 6016 | 1722 | 573 | 2102 | 1.30E−217 | sp:[LN:YJJK_HAEIN] [AC:P45127] [GN:H11252] [OR:*HAEMOPHILUS INFLUENZAE*] [DE:ABC TRANSPORTER ATP-BINDING PROTEIN H11252] [SP:P45127] |
| Contig143G | 1053427_c1_590 | 1891 | 6017 | 1941 | 646 | 768 | 9.70E−90 | sp:[LN:DEAD_KLEPN] [AC:P33906] [GN:DEAD] [OR:*KLEBSIELLA PNEUMONIAE*] [DE:ATP-DEPENDENT RNA HELICASE DEAD] [SP:P33906] |

TABLE 2-continued

| Query | Orf | NT ID | AA ID | NT Lgth | AA Lgth | Score | P-value | Subject |
|---|---|---|---|---|---|---|---|---|
| Contig143G | 10553775_f1_156 | 1892 | 6018 | 2199 | 732 | 793 | 6.80E−79 | gp:[GI:g2981048] [LN:AF051691] [AC:AF051691] [PN:hydroxamate type ferrisiderophore receptor] [GN:fiuA] [OR:*Pseudomonas aeruginosa*] [DE:*Pseudomonas aeruginosa* stress factor A (psfA), ECF sigma factor(fiuI), transmembrane sensor (fiuR), and hydroxamate-typeferrisiderophore receptor (fiuA) genes, complete cds.] [NT:FiuA] |
| Contig143G | 10554510_f1_63 | 1893 | 6019 | 231 | 76 | 152 | 5.70E−11 | gp:[GI:g4378826] [LN:AF121138] [AC:AF121138] [PN:bacterioferritin-associated ferredoxin] [GN:bfd] [OR:*Azotobacter vinelandii*] [DE:*Azotobacter vinelandii* putative RNase T (rnt) gene, partial cds;bacterioferritin-associated ferredoxin (bfd) gene, complete cds;and bacterioferritin (bfr) gene, partial cds.] [NT:Bfd] |
| Contig143G | 10663290_c3_805 | 1894 | 6020 | 1452 | 483 | 800 | 1.20E−79 | sp:[LN:MURF_HAEIN] [AC:P45061] [GN:MURF:H11134] [OR:*HAEMOPHILUS INFLUENZAE*] [EC:6.3.2.15] [DE:(D-ALANYL-D-ALANINE-ADDING ENZYME)] [SP:P45061] |
| Contig143G | 1071011_c3_757 | 1895 | 6021 | 1980 | 659 | 1389 | 4.70E−142 | sp:[LN:BETT_ECOLI] [AC:P17447] [GN:BETT] [OR:*ESCHERICHIA COLI*] [DE:HIGH-AFFINITY CHOLINE TRANSPORT PROTEIN] [SP:P17447] |
| Contig143G | 10719827_c1_554 | 1896 | 6022 | 1002 | 333 | | | NO-HIT |
| Contig143G | 10722077_c3_827 | 1897 | 6023 | 1407 | 468 | 700 | 4.80E−69 | sp:[LN:AIP2_YEAST] [AC:P46681] [GN:AIP2:YDL178W] [OR:*SACCHAROMYCES CEREVISIAE*] [SR:,BAKER'S YEAST] [DE:ACTIN INTERACTING PROTEIN 2] [SP:P46681] |
| Contig143G | 10804687_f1_126 | 1898 | 6024 | 744 | 247 | 248 | 3.80E−21 | gp:[GI:e1215185:g2687328] [LN:SC4H8] [AC:AL020958] [PN:hypothetical protein SC4H8.02] [GN:SC4H8.02] [OR:*Streptomyces coelicolor*] [DE:*Streptomyces coelicolor* cosmid 4H8] [NT:SC4H8.02, possible membrane protein, len: 256] |
| Contig143G | 10954807_c1_521 | 1899 | 6025 | 645 | 214 | 176 | 1.60E−13 | gp:[GI:d1032489:g3298508] [LN:AB015670] [AC:AB015670] [OR:Bacillus sp] [SR:Bacillus sp. DNA] [DE:Bacillus sp. genes for CDase, CGTase, MBP and 15 ORFs, partial andcomplete cds.] [NT:A2-5a orf2; hypothetical protein] |

TABLE 2-continued

| Query | Orf | NT ID | AA ID | NT Lgth | AA Lgth | Score | P-value | Subject |
|---|---|---|---|---|---|---|---|---|
| Contig143G | 11017941_c1_592 | 1900 | 6026 | 789 | 262 | 801 | 960E−80 | gp:[GI:g4336799] [LN:AF106002] [AC:AF106002] [PN:toluene tolerance protein Ttg2B] [GN:ttg2B] [OR:*Pseudomonas putida*] [DE:*Pseudomonas putida* strain GM73 toluene tolerance protein Ttg2A(ttg2A), toluene tolerance protein Ttg2B (ttg2B), toluene toleranceprotein Ttg2C (ttg2c), toluene tolerance protein Ttg2D (ttg2D),toluene tolerance protein Ttg2E (ttg2E); toluene tolerance proteinTtg2F (ttg2F), and UDP-N-acetylglucosamine enolpynuvyl transferasehomolog (ttg2G) genes, complete cds.] [NT:hypothetical protein; six-pass transmembrane] |
| Contig143G | 11209542_c2_649 | 1901 | 6027 | 870 | 289 | 158 | 2.70E−09 | pir:[LN:S18533] [AC:S18533:S16747] [PN:eryG protein] [GN:eryG] [CL:bioC homology] [OR:*Saccharopolyspora erythraea*] |
| Contig143G | 1172192_f3_373 | 1902 | 6028 | 1131 | 376 | 385 | 1.20E−35 | pir:[LN:A70365] [AC:A70365] [PN:conserved hypothetical protein aq_740] [GN:aq_740] [OR:*Aquifex aeolicus*] |
| Contig143G | 11767501_c3_823 | 1903 | 6029 | 924 | 307 | 692 | 3.40E−68 | sp:[LN:TRUB_ECOLI] [AC:P09171:P76671] [GN:TRUB:P35] [OR:*ESCHERICHIA COLI*] [EC:4.2.1.70] [DE:HYDROLYASE) (P35 PROTEIN)] [SP:P09171:P76671] |
| Contig143G | 11839177_f1_59 | 1904 | 6030 | 207 | 68 | | | ND-HIT |
| Contig143G | 11990925_f3_460 | 1905 | 6031 | 780 | 259 | 464 | 4.90E−44 | gp:[GI:g2582421] [LN:AF026067] [AC:AF026067] [PN:putative reductase] [GN:slfA] [OR:*Pseudomonas aeruginosa*] [DE:*Pseudomonas aeruginosa* putative reductase (slfA), putativeFMNH2-dependent monooxygenase (slfB), and putative FMNH2-dependentmonooxygenase (slfC) genes, complete cds.] |
| Contig143G | 1210927_c1_485 | 1906 | 6032 | 372 | 123 | 654 | 3.60E−64 | sp:[LN:FERX_ACICA] [AC:P3 1004] [OR:*ACTNETOBACTER CALCOACETICUS*] [DE:PUTATIVE FERREDOXIN) [SP:P31004] |
| Contig143G | 12T20392_f2_195 | 1907 | 6033 | 855 | 284 | 148 | 7.50E−08 | sp:[LN:Y401_LAMBD] [AC:P03764] [OR:*BACTERTOPHAGE LAMBDA*] [DE:HYPOTHETTCAL PROTETN ORF401] [SP:P03764] |
| Contig143G | 1214012_f1_148 | 1908 | 6034 | 582 | 193 | 115 | 5.30E−07 | sp:[LN:YHAT_ECOLI] [AC:P42622] [GN:YHAI] [OR:*ESCHERICHIA COLI*] [DE:HYPOTHETICAL 13.5 KD PROTEIN TN EXUR-TDCC INTERGENIC REGION] [SP:P42622] |
| Contig143G | 12619031_c2_693 | 1909 | 6035 | 552 | 183 | 378 | 6.40E−35 | sp:[LN:RIMM_HAEIN] [AC:P44568] [GN:RIMM:H10203] [OR:*HAEMOPHILUS INFLUENZAE*] [DE:16S RRNA PROCESSING PROTEIN RIMM] [SP:P44568] |

TABLE 2-continued

| Query | Orf | NT ID | AA ID | NT Lgth | AA Lgth | Score | P-value | Subject |
|---|---|---|---|---|---|---|---|---|
| Contig143G | 13063202_c3_765 | 1910 | 6036 | 549 | 182 | 180 | 6.10E−14 | gp:[GI:d1032534:g3318590] [LN:AB015670] [AC:AB015670] [OR:Bacillus sp.] [SR:Bacillus sp. DNA] [DE:Bacillus sp. genes for CDase, CGTase, MBP and 15 ORFs, partial andcomplete cds.] [NT:A2-5a orf21; hypothetical protein] |
| Contig143G | 1306502_c3_741 | 1911 | 6037 | 2721 | 906 | 2895 | 1.20E−301 | gp:[GI:e1154132:g2564217] [LN:AZPDHE] [AC:Y15124] [PN:pyruvate dehydrogenase (lipoamide)] [GN:pdhE] [OR:*Azotobacter vinelandii*] [EC:1.2.4.1] [DE:*Azotobacter vinelandii* pdhE gene.] |
| Contig143G | 134412_c1_604 | 1912 | 6038 | 789 | 262 | 428 | 3.20E−40 | pir:[LN:S75988] [AC:S75988] [PN:hypothetical protein] [OR:Synechocystis sp.] [SR:PCC 6803, PCC 6803] [SR:P,CC 6803,] |
| Contig143G | 1353436_c1_488 | 1913 | 6039 | 702 | 233 | 514 | 2.50E−49 | sp:[LN:PDXH_SYNY3] [AC:P74211] [GN:PDXH SLL1440] [OR.SYNECHOCYSTIS SP] [SR:PCC 6803,] [EC:1.4.3.5] [DE:PYRIDOXAMINE 5,-PHOSPHATE OXIDASE, (PNP/PMP OXIDASE)] [SP:P74211] |
| Contig143G | 13673177_c1_523 | 1914 | 6040 | 210 | 69 | | | NO-HIT |
| Contig143G | 13722252_c3_831 | 1915 | 6041 | 1455 | 484 | 1323 | 4.70E−135 | sp:[LN:YKFD_ECOLI] [AC:Q47689] [GN:YKFD] [OR:*ESCHERICHIA COLI*] [DE:HYPOTHETICAL 51.5 KD TRANSPORT PROTEIN IN PERR-ARGF INTERGENIC REGION] [SP:Q47689] |
| Contig143G | 13726015_c3_804 | 1916 | 6042 | 960 | 319 | 773 | 8.90E−77 | sp:[LN:YABC_HAEIN] [AC:P45057] [GN:H11130] [OR:*HAEMOPHILUS INFLUENZAE*] [DE:HYPOTHETICAL PROTEIN H11130] [SP:P45057] |
| Contig143G | 13923141_c2_739 | 1917 | 6043 | 645 | 214 | 668 | 1.20E−65 | sp:[LN:RL4_HAEIN] [AC:P44345] [GN:RPLD:RPL4:H10778] [OR:*HAEMOPHILUS INFLUENZAE*] [DE:50S RIBOSOMAL PROTEIN L4] [SP:P44345] |
| Contig143G | 14062961_c1_579 | 1918 | 6044 | 1230 | 409 | 894 | 1.30E−89 | gp:[Gi:g3860032] [LN:AF090987] [AC:AF090987] [PN:drug efflux protein TetA] [GN:tetA] [FN:drug resistance pump] [OR:*Agrobacterium tumefaciens*] [DE:*Agrobacterium tumefaciens* transcriptional repressor TetR (tctR) anddrug efflux protein TetA (tetA) genes, complete cds.] |
| Contig143G | 14348262_c2_691 | 1919 | 6045 | 3888 | 1295 | 335 | 6.40E−61 | gp:[GI:g2598966] [LN:AF027189] [AC:AF027189] [PN:ComC] [GN:comC] [OR:*Acinetobacter calcoaceticus*] [DE:*Acinetobacter calcoaceticus* ComC (comC) gene. complete cds.] [NT:similar to type IV-pili assembly factors] |
| Contig143G | 14453552_c1_552 | 1920 | 6046 | 1011 | 336 | 1065 | 1.00E−107 | sp:[LN:LYTB_ECOLI] [AC:P22565] [GN:LYTB] [OR:*ESCHERTCHIA COLI*] [DE:LYTB PROTEIN] [SP:P22565] |
| Contig143G | 14508377_f3_375 | 1921 | 6047 | 603 | 200 | 824 | 3.50E−82 | sp:[LN:MDAB_ECOLI] [AC:P40717] [GN:MDAB:MDA66] [OR:*ESCHERICHIA COLI*] [DE:MODULATOR OF DRUG ACTIVITY B] [SP:P40717] |

TABLE 2-continued

| Query | Orf | NT ID | AA ID | NT Lgth | AA Lgth | Score | P-value | Subject |
|---|---|---|---|---|---|---|---|---|
| Contig143G | 14569068_c3_809 | 1922 | 6048 | 2220 | 739 | 603 | 1.30E−129 | gp:[GI:g459551] [LN:PSEFIMBA] [AC:L13865] [PN:fimbrial assembly protein] [GN:pilQ] [OR:*Pseudomonas aeruginosa*] [SR:*Pseudomonas aeruginosa* (strain PAOI) DNA] [DE:*Pseudomonas aeruginosa* pilQ gene, complete cds, and shikimatekinase (aroK) gene, partial cds.] [NT:translation may start with ATG at position 175–177] |
| Contig143G | 14587800_c2_677 | 1923 | 6049 | 645 | 214 | 339 | 8.70E−31 | pir:[LN:S77727] [AC:S77727] [PN:fimbrial assembly protein pilN] [GN:pilN] [OR:*Pseudomonas aeruginosa*] |
| Contig143G | 1459751_f1_45 | 1924 | 6050 | 642 | 213 | 446 | 4.00E−42 | gp:[GI:e243218:g1890173] [LN:ECSODC] [AC:X97766] [PN:superoxide dismutase] [GN:sodC] [OR:*Escherichia coli*] [EC:1.15.1.1] [DE:*E.coli* sodC gene for Cu,Zn superoxide dismutase.] [SP:P53635] |
| Contig143G | 14734582_c2_674 | 1925 | 6051 | 357 | 118 | | | NO-HIT |
| Contig143G | 14745912_f3_388 | 1926 | 6052 | 732 | 243 | 553 | 1.80E−53 | sp:[LN:KGUA_ECOLI] [AC:P24234] [GN:GMK:SPOR] [OR:*ESCHERICRIA COLI*] [EC:2.7.4.8] [DE:GUANYLATE KINASE, (GMP KINASE)] [SP:P24234] |
| Contig143G | 14879843_f1_13 | 1927 | 6053 | 2055 | 684 | 1838 | 1.20E−189 | sp:[LN:RECG_ECOLI] [AC:P24230:P76721] [GN:RECG] [OR:*ESCHERICHIA COLI*] [EC:3.6.1.—] [DE:ATP-DEPENDENT DNA HELICASE RECG,] [SP:P24230:P76721] |
| Contig143G | 14881381_f1_423 | 1928 | 6054 | 624 | 207 | 446 | 4.00E−42 | pir:[LN:S76614] [AC:S76614] [PN:hypothetical protein] [CL:amidotransferase hisH] [OR:Synechocystis sp.] [SR:PCC 6803, , PCC 6803] [SR:PCC 6803,] |
| Contig143G | 14892287_c2_735 | 1929 | 6055 | 1326 | 441 | 709 | 5.40E−70 | pir:[LN:B70415] [AC:B70415] [PN:proton/sodium-glutamate symport protein] [GN:gltP] [OR:*Aquifex aeolicus*] |
| Contig143G | 14895300_c2_675 | 1930 | 6056 | 831 | 276 | 496 | 2.00E−47 | sp:[LN:RRMA_ECOLI] [AC:P36999] [GN:RRMA] [OR:*ESCHERICHIA COLI*] [EC:2.1.1.51 [DE:METHYLTRANSFERASE)] [SP:P36999] |
| Contig143G | 14898437_c1_500 | 1931 | 6057 | 375 | 124 | 201 | 3.70E−16 | gp:[GI:g3128275] [LN:AF010496] [AC:AF010496] [PN:hypothetical protein] [OR:*Rhodobacter capsulatus*] [DE:*Rhodobacter capsulatus* strain SB1003, partial genome.] |
| Contig143G | 14956561_f3_431 | 1932 | 6058 | 1035 | 344 | 291 | 1.10E−25 | gp:[GI:g1657970] [LN:PAU73506] [AC:U73506] [PN:OruR] [GN:oruR] [OR:*Pseudormonas aeruginosa*] [DE:*Pseudormonas aeruginosa* ornithine utilization regulatory (oruR)gene, complete cds.] [NT:regulatory locus for ornithine utilization] |
| Contig143G | 156951_f1_131 | 1933 | 6059 | 702 | 233 | 303 | 5.70E−27 | pir:[LN:G64680] [AC:G64680] [PN:transcription regulator] [OR:*Helicobacter pylori*] |
| Contig143G | 15875200_c1_535 | 1934 | 6060 | 435 | 144 | | | NO-HIT |
| Contig143G | 16039128_f1_20 | 1935 | 6061 | 237 | 78 | 139 | 6.70E−08 | gp:[GI:g4063042] [LN:AF068065] [AC:AF068065] [PN:GP900] [OR:*Cryptosporidium parvum*] [DE:*Cryptosporidium parvum* GP900 gene, complete cds.] ]NT:mucin-like glycoprotein] |

TABLE 2-continued

| Query | Orf | NT ID | AA ID | NT Lgth | AA Lgth | Score | P-value | Subject |
|---|---|---|---|---|---|---|---|---|
| Contig143G | 16039633_f1_417 | 1936 | 6062 | 1320 | 439 | 1162 | 5.40E–118 | gp:[GI:e293806:g1835113] [LN:LMMETYX] [AC:Y10744] [PN:O-acetylhomoserine sulfhydrylase] [GN:metY] [FN:involved in the transsulfuration pathway] [OR:*Leptospira meyeri*] [DE:*L.meyeri* metY and metX genes.] |
| Contig143G | 160807_f1_49 | 1937 | 6063 | 351 | 116 | 351 | 4.10E–33 | sp:[LN:YGIN_ECOLI] [AC:P40718] [GN:YGIN] [OR:*ESCHERICHIA COLI*] [DE:11.5 KD PROTEIN IN PARC-PARE INTERGENIC REGION] [SP:P40718] |
| Contig143G | 16180387_c2_724 | 1938 | 6064 | 897 | 298 | 593 | 1.10E–57 | sp:[N SUHB_HAEIN] [AC:P44333] [GN:SUHB:H10937] [OR:*HAEMOPHILUS INFLUENZAE*] [DE:EXTRAGENIC SUPPRESSOR PROTEIN SUHB HOMOLOG] [SP:P44333] |
| Contig143G | 16456576_c2_619 | 1939 | 6065 | 1056 | 351 | 1294 | 5.50E–132 | sp:[LN:RF2_SALTY] [AC:P28353] [GN:PRFB] [OR:*SALMONELLA TYPHIMURIUM*] [DE:PEPTIDE CHAIN RELEASE FACTOR 2 (RF-2)] [SP:P28353] |
| Contig143G | 16820937_f3_358 | 1940 | 6066 | 249 | 82 | 104 | 7.00E–06 | sp:[LN:SYGB_NEIGO] [AC:Q50945] [GN:GLYS] [OR:*NEISSERIA GONORRHOEAE*] [EC:6.1.1.14] [DE:BETA CHAIN) (GLYRS) (FRAGMENT)] [SP:Q50945] |
| Contig143G | 17000051_c1_493 | 1941 | 6067 | 1311 | 436 | 2227 | 7.50E–231 | gp:[GI:e322235:g2765829] [LN:ABWAAA153] [AC:Z96925] [PN:3-deoxy-D-manno-2-octulosonate transferase] [GN:A] [FN:Kdo transfer in lipopolysaccharides] [OR:*Acinetobacter baumannii*] [DE:*Acinetobacter baumannii* A gene, strain ATCC 15308.] [NT: formerly named kdtA] |
| Contig143G | 19533537_c2_731 | 1942 | 6068 | 597 | 198 | 453 | 7.20E–43 | pir:[LN:D70033] [AC:D70033] [PN:conserved hypothetical protein yvdD] [GN:yvdD] [CL:yeast conserved hypothetical protein YJL055w] [OR:*Bacillus subtilis*] |
| Contig143G | 19557656_f1_137 | 1943 | 6069 | 918 | 305 | | | NO-HIT |
| Contig143G | 19625913_c2_740 | 1944 | 6070 | 291 | 96 | 303 | 5.70E–27 | pir:[LN:E64093] [AC:E64093] [PN:ribosomal protein 517] [CL:*Escherichia coli* ribosomal protein 517] [OR:*Haemophilus influenzae*] |
| Contig143G | 19643768_f1_144 | 1945 | 6071 | 3519 | 1172 | 512 | 5.80E–48 | gp:[GI:e1245842:g2808665] [LN:PDAJ346O] [AC:AJ223460] [GN:flhS] [OR:*Paracoccus denitrificans*] [DE:*Paracoccus denitrificans* flhS, flhR, abcA, abcB, abcC, pqqE genesand orf's.] |
| Contig143G | 196892_f1_114 | 1946 | 6072 | 954 | 317 | 156 | 5.70E–09 | gp:[GI:g1103915] [LN:RLU40388] [AC:U40388] [PN:PobR] [GN:pobR] [OR:*Rhizobium leguminosarum*] [SR:*Rhizobium leguminosarum* strain=B155] [DE:*Rhizobium leguminosarum* positive regulator of pobA (pobR) gene,complete cds, and 4-hydroxybenzoate hydroxylase (pobA) gene,partial cds.] [NT:positive regulator for pobA, the structural gene] |

TABLE 2-continued

| Query | Orf | NT ID | AA ID | NT Lgth | AA Lgth | Score | P-value | Subject |
|---|---|---|---|---|---|---|---|---|
| Contig143G | 19725260_f3_420 | 1947 | 6073 | 798 | 265 | 841 | 5.50E−84 | sp:[LN:OMPR_ECOLI] [AC:P03025] [GN:OMPR:OMPB:KMT] [OR:*ESCHERICHIA COLI*] [DE:TRANSCRIPTIONAL REGULATORY PROTEIN OMPR] [SP:P03025] |
| Contig143G | 19742803_c2_730 | 1948 | 6074 | 672 | 223 | 287 | 2.80E−25 | gp:[GI:g4336801] [LN:AF106002] [AC:AF106002] [PN:toluene tolerance protein Ttg2D] [GN:ttg2D] [OR:*Pseudomonas putida*] [DE:*Pseudomonas putida* strain GM73 toluene tolerance protein Ttg2A(ttg2A), toluene tolerance protein Ttg2B (ttg2B), toluene toleranceprotein Ttg2C (ttg2C), toluene tolerance protein Ttg2D (ttg2D),toluene tolerance protein Ttg2E (ttg2E) toluene tolerance protein Ttg2F (ttg2F), and UDP-N-acetylglucosamine enolpyruvyl transferasehomolog (ttg2G) genes, complete cds.] [NT:hypothetical protein] |
| Contig143G | 19803187_f1_105 | 1949 | 6075 | 195 | 64 | | | NO-HIT |
| Contig143G | 19806508_c3_746 | 1950 | 6076 | 1341 | 446 | 1273 | 9.20E−130 | sp:[LN:MRSA_ECOLI] [AC:P31120] [GN:MRSA] [OR:*ESCHERICHIA COLI*] [DE:MRSA PROTEIN] [SP:P31120] |
| Contig143G | 19941438_f1_28 | 1951 | 6077 | 534 | 177 | | | NO-HIT |
| Contig143G | 20447802_c1_581 | 1952 | 6078 | 1128 | 375 | 501 | 5.90E−48 | gp:[GI:e246538:g1684732] [LN:PSDNGC] [AC:Z73914] [PN:ORF378 protein] [GN:orf378] [FN:A membrane-bound protein] [OR:*Pseudomonas stutzeri*] [DE:*Pseudomonas stutzeri* orf175 gene.] |
| Contig143G | 20509687_f1_115 | 1953 | 6079 | 1005 | 334 | 753 | 1.20E−74 | gp:[GI:g2462762] [LN:AC002292] [AC:AC002292] [GN:F8A5.21] [OR:*Arabidopsis thaliana*] [SR:thale cress] [DE:Genomic sequence of Arabidopsis BAC F8A5, complete sequence.] [NT:Highly similar to auxin-induced protein (aldo/keto] |
| Contig143G | 2072215_c3_828 | 1954 | 6080 | 186 | 61 | | | NO-HIT |
| Contig143G | 214417_c3_825 | 1955 | 6081 | 240 | 79 | | | NO-HIT |
| Contig143G | 21485002_c2_729 | 1956 | 6082 | 945 | 314 | 862 | 314 3.30E−86 | sp:[LN:YRBF_HAEIN] [AC:P45031] [GN:H11087] [OR:*HAEMOPHILUS INFLUENZAE*] [DE:HYPOTHETICAL ABC TRANSPORTER ATP-BINDING PROTEIN H11087] [SP:P45031] |
| Contig143G | 21541067_c1_593 | 1957 | 6083 | 291 | 96 | | | NO-HIT |
| Contig143G | 21562641_f2_252 | 1958 | 6084 | 1449 | 482 | 1368 | 7.90E−140 | sp:[LN:YKFD_ECOLI] [AC:Q47689] [GN:YKFD] [OR:*ESCHERICHIA COLI*] [DE:HYPOTHETICAL 51.5 KD TRANSPORT PROTEIN IN PERR-ARGF INTERGENIC REGION] [SP:Q47689] |
| Contig143G | 21603201_c2_640 | 1959 | 6085 | 231 | 76 | | | NO-HIT |
| Contig143G | 21619062_f1_445 | 1960 | 6086 | 630 | 209 | 930 | 2.10E−93 | sp:[LN:YCAC_ECOLI] [AC:P21367] [GN:YCAC] [OR:*ESCHERICHIA COLI*] [DE:HYPOTHETICAL 23.1 KD PROTEIN IN DMSC-PFLA INTERGENIC REGION] [SP:P21367] |

TABLE 2-continued

| Query | Orf | NT ID | AA ID | NT Lgth | AA Lgth | Score | P-value | Subject |
|---|---|---|---|---|---|---|---|---|
| Contig143G | 21640955_c3_774 | 1961 | 6087 | 594 | 197 | 429 | 2.50E−40 | sp:[LN:GS14_BACSU] [AC:P80871] [GN:YWRO] [OR:*BACILLUS SUBTILIS*] [EC:16.99.—] [DE:GENERAL STRESS PROTEIN 14 (GSPI4),] [SP:P80871] |
| Contig143G | 21718785_f2_224 | 1962 | 6088 | 444 | 147 | 441 | 1.40E−41 | pir:[LN:B44514] [AC:B44514] [PN:hypothetical protein I (vnfA 5' region)] [CL:hypothetical protein HI0719] (OR:*Azotobacter vinelandii*] |
| Contig143G | 21742177_f1_82 | 1963 | 6089 | 1575 | 524 | 1293 | 7.00E−132 | sp:[LN:SYERHIME] [AC:P151891 [GN:GLTX] [OR:*RHIZOBIUM MELILOTI*] [EC:6.1.1.17] [DE:(GLURS)] [SP:P15189] |
| Contig143G | 22142137_c1_495 | 1964 | 6090 | 2001 | 666 | 2272 | 1.30E−235 | sp:[LN:ACSA_ECOLI] [AC:P27550] [GN:ACS] [OR:*ESCHERICHIA COLI*] [EC:6.2.1.1] [DE:ACTIVATING ENZYME)] [SP:P27550] |
| Contig143G | 2225292_c2_695 | 1965 | 6091 | 522 | 173 | 389 | 4.40E−36 | sp:[LN:PL19_ECOLI] [AC:P02420] [GN:RPLS] [OR:*ESCHERICHIA COLI*] [DE:50S RIBOSOMAL PROTEIN L19] [SP:P02420] |
| Contig143G | 2228212_c3_771 | 1966 | 6092 | 438 | 145 | | | NO-HIT |
| Contig143G | 22282753_c2_612 | 1967 | 6093 | 198 | 65 | | | NO-HIT |
| Contig143G | 22284462_c3_781 | 1968 | 6094 | 1032 | 343 | 275 | 5.30E−24 | gp:[GI:g3089616] [LN:AF086791] [AC:AF086791:AF030862:AF030 863:AF034614:AF034615:AF060 218] [PN:homoserine kinase homolog] [OR:*Zymomonas mobitis*] [DE:*Zymomonas mobitis* strain ZM4 clone 67E10 carbarnoylphosphatesynthetase small subunit (carA), carbamoylphosphate synthetaselarge subunit (carB), transcription elongation factor (greA),enolase (eno), pyruvate dehydrogenase alpha subunit (pdhA),pyruvate dehydrogenase beta subunit (pdhB), ribonuclease H (rnh),homoserine kinase homolog, alcohol dehydrogenase II (adhB), andexcinuclease ABC subunit A (uvrA) genes, complete cds; and unknowngenes.] [NT:ORF5] |
| Contig143G | 2235332_c3_760 | 1969 | 6095 | 636 | 211 | 379 | 5.00E−35 | pir:[LN:C64922] [AC:C64922] [PN:conserved hypothetical protein b1649] [OR:*Escherichia coli*] |
| Contig143G | 22470468_f2_250 | 1970 | 6096 | 315 | 104 | | | NO-HIT |
| Contig143G | 22540825_c2_702 | 1971 | 6097 | 1272 | 423 | 795 | 4.20E−79 | sp:[LN:MDFA_ECOLI] [AC:Q46966:P71226:P75807] [GN:CMR:MDFA] [OR:*ESCHERICHIA COLI*] [DE:MULTIDRUG TRANSLOCASE MDFA (CHLORAMPHENICOL RESISTANCE PUMP CMR)] [SP:Q46966:P71226:P75807] |
| Contig143G | 22665905_c1_608 | 1972 | 6098 | 417 | 138 | 538 | 7.10E−52 | sp:[LN:RL16_ACTAC] [AC:P55837] [GN:RPLP] [OR:*ACTINOBACILLUS ACTINOMYCETEMCOMITANS*] ]SR:,*HAEMOPHILUS ACTINOMYCETEMCOMITANS*] [DE:50S RIBOSOMAL PROTEIN L16] [SP:P55837] |

TABLE 2-continued

| Query | Orf | NT ID | AA ID | NT Lgth | AA Lgth | Score | P-value | Subject |
|---|---|---|---|---|---|---|---|---|
| Contig143G | 22687592_c3_864 | 1973 | 6099 | 651 | 216 | 751 | 1.90E−74 | sp:[LN:RL3_HAEIN] [AC:P44344] [GN:RPLC:RPL3:H10777] [OR:*HAEMOPHILUS INFLUENZAE*] [DE:50S RIBOSOMAL PROTEIN L3] [SP:P44344] |
| Contig143G | 22740808_c1_550 | 1974 | 6100 | 4548 | 1515 | 5323 | 0 | gp:[GI:g1750397] [LN:PAU81261] [AC:U81261] [PN:glutamate synthase large subunit] [GN:gltB] [OR:*Pseudomonas aeruginosa*] [DE:*Pseudomonas aeruginosa* glutamate synthase large subunit (gltB) andglutamate synthase small subunit (gltD) genes, complete cds andHemE homolog (hemE) gene, partial cds.] |
| Contig143G | 22853405_c2_638 | 1975 | 6101 | 1086 | 361 | 689 | 7.10E−68 | pir:[LN:F70561] [AC:F70561] [PN:hypothetical protein Rv3629c] [GN:Rv3629c] [OR:*Mycobacterium tuberculosis*] |
| Contig143G | 23437678_f3_436 | 1976 | 6102 | 891 | 296 | 139 | 4.30E−07 | sp:[LN:YISR_BACSU] [AC:P40331:O07913] [GN:YISR] [OR:*BACILLUS SUBTILIS*] [DE:HYPOTHETICAL TRANSCRIPTIONAL REGULATOR IN WPRA-DEGA INTERGENIC REGION] [SP:P40331:O07913] |
| Contig143G | 23445915_c2_713 | 1977 | 6103 | 915 | 304 | 432 | 1.20E−40 | pir:[LN:A69780] [AC:A69780] [PN:conserved hypothetical protein ydfC] [GN:ydfC] [OR:*Bacillus subtilis*] |
| Contig143G | 2348436_c2_705 | 1978 | 6104 | 258 | 85 | | | NO-HIT |
| Contig143G | 23522925_f1_61 | 1979 | 6105 | 291 | 96 | | | NO-HIT |
| Contig143G | 23566025_c3_829 | 1980 | 6106 | 195 | 64 | | | NO-HIT |
| Contig143G | 23593840_c3_810 | 1981 | 6107 | 1098 | 365 | 1013 | 3.30E−102 | sp:[LN:AROB_HAEIN] [AC:P43879] [GN:AROB:H10208] [OR:*HAEMOPHILUS INFLUENZAE*] [EC:4.6.1.3] [DE:3-DEHYDROQUINATE SYNTHASE,] [SP:P43879] |
| Contig143G | 23601587_c1_539 | 1982 | 6108 | 972 | 323 | | | NO-HIT |
| Contig143G | 23610075_c3_768 | 1983 | 6109 | 984 | 327 | 394 | 1.30E−36 | gp:[GI:e274873:g1907076] [LN:HSPIRIN I] [AC:Y07867] [PN:pirin] [OR:*Homo sapiens*] [DE:*H.sapiens* mRNA for Pirin. isolate I.] |
| Contig143G | 23626555_f3_379 | 1984 | 6110 | 897 | 298 | 590 | 2.20E−57 | pir:[LN:E64818] [AC:E64818:169618] [PN:probable membrane protein ybiF] [GN:ybiF] [OR:*Escherichia coli*] |
| Contig143G | 23634626_c3_821 | 1985 | 6111 | 486 | 161 | 117 | 4.90E−11 | gp:[GI:g1562565] [LN:KDU68760] [AC:U68760] [PN:KdpA] [GN:kdpA] [OR:*Kingella denitrificans*] [DE:*Kingella denitrificans* type 4 pilin protein KdpA (kdpA) gene,complete cds.] [NT:type 4 pilin protein] |
| Contig143G | 23707562_f1_468 | 1986 | 6112 | 927 | 308 | | | NO-HIT |
| Contig143G | 23860753_f3_337 | 1987 | 6113 | 252 | 83 | | | NO-HIT |
| Contig143G | 23865953_c1_511 | 1988 | 6114 | 1338 | 445 | 180 | 7.20E−11 | pir:[LN:B70831] [AC:B70831] [PN:probable dehydrogenase] [GN:Rv0449c] [OR:*Mycobacterium tubcrculosis*] |
| Contig143G | 23868801_f3_426 | 1989 | 6115 | 798 | 265 | 625 | 4.30E−61 | sp:[LN:HIS4_RHOSH] [AC:P50936] [GN:HISA] [OR:*RHODOBACTER SPHAEROIDES*] [SR:,*RHODOPSEUDOMONAS SPHAEROIDES*] [EC:5.3.1.161 [DE:ISOMERASE,] [SP:P50936] |

TABLE 2-continued

| Query | Orf | NT ID | AA ID | NT Lgth | AA Lgth | Score | P-value | Subject |
|---|---|---|---|---|---|---|---|---|
| Contig143G | 24000252_f2_268 | 1990 | 6116 | 510 | 169 | 389 | 4.40E−36 | pir:[LN:A65018] [AC:A65018] [PN:hypothetical protein b2434] [OR:*Escherichia coli*] |
| Contig143G | 24016942_c1_522 | 1991 | 6117 | 267 | 88 | | | NO-HIT |
| Contig143G | 24101540_c1_510 | 1992 | 6118 | 1473 | 490 | 1496 | 2.20E−153 | sp:[LN:GABD_ECOLI] [AC:P255526] [GN:GABD] [OR:*ESCHERICHIA COLI*] [EC:1.2.1.16] [DE:SUCCINATE-SEMIALDEHYDE DEHYDROGENASE (NADP+), (SSDH)] [SP:P25526] |
| Contig143G | 24218760_c2_718 | 1993 | 6119 | 1299 | 432 | 494 | 3.30E−47 | pir:[LN:B69061] [AC:B69061] [PN:hypothetical protein MTH1458] [GN:MTH1458] [OR:*Methanobacterium thermoautotrophicum*] |
| Contig143G | 24219067_c2_652 | 1994 | 6120 | 756 | 251 | | | NO-HIT |
| Contig143G | 24228453_c3_779 | 1995 | 6121 | 642 | 213 | | | NO-HIT |
| Contig143G | 24258587_c3_782 | 1996 | 6122 | 642 | 213 | 100 | 4.30E−05 | sp:[LN:Y4CH_RHISN] [AC:P55390] [GN:Y4CH] [OR:RHIZOBIUM SP] [DE:PROBABLE COLD SHOCK PROTEIN Y4CH] [SP:P55390] |
| Contig143G | 242825_f1_136 | 1997 | 6123 | 2847 | 948 | 3410 | 0 | sp:[LN:UVRA_SALTY] [AC:P37434] [GN:UVRA] [OR:*SALMONELLA TYPHIMURIUM*] [DE:EXCINUCLEASE ABC SUBUNIT A] [SP:P37434] |
| Contig143G | 2429687_f1_351 | 1998 | 6124 | 1026 | 341 | 1032 | 3.20E−104 | sp:[LN:HEM6_PSEAE] [AC:P43898] [GN:HEMF] [OR:*PSEUDOMONAS AERUGINOSA*] [EC:1.3.3.3] [DE:(COPROPORPHYRINOGEN ASE) (COPROGEN OXIDASE)] [SP:P43898] |
| Contig143G | 24297782_f2_189 | 1999 | 6125 | 189 | 62 | | | NO-HIT |
| Contig143G | 24304625_c3_814 | 2000 | 6126 | 1104 | 367 | 320 | 9.00E−29 | sp:[LN:YGCG_ECOLI] [AC:P55140] [GN:YGCG] [OR:*ESCHERICHIA COLI*] [DE:HYPOTHETICAL 34.9 KD PROTEIN IN CYSJ-ENO INTERGENIC REGION (O313)] [SP:P55140] |
| Contig143G | 24307263_c3_863 | 2001 | 6127 | 360 | 119 | 449 | 1.90E−42 | sp:[LN:RSIO_HAEIN] [AC:P44378] [GN:RPSJ:RPS10:H10776] [OR:*HAEMOPHILUS INFLUENZAE*] [DE:30S RIBOSOMAL PROTEIN S10] [SP:P44378] |
| Contig143G | 24397777_f3_442 | 2002 | 6128 | 237 | 78 | | | NO-HIT |
| Contig143G | 24401062_f2_204 | 2003 | 6129 | 807 | 268 | 308 | 1.70E−27 | pir:[LN:E70846] [AC:E70846] [PN:hypothetical protein Rv3342] [GN:Rv3342] [OR:*Mycobacterium tuberculosis*] |
| Contig143G | 24414802_c3_832 | 2004 | 6130 | 1284 | 427 | 1114 | 6.50E−113 | sp:[LN:DHE3_THEMA] [AC:P96110] [GN:GDH] [OR:*THERMOTOGA MARITIMA*] [EC:1.4.1.3] [DE:GLUTAMATE DEHYDROGENASE, (GDH)] [SP:P96110] |
| Contig143G | 24429058_f1_62 | 2005 | 6131 | 2127 | 708 | 895 | 1.10E−89 | sp:[LN:SPOT_ECOLI] [AC:P17580] [GN:SPOT] [OR:*ESCHERICHIA COLI*] [EC:3.1.7.2] [DE:((PPGPP)ASE) (PENTA-PHOSPHATE GUANOSINE-3'-PYROPHOSPHOHYDROLASE)] [SP:P17580] |

TABLE 2-continued

| Query | Orf | NT ID | AA ID | NT Lgth | AA Lgth | Score | P-value | Subject |
|---|---|---|---|---|---|---|---|---|
| Contig143G | 24507812_c3_834 | 2006 | 6132 | 1050 | 349 | 1123 | 7.30E−114 | gp:[GI:e1331954:g4106585] [LN:YP102KB] [AC:AL031866] [GN:aruF] [OR:*Yersinia pestis*] [DE:*Yersinia pestis* 102 kbases unstable region: from 1 to 119443.] [NT:ORF17, len: 350, aruF, probable] |
| Contig143G | 24620342_c2_628 | 2007 | 6133 | 1758 | 585 | 1737 | 6.30E−179 | gp:[GI:g3128276] [LN:AF010496] [AC:AF0104496] [PN:transmembrane protein DhlC homolog] [OR:*Rhodobacter capsulatus*] [DE:*Rhodobacter capsulatus* strain SB1003, partial genome.] |
| Contig143G | 24620753_f2_205 | 2008 | 6134 | 549 | 182 | 91 | 0.00029 | gp:[GI:g4156034] [LN:AE001564] [AC:AE001564:AE001439] [PN:putative] [GN:jhp1413] [OR:*Helicobacter pylori* J99] [DE:*Helicobacter pylori*, strain J99 section 125 of 132 of the completegenome.] [NT:similar to *H. pylori* 26695 gene HP1524] |
| Contig143G | 24640830_c3_753 | 2009 | 6135 | 657 | 218 | 429 | 2.50E−40 | sp:[LN:AGMR_PSEAE] [AC:P29369] [GN:AGMR:GLPR] [OR:*PSEUDOMONAS AERUGINOSA*] [DE:GLYCEROL METABOLISM ACTIVATOR (AGMR PROTEIN)] [SP:P29369] |
| Contig143G | 24644541_f3_332 | 2010 | 6136 | 1197 | 398 | 515 | 1.90E−49 | sp:[LN:METC_BORAV] [AC:Q07703] [GN:METC] [OR:*BORDETELLA AVIUM*] [EC:4.4.1.8] [DE:(CYSTEINE LYASE) (OSTEOTOXIN)] [SP:Q07703] |
| Contig143G | 24648405_f1_31 | 2011 | 6138 | 426 | 141 | | | NO-HIT |
| Contig143G | 24657262_f3_418 | 2012 | 6138 | 897 | 298 | 1255 | 7.50E−128 | gp:[GI:g1684886] [LN:ACU77680] [AC:U77680] [PN:fatty acyl-CoA reductase] ]GN:acrl] [FN:reduces acyl-CoA esters of fatty acids to fatty] [OR:*Acinetobacter calcoaceticus*] [DE:*Acinetobacter calcoaceticus* fatty acyl-CoA reductase (acrl) gene,partial cds.] |
| Contig143G | 2477083_f3_335 | 2013 | 6139 | 810 | 269 | 519 | 7.30E−50 | sp:[LN:YIHA_HAEIN] [AC:P46453] [GN:H11118] [OR:*HAEMOPHILUS INFLUENZAE*] [DE:HYPOTHETICAL GTP-BINDING PROTEIN H11118] [SP:P46453] |
| Contig143G | 24880291_c2_694 | 2014 | 6140 | 768 | 255 | 710 | 4.20E−70 | sp:[LN:TRMD_HAEIN] [AC:P43912] [GN:TRMD:H10202] [OR:*HAEMOPHILUS INFLUENZAE*] [EC:2.1.1.31] [DE:METHYLTRANSFERASE) (TRNA [GM37] METHYLTRANSFERASE)] [SP:P43912] |
| Contig143G | 25398452_c2_654 | 2015 | 6141 | 1398 | 465 | 126 | 7.20E−06 | gp:[GI:e1215351:g2687741] [LN:LAH222725] [AC:AJ222725] [PN:hypothetical protein] [GN:orf-495] [FN:unknown] [OR:*Lactobacillus helveticus*] [DE:*Lactobacillus helveticus* plasmid pLHI complete sequence, strainATCC15009.] |
| Contig143G | 25402337_c1_555 | 2016 | 6142 | 318 | 105 | 305 | 3.50E−27 | sp:[LN:RS16_HAEIN] [AC:P44382] [GN:RPSP:RPS16:H10204] [OR:*HAEMOPHILUS INFLUENZAE*] [DE:30S RIBOSOMAL PROTEIN S16] [SP:P44382] |

TABLE 2-continued

| Query | Orf | NT ID | AA ID | NT Lgth | AA Lgth | Score | P-value | Subject |
|---|---|---|---|---|---|---|---|---|
| Contig143G | 25430_c3_792 | 2017 | 6143 | 2388 | 795 | 1932 | 1.40E−199 | sp:[LN:YHGF__NEIME] [AC:Q51152] [OR:*NEISSERIA MENINGITIDIS*] [DE:HYPOTHETICAL 83.1 KD PROTEIN IN REGION E] [SP:Q51152] |
| Contig143G | 25439500_c3_852 | 2018 | 6144 | 717 | 238 | 196 | 3.50E−27 | gp:[GI:g4336800] [LN:AF106002] [AC:AF106002] [PN:toluene tolerance protein Ttg2C] [GN:ttg2C] [OR:*Pseudomonas putida*] [DE:*Pseudomonas putida* strain GM73 toluene tolerance protein Ttg2A(ttg2A), toluene tolerance protein Ttg2B (ttg2B), toluene toleranceprotein Ttg2C (ttg2C), toluene tolerance protein Ttg2D (ttg2D),toluene tolerance protein Ttg2E (ttg2E), toluene tolerance proteinTtg2F (ttg2F), and UDP-N-acetylglucosamine enolpyruvyl transferasehomolog (ttg2G) genes, complete cds.] [NT:hypothetical protein] |
| Contig143G | 25441876_c2_610 | 2019 | 6145 | 501 | 166 | 302 | 7.30E−27 | pir:[LN:H70450] [AC:H70450] [PN:lipoprotein NlpD fragment] [GN:nlpD2] [OR:*Aquifex acolicus*] |
| Contig143G | 25501677_c3_833 | 2020 | 6146 | 1233 | 410 | 1474 | 4.60E−151 | gp:[GI:e1331955:g4106586] [LN:YP102KB] [AC:AL031866] [GN:aruC] [OR:*Yersinia pestis*] [DE:*Yersinia pestis* 102 kbases unstable region: from 1 to 119443.] [NT:ORF18, len:414, aruC, probable succinylornithine] |
| Contig143G | 25509687_f2_283 | 2021 | 6147 | 339 | 112 | 309 | 1.30E−27 | gp:[GI:d1039059:g4512356] [LN:AB011836] [AC:AB011836] [GN:ydzF] [OR:*Bacillus halodurans*] [SR:*Bacillus halodurans* (strain:C-125, isolate:xylanase producer) DNA] [DE:*Bacillus halodurans* C-125 genomic DNA, clone ALBAC003.] [NT:similar to *B. subtilis* ydzF gene(545-identity)] |
| Contig143G | 25679511_c2_701 | 2022 | 6148 | 396 | 131 | | | NO-HIT |
| Contig143G | 26046911_c2_679 | 2023 | 6149 | 603 | 200 | 476 | 2.60E−45 | sp:[LN:AROK__HAEIN] [AC:P43880] [GN:AROK:H10207] [OR:*HAEMOPHILUS INFLUENZAE*] [EC:2.7.1.71] [DE:SHIKIMATE KINASE, (SK)] [SP:P43880] |
| Contig143G | 26054637_c1_572 | 2024 | 6150 | 1158 | 385 | 192 | 140E−12 | gp:[GI:g1066056] [LN:BSU39230] [AC:U39230] [PN:SprC] [OR:Bacillus sp.] [SR:Bacillus sp] [DE:Bacillus sp. SprA gene, partial cds and SprB, SpC, and SprD genes,complete cds.] [NT:subtilisin-like protease C] |
| Contig143G | 26288427_c1_597 | 2025 | 6151 | 1047 | 348 | | | NO-HIT |
| Contig143G | 26345952_c1_547 | 2026 | 6152 | 741 | 246 | 412 | 1.60E−38 | pir:[LN:S77728] [AC:S77728] [PN:fimbrial assembly protein pilO] [GN:pilO] [OR:*Pseudomonas aeruginosa*] |
| Contig143G | 26360687_c3_813 | 2027 | 6153 | 624 | 207 | 426 | 5.30E−40 | pir:[LN:A71309] [AC:A71309:S18231:S19826] [PN:protein Tp70] [GN:Tp70:TP0571] [OR:*Treponema pallidum* subsp. *pallidum*] [SR:, syphilis spirochete] |
| Contig143G | 26461418_c1_553 | 2028 | 6154 | 573 | 190 | 128 | 1.10E−07 | pir:[LN:577594] [AC:577594] [PN:pilV protein] [GN:pilV] [OR:*Pseudomonas aeruginosa*] |

TABLE 2-continued

| Query | Orf | NT ID | AA ID | NT Lgth | AA Lgth | Score | P-value | Subject |
|---|---|---|---|---|---|---|---|---|
| Contig143G | 26595300_6_359 | 2029 | 6155 | 873 | 290 | 476 | 2.60E−45 | pir:[LN:E70022] [AC:E70022] [PN:transcription regulator LysR family homolog yusT] [GN:yusT] [CL:*Pseudomonas putida* regulatory protein catR] [OR:*Bacillus subtilis*] |
| Contig143G | 26750187_f2_217 | 2030 | 6156 | 1056 | 351 | 885 | 1.20E−88 | pir:[LN:A57253] [AC:A57253:562094] [PN:chaperone-like protein lipB] [GN:lipB] [OR:*Acinetobacter calcoaceticus*] |
| Contig143G | 26757762_c2_636 | 2031 | 6157 | 372 | 123 | 146 | 2.50E−10 | sp:[LN:YTRP_LACLA] [AC:Q02009] [OR:*LACTOCOCCUS LACTIS*] [SR:,SUBSPLACTIS:STREPTOCOCCUS LACTIS] [DE:HYPOTHETICAL 13.3 KD PROTEIN IN TRPE 5'REGION] [SP:Q02009] |
| Contig143G | 275_f1_83 | 2032 | 6158 | 363 | 120 | | | NO-HIT |
| Contig143G | 2776512_c1_568 | 2033 | 6159 | 1371 | 456 | 277 | 7.80E−24 | gp:[GI:e263934:g1890583] [LN:RMEXPGNS] [AC:Z79692] [PN:ExpE8] [OR:*Sinorhizobium meliloti*] [DE:*R.meliloti* exp gene cluster.] |
| Contig143G | 290702_c3_743 | 2034 | 6160 | 273 | 90 | | | NO-HIT |
| Contig143G | 29323432_c3_751 | 2035 | 6161 | 339 | 112 | 151 | 730E−11 | gp:[GI:e1173374:g2292734] [LN:ARGTR] [AC:Y13942] [GN ORFI] [FN:unknown] [OR:*Agrobacterium radiobacter*] [DE:*Agrobacterium radiobacter* genomic DNA for glycerol trinitratereductase.] |
| Contig143G | 29402178_c1_544 | 2036 | 6162 | 1848 | 615 | 1013 | 1.40E−116 | pir:[LN:S54872] [AC:S54872] [PN:penicillin-binding protein 3] [OR:*Pseudomonas aeruginosa*] |
| Contig143G | 29460062_c3_775 | 2037 | 6163 | 1902 | 633 | 1545 | 1.40E−158 | sp:[LN:KUP_ECOLI] [AC:P30016] [GN:KUP:TRKD] [OR:*ESCHERICHIA COLI*] [DE:KUP SYSTEM POTASSIUM UPTAKE PROTEIN] [SP:P30016] |
| Contig143G | 29489141_c3_818 | 2038 | 6164 | 858 | 285 | | | NO-HIT |
| Contig143G | 29492793_f2_226 | 2039 | 6165 | 492 | 163 | 500 | 7.60E−48 | sp:[LN:BFR_AZOVI] [AC:P22759] [GN:BFR] [OR:*AZOTOBACTER VINELANDII*] [DE:BACTERIOFERRITIN (BFR) (CYTOCHROME B-557.5)] [SP:P22759] |
| Contig143G | 29494517_c1_537 | 2040 | 6166 | 3189 | 1062 | 3294 | 0 | sp:[LN:CZCA_ALCSP] [AQ:P94177] [GN:CZCA] [OR:ALCALIGENES SP] [DE:CATION EFFLUX SYSTEM PROTEIN CZCA] [SP:P94177] |
| Contig143G | 29570382_f3_469 | 2041 | 6167 | 822 | 273 | 84 | 0.00016 | gp:[GI:g47797] [LN:STOMP] [AC:X07835] [OR:*Salmonella typhi*] [DE:*Salmonella typhi* DNA for outer membrane protein.] [NT:outer membrane protein (AA 1-377)] [SP:P09878] |
| Contig143G | 29895150_c1_551 | 2042 | 6168 | 1491 | 496 | 1997 | 1.80E−206 | gp:[GI:g1750398] [LN:PAU81261] [AC:U81261] [PN:glutamate synthase small subunit] [GN:gltD] [OR:*Pseudomonas aeruginosa*] [DE:*Pseudomonas aeruginosa* glutamate synthase large subunit (gltB) andglutamate synthase small subunit (gltD) genes, complete cds andHemE homolog (hemE) gene, partial cds.] |

TABLE 2-continued

| Query | Orf | NT ID | AA ID | NT Lgth | AA Lgth | Score | P-value | Subject |
|---|---|---|---|---|---|---|---|---|
| Contig143G | 30087702_c3_806 | 2043 | 6169 | 1119 | 372 | 1071 | 2.40E−108 | sp:[LN:MRAY_HAEIN] [AC:P45062] [GN MRAY:H11135] [OR:*HAEMOPHILUS INFLUENZAE*] [EC:2.7.8.13] [DE:(UDP-MURNAC-PENTAPEPTIDE PHOSPHOTRANSFERASE)] [SP:P45062] |
| Contig143G | 3017158_f2_191 | 2044 | 6170 | 282 | 93 | | | NO-HIT |
| Contig143G | 30361377_f1_26 | 2045 | 6171 | 993 | 330 | 1352 | 3.90E−138 | sp:[LN:SYGA_MORCA] [AC:P77892] [GN:GLYQ] [OR:*MORAXELLA CATARRHALIS*] [EC:6.1.1.14] [DE:ALPHA CHAIN) (GLYRS)] ]SP:P77892] |
| Contig143G | 30475137_f3_338 | 2046 | 6172 | 207 | 68 | | | NO-HIT |
| Contig143G | 30476502_c1_526 | 2047 | 6173 | 639 | 212 | 151 | 7.30E−11 | gp:[GI:d1032534:g3318590] [LN:AB015670] [AC:AB015670] [OR:Bacillus sp.] [SR:Bacillus sp. DNA] [DE:Bacillus sp. genes for CDase, CGTase, MBP and 15 ORFs, partial andcomplete cds.] [NT:A2-5a orf21; hypothetical protein] |
| Contig143G | 30553412_f2_290 | 2048 | 6174 | 1371 | 456 | 824 | 3.50E−82 | sp:[LN:YYBF_BACSU] [AC:P37498] [GN:YYBF] [OR:*BACILLUS SUBTILIS*] [DE:HYPOTHETICAL 44.2 KD PROTEIN IN COTF-TETB INTERGENIC REGION] [SP:P37498] |
| Contig143G | 30664000_f3_413 | 2049 | 6175 | 993 | 330 | | | NO-HIT |
| Contig143G | 30719687_c2_710 | 2050 | 6176 | 1536 | 511 | 1844 | 2.90E−190 | gp:[GI:e1331953:g4106584] [LN:YP102KB] [AC:AL031866] [GN:aruD] [OR:*Yersinia pestis*] [DE:*Yersinia pestis* 102 kbases unstable region: from 1 to 119443.] [NT:ORF16, len:505, aruD, probable succinylgtutamate) |
| Contig143G | 30756875_f2_299 | 2051 | 6177 | 1596 | 531 | 863 | 2.60E−86 | sp:[LN:MOCR_RHIME] [AC:P49309] [GN:MOCR] [OR:*RHIZOBIUM MELILOTI*] [DE:PROBABLE RHIZOPINE CATABOLISM REGULATORY PROTEIN MOCR] [SP:P49309] |
| Contig143G | 31353426_c1_606 | 2052 | 6178 | 279 | 92 | 375 | 1.30E−34 | pir:[LN:164092] [AC:164092] [PN:ribosomal protein S19] [CL:*Escherichia coli* ribosomal protein S19] [OR:*Haemophilus influenzae*] |
| Contig143G | 31367768_c1_605 | 2053 | 6179 | 333 | 110 | 232 | 1.90E−19 | sp:[LN:RL23_ECOLI] [AC:P02424] [GN:RPLW] [OR:*ESCHERICHIA COLI*] [DE:50S RIBOSOMAL PROTEIN L23] [SP:P02424] |
| Contig143G | 31410787_c3_867 | 2054 | 6180 | 228 | 75 | 161 | 6.30E−12 | sp:[LN:RL29_HAEIN] [AC:P44365] [GN:RPMC:RPL29:H10785] [OR:*HAEMOPHILUS INFLUENZAE*] [DE:50S RIBOSOMAL PROTEIN L29] [SP:P44365] |
| Contig143G | 31696062_c1_538 | 2055 | 6181 | 972 | 323 | 872 | 2.90E−87 | sp:[LN:CZCD_ALCEU] [AC:P13512] [GN:CZCD] [OR:*ALCALIGENES EUTROPHUS*] [DE:PROTEIN CZCD)] [SP:P13512] |
| Contig143G | 32234840_f2_293 | 2056 | 6182 | 945 | 314 | 325 | 2.70E−29 | pir:[LN:S77111] [AC:S77111] [PN:transcription regulator slr1871:protein s1r1871:protein slr1871] [CL:conserved hypothetical protein H11364] [OR:Synechocystis sp.] [SR:PCC 6803, , PCC 6803] [SR:PCC 6803,] |
| Contig143G | 32281553_c1_609 | 2057 | 6183 | 258 | 85 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig143G | 32422206_f3_462 | 2058 | 6184 | 600 | 199 | 379 | 5.00E−35 | pir:[LN:G69776] [AC:G69776] [PN:conserved hypothetical protein yddQ] [GN:yddQ] [CL:hypothetical protein yddQ] [OR:*Bacillus subtilis*] |
| Contig143G | 33242150_f3_352 | 2059 | 6185 | 1845 | 614 | 839 | 9.00E−84 | gp:[GI:g3172117] [LN:ACCPCAOP] [AC:L05770:U04359:M33798:U20284:U11554:L13114:L03407] [PN:acyl-COA dehydrogenase] [OR:Acinetobacter sp. ADPI] [DE:Acinetobacter sp. ADPI pca-qui-pob supraoperonic cluster, completesequence.] [NT:encodes protein similar to acyl-CoA dehydrogenase] |
| Contig143G | 3324215_c3_838 | 2060 | 6186 | 264 | 87 | 137 | 2.30E−08 | sp:[LN:PROA_VIBAL] [AC:P16588] [GN:PROA] [OR:*VIBRIO ALGINOLYTICUS*] [EC:3.4.21.—] [DE:ALKALINE SERINE EXOPROTEASE A PRECURSOR,] [SP:P16588] |
| Contig143G | 33447041_f1_430 | 2061 | 6187 | 807 | 268 | 894 | 1.30E−89 | sp:[LN:H156_AZOBR] [AC:P26721] [GN:HISF] [OR:*AZOSPIRILLUM BRASILENSE*] [DE:HTSF PROTEIN (CYCLASE)] [SP:P26721] |
| Contig143G | 33452_f1_103 | 2062 | 6188 | 273 | 90 | | | NO-HIT |
| Contig143G | 33475268_f1_44 | 2063 | 6189 | 687 | 228 | 197 | 970E−16 | gp:[GIg1688245] [LN:CLU77780] [AC:U77780] [PN.unknown[ [GN:hyp7h] [OR:*Chlorobium limicola*] [DE:*Chlorobium limicola* strain DSM 249 endogenous plasmid pCL1,complete genomic sequence.] [NT:orf2.4; putative; 22.9 kDa, IEP 6.5; similar to] |
| Contig143G | 33784791_c2_685 | 2064 | 6190 | 801 | 266 | 117 | 0.00011 | pir:[LN:H71308] [AC:H71308] [PN:hypothetical protein TP0570] [GN:TP0570] [OR:*Treponema pallidum* subsp. *pallidum*] [SR:, syphilis spirochete] |
| Contig143G | 33800257_f1_15 | 2065 | 6191 | 1128 | 375 | 419 | 2.90E−39 | sp:[LN:CORA_SALTY] [AC:P31 138] [GN:CORA] [OR:*SALMONELLA TYPHIMURIUM*] [DE:MAGNESIUM AND COBALT TRANSPORT PROTEIN CORA] [SP:P31138] |
| Contig143G | 33884438_c2_644 | 2066 | 6192 | 1539 | 512 | 1103 | 9.60E−112 | sp:[LN:GABP_ECOLI] [AC:P25527] [GN:GABP] [OR:*ESCHERICHIA COLI*] [DE:PERMEASE)] [SP:P25527] |
| Contig143G | 34007968_c2_611 | 2067 | 6193 | 1995 | 664 | 1244 | 1.10E−126 | sp:[LN:ODP2_PSEAE] [AC:Q59638] [GN:ACEF:ACEB] [OR:*PSEUDOMONAS AERUGINOSA*] [EC:2.3.1.12] [DE:COMPLEX, (E2)] [SP:Q59638] |
| Contig143G | 34171936_c3_769 | 2068 | 6194 | 984 | 327 | 631 | 9.90E−62 | gp:[GI:e1331986:g4106617] [LN:YP102KB] [AC:AL031866] [OR:*Yersinia pestis*] [DE:*Yersinia pestis* 102 kbases unstable region: from 1 to 119443.] [NT:ORF49, len= 294, propable transcriptional] |
| Contig143G | 34178877_c1_580 | 2069 | 6195 | 906 | 301 | | | NO-HIT |
| Contig143G | 34181562_c1_218 | 2070 | 6196 | 978 | 325 | 788 | 2.30E−78 | pir:[LN:561927] [AC:S61927:B57253] [PN:lipase A precursor] [GN:lipA] [CL:*Pseudomonas triacylglycerol* lipase] [OR:*Acinetobacter calcoaceticus*] |

TABLE 2-continued

| Query | Orf | NT ID | AA ID | NT Lgth | AA Lgth | Score | P-value | Subject |
|---|---|---|---|---|---|---|---|---|
| Contig143G | 34244042_c3_761 | 2071 | 6197 | 981 | 326 | 393 | 1.70E−36 | gp:[GI:d1035787:g3970880] [LN:AB0157241 [AC:AB015724] [PN:nuclear receptor binding factor-1] [GN:NRBF-1] [OR:: Rattus norvegicus] [SR:Rattus norvegicus cDNA to mRNA] [DE:Rattus norvegicus mRNA for nuclear receptor binding factor-1,complete cds.] |
| Contig143G | 34256381_c2_680 | 2072 | 6198 | 207 | 68 | | | NO-HIT |
| Contig143G | 34271937_f3_439 | 2073 | 6199 | 909 | 302 | 224 | 1.30E−18 | pir:[LN:D71226] [AC:D71226] [PN:hypothetical protein PH0070] [GN:PH0070] [OR:Pyrococcus horikoshii] |
| Contig143G | 34375016_f1_104 | 2074 | 6200 | 615 | 204 | 588 | 3.60E−57 | sp:[LN:HIS7_ANASP] [AC:Q05068] [GN:HISB] [OR:ANABAENA SP] [SR:PCC 7120,] [EC:4.2.1.19] [DE:IMIDAZOLEGLYCEROL-PHOSPHATE DEHYDRATASE, (IGPD)] [SP:Q05068] |
| Contig143G | 34376311_c1_567 | 2075 | 6201 | 438 | 145 | | | NO-HIT |
| Contig143G | 34379625_f3_428 | 2076 | 6202 | 915 | 304 | 279 | 2.00E−24 | pir:[LN:D69348] [AC:D69348] [PN:conserved hypothetical protein AF0788] [OR:Archaeoglobus fulgidus] |
| Contig143G | 34414051_c1_558 | 2077 | 6203 | 462 | 153 | 107 | 1.10E−05 | sp:[LN:YQ03_MYCTU] [AC:P71932] [GN:MTCY441.03C] [OR:MYCOBACTERIUM TUBERCULOSIS] [DE:HYPOTHETICAL 18.2 KD PROTEIN CY441.03C] [SP:P71932] |
| Contig143G | 34414062_f3_452 | 2078 | 6204 | 330 | 109 | 99 | 2.40E−05 | gp:[GI:e1215186:g2687329] [LN:SC4H8] [AC:AL020958] [PN:hypothetical protein SC4H8.03] [GN:5C4H8.03] [OR:Streptomyces coelicolor] [DE:Streptomyces coelicolor cosmid 4H8.] [NT:SC4H8.03, unknown hydrophobic protein, len: 102] |
| Contig143G | 34428376_f2_186 | 2079 | 6205 | 864 | 287 | 555 | 1.10E−53 | sp:[LN:AROE_ECOLI] [AC:P15770] [GN:AROE] [OR:ESCHERICHIA COLI] [EC:1.1.1.25] [DE:SHIKIMATE 5-DEHYDROGENASE,] [SP:P15770] |
| Contig143G | 34430262_f2_265 | 2080 | 6206 | 1464 | 487 | 602 | 1.20E−58 | sp:[LN:ENVZ_SALTY] [AC:P08982] [GN:ENVZ] [OR:SALMONELLA TYPHIMURIUM] [EC:2.7.3.—] [DE:OSMOLARITY SENSOR PROTEIN ENVZ,] [SP:P08982] |
| Contig143G | 34454692_c1_518 | 2081 | 6207 | 636 | 211 | | | NO-HIT |
| Contig143G | 35240830_c3_752 | 2082 | 6208 | 729 | 242 | 596 | 5.10E−58 | gp:[GI:e1227115:g2765835] [LN:AHWAAA179] [AC:Z96927] [PN:hypothetical protein] [OR:Acinetobacter haemolyticus] [DE:Acinetobacter haemolyticus A gene, strain ATCC 17906.] [RE: |
| Contig143G | 35817712_c3_865 | 2083 | 6209 | 852 | 283 | 1089 | 2.90E−110 | sp:[LN:RL2_YERPS] [AC:P11255] [GN:RPLB] [OR:YERSINIA PSEUDOTUBERCULOSIS] [DE:50S RIBOSOMAL PROTEIN L2] [SP:P11255] |
| Contig143G | 35942781_c3_849 | 2084 | 6210 | 1947 | 648 | 1590 | 2.40E−163 | sp:[LN:DXS_ECOLI] [AC:P77488] [GN:DXS] [OR:ESCHERICHIA COLI] [DE:1-DEOXYXYLULOSE-5-PHOSPHATE SYNTHASE (DXP SYNTHASE)] [SP:P77488] |

TABLE 2-continued

| Query | Orf | NT ID | AA ID | NT Lgth | AA Lgth | Score | P-value | Subject |
|---|---|---|---|---|---|---|---|---|
| Contig143G | 35975082_c3_866 | 2085 | 6211 | 348 | 115 | 386 | 9.10E−36 | sp:[LN:RL22_HAEIN] [AC:P44360] [GN:RPLV:RPL22:H10782] [OR:*HAEMOPHILUS INFLUENZAE*] [DE:50S RIBOSOMAL PROTEIN L22] [SP:P44360] |
| Contig143G | 36130292_f3_356 | 2086 | 6212 | 2094 | 697 | 1642 | 7.30E−169 | sp:[LN:SYGB_HAEIN] [AC:P43822] [GN:GLYS:H10924] [OR:*HAEMOPHILUS INFLUENZAE*] [EC:6.1.1.14] [DE:BETA CHAIN) (GLYRS)] [SP:P43822] |
| Contig143G | 36204386_c2_655 | 2087 | 6213 | 564 | 187 | 145 | 3.10E−10 | pir:[LN:C69895] [AC:C69895] [PN:conserved hypothetical protein yoaA] [GN:yoaA] [CL:hypothetical protein yoaA] [OR:*Bacitius subtilis*] |
| Contig143G | 36360687_f1_5 | 2088 | 6214 | 1554 | 517 | 1421 | 1.90E−145 | sp:[LN:YJGR_ECOLI] [AC:P39342] [GN:YJGR] [OR:*ESCHERICHIA COLI*] [DE:HYPOTHETICAL 54.3 KD PROTEIN IN PEPA-GNTV INTERGENIC REGION (F500)] [SP:P39342] |
| Contig143G | 3914068_c3_830 | 2089 | 6215 | 477 | 158 | | | NO-HIT |
| Contig143G | 3928167_f1_73 | 2090 | 6216 | 2568 | 855 | 1758 | 2.90E−183 | gp:[GI:g1763284] [LN:PAU73780] [AC:U73780] [PN:penicillin-binding protein 1A] [GN:ponA] [OR:*Pseudomonas aeruginosa*] [DE:*Pseudomonas aeruginosa* penicillin-binding protein 1A (ponA) gene,complete cds, and malic enzyme gene, partial cds.] [NT:penicillin-binding protein; PBP1A] |
| Contig143G | 3929137_f1_111 | 2091 | 6217 | 513 | 170 | 149 | 1.20E−10 | gp:[GI:g451544] [LN:GBU04267] [AC:U04267] [PN:proline-rich cell wall protein] [OR:*Gossypium barbadense*] [SR:sea-island cotton] [DE:*Gossypium barbedense* Sea Island proline-rich cell wall protein genecomplete cds.] |
| Contig143G | 3992702_c3_756 | 2092 | 6218 | 693 | 230 | 124 | 6.30E−06 | pir:[LN:S76625] [AC:S76625] [PN:hypothetical protein] [OR:Synechocystis sp.] [SR:PCC 6803, , PCC 6803] [SR:PCC 6803,] |
| Contig143G | 4009680_c1_528 | 2093 | 6219 | 387 | 128 | | | NO-HIT |
| Contig143G | 4009755_f2_185 | 2094 | 6220 | 606 | 201 | 549 | 4.90E−53 | sp:[LN:GCH2_ECOLI] [AC:P25523:P78147] [GN:RIBA] [OR:*ESCHERICHIA COLI*] [EC:3.5.4.25] [DE:GTP CYCLOHYDROLASE II,] [SP:P25523:P78147] |
| Contig143G | 4019131_c3_816 | 2095 | 6221 | 1638 | 545 | 164 | 7.20E−09 | gp:[GI:g1549377] [LN:SPU62616] [AC:U62616] [PN:putative membrane protein] [GN:del4] [OR:Synechococcus PCC7942] [DE:Synechococcus PCC7942 putative protein (dc11) gene, partial cds,and putative proteins (dc12), (dc13), (dc14) and (di33) genes,complete cds.] [NT:inactivation of this gene produced a] |
| Contig143G | 4072202_c2_720 | 2096 | 6222 | 657 | 218 | | | NO-HIT |
| Contig143G | 4079791_f2_193 | 2097 | 6223 | 510 | 169 | | | NO-HIT |
| Contig143G | 4100462_c3_799 | 2098 | 6224 | 621 | 206 | | | NO-HIT |
| Contig143G | 4103203_c2_684 | 2099 | 6225 | 897 | 298 | 258 | 3.30E−22 | pir:[LN:H70882] [AC:H70882] [PN:hypothetical protein Rv2777c] [GN:Rv2777c] [OR:*Mycobacterium tuberculosis*] |
| Contig143G | 4103437_c2_620 | 2100 | 6226 | 417 | 138 | 203 | 2.20E−16 | pir:[LN:E69653] [AC:E69653] [PN:transcription regulator of glyA trans IrpB] [GN:IrpB] [OR:*Bacillus subtilis*] |

TABLE 2-continued

| Query | Orf | NT ID | AA ID | NT Lgth | AA Lgth | Score | P-value | Subject |
|---|---|---|---|---|---|---|---|---|
| Contig143G | 4109468_c1_607 | 2101 | 6227 | 762 | 253 | 819 | 1.20E−81 | pir:[LN:R3EC3] [AC:H23129:A02699:S59051:E65124] [PN:ribosornal protein S3] [GN:rpsC] [CL:*Escherichia coli* ribosomal protein S3] [OR:*Escherichia coli*] [MP:73 min] |
| Contig143G | 4303777_f2_318 | 2102 | 6228 | 198 | 65 | | | NO-HIT |
| Contig143G | 4375893_f3_380 | 2103 | 6229 | 870 | 289 | 501 | 5.90E−48 | pir:[LN:E64818] [AC:E64818:169618] [PN:probable membrane protein ybiF] [GN:ybiF] [OR:*Escherichia coli*] |
| Contig143G | 437792_f3_422 | 2104 | 6230 | 198 | 65 | | | NO-HIT |
| Contig143G | 4428268_f2_174 | 2105 | 6231 | 774 | 257 | 488 | 1.40E−46 | sp:[LN:HMPA_ALCEU] [AC:P39662] [GN:FHP] [OR:*ALCALIGENES EUTROPHUS*] [DE:FLAVOHEMOPROTEIN (HAEMOGLOBIN-LIKE PROTEIN) (FLAVOHEMOGLOBIN)] [SP:P39662] |
| Contig143G | 4456583_c2_653 | 2106 | 6232 | 561 | 186 | 120 | 3.00E−06 | gp:[GI:e1312906:g3355680] [LN:SC1C2] [AC:AL031124] [PN:putative transcriptional regulator] [GN:SC1C2.13] [OR:*Streptomyces coelicolor*] [DE:*Streptomyces coelicolor* cosmid 1C2.] [NT:SC1C2.13, probable transcriptional regulator, len:] |
| Contig143G | 4459402_c3_798 | 2107 | 6233 | 189 | 62 | | | NO-HIT |
| Contig143G | 4502318_c1_570 | 2108 | 6234 | 984 | 327 | 872 | 2.90E−87 | gp:[GI:e1331951:g4106582] [LN:YP102KB] [AC:AL031866] [GN:aruE] [OR:*Yersinia pestis*] [DE:*Yersinia pestis* 102 kbases unstable region: from 1 to 119443.] [NT:ORF14, len:330. aruE, probable succinylglutamate] |
| Contig143G | 4557638_c3_762 | 2109 | 6235 | 351 | 116 | 284 | 5.90E−25 | sp:[LN:GLPM_PSEAE] [AC:P52112] [GN:GLPM] [OR:*PSEUDOMONAS AERUGINOSA*] [DE:MEMBRANE PROTEIN GLPM] [SP:P52112] |
| Contig143G | 4584653_c2_613 | 2110 | 6236 | 609 | 202 | 222 | 2.20E−18 | pir:[LN:E70654] [AC:E70654] [PN:hypothetical protein Rv3848] [GN:Rv3848] [OR:*Mycobacterium tuberculosis*] |
| Contig143G | 4587787_c1_557 | 2111 | 6237 | 780 | 259 | 361 | 4.10E−33 | sp:[LN:YCB9_PSEDE] [AC:P29942] [OR:*PSEUDOMONAS DENITRIFICANS*] [DE:HYPOTHETICAL 27.4 KD PROTEIN IN COBO 3'REGION (ORF9)] [SP:P29942] |
| Contig143G | 4687913_f1_41 | 2112 | 6238 | 213 | 70 | | | NO-HIT |
| Contig143G | 4704437_c3_745 | 2113 | 6239 | 834 | 277 | 660 | 8.40E−65 | pir:[LN:G70385] [AC:G70385] [PN:conserved hypothetical protein aq_990] [GN:aq_990] [OR:*Aquifex aeolicus*] |
| Contig143G | 4713942_c1_507 | 2114 | 6240 | 591 | 196 | 458 | 2.10E−43 | sp:[LN:SSB_ECOLI] [AC:P02339] [GN:SSB:EXRB:LEXC] [OR:*ESCHERICHIA COLI*] [DE:SINGLE-STRAND BINDING PROTEIN (SSB) (HELIX-DESTABILIZING PROTEIN)] [SP:P02339] |

TABLE 2-continued

| Query | Orf | NT ID | AA ID | NT Lgth | AA Lgth | Score | P-value | Subject |
|---|---|---|---|---|---|---|---|---|
| Contig143G | 4726552_f3_461 | 2115 | 6241 | 1143 | 380 | 394 | 1.30E-36 | sp:[LN:SSUD_BACSU] [AC:P40402] [GN:SSUD] [OR:*BACILLUS SUBTILIS*] [EC:1.1.—.—] [DE:PUTATIVE ALIPHATIC SULFONATE MONOOXYGENASE,] [SP:P40402] |
| Contig143G | 47327_c1_534 | 2116 | 6242 | 2202 | 733 | 731 | 2.50E-72 | pir:[LN:B70979] [AC:B70979] [PN:hypothetical protein Rv3273] [GN:Rv3273] [OR:*Mycobacterium tuberculosis*] |
| Contig143G | 4767787_c2_728 | 2117 | 6243 | 195 | 64 | | | NO-HIT |
| Contig143G | 4783193_f1_102 | 2118 | 6244 | 1524 | 507 | 1995 | 2.90E-206 | gp:[GI:g3249555] [LN:AF010184] [AC:AF010184] [PN:coenzyme A transferase PsecoA [GN:psecoA] [OR:*Pseudomonas aeruginosa*] [DE:*Pseudomonas aeruginosa* coenzyme A transferase PsecoA (psecoA) gene,complete cds.] [NT: located downstream of the A-band polysaccharide] |
| Contig143G | 4800303_f3_432 | 2119 | 6245 | 699 | 232 | 800 | 1.20E-79 | sp:[LN:AQPZ_ECOLI] [AC:P48838:P75827:Q47159] [GN:AQPZ:BNIP] [OR:*ESCHERICHIA COLI*] [DE:AQUAPORIN Z (BACTERIAL NODULIN-LIKE INTRINSIC PROTEIN)] [SP:P48838:P75827:Q47159] |
| Contig143G | 4804703_c1_595 | 2120 | 6246 | 402 | 133 | 124 | 5.30E-08 | pir:[LN:D69663] [AC:D69663] [PN:mutator protein mutT] [GN:mutT] [CL:mutT domain homotogy] [OR:*Bacillus subtilis*] |
| Contig143G | 4859755_f1_389 | 2121 | 6247 | 315 | 104 | 185 | 1.80E-14 | sp:[LN:RPOZ_ECOLI] [AC:P08374] [GN:RPOZ] [OR:*ESCHERICHIA COLI*] [EC:2.7.7.6] [DE:OMEGA CHAIN) (RNA POLYMERASE OMEGA SUBUNIT)] [SP:P08374] |
| Contig143G | 4860968_c2_646 | 2122 | 6248 | 1302 | 433 | 1338 | 1.20E-136 | sp:[LN:GOAG_ECOLI] [AC:P50457:P78150] [GN:GOAG] [OR:*ESCHERICHIA COLI*] [EC:2.6.1.19] [DE:TRANSAMINASE) (GABA AMINOTRANSFERASE)] [SP:P50457:P78150] |
| Contig143G | 4870658_f1_21 | 2123 | 6249 | 333 | 110 | | | NO-HIT |
| Contig143G | 4882202_c1_489 | 2124 | 6250 | 1701 | 566 | 1244 | 1.10E-126 | sp:[LN:RECJ_HAEIN] [AC:P45112] [GN:RECJ:H11214] [OR:*HAEMOPHILUS INFLUENZAE*] [EC:3.1.—.—] [DE:SINGLE-STRANDED-DNA-SPECIFIC EXONUCLEASE RECJ.] [SP:P45112] |
| Contig143G | 4884702_c2_711 | 2125 | 6251 | 312 | 103 | | | NO-HIT |
| Contig143G | 4894050_f2_285 | 2126 | 6252 | 261 | 86 | | | NO-HIT |
| Contig143G | 4960952_c3_803 | 2127 | 6253 | 1002 | 333 | 1096 | 5.30E-111 | gp:[GI:g4323056] [LN:AF098509] [AC:AF098509] [PN:putative sulfur-binding protein] [GN:sbp] [OR:*Enterobacter cloacae*] [DE:*Enterobacter cloacae* phosphofructokinase (pfkA), putativesulfur-binding protein (sbp), putative CDP-diglyceride hydrotase(cdh), and triose phosphate isomerase (tpi) genes, complete cds;and unknown genes.] |
| Contig143G | 505062_f1_64 | 2128 | 6254 | 306 | 101 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig143G | 5117012_f3_424 | 2129 | 6255 | 573 | 190 | 115 | 4.80E−07 | sp:[LN:YHAI_ECOLI] [AC:P42622] [GN:YHAI] [OR:*ESCHERICHIA COLI*] [DE:HYPOTHETICAL 13.5 KD PROTEIN IN EXUR-TDCC INTERGENIC REGION]. [SP:P42622] |
| Contig143G | 5134375_f3_334 | 2130 | 6256 | 450 | 149 | 266 | 4.70E−23 | pir:[LN:C69825] [AC:C69825] [PN:conserved hypothetical protein vhdE] [GN:yhdE] [CL:hypothetical protein b2531] [OR:*Bacillus subtilis*] |
| Contig143G | 516917_c2_700 | 2131 | 6257 | 399 | 132 | | | NO-HIT |
| Contig143G | 5214153_c1_492 | 2132 | 6258 | 1071 | 356 | 829 | 1.00E−82 | gp:[GI:e1173375:g2623967] [LN:ARGTR] [AC:Y13942] [PN:GTN Reductase] [GN:nerA] [FN:Liberates nitrite from nitroglycerine and] [OR:*Agrobacterium radiobacter*] [DE:*Agrobacterium radiobacter* genomic DNA for glycerol trinitratereductase.] |
| Contig143G | 5257693_c2_678 | 2133 | 6259 | 618 | 205 | 263 | 9.90E−23 | pir:[LN:S77729] [AC:S77729] [PN:timbrial assembly protein pilP precursor] [GN:pilP] [OR:*Pseudomonas aeruginosa*] |
| Contig143G | 5275002_f1_112 | 2134 | 6260 | 210 | 69 | | | NO-HIT |
| Contig143G | 5282838_c1_574 | 2135 | 6261 | 294 | 97 | | | NO-HIT |
| Contig143G | 5349062_c1_520 | 2136 | 6262 | 1128 | 375 | 262 | 1.30E−22 | sp:[LN:NUCI_CUNEE] [AC:P81203] [GN:NUCICE] [OR:*CUNNINGHAMELLA ECHINULATA VARECHINULATA*] [EC:3.1.30.—] [DE:NUCLEASE CI,] [SP:P81203] |
| Contig143G | 5351457_f2_314 | 2137 | 6263 | 786 | 261 | | | NO-HIT |
| Contig143G | 548128_f1_119 | 2138 | 6264 | 219 | 72 | | | NO-HIT |
| Contig143G | 5864080_c1_502 | 2139 | 6265 | 1815 | 604 | 314 | 1.00E−26 | pir:lLN:H70302] [AC:H70302] [PN:conserved hypothetical protein aq_035] [GN:aq_035] [OR:*Aquifex aeolicus*] |
| Contig143G | 5978383_c1_545 | 2140 | 6266 | 1503 | 500 | 764 | 8.00E−76 | sp:[LN:MURE_HAEIN] [AC:P45060] [GN:MURE:H11133] [OR:*HAEMOPHILUS INFLUENZAE*] [EC:6.3.2.13] [DE:(EC 6.32.13) (UDP-N-ACETYLMURAMYL-TRIPEPTIDE SYNTHETASE)] [SP:P45060] |
| Contig143G | 5978417_c3_811 | 2141 | 6267 | 879 | 292 | | | NO-HIT |
| Contig143G | 5992890_f1_88 | 2142 | 6268 | 351 | 116 | | | NO-HIT |
| Contig143G | 6034450_c1_599 | 2143 | 6269 | 966 | 321 | 620 | 1.50E−60 | pir:[LN:D64775] [AC:D64775:JH04-1:PS0216] [PN:acyl-COA thiolesterase, II precursor] [GN:tesB] [CL:acyl-CoA thiolesterase II] [OR:*Escherichia coli*] [EC:3.1.2.—] |
| Contig143G | 6126538_c3_808 | 2144 | 6270 | 1068 | 355 | 973 | 5.70E−98 | gp:[GI:g895925] [LN:PSEPONA] [AC:L28837] [PN:membrane protein] [GN:pitM] [FN:apparent membrane protein required in pilus] [OR:*Pseudomonas syringae*] [SR:*Pseudomonas syringae* (pathovar phaseolicola, strain HBIOY) DNA] [DE:*Pseudomonas syringae* penicillin binding protein (ponA), membraneproteins (pitN, pitO) pilus expression proteins (pitM, pitP)genes, complete cds and pilus expression protein (pilQ) gene,partial cds.] [NT:putative; ORF 1] |

TABLE 2-continued

| Query | Orf | NT ID | AA ID | NT Lgth | AA Lgth | Score | P-value | Subject |
|---|---|---|---|---|---|---|---|---|
| Contig143G | 6288908_c1_506 | 2145 | 6271 | 1452 | 483 | 890 | 3.60E−89 | sp:[LN:YAJR_ECOLI] [AC:P77726] [GN:YAJR] [OR:*ESCHERICHIA COLI*] [DE:HYPOTHETICAL 49.0 KD PROTEIN IN ABPA-CYOE INTERGENIC REGION] [SP:P77726] |
| Contig143G | 6297067_f2_319 | 2146 | 6272 | 990 | 329 | 349 | 7.60E−32 | pir:[LN:A69443] [AC:A69443] [PN:conserved hypothetical protein AF1546] [OR:*Archaeoglobus fulgidus*] |
| Contig143G | 635305_c3_800 | 2147 | 6273 | 1272 | 423 | 536 | 2.30E−56 | sp:[LN:CZCB_ALCEU] [AC:P13510] [GN:CZCB] [OR:*ALCALIGENES EUTROPHUS*] [DE:PROTEIN CZCB)] [SP:P13510] |
| Contig143G | 6382812_f3_374 | 2148 | 6274 | 2160 | 719 | 1538 | 7.70E−158 | sp:[LN:YCCS_ECOLI] [AC:P75870] [GN:YCCS] [OR:*ESCHERICHIA COLI*] [DE:HYPOTHETICAL 82.0 KD PROTEIN IN SULA-HELD INTERGENIC REGION] [SP:P75870] |
| Contig143G | 641928_f2_280 | 2149 | 6275 | 189 | 62 | | | NO-HIT |
| Contig143G | 6453337_c1_569 | 2150 | 6276 | 1410 | 469 | 1580 | 2.70E−162 | gp:[GI:e1331952:g4106583] [LN:YP102KB] [AC:AL031866] [GN:aruB] [OR:*Yersinia pestis*] [DE:*Yersinia pestis* 102 kbases unstable region: from 1 to 119443.] [NT:ORF15,ten: 447, aruB, probable succinylarginine] |
| Contig143G | 664076_c2_686 | 2151 | 6277 | 510 | 169 | 372 | 2.80E−34 | gp:[GI:g2801829] [LN:AF042829] [AC:AF042829] [PN:fimbrillin] [GN:fimA] [OR:*Xanthomonas citri*] [DE:*Xanthomonas citri* fimbrillin (timA) gene, complete cds.] |
| Contig143G | 6640937_c2_689 | 2152 | 6278 | 504 | 167 | 125 | 4.10E−08 | gp:[GI:g1161221] [LN:PSEPILRV] [AC:L48934] [GN:fimU] [OR:*Pseudomonas aeruginosa*] [DE:*Pseudomonas aeruginosa* (isolate pRIC351) pilR gene, 3' end of cds,dada*, fimT, fimU and pilV genes, complete cds.] [NT:contains pre-pilin like leader sequence; involved] |
| Contig143G | 6641937_c3_855 | 2153 | 6279 | 906 | 301 | 126 | 1.30E−05 | sp:[LN:YEEZ_ECOLI] [AC:P76370] [GN:YEEZ] [OR:*ESCHERICHIA COLI*] [DE:HYPOTHETICAL 29.7 KD PROTEIN IN SBCB-HISL INTERGENIC REGION PRECURSOR] [SP:P76370] |
| Contig143G | 6728383_c1_513 | 2154 | 6280 | 426 | 141 | 94 | 0.00028 | gp:[GI:e1132704:g2408054] [LN:SPAC29B12] [AC:Z99164] [PN:hypothetical protein] [GN:SPAC29B12.13] [OR:*Schizosaccharomyces pombe*] [SR:fission yeast] [DE:*S.pombe* chromosome I cosmid c29B12.] [NT:SPAC29B12.13, unknown, len:13] |
| Contig143G | 672917_f2_175 | 2155 | 6281 | 669 | 222 | 245 | 8.00E−21 | sp:[LN:COMF_HAEIN] [AC:P31773] [GN:COMF:H10434] [OR:*HAEMOPHILUS INFLUENZAE*] [DE:COM101A)] [SP:P31773] |
| Contig143G | 6739416_f1_52 | 2156 | 6282 | 1290 | 429 | 1364 | 2.10E−139 | sp:[LN:SERA_HAEIN] [AC:P43885] [GN:SERA:H10465] [OR:*HAEMOPHILUS INFLUENZAE*] [EC:1.1.1.95] [DE:D-3-PHOSPHOGLYCERATE DEHYDROGENASE, (PGDH)] [SP:P43885] |

TABLE 2-continued

| Query | Orf | NT ID | AA ID | NT Lgth | AA Lgth | Score | P-value | Subject |
|---|---|---|---|---|---|---|---|---|
| Contig143G | 6775018_c2_692 | 2157 | 6283 | 435 | 144 | 153 | 4.50E−11 | pir:[LN:S54700] [AC:S54700] [PN:PilE protein] [OR:*Pseudomonas aeruginosa*] |
| Contig143G | 6835327_c3_807 | 2158 | 6284 | 333 | 110 | | | NO-HIT |
| Contig143G | 6912500_f2_261 | 2159 | 6285 | 711 | 236 | | | NO-HIT |
| Contig143G | 6928563_f3_339 | 2160 | 6286 | 2589 | 862 | 1252 | 1.60E−127 | pir:[LN:XUECAG] [AC:A00565:C42956:H65211] [PN:glycerol-3-phosphate O-acyltransferase,] [GN:plsB] [CL:glycerol-3-phosphate acyltransferase] [OR:*Escherichia coli*] [EC:2.3.1.15] [MP:92 min] |
| Contig143G | 7220417_c2_722 | 2161 | 6287 | 2328 | 775 | 130 | 0.00039 | gp:[GI.g1141790] [LN:DMU35816] [AC:U35816] [PN:nonmuscle myosin-II heavy chain] [GN:zip] [OR:*Drosophila melanogaster*] [SR:fruit fly] [DE:*Drosophila melanogaster* nonmuscle myosin-II heavy chain (zip) gene,complete cds.] |
| Contig143G | 781627_c3_783 | 2162 | 6288 | 426 | 141 | | | NO-HIT |
| Contig143G | 801052_f2_270 | 2163 | 6289 | 672 | 223 | 201 | 7.90E−15 | gp:[GI:g3851581] [LN:AF091216] [AC:AF091216] [PN:Wrn protein] [GN:Wrn] [OR:*Mus musculus*] [SR:house mouse] [DE:*Mus musculus* Wrn protein (Wrn) gene, complete, cds.] |
| Contig143G | 860662_f1_106 | 2164 | 6290 | 210 | 69 | | | NO-HIT |
| Contig143G | 901092_f1_57 | 2165 | 6291 | 261 | 86 | | | NO-HIT |
| Contig143G | 970000_f2_284 | 2166 | 6292 | 246 | 81 | | | NO-HIT |
| Contig143G | 977162_f1_125 | 2167 | 6293 | 258 | 85 | | | NO-HIT |
| Contig143G | 978452_f3_336 | 2168 | 6294 | 951 | 316 | 498 | 1.20E−47 | pir:[LN:H70882] [AC.H70882] [PN:hypothetical protein Rv2777c] [GN:Rv2777c] [OR:*Mycobacterium tuberculosis*] |
| Contig143G | 9808333_f1_67 | 2169 | 6295 | 213 | 70 | | | NO-HIT |
| Contig143G | 9853412_c1_536 | 2170 | 6296 | 1419 | 472 | 223 | 9.90E−16 | pir:[LN:JC4698] [AC:JC4698] [PN:divalent cation resistant determinant protein C] [GN:czcC] [OR:Alcaligenes sp.] |
| Contig143G | 994651_c1_486 | 2171 | 6297 | 1494 | 497 | 2416 | 7.00E−251 | sp:[LN:IMDH_ACICA] [AC:P31002] [GN:GUAB] [OR:*ACINETOBACTER CALCOACETICUS*] [EC:1.1.1.205] [DE:DEHYDROGENASE) (IMPDH) (IMPD)] [SP:P31002] |
| Contig143G | 9957327_f1_24 | 2172 | 6298 | 255 | 84 | 156 | 2.10E−11 | pir:[LN:E70043] [AC:E70043] [PN:hypothetical protein yvlC] [GN:yvlC] [OR:*Bacillus subtilis*] |
| Contig144G | 10972025_c1_12 | 2173 | 6299 | 540 | 179 | 580 | 2.50E−56 | pir:[LN:R5EC6] [AC:D65123:A02765] [PN:ribosomal protein L6] [GN:rplF] [CL:*Escherichia coli* ribosomal protein L6] [OR:*Escherichia coli*] [MP:73 min] |
| Contig144G | 10992630_c2_18 | 2174 | 6300 | 1383 | 461 | 1294 | 5.50E−132 | sp:[LN:SECY_ECOLI] [AC:P03844] [GN:SECY:PRLA] [OR:*ESCHERICHIA COLI*] [DE:PREPROTEIN TRANSLOCASE SECY SUBUNIT] [SP:P03844] |
| Contig144G | 16992253_c1_10 | 2175 | 6301 | 549 | 182 | 674 | 2.80E−66 | pir:[LN:H64093] [AC:H64093] [PN:ribosomal protein L5] [CL:*Escherichia coli* ribosomal protein L5] [OR:*Haemophilus influenzae*] |
| Contig144G | 2072158_c2_17 | 2176 | 6302 | 444 | 147 | 502 | 4.60E−48 | sp:[LN:RL15_HAEIN] [AC:P44353] [GN:RPLO:RPL15:HI0797] [OR:*HAEMOPHILUS INFLUENZAE*] [DE:50S RIBOSOMAL PROTEIN L15] [SP:P44353] |

TABLE 2-continued

| Query | Orf | NT ID | AA ID | NT Lgth | AA Lgth | Score | P-value | Subject |
|---|---|---|---|---|---|---|---|---|
| Contig144G | 22689702_c3_19 | 2177 | 6303 | 396 | 131 | 429 | 2.50E−40 | pir:[LN:A64094] [AC:A64094] [PN:ribosomal protein S8] [CL:*Escherichia coli* ribosomal protein S8] [OR:*Haemophilus influenzae*] |
| Contig144G | 24644055_c2_16 | 2178 | 6304 | 183 | 60 | 193 | 2.60E−15 | sp:[LN:RL30_ACYKS] [AC:P46184] [GN:RPMD] [OR:ACYRTHOSIPHON KONDOI SYMBIOTIC BACTERIUM] [DE:50S RIBOSOMAL PROTEIN L30] [SP:P46184] |
| Contig144G | 34023563_c3_20 | 2179 | 6305 | 375 | 124 | 334 | 2.90E−30 | sp:[LN:RL18_VIBPR] [AC:P52863] [GN:RPLR] [OR:*VIBRIO PROTEOLYTICUS*] [SR:,*AEROMONAS PROTEOLYTICA*] [DE:50S RIBOSOMAL PROTEIN L18] [SP:P52863] |
| Contig144G | 35183342_c2_15 | 2180 | 6306 | 519 | 172 | 613 | 8.00E−60 | pir:[LN:R3EC5] [AC:B65123:A02707] [PN:ribosomal protein S5] [GN:rpsE] [CL:*Escherichia coli* ribosomal protein S5] [OR:*Escherichia coli*] [MP:73 min] |
| Contig144G | 4112963_c1_11 | 2181 | 6307 | 315 | 104 | 324 | 3.40E−29 | pir:[LN:R3EC14] [AC:F65123:A02732] [PN:ribosomal protein S14] [GN:rpsN] [CL:*Escherichia coli* ribosomal protein S14] [OR:*Escherichia coli*] [MP:73 min] |
| Contig145G | 10975428_c1_102 | 2182 | 6308 | 651 | 216 | 358 | 6.70E−45 | sp:[LN:MIAE_SALTY] [AC:Q08015] [GN:MIAE] [OR:*SALMONELLA TYPHIMURIUM*] [EC:1.—.—.—] [DE:TRNA-(MS[2]IO[6]A)-HYDROXYLASE,] [SP:Q08015] |
| Contig145G | 11128593_c2_116 | 2183 | 6309 | 1101 | 366 | 860 | 5.40E−86 | sp:[LN:ERA_ECOLI] [AC:P06616] [GN:ERA:RBAA] [OR:*ESCHERICHIA COLI*] [DE:GTP-BINDING PROTEIN ERA] SP:P06616] |
| Contig145G | 11750001_f2_51 | 2184 | 6310 | 591 | 196 | 346 | 1.60E−31 | gp:[GI:e327826:g2251192] [LN:PAOPRLGN] [AC:Z50191] [PN:outer membrane protein] [GN:oprL] [OR:*Pseudomonas aeruginosa*] [DE:*P.aeruginosa* oprL gene.] |
| Contig145G | 1182157_c3_127 | 2185 | 6311 | 681 | 226 | 320 | 9.00E−29 | pir:[LN:S77001] [AC:S77001] [PN:hypothetical protein slr0787] [CL:mutT domain homology] [OR:Synechocystis sp.] [SR:PCC 6803,, PCC 6803] [SR:PCC 6803,] |
| Contig145G | 11974168_f2_27 | 2186 | 6312 | 1371 | 456 | 1494 | 3.50E−153 | sp:[LN:NADB_PSEAE] [AC:Q51363:Q51412] [GN:NADB] [OR:*PSEUDOMONAS AERUGINOSA*] [EC:1.4.3.16] [DE:L-ASPARTATE OXIDASE, (QUINOLINATE SYNTHETASE B)] [SP:Q51363:Q51412] |
| Contig145G | 14734692_f3_75 | 2187 | 6313 | 741 | 246 | 512 | 4.10E−49 | sp:[LN:TOLQ_PSEAE] [AC:P50598] [GN:TOLQ] [OR:*PSEUDOMONAS AERUGINOSA*] [DE:TOLQ PROTEIN] [SP:P50598] |

TABLE 2-continued

| Query | Orf | NT ID | AA ID | NT Lgth | AA Lgth | Score | P-value | Subject |
|---|---|---|---|---|---|---|---|---|
| Contig145G | 15660767_c1_91 | 2188 | 6314 | 3885 | 1294 | 3770 | 0 | sp:[LN:PURL_ECOLI] [AC:P15254:P78097] [GN:PURL:PURI] [OR:*ESCHERICHIA COLI*] [EC:6.3.5.3] [DE:SYNTHASE) (FORMYLGLYCINAMIDE RIBOTIDE AMIDOTRANSFERASE) (FGARAT)] [SP:P15254:P78097] |
| Contig145G | 19766932_c2_112 | 2189 | 6315 | 1461 | 486 | 964 | 5.10E−97 | gp:[GI:g1184684] [LN:PAU32853] [AC:U32853] [PN:MucD] [GN:mucD] [OR:*Pseudomonas aeruginosa*] [DE:*Pseudomonas aeruginosa* mucC and mucD genes, complete cds.] [NT:HtrA serine protease homolog; similar to *E. coli*] |
| Contig145G | 19961562_c1_93 | 2190 | 6316 | 822 | 273 | | | NO-HIT |
| Contig145G | 2000025_f1_8 | 2191 | 6317 | 639 | 212 | 200 | 4.70E−16 | gp:[GI:e1264045:g2959318] [LN:CBFMS] [AC:Z96934] [PN:hypothetical protein] [OR:*Clostridium beijerinckii*] [DE:*Clostridium beijerinckii* fms gene.] RE: |
| Contig145G | 21489077_f3_66 | 2192 | 6318 | 924 | 307 | 848 | 1.00E−84 | sp:[LN:CBL_KLEAE] [AC:Q08598] [GN:CBL] [OR:*KLEBSIELLA AEROGENES*] [DE:TRANSCRIPTIONAL REGULATOR CBL] [SP:Q08598] |
| Contig145G | 22682052_f2_25 | 2193 | 6319 | 201 | 66 | | | NO-HIT |
| Contig145G | 22790906_c2_114 | 2194 | 6320 | 1821 | 606 | 2286 | 4.20E−237 | sp:[LN:LEPA_ECOLI] [AC:P07682:P76590] [GN:LEPA] [OR:*ESCHERICHIA COLI*] [DE:GTP-BINDING PROTEIN LEPA] [SP:P07682:P76590] |
| Contig145G | 23634633_f2_49 | 2195 | 6321 | 1407 | 468 | 449 | 2.60E−41 | pir:[LN:A44937] [AC:A44937:S27855] [PN:kinetoplast-associated protein:probable structural protein KAP] [CL:kinetoplast-associated protein] [OR:*Trypanosoma cruzi*] |
| Contig145G | 23989426_f2_50 | 2196 | 6322 | 1332 | 443 | 733 | 1.50E−72 | gp:[GI:g1685080] [LN:HIU32470] [AC:U32470] [PN:TolB] [OR:*Haemophilus influenzae*] [DE:*Haemophilus influenzae* tolQRAB gene cluster, inner membrane protein(tolQ) gene, partial cds, inner membrane protein (tolR), outermembrane integrity protein (tolA) and colicin tolerance protein(tolB) genes, complete cds.] NT:colicin tolerance protein; similar to *E. coli* TolB,] |
| Contig145G | 24473813_c3_119 | 2197 | 6323 | 306 | 101 | | | NO-HIT |
| Contig145G | 246017_c2_113 | 2198 | 6324 | 462 | 153 | 119 | 1.80E−07 | pir:[LN:B71359] [AC:B71359] [PN:conserved hypothetical protein TP0156] [GN:TP0156] [OR:*Treponema pallidum* subsp. *pallidum*] [SR:, syphilis spirochete] |
| Contig145G | 24632628_c3_143 | 2199 | 6325 | 798 | 265 | 845 | 2.10E−84 | sp:[LN:YDFG_HAEIN] [AC:P45200] [GN:HI1430] [OR:*HAEMOPHILUS INFLUENZAE*] [EC:1.—.—.—] [DE:HYPOTHETICAL OXIDOREDUCTASE HI1430,] [SP:P45200] |
| Contig145G | 24667833_c3_134 | 2200 | 6326 | 183 | 60 | | | NO-HIT |
| Contig145G | 24692137_f1_69 | 2201 | 6327 | 594 | 197 | 176 | 1.60E−13 | pir:[LN:C69870] [AC:C69870] [PN:conserved hypothetical protein ykwD] [GN:ykwD] [OR:*Bacillus subtilis*] |

TABLE 2-continued

| Query | Orf | NT ID | AA ID | NT Lgth | AA Lgth | Score | P-value | Subject |
|---|---|---|---|---|---|---|---|---|
| Contig145G | 24703402_f2_39 | 2202 | 6328 | 696 | 231 | 542 | 2.70E−52 | pir:[LN:S75967] [AC:S75967] [PN:hypothetical protein] [CL:conserved hypothetical protein HI1191] [OR:Synechocystis sp.] [SR:PCC 6803,, PCC 6803] [SR:PCC 6803,] |
| Contig145G | 24881650_f1_9 | 2203 | 6329 | 1080 | 359 | 913 | 1.30E−91 | sp:[LN:CYSA_ECOLI] [AC:P16676:P77693] [GN:CYSA] [OR:*ESCHERICHIA COLI*] [DE:SULFATE TRANSPORT ATP-BINDING PROTEIN CYSA] [SP:P16676:P77693] |
| Contig145G | 25478438_f2_40 | 2204 | 6330 | 465 | 154 | 277 | 3.20E−24 | pir:[LN:S74552] [AC:S74552] [PN:bacterioferritin comigratory protein bcp:hypothetical protein slr0242:hypothetical protein slr0242] [GN:bcp] [CL:bacterioferritin comigratory protein:alkyl hydroperoxidase c22 protein homology] [OR:Synechocystis sp.] [SR:PCC 6803,, PCC 6803] [SR:PCC 6803,] |
| Contig145G | 25595277_f1_17 | 2205 | 6331 | 1029 | 342 | 1226 | 8.80E−125 | sp:[LN:RUVB_PSEAE] [AC:Q51426] [GN:RUVB] [OR:*PSEUDOMONAS AERUGINOSA*] [DE:HOLLIDAY JUNCTION DNA HELICASE RUVB] [SP:Q51426] |
| Contig145G | 25912812_f3_81 | 2206 | 6332 | 717 | 238 | 123 | 3.90E−06 | sp:[LN:SIGX_BACSU] [AC:P35165] [GN:SIGX] [OR:*BACILLUS SUBTILIS*] [DE:RNA POLYMERASE SIGMA FACTOR SIGX] [SP:P35165] |
| Contig145G | 26353408_f3_68 | 2207 | 6333 | 561 | 186 | 278 | 2.50E−24 | pir:[LN:H69339] [AC:H69339] [PN:conserved hypothetical protein AF0720] [OR:*Archaeoglobus fulgidus*] |
| Contig145G | 26610143_c3_140 | 2208 | 6334 | 834 | 277 | 333 | 6.60E−52 | sp:[LN:LEP_SALTY] [AC:P23697] [GN:LEPB] [OR:*SALMONELLA TYPHIMURIUM*] [EC:3.4.21.89] [DE:SIGNAL PEPTIDASE I, (SPASE I) (LEADER PEPTIDASE I)] [SP:P23697] |
| Contig145G | 26803902_f1_21 | 2209 | 6335 | 339 | 112 | | | NO-HIT |
| Contig145G | 26804706_c2_115 | 2210 | 6336 | 420 | 139 | | | NO-HIT |
| Contig145G | 29407913_c3_117 | 2211 | 6337 | 1146 | 381 | | | NO-HIT |
| Contig145G | 30131288_f1_19 | 2212 | 6338 | 540 | 179 | 222 | 2.20E−18 | sp:[LN:YBGC_HAEIN] [AC:P44679] [GN:HI0386] [OR:*HAEMOPHILUS INFLUENZAE*] [DE:HYPOTHETICAL PROTEIN HI0386] [SP:P44679] |
| Contig145G | 30161312_f2_53 | 2213 | 6339 | 426 | 141 | | | NO-HIT |
| Contig145G | 32134637_f1_20 | 2214 | 6340 | 1029 | 342 | 874 | 1.80E−87 | sp:[LN:F16P_ALCEU] [AC:P19911] [GN:CBBFC:CFXF] [OR:*ALCALIGENES EUTROPHUS*] [EC:3.1.3.11] [DE:1,6-BISPHOSPHATE 1-PHOSPHOHYDROLASE) (FBPASE)] [SP:P19911] |
| Contig145G | 3256442_f1_7 | 2215 | 6341 | 1068 | 355 | 1118 | 2.50E−113 | pir:[LN:BYEC] [AC:S40860:H65197:B25206:A94501:A23719:S78618] [PN:sulphate binding protein precursor, periplasmic:sulfate starvation-induced protein SSI2] [GN:sbp] [CL:sulfate-binding protein] [OR:*Escherichia coli*] [MP:88 min] |
| Contig145G | 3322287_f3_76 | 2216 | 6342 | 843 | 280 | 139 | 4.20E−07 | pir:[LN:S27846] [AC:S27846] [PN:hypothetical protein] [OR:*Trypanosoma brucei*] |

TABLE 2-continued

| Query | Orf | NT ID | AA ID | NT Lgth | AA Lgth | Score | P-value | Subject |
|---|---|---|---|---|---|---|---|---|
| Contig145G | 33417167_f3_70 | 2217 | 6343 | 816 | 271 | 331 | 6.10E−30 | gp:[GI:e1351730:g3878905] [LN:CER06F6] [AC:Z46794] [GN:R06F6.9] [OR:*Caenorhabditis elegans*] [DE:*Caenorhabditis elegans* cosmid R06F6, complete sequence.] [NT:similarity to enoyl CoA hydratase. Amino terminus] |
| Contig145G | 34063376_f2_33 | 2218 | 6344 | 930 | 309 | 770 | 1.90E−76 | sp:[LN:CYSW_SYNY3] [AC:P74547] [GN:CYSW:SLR1454] [OR:SYNECHOCYSTIS SP] [SR:PCC 6803,] [DE:SULFATE TRANSPORT SYSTEM PERMEASE PROTEIN CYSW] [SP:P74547] |
| Contig145G | 34100317_c3_136 | 2219 | 6345 | 429 | 142 | | | NO-HIT |
| Contig145G | 34259386_c3_141 | 2220 | 6346 | 708 | 235 | 615 | 4.90E−60 | sp:[LN:RNC_ECOLI] [AC:P05797:P06141] [GN:RNC] [OR:*ESCHERICHIA COLI*] [EC:3.1.26.3] [DE:RIBONUCLEASE III, (RNASE III)] [SP:P05797:P06141] |
| Contig145G | 35157041_f3_80 | 2221 | 6347 | 798 | 265 | 286 | 3.60E−25 | sp:[LN:YG73_SYNY3] [AC:P74261] [GN:SLR1673] [OR:SYNECHOCYSTIS SP] [SR:PCC 6803,] [EC:2.1.1.—] [DE:HYPOTHETICAL TRNA/RRNA METHYLTRANSFERASE SLR1673,] [SP:P74261] |
| Contig145G | 35760927_c3_135 | 2222 | 6348 | 831 | 276 | 350 | 5.90E−32 | sp:[LN:PABC_ECOLI] [AC:P28305] [GN:PABC] [OR:*ESCHERICHIA COLI*] [EC:4.—.—.—] [DE:4-AMINO-4-DEOXYCHORISMATE LYASE, (ADC LYASE)] [SP:P28305] |
| Contig145G | 36601553_f2_26 | 2223 | 6349 | 315 | 104 | 262 | 6.90E−22 | sp:[LN:NADB_PSEAE] [AC:Q51363:Q51412] [GN:NADB] [OR:*PSEUDOMONAS AERUGINOSA*] [EC:1.4.3.16] [DE:L-ASPARTATE OXIDASE, (QUINOLINATE SYNTHETASE B)] [SP:Q51363:Q51412] |
| Contig145G | 3906263_c1_101 | 2224 | 6350 | 735 | 244 | 760 | 2.10E−75 | sp:[LN:PDXJ_ECOLI] [AC:P24223] [GN:PDXJ] [OR:*ESCHERICHIA COLI*] [DE:PYRIDOXAL PHOSPHATE BIOSYNTHETIC PROTEIN PDXJ] [SP:P24223] |
| Contig145G | 3914053_f3_67 | 2225 | 6351 | 426 | 141 | | | NO-HIT |
| Contig145G | 3942580_f2_48 | 2226 | 6352 | 528 | 175 | 255 | 6.90E−22 | pir:[LN:A71687] [AC:A71687] [PN:tolR protein (tolR) RP310] [GN:tolR:RP310] [OR:*Rickettsia prowazekii*] |
| Contig145G | 3961378_c2_106 | 2227 | 6353 | 189 | 62 | | | NO-HIT |
| Contig145G | 4035637_f2_46 | 2228 | 6354 | 609 | 202 | 470 | 1.10E−44 | sp:[LN:RUVA_PSEAE] [AC:Q51425] [GN:RUVA] [OR:*PSEUDOMONAS AERUGINOSA*] [DE:HOLLIDAY JUNCTION DNA HELICASE RUVA] [SP:Q51425] |
| Contig145G | 4071011_c3_142 | 2229 | 6355 | 693 | 230 | 254 | 8.90E−22 | sp:[LN:RECO_COXBU] [AC:P51838] [GN:RECO] [OR:*COXIELLA BURNETII*] [DE:DNA REPAIR PROTEIN RECO HOMOLOG] [SP:P51838] |
| Contig145G | 4120263_f1_18 | 2230 | 6356 | 1344 | 447 | 630 | 1.30E−61 | pir:[LN:G71097] [AC:G71097] [PN:probable amidohydrolase] [GN:PH1043] [OR:*Pyrococcus horikoshii*] |

TABLE 2-continued

| Query | Orf | NT ID | AA ID | NT Lgth | AA Lgth | Score | P-value | Subject |
|---|---|---|---|---|---|---|---|---|
| Contig145G | 429640_f1_10 | 2231 | 6357 | 858 | 285 | 1074 | 1.10E−108 | sp:[LN:DAPD_ECOLI] [AC:P03948] [GN:DAPD] [OR:*ESCHERICHIA COLI*] [EC:2.3.1.117] [DE:(THP SUCCINYLTRANSFERASE) (TETRAHYDROPICOLINATE SUCCINYLASE)] [SP:P03948] |
| Contig145G | 4305277_c1_98 | 2232 | 6358 | 1086 | 361 | 612 | 1.00E−59 | sp:[LN:YCEG_HAEIN] [AC:P44720] [GN:HI0457] [OR:*HAEMOPHILUS INFLUENZAE*] [DE:HYPOTHETICAL PROTEIN HI0457] [SP:P44720] |
| Contig145G | 4329693_f3_65 | 2233 | 6359 | 843 | 280 | 727 | 6.70E−72 | sp:[LN:CYST_SYNY3] [AC:Q01895] [GN:CYST:SLR1453] [OR:SYNECHOCYSTIS SP] [SR:PCC 6803,] [DE:SULFATE TRANSPORT SYSTEM PERMEASE PROTEIN CYST] [SP:Q01895] |
| Contig145G | 467327_f1_16 | 2234 | 6360 | 1341 | 446 | 720 | 3.70E−71 | pir:[LN:S76527] [AC:S76527] [PN:hypothetical protein] [OR:Synechocystis sp.] [SR:PCC 6803,, PCC 6803] [SR:PCC 6803,] |
| Contig145G | 4883442_c2_105 | 2235 | 6361 | 1215 | 404 | 522 | 3.50E−50 | gp:[GI:g3378262] [LN:AF079317] [AC:AF079317] [PN:unknown] [GN:orf003] [OR:*Sphingomonas aromaticivorans*] [DE:*Sphingomonas aromaticivorans* plasmid pNL1, complete plasmidsequence.] [NT:putative inner membrane protein; similar to] |
| Contig145G | 5289068_c1_99 | 2236 | 6362 | 609 | 202 | 383 | 1.90E−35 | sp:[LN:KTHY_BACSU] [AC:P37537] [GN:TMK] [OR:*BACILLUS SUBTILIS*] [EC:2.7.4.9] [DE:THYMIDYLATE KINASE, (DTMP KINASE)] [SP:P37537] |
| Contig145G | 797153_c3_126 | 2237 | 6363 | 330 | 109 | 249 | 4.20E−21 | gp:[GI:e1293607:g3150237] [LN:MLCB1243] [AC:AL023635] [PN:hypothetical protein MLCB1243.36] [GN:MLCB1243.36] [OR:*Mycobacterium leprae*] [DE:*Mycobacterium leprae* cosmid B1243.] [NT:MLCB1243.36, unknown, len: 385; similar to] |
| Contig145G | 9799140_f1_11 | 2238 | 6364 | 726 | 241 | 213 | 2.00E−17 | pir:[LN:F70474] [AC:F70474] [PN:conserved hypothetical protein aq_2035] [GN:aq_2035] [OR:*Aquifex aeolicus*] |
| Contig146G | 10440893_c2_1087 | 2239 | 6365 | 1536 | 511 | 851 | 4.80E−85 | pir:[LN:E70081] [AC:E70081] [PN:purine-cytosine permease homolog yxlA] [GN:yxlA] [OR:*Bacillus subtilis*] |
| Contig146G | 10444091_c1_908 | 2240 | 6366 | 273 | 90 | | | NO-HIT |
| Contig146G | 1056311_f2_334 | 2241 | 6367 | 483 | 160 | | | NO-HIT |
| Contig146G | 10567193_f2_456 | 2242 | 6368 | 498 | 165 | 544 | 1.60E−52 | gp:[GI:e1172770:g2598550] [LN:LLAJ109] [AC:AJ000109] [PN:gluthatione peroxidase] [GN:gpo] [OR:*Lactococcus lactis*] [DE:*Lactococcus lactis* carB and gpo genes.] |
| Contig146G | 1056875_c1_804 | 2243 | 6369 | 1326 | 441 | | | NO-HIT |
| Contig146G | 1062790_c3_1385 | 2244 | 6370 | 897 | 298 | 565 | 9.80E−55 | gp:[GI:g3046324] [LN:AF010139] [AC:AF010139] [PN:unknown] [OR:*Azotobacter vinelandii*] [DE:*Azotobacter vinelandii* iron-sulfur cluster assembly gene cluster,suhB, cysE2, iscS, iscU, iscA, hscB, hscA and fdx genes completecds; ndk gene, partial cds.] [NT:orf1] |

TABLE 2-continued

| Query | Orf | NT ID | AA ID | NT Lgth | AA Lgth | Score | P-value | Subject |
|---|---|---|---|---|---|---|---|---|
| Contig146G | 10660818_c2_1074 | 2245 | 6371 | 1506 | 501 | 1757 | 4.80E−181 | pir:[LN:JC2382] [AC:JC2382] [PN:sodium/proline symporter:proline permease] [CL:proline carrier protein] [OR:*Pseudomonas fluorescens*] |
| Contig146G | 10681555_f3_579 | 2246 | 6372 | 543 | 180 | 359 | 6.60E−33 | sp:[LN:YRBI_ECOLI] [AC:P45396:P45398] [GN:YRBI] [OR:*ESCHERICHIA COLI*] [DE:HYPOTHETICAL 20.0 KD PROTEIN IN MURA-RPON INTERGENIC REGION] [SP:P45396:P45398] |
| Contig146G | 1070887_f2_296 | 2247 | 6373 | 3894 | 1297 | 1730 | 1.70E−266 | sp:[LN:HRPA_ECOLI] [AC:P43329:P77479:P76861::P76863] [GN:HRPA] [OR:*ESCHERICHIA COLI*] [DE:ATP-DEPENDENT HELICASE HRPA] [SP:P43329:P77479:P76861:P76863] |
| Contig146G | 10741567_c1_889 | 2248 | 6374 | 438 | 145 | | | NO-HIT |
| Contig146G | 10745927_f1_129 | 2249 | 6375 | 1077 | 358 | 848 | 1.00E−84 | gp:[GI:e242881:g2764827] [LN:ECPAA] [AC:X97452] [PN:ferredoxin reductase electron transfer] [GN:E] [OR:*Escherichia coli*] [DE:*E.coli* cluster for phenylacetic acid degradation.] [NT:putative] |
| Contig146G | 10750686_c1_826 | 2250 | 6376 | 540 | 179 | 253 | 1.10E−21 | pir:[LN:E70632] [AC:E70632] [PN:hypothetical protein Rv0390] [GN:Rv0390] [OR:*Mycobacterium tuberculosis*] |
| Contig146G | 10750892_c2_1190 | 2251 | 6377 | 243 | 80 | | | NO-HIT |
| Contig146G | 10801387_f3_578 | 2252 | 6378 | 1029 | 342 | 861 | 4.20E−86 | sp:[LN:YRBH_ECOLI] [AC:P45395] [GN:YRBH] [OR:*ESCHERICHIA COLI*] [DE:HYPOTHETICAL 35.2 KD PROTEIN IN MURA-RPON INTERGENIC REGION (O328)] [SP:P45395] |
| Contig146G | 10801905_f2_318 | 2253 | 6379 | 486 | 161 | | | NO-HIT |
| Contig146G | 10824187_f3_654 | 2254 | 6380 | 1170 | 389 | 767 | 3.90E−76 | sp:[LN:ACDB_BACSU] [AC:P45857] [GN:MMGC] [OR:*BACILLUS SUBTILIS*] [EC:1.3.99.—] [DE:ACYL-COA DEHYDROGENASE,] [SP:P45857] |
| Contig146G | 10970313_f3_511 | 2255 | 6381 | 630 | 209 | 129 | 2.70E−07 | sp:[LN:BM3R_BACME] [AC:P43506] [GN:BM3R1] [OR:*BACILLUS MEGATERIUM*] [DE:TRANSCRIPTIONAL REPRESSOR BM3R1] [SP:P43506] |
| Contig146G | 10978403_f3_635 | 2256 | 6382 | 795 | 264 | 204 | 3.20E−21 | gp:[GI:d1026542:g3059193] [LN:D88016] [AC:D88016] [PN:2-hydroxy-6-oxo-6-phenylhexa-2,4-dienoate] [GN:bphD] [FN:meta-cleavage compound hydrolase] [OR:*Rhodococcus erythropolis*] [SR:*Rhodococcus erythropolis* (strain:TA421) DNA] [DE:*Rhodococcus erythropolis* DNA for ferredoxin reductase,2,3-dihydroxybiphnyl 1,2-dioxygenase,2-hydroxy-6-oxo-6-phenylhexa-2,4-dieonate hydrolase, partial andcomplete cds.] |
| Contig146G | 10979640_f2_256 | 2257 | 6383 | 954 | 317 | 1128 | 2.10E−114 | sp:[LN:KDGD_PSEPU] [AC:P42233] [OR:*PSEUDOMONAS PUTIDA*] [EC:4.2.1.41] [DE:GLUCARATE DEHYDRATASE) (KDGDH)] [SP:P42233] |
| Contig146G | 111053_c3_1369 | 2258 | 6384 | 246 | 81 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig146G | 11178208_c1_1059 | 2259 | 6385 | 1587 | 528 | 1930 | 2.20E−199 | sp:[LN:YHAG_ECOLI] [AC:P39829] [GN:YHAG] [OR:*ESCHERICHIA COLI*] [DE:HYPOTHETICAL 56.4 KD [OR:*ESCHERICHIA COLI*] INTERGENIC REGION] [SP:P39829] |
| Contig146G | 113217_c2_1162 | 2260 | 6386 | 1200 | 399 | 593 | 1.10E−57 | pir:[LN:D69779] [AC:D69779] [PN:antibiotic resistance protein homolog ydeR] [GN:ydeR] [OR:*Bacillus subtilis*] |
| Contig146G | 1172825_f2_372 | 2261 | 6387 | 1002 | 333 | 1307 | 2.30E−133 | sp:[LN:PAAA_ECOLI] [AC:P76077:O53010] [GN:PAAA] [OR:*ESCHERICHIA COLI*] [DE:PHENYLACETIC [GN:PAAA] [OR:*ESCHERICHIA COLI*] [DE:PHENYLACETIC [SP:P76077:O53010] |
| Contig146G | 1173135_f3_682 | 2262 | 6388 | 681 | 226 | 532 | 3.10E−51 | gp:[GI:g4155694] [LN:AE001537] [AC:AE001537:AE001439] [PN:AMINO ACID ABC TRANSPORTER, PERMEASE PROTEIN] [GN:jhp1096] [OR:*Helicobacter pylori* J99] [DE:*Helicobacter pylori*, strain J99 section 98 of 132 of the completegenome.] [NT:similar to *H. pylori* 26695 gene HP1169] |
| Contig146G | 1188907_c3_1419 | 2263 | 6389 | 657 | 218 | 502 | 4.60E−48 | sp:[LN:YFCF_ECOLI] [AC:P77544] [GN:YFCF] [OR:*ESCHERICHIA COLI*] [DE:HYPOTHETICAL 24.3 KD PROTEIN IN PTA-FOLX INTERGENIC REGION] [SP:P77544] |
| Contig146G | 119026_f2_365 | 2264 | 6390 | 756 | 251 | 153 | 2.30E−09 | sp:[LN:LUMQ_PHOLE] [AC:Q51872] [GN:LUMQ] [OR:*PHOTOBACTERIUM LEIOGNATHI*] [DE:PROBABLE TRANSCRIPTIONAL REGULATOR LUMQ] [SP:Q51872] |
| Contig146G | 11929832_c2_1107 | 2265 | 6391 | 954 | 317 | | | NO-HIT |
| Contig146G | 11990933_f2_306 | 2266 | 6392 | 201 | 66 | | | NO-HIT |
| Contig146G | 1204817_f3_609 | 2267 | 6393 | 1371 | 456 | 104 | 6.60E−05 | gp:[GI:e1312335:g3341578] [LN:VCH231091] [AC:AJ231091] [GN:z29f] [OR:*Vibrio cholerae*] DE:*Vibrio cholerae* z29f gene.] |
| Contig146G | 1213937_c1_1013 | 2268 | 6394 | 1572 | 523 | 1758 | 3.70E−181 | gp:[GI:d1032427:g3298356] [LN:AB010689] [AC:AB010689] [PN:AhpF] [GN:ahpF] [OR:*Pseudomonas putida*] [SR:*Pseudomonas putida* (strain:TOL) DNA] [DE:*Pseudomonas putida* gene for AhpC, AhpF, complete cds.] |
| Contig146G | 1213937_f2_452 | 2269 | 6395 | 1572 | 523 | 1750 | 2.60E−180 | gp:[GI:d1032427:g3298356] [LN:AB010689] [AC:AB010689] [PN:AhpF] [GN:ahpF] [OR:*Pseudomonas putida*] [SR:*Pseudomonas putida* (strain:TOL) DNA] [DE:*Pseudomonas putida* gene for AhpC, AhpF, complete cds.] |
| Contig146G | 1223288_f3_620 | 2270 | 6396 | 1386 | 461 | 1341 | 5.80E−137 | gp:[GI:e1314375:g3402236] [LN:SC2A11] [AC:AL031184] [PN:L-serine dehydratase] [GN:sdaA] [OR:*Streptomyces coelicolor*] [DE:*Streptomyces coelicolor* cosmid 2A11.] [NT:SC2A11.03c, sdaA, probable L-serine dehydratase,] |

TABLE 2-continued

| Query | Orf | NT ID | AA ID | NT Lgth | AA Lgth | Score | P-value | Subject |
|---|---|---|---|---|---|---|---|---|
| Contig146G | 12266002_c1_1032 | 2271 | 6397 | 738 | 245 | 566 | 7.70E−55 | sp:[LN:VFR_PSEAE] [AC:P55222] [GN:VFR] [OR:*PSEUDOMONAS AERUGINOSA*] [DE:CYCLIC AMP RECEPTOR-LIKE PROTEIN] [SP:P55222] |
| Contig146G | 12266505_f3_698 | 2272 | 6398 | 948 | 315 | 554 | 1.40E−53 | sp:[LN:GCVA_ECOLI] [AC:P32064] [GN:GCVA] [OR:*ESCHERICHIA COLI*] [DE:ACTIVATOR] [SP:P32064] |
| Contig146G | 12267308_f2_437 | 2273 | 6399 | 876 | 291 | 788 | 2.30E−78 | gp:[GI:D1037194:g4062977] [LN:AB017138] [AC:AB017138] [PN:gamma subunit of malonate decarboxylase] [GN:mdcE] [OR:*Pseudomonas putida*] [SR:*Pseudomonas putida* DNA] [DE:*Pseudomonas putida* malonate decarboxylase gene cluster (mdcA, mdcB,mdcC, mdcD, mdcE, mdcG, mdcH, mdcL and mdcM genes), complete cds.] |
| Contig146G | 12272012_f1_132 | 2274 | 6400 | 996 | 331 | 619 | 1.90E−60 | gp:[GI:g3253210] [LN:AF029714] [AC:AF029714:Z71175] [PN:PhaN] [GN:phaN] [OR:*Pseudomonas putida*] [DE:*Pseudomonas putida* repressor (phaN), regulatory protein (phaM),enoyl-CoA hydratase I (phaA), enoyl-CoA hydratase II (phaB),3-hydroxyacyl-CoA dehydrogenase (phaC), ketothiolase (phaD),phenylacetyl-CoA ligase (phaE), ring-oxidation complex protein 1(pbaF), ring-oxidation complex protein 2 (phaG), ring-oxidationcomplex protein 3 (phaH), ring-oxidation complex protein 4 (phaI),permease (phaJ), channel-forming protein (phaK), and ring-openingenzyme (phaL) genes, complete cds.] [NT:Repressor protein] |
| Contig146G | 12501467_f2_315 | 2275 | 6401 | 690 | 229 | | | NO-HIT |
| Contig146G | 12527128_c3_1528 | 2276 | 6402 | 297 | 98 | | | NO-HIT |
| Contig146G | 1253137_c3_1451 | 2277 | 6403 | 225 | 74 | | | NO-HIT |
| Contig146G | 12531877_f1_83 | 2278 | 6404 | 960 | 319 | 477 | 2.10E−45 | pir:[LN:G65011] [AC:G65011] [PN:probable lauroyl acyltransferase b2378:probable lipid A biosynthesis protein b2378] [OR:*Escherichia coli*] |
| Contig146G | 125437_f3_669 | 2279 | 6405 | 1449 | 482 | | | NO-HIT |
| Contig146G | 12585883_c1_862 | 2280 | 6406 | 1590 | 529 | 800 | 1.20E−79 | gp:[GI:g3253199] [LN:AF029714] [AC:AF029714:Z71175] [PN:PhaC] [GN:phaC] [OR:*Pseudomonas putida*] [DE:*Pseudomonas putida* repressor (phaN), regulatory protein (phaM),enoyl-CoA hydratase I (phaA), enoyl-CoA hydratase II (phaB),3-hydroxyacyl-CoA dehydrogenase (phaC), ketothiolase (phaD),phenylacetyl-CoA ligase (phaE), ring-oxidation complex protein 1(phaF), ring-oxidation complex protein 2 (phaG), ring-oxidationcomplex protein 3 (phaH), ring-oxidation complex protein 4 (phaI),permease (phaJ), channel-forming protein (phaK), and ring-openingenzyme (phaL) genes, complete cds.] [NT:3-Hydroxyacyl-CoA dehydrogenase] |
| Contig146G | 12695967_c2_1223 | 2281 | 6407 | 414 | 137 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig146G | 12759591_c1_837 | 2282 | 6408 | 390 | 129 | 176 | 3.20E−12 | gp:[GI:g3153821] [LN:AF062655] [AC:AF062655] [PN:plenty-of-prolines-101] [OR:*Mus musculus*] [SR:house mouse] [DE:*Mus musculus* plenty-of-prolines-101 mRNA, complete cds.] [NT:binds to several SH3 domain containing proteins] |
| Contig146G | 12890642_f1_54 | 2283 | 6409 | 606 | 201 | 225 | 1.00E−18 | gp:[GI:g3128260] [LN:AF010496] [AC:AF010496] [PN:hypothetical protein] [OR:*Rhodobacter capsulatus*] [DE:*Rhodobacter capsulatus* strain SB1003, partial genome.] |
| Contig146G | 13167703_f2_352 | 2284 | 6410 | 1497 | 498 | 1608 | 2.90E−165 | gp:[GI:g2708666] [LN:AF037441] [AC:AF037441] [PN:putative 54.5 kDa protein] [GN:eip55] [OR:*Edwardsiella ictaluri*] [DE:*Edwardsiella ictaluri* putative 18.8 kDa protein (eip19), putative17.8 kDa protein (eip18), putative 54.5 kDa protein (eip55), andputative 19.5 kDa protein (eip20) genes, complete cds.] [NT:EIP55; antigenic to catfish] |
| Contig146G | 13175308_f2_359 | 2285 | 6411 | 1197 | 398 | 771 | 1.50E−76 | sp:[LN:CYNX_ECOLI] [AC:P17583:P75695:P71308] [GN:CYNX] [OR:*ESCHERICHIA COLI*] [DE:*CYANATE TRANSPORT PROTEIN CYNX*] [SP:P17583:P75695:P71308] |
| Contig146G | 1345143_f1_5 | 2286 | 6412 | 1281 | 426 | 1441 | 1.50E−147 | gp:[GI:g1916298] [LN:ECU90416] [AC:U90416] [PN:N-(alpha)-acetylornithine-(delta)-] [GN:cstC] [OR:*Escherichia coli*] [DE:*Escherichia coli* N-(alpha)-acetylornithine-(delta)-aminotransferase(cstC) gene, complete cds.] [NT:CstC; similar to ArgD] |
| Contig146G | 13672258_f2_445 | 2287 | 6413 | 948 | 315 | 765 | 6.30E−76 | sp:[LN:TAUD_ECOLI] [AC:P37610:Q47540:P77797] [GN:TAUD:SSID] [OR:*ESCHERICHIA COLI*] [EC:1.—.—.—] [DE:STARVATION-INDUCED PROTEIN 3) (SSI3)] [SP:P37610:Q47540:P77797] |
| Contig146G | 13694033_c3_1423 | 2288 | 6414 | 768 | 255 | 495 | 2.60E−47 | sp:[LN:SDR1_PICAB] [AC:Q08632] [OR:*PICEA ABIES*] [SR:,NORWAY SPRUCE:PICEA EXCELSA] [EC:1.—.—.—] [DE:SHORT-CHAIN TYPE DEHYDROGENASE/REDUCTASE,] [SP:Q08632] |
| Contig146G | 13724193_f3_707 | 2289 | 6415 | 885 | 294 | 774 | 7.00E−77 | gp:[GI:g1657562] [LN:ECU73857] [AC:U73857] [PN:membrane component] [OR:*Escherichia coli*] [DE:*Escherichia coli* chromosome minutes 6–8.] |
| Contig146G | 13728406_c3_1460 | 2290 | 6416 | 1281 | 426 | 1108 | 2.80E−112 | gp:[GI:g2996619] [LN:AF009224] [AC:AF009224:M76991:M76990:M23245:M29848:M29714:M62649] [PN:beta-ketoadipyl CoA thiolase] [GN:catF] [FN:thiolytic cleavage of beta-ketoadipyl CoA] [OR:Acinetobacter sp. ADP1] [DE:Acinetobacter sp. ADP1 ben operon and cat operon, completesequence.] |

TABLE 2-continued

| Query | Orf | NT ID | AA ID | NT Lgth | AA Lgth | Score | P-value | Subject |
|---|---|---|---|---|---|---|---|---|
| Contig146G | 13751966_c1_781 | 2291 | 6417 | 822 | 273 | 477 | 2.10E−45 | p:[LN:Y4FC_RHISN] [AC:P55441] [GN:Y4FC] [OR:RHIZOBIUM SP] [EC:1.—.—.—] [DE:HYPOTHETICAL MONOOXYGENASE Y4FC,] [SP:P55441] |
| Contig146G | 1384375_c2_1091 | 2292 | 6418 | 768 | 255 | 794 | 5.30E−79 | sp:[LN:YEBC_ECOLI] [AC:P24237] [GN:YEBC] [OR:*ESCHERICHIA COLI*] [DE:HYPOTHETICAL 26.4 KD PROTEIN IN RUVC-ASPS INTERGENIC REGION] [SP:P24237] |
| Contig146G | 13866452_f3_539 | 2293 | 6419 | 588 | 195 | 179 | 1.00E−18 | pir:[LN:F69979] [AC:F69979] [PN:caffeoyl-CoA O-methyltransferase homolog yrrM] [GN:yrrM] [OR:*Bacillus subtilis*] |
| Contig146G | 13869077_f2_342 | 2294 | 6420 | 1722 | 573 | 1598 | 3.40E−164 | pir:[LN:S71009] [AC:S71009] [PN:biotin carboxylase protein A2] [GN:bcpA2] [CL:biotin carboxylase homology:lipoyl/biotin-binding homology] [OR:*Saccharopolyspora erythraea*] |
| Contig146G | 13945268_c2_1113 | 2295 | 6421 | 747 | 248 | 585 | 7.40E−57 | sp:[LN:HYUE_PSESP] [AC:Q00924] [GN:HYUE] [OR:PSEUDOMONAS SP] [EC:5.1.99.—] [DE:HYDANTOIN RACEMASE,] [SP:Q00924] |
| Contig146G | 14220327_c3_1620 | 2296 | 6422 | 1752 | 583 | 189 | 7.60E−15 | pir:[LN:JC5087] [AC:JC5087:PC4226] [PN:tannase, precursor:tannin acyl hydrolase] [OR:*Aspergillus oryzae*] [EC:3.1.1.20] |
| Contig146G | 14273438_c1_1070 | 2297 | 6423 | 453 | 150 | 126 | 4.30E−07 | gp:[GI:e1352251:g3892703] [LN:ATF7K2] [AC:AL033545] [PN:putative glycine-rich protein] [GN:F7K2_60] [OR:*Arabidopsis thaliana*] [SR:thale cress] [DE:*Arabidopsis thaliana* DNA chromosome 4, BAC clone F7K2 (ESSAIIproject).] [NT:long ORF and comparable genepredictions are also] |
| Contig146G | 14337751_f3_733 | 2298 | 6424 | 1236 | 411 | 98 | 7.20E−05 | sp:[LN:INTF_ECOLI] [AC:P71298] [GN:INTF] [OR:*ESCHERICHIA COLI*] [DE:PUTATIVE INTEGRASE INTF] [SP:P71298] |
| Contig146G | 14351500_c2_1225 | 2299 | 6425 | 552 | 183 | 276 | 4.10E−24 | sp:[LN:YDEQ_BACSU] [AC:P96674] [GN:YDEQ] [OR:*BACILLUS SUBTILIS*] [EC:1.6.99.—] [DE:PUTATIVE NAD(P)H OXIDOREDUCTASE YDEQ,] [SP:P96674] |
| Contig146G | 1438816_f1_183 | 2300 | 6426 | 1758 | 585 | 2365 | 1.80E−245 | gp:[GI:d1037190:g4062973] [LN:AB017138] [AC:AB017138] [PN:alpha subunit of malonate decarboxylase] [GN:mdcA] [OR:*Pseudomonas putida*] [SR:*Pseudomonas putida* DNA] [DE:*Pseudomonas putida* malonate decarboxylase gene cluster (mdcA, mdcB,mdcC, mdcD, mdcE, mdcG, mdcH, mdcL and mdcM genes), complete cds.] |
| Contig146G | 1442212_c3_1610 | 2301 | 6427 | 891 | 296 | 283 | 7.50E−25 | pir:[LN:F69864] [AC:F69864] [PN:hypothetical protein yktD] [GN:yktD] [OR:*Bacillus subtilis*] |
| Contig146G | 14485967_f3_636 | 2302 | 6428 | 945 | 314 | 329 | 1.00E−29 | gp:[GI:g996073] [LN:RMNOLNOD] [AC:X91350] [OR:*Sinorhizobium meliloti*] [DE:*R.meliloti* nolQa, nolQb, nolS and nodD2 genes.] [NT:belongs to stac operon] [RE: |

TABLE 2-continued

| Query | Orf | NT ID | AA ID | NT Lgth | AA Lgth | Score | P-value | Subject |
|---|---|---|---|---|---|---|---|---|
| Contig146G | 14486025_f2_285 | 2303 | 6429 | 456 | 151 | | | NO-HIT |
| Contig146G | 14486063_f2_418 | 2304 | 6430 | 1248 | 415 | 392 | 1.70E−35 | sp:[LN:VG48_HSVSA] [AC:Q01033] [GN:48:EDLF5] [OR:*HERPESVIRUS SAIMIRI*] [DE:HYPOTHETICAL GENE 48 PROTEIN] [SP:Q01033] |
| Contig146G | 14495312_c2_1280 | 2305 | 6431 | 414 | 137 | 270 | 1.80E−23 | gp:[GI:g2995632] [LN:AF052749] [AC:AF052749] [PN:unknown] [OR:*Pseudomonas putida*] [DE:*Pseudomonas putida* plasmid pPGH1 transposon Tn5502 unknown genes.] [NT:Orf109; ferredoxin homolog; similar to the] |
| Contig146G | 14580382_f2_403 | 2306 | 6432 | 984 | 327 | 419 | 2.90E−39 | gp:[GI:g1139588] [LN:HIU20964] [AC:U20964] [PN:ORF2] [OR:*Haemophilus influenzae*] [DE:*Haemophilus influenzae* DNA topoisomerase I (topA) gene, completecds, putative pyridine nucleotide transhydrogenase beta subunit(pntB) gene, partial cds, ORF2 and ORF3 genes, complete cds andputative threonyl-tRNA synthetase (thrS) gene, partial cds.] [NT:ORF2 has a predicted molecular weight of 34.5kd and] |
| Contig146G | 14584412_f1_137 | 2307 | 6433 | 735 | 244 | 114 | 6.30E−05 | gp:[GI:e1312906:g3355680] [LN:SC1C2] [AC:AL031124] [PN:putative transcriptional regulator] [GN:SC1C2.13] [OR:*Streptomyces coelicolor*] [DE:*Streptomyces coelicolor* cosmid IC2.] [NT:SC1C2.13, probable transcriptional regulator, len:] |
| Contig146G | 1460875_c2_1344 | 2308 | 6434 | 348 | 115 | 233 | 1.50E−19 | gp:[GI:g3241975] [LN:SSU85710] [AC:U85710] [PN:transporase] [OR:*Sulfolobus solfataricus*] [DE:*Sulfolobus solfataricus* insertion element ISC1041, transposasegene, complete cds.] |
| Contig146G | 1460875_f3_750 | 2309 | 6435 | 342 | 113 | 233 | 1.50E−19 | gp:[GI:g3241975] [LN:SSU85710] [AC:U85710] [PN: transposase] [OR:*Sulfolobus solfataricus*] [DE:*Sulfolobus solfataricus* insertion element ISC1041, transposasegene, complete cds.] |
| Contig146G | 14640927_c2_1322 | 2310 | 6436 | 597 | 198 | 166 | 1.90E−12 | pir:[LN:G70035] [AC:G70035] [PN:hypothetical protein yveG] [GN:yveG] [OR:*Bacillus subtilis*] |
| Contig146G | 14648587_f3_660 | 2311 | 6437 | 1815 | 604 | 1414 | 1.10E−144 | gp:[GI:g3172117] [LN:ACCPCAOP] [AC:L05770:U04359:M33798:U20284:U11554:L13114:L03407] [PN:acyl-CoA dehydrogenase] [OR:Acinetobacter sp. ADP1] [DE:Acinetobacter sp. ADP1 pca-qui-pob supraoperonic cluster, completesequence.] [NT:encodes protein similar to acyl-CoA dehydrogenase] |
| Contig146G | 14850806_c1_913 | 2312 | 6438 | 249 | 82 | | | NO-HIT |
| Contig146G | 14875010_f1_195 | 2313 | 6439 | 1398 | 465 | 644 | 4.20E−63 | sp:[LN:SOXA_RHOSO] [AC:P54995] [GN:SOXA:DSZA] [OR:RHODOCOCCUS SP] [DE:DIBENZOTHIOPHENE DESULFURIZATION ENZYME A] [SP:P54995] |
| Contig146G | 14938787_f1_103 | 2314 | 6440 | 762 | 253 | | | NO-HIT |
| Contig146G | 14962755_f3_743 | 2315 | 6441 | 1992 | 663 | 2418 | 4.30E−251 | sp:[LN:TKT1_ECOLI] [AC:P27302] [GN:TKTA:TKT] [OR:*ESCHERICHIA COLI*] [EC:2.2.1.1] [DE:TRANSKETOLASE 1, (TK 1)] [SP:P27302] |

TABLE 2-continued

| Query | Orf | NT ID | AA ID | NT Lgth | AA Lgth | Score | P-value | Subject |
|---|---|---|---|---|---|---|---|---|
| Contig146G | 15051712_c1_867 | 2316 | 6442 | 1164 | 387 | 726 | 8.50E−72 | pir:[LN:G69893] [AC:G69893] [PN:butyryl-CoA dehydrogenase homolog yngJ] [GN:yngJ] [CL:acyl-CoA dehydrogenase] [OR:*Bacillus subtilis*] |
| Contig146G | 15057937_f2_448 | 2317 | 6443 | 771 | 256 | 215 | 1.20E−17 | gp:[GI:e1359141:g4007683] [LN:SC4B5] [AC:AL034443] [PN:putative transcriptional regulator] [GN:SC4B5.15] [OR:*Streptomyces coelicolor*] [DE:*Streptomyces coelicolor* cosmid 4B5.] [NT:SC4B5.15, probable transcriptional regulator, len:] |
| Contig146G | 15094063_f2_328 | 2318 | 6444 | 204 | 67 | | | NO-HIT |
| Contig146G | 15626552_f3_671 | 2319 | 6445 | 918 | 305 | 509 | 8.40E−49 | sp:[LN:YAFC_ECOLI] [AC:P30864] [GN:YAFC] [OR:*ESCHERICHIA COLI*] [DE:(ORF304)] [SP:P30864] |
| Contig146G | 15641561_f2_381 | 2320 | 6446 | 684 | 227 | 218 | 5.80E−18 | pir:[LN:S77900] [AC:S77900:S43551] [PN:hypothetical protein 1] [OR:*Clostridium barkeri*] |
| Contig146G | 15683178_f3_569 | 2321 | 6447 | 1077 | 358 | 128 | 7.80E−05 | gp:[GI:g189083] [LN:HUMNC1A] [AC:M96984] [PN:type VII collagen] [OR:*Homo sapiens*] [SR:*Homo sapiens* (library: WISH) cDNA to mRNA] [DE:Human collagen type VII NC1 region mRNA, partial cds.] [NT:NC1 region] |
| Contig146G | 15814092_f2_340 | 2322 | 6448 | 777 | 258 | 633 | 6.10E−62 | pir:[LN:E71090] [AC:E71090] [PN:probable lactam utilization protein] [GN:PH0986] [OR:*Pyrococcus horikoshii*] |
| Contig146G | 159375_c3_1441 | 2323 | 6449 | 306 | 101 | | | NO-HIT |
| Contig146G | 16063553_c3_1542 | 2324 | 6450 | 336 | 111 | 476 | 2.60E−45 | sp:[LN:FER_PSEST] [AC:P08811] [OR:*PSEUDOMONAS STUTZERI*] [SR:,*PSEUDOMONAS PERFECTOMARINA*] [DE:FERREDOXIN] [SP:P08811] |
| Contig146G | 16188425_f3_704 | 2325 | 6451 | 1260 | 419 | 297 | 1.70E−25 | sp:[LN:SOXC_RHOSO] [AC:P54998] [GN:SOXC:DSZC] [OR:RHODOCOCCUS SP] [DE:DIBENZOTHIOPHENE DESULFURIZATION ENZYME C (DBT SULFUR DIOXYGENASE)] [SP:P54998] |
| Contig146G | 16222682_c2_1284 | 2326 | 6452 | 1491 | 496 | 2272 | 1.30E−235 | sp:[LN:BENA_ACICA] [AC:P07769] [GN:BENA] [OR:*ACINETOBACTER CALCOACETICUS*] [EC:1.14.12.10] [DE:BENZOATE 1,2-DIOXYGENASE ALPHA SUBUNIT,] [SP:P07769] |
| Contig146G | 16275311_f1_102 | 2327 | 6453 | 1167 | 388 | 1511 | 5.60E−155 | sp:[LN:YBDR_ECOLI] [AC:P77316] [GN:YBDR] [OR:*ESCHERICHIA COLI*] [DE:INTERGENIC REGION] [SP:P77316] |
| Contig146G | 162816_f2_449 | 2328 | 6454 | 351 | 116 | 257 | 4.30E−22 | gp:[GI:g3095050] [LN:AF010234] [AC:AF010234] [PN:ArsR] [GN:arsR] [OR:*Pseudomonas aeruginosa*] [DE:*Pseudomonas aeruginosa* ars operon, regulator (arsR), membrane pump(arsB) and arsenate reductase (arsC) genes, complete cds.] [NT:regulator] |
| Contig146G | 163405_c1_793 | 2329 | 6455 | 2025 | 674 | | | NO-HIT |
| Contig146G | 16416056_c1_998 | 2330 | 6456 | 297 | 98 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig146G | 16439077_c3_1452 | 2331 | 6457 | 3483 | 1160 | 197 | 7.90E−19 | pir:[LN:G69114] [AC:G69114] [PN:indolepyruvate oxidoreductase, alpha subunit] [GN:MTH1852] [CL:indolepyruvate synthase alpha chain] [OR:*Methanobacterium thermoautotrophicum*] |
| Contig146G | 16440937_f3_599 | 2332 | 6458 | 690 | 229 | 110 | 0.00011 | pir:[LN:B70391] [AC:B70391] [PN:transcription regulator TetR/AcrR family] [GN:acrR1] [OR:*Aquifex aeolicus*] |
| Contig146G | 165813_c2_1330 | 2333 | 6459 | 915 | 304 | 315 | 3.00E−28 | pir:[LN:B71256] [AC:B71256] [PN:conserved hypothetical integral membrane protein TP0986] [GN:TP0986] [OR:*Treponema pallidum* subsp. *pallidum*] [SR:, syphilis spirochete] |
| Contig146G | 166087_c2_1294 | 2334 | 6460 | 186 | 61 | | | NO-HIT |
| Contig146G | 16828465_c2_1167 | 2335 | 6461 | 1257 | 418 | 1918 | 4.10E−198 | gp:[GI:g1842056] [LN:ACU87258] [AC:U87258] [PN:cis,cis-muconate transport protein MucK] [GN:mucK] [OR:Acinetobacter sp. ADP1] [DE:Acinetobacter sp. ADP1 cis,cis-muconate transport protein MucK(mucK) and electron transfer flavoprotein-ubiquinone oxidoreductasehomolog genes, complete cds.] |
| Contig146G | 16979688_c3_1384 | 2336 | 6462 | 1125 | 374 | 1489 | 1.20E−152 | sp:[LN:ASPQ_ACIGL] [AC:P10172] [OR:*ACINETOBACTER GLUTAMINASIFICANS*] [EC:3.5.1.38] [DE:GLUTAMINASE-ASPARAGINASE,] [SP:P10172] |
| Contig146G | 17001515_f2_280 | 2337 | 6463 | 1335 | 444 | 1522 | 3.80E−156 | sp:[LN:PURA_VIBPA] [AC:P40607] [GN:PURA] [OR:*VIBRIO PARAHAEMOLYTICUS*] [EC:6.3.4.4] [DE:ADENYLOSUCCINATE SYNTHETASE, (IMP--ASPARTATE LIGASE)] [SP:P40607] |
| Contig146G | 17008442_f2_327 | 2338 | 6464 | 858 | 285 | 383 | 1.90E−35 | gp:[GI:e321555:g2208981] [LN:YEY13308] [AC:Y13308] [PN:hypothetical protein] [OR:*Yersinia enterocolitica*] [DE:*Yersinia enterocolitica* plasmid DNA fragment, strain 15673.] [T:ORF2] |
| Contig146G | 17069691_f1_147 | 2339 | 6465 | 1728 | 575 | 492 | 5.30E−47 | gp:[GI:g1477454] [LN:APU04954] [AC:U04954] [GN:afuB] [OR:*Actinobacillus pleuropneumoniae*] [DE:*Actinobacillus pleuropneumoniae* afuA, afuB, afuC, apxIC and RTX-1toxin determinant (apxIA) genes, complete cds.] |
| Contig146G | 188752_f2_283 | 2340 | 6466 | 450 | 149 | 446 | 4.00E−42 | gp:[GI:g1888564] [LN:PAU89892] [AC:U89892] [OR:*Pseudomonas aeruginosa*] [DE:*Pseudomonas aeruginosa* virulence factor regulator (vfr) gene,partial cds.] [NT:ORFX] |
| Contig146G | 188805_f3_487 | 2341 | 6467 | 1527 | 508 | 1413 | 1.40E−144 | sp:[LN:CYCA_ECOLI] [AC:P39312] [GN:CYCA:DAGA] [OR:*ESCHERICHIA COLI*] [DE:D-SERINE/D-ALANINE/GLYCINE TRANSPORTER] [SP:P39312] |

TABLE 2-continued

| Query | Orf | NT ID | AA ID | NT Lgth | AA Lgth | Score | P-value | Subject |
|---|---|---|---|---|---|---|---|---|
| Contig146G | 189012_c3_1619 | 2342 | 6468 | 435 | 144 | 109 | 2.10E−06 | pir:[LN:S74052] [AC:S74052] [PN:hypothetical protein c0116] [OR:*Sulfolobus solfataricus*] |
| Contig146G | 189062_c2_1100 | 2343 | 6469 | 1236 | 411 | 1098 | 3.20E−111 | sp:[LN:PURT_ECOLI] [AC:P33221] [GN:PURT] [OR:*ESCHERICHIA COLI*] [EC:2.1.2.—] [DE:2)(FORMATE-DEPENDENT GAR TRANSFORMYLASE)] [SP:P33221] |
| Contig146G | 194137_f3_565 | 2344 | 6470 | 201 | 66 | | | NO-HIT |
| Contig146G | 1953193_c2_1135 | 2345 | 6471 | 669 | 222 | 158 | 1.30E−11 | sp:[LN:YEAS_ECOLI] [AC:P76249:O07971:O07969] [GN:YEAS] [OR:*ESCHERICHIA COLI*] [DE:*HYPOTHETICAL 23.2 KD PROTEIN IN GAPA-RND INTERGENIC REGION*] [SP:P76249:O07971:O07969] |
| Contig146G | 19542177_f1_231 | 2346 | 6472 | 573 | 190 | 133 | 2.40E−11 | sp:[LN:FXSA_ECOLI] [AC:P37147] [GN:FXSA] [OR:*ESCHERICHIA COLI*] [DE:FXSA PROTEIN] [SP:P37147] |
| Contig146G | 19568813_c3_1593 | 2347 | 6473 | 852 | 283 | 292 | 8.30E−26 | gp:[GI:d1002964:g217121] [LN:SYOCPCB] [AC:D13173] [PN:ORF1] [OR:*Synechococcus elongatus*] [SR:*Synechococcus elongatus* DNA] [DE:*Synechococcus elongatus* phycocyanin genes.] |
| Contig146G | 195927_c3_1609 | 2348 | 6474 | 1551 | 516 | 912 | 1.70E−91 | pir:[LN:D70861] [AC:D70861] [PN:probable monoxygenase] [GN:Rv3049c] [OR:*Mycobacterium tuberculosis*] |
| Contig146G | 19610941_f3_488 | 2349 | 6475 | 318 | 105 | | | NO-HIT |
| Contig146G | 19640842_f1_180 | 2350 | 6476 | 750 | 249 | 388 | 5.60E−36 | sp:[LN:YWBG_BACSU] [AC:P39590] [GN:YWBG:IPA-22R] [OR:*BACILLUS SUBTILIS*] [DE:HYPOTHETICAL 25.8 KD PROTEIN IN EPR-GALK INTERGENIC REGION] [SP:P39590] |
| Contig146G | 19688392_f2_336 | 2351 | 6477 | 318 | 105 | | | NO-HIT |
| Contig146G | 19688953_f2_399 | 2352 | 6478 | 711 | 236 | 815 | 3.20E−81 | pir:[LN:B44570] [AC:B44570] [PN:3-oxoadipate CoA-transferase, beta chain] [GN:catJ] [CL:3-oxoadipate CoA-transferase beta chain:3-oxoadipate CoA-transferase beta chain homology] [OR:*Acinetobacter calcoaceticus*] [EC:2.8.3.6] |
| Contig146G | 19725053_f3_607 | 2353 | 6479 | 2712 | 903 | 753 | 6.10E−150 | pir:[LN:S76431] [AC:S76431] [PN:ATP-dependent Clp proteinase, regulatory chain B2:protein slr0156:protein slr0156] [GN:clpB2] [CL:ATP-dependent Clp proteinase chain A] [OR:Synechocystis sp.] [SR:PCC 6803,, PCC 6803] [SR:PCC 6803,] [EC:3.4.21.—] |
| Contig146G | 19726457_f3_639 | 2354 | 6480 | 1215 | 404 | | | NO-HIT |
| Contig146G | 19727313_f1_35 | 2355 | 6481 | 1059 | 352 | 801 | 9.60E−80 | sp:[LN:ADA_YEAST] [AC:P53909] [GN:YNL141W:N1208:N1825] [OR:*SACCHAROMYCES CEREVISIAE*] [SR:,BAKER'S YEAST] [EC:3.5.4.4] [DE:PROBABLE ADENOSINE DEAMINASE, (ADENOSINE AMINOHYDROLASE)] [SP:P53909] |
| Contig146G | 19739576_c1_835 | 2356 | 6482 | 192 | 63 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig146G | 1980166_c1_1069 | 2357 | 6483 | 1389 | 462 | 1415 | 8.30E−145 | pir:[LN:QRECAA] [AC:H64733:JS0447:S10720:S45191] [PN:aromatic amino acid transport protein aroP] [GN:aroP] [CL:arginine permease] [OR:*Escherichia coli*] [MP:2.6 min] |
| Contig146G | 19820302_f3_489 | 2358 | 6484 | 462 | 153 | | | NO-HIT |
| Contig146G | 198582_c2_1313 | 2359 | 6485 | 867 | 288 | 636 | 2.90E−62 | pir:[LN:A70853] [AC:A70853] [PN:hypothetical protein Rv3085] [GN:Rv3085] [OR:*Mycobacterium tuberculosis*] |
| Contig146G | 19925212_c3_1515 | 2360 | 6486 | 270 | 89 | | | NO-HIT |
| Contig146G | 1992937_f2_436 | 2361 | 6487 | 315 | 104 | 353 | 2.90E−32 | gp:[GI:d1037192:g4062975] [LN:AB017138] [AC:AB017138] [PN:delta subunit of malonate decarboxylase] [GN:mdcC] [OR:*Pseudomonas putida*] [SR:*Pseudomonas putida* DNA] [DE:*Pseudomonas putida* malonate decarboxylase gene cluster (mdcA, mdcB,mdcC, mdcD, mdcE, mdcG, mdcH, mdcL, and mdcM genes), complete cds.] [NT:acyl carrier protein] |
| Contig146G | 20003183_c3_1635 | 2362 | 6488 | 1530 | 509 | 542 | 2.70E−52 | sp:[LN:ORDL_ECOLI] [AC:P37906] [GN:ORDL] [OR:*ESCHERICHIA COLI*] [EC:1.—.—.—] [DE:PROBABLE OXIDOREDUCATASE ORDL,] [SP:P37906] |
| Contig146G | 20026410_c3_1465 | 2363 | 6489 | 189 | 62 | | | NO-HIT |
| Contig146G | 20134703_f2_375 | 2364 | 6490 | 795 | 264 | 862 | 3.30E−86 | gp:[GI:g3253198] [LN:AF029714] [AC:AF029714:Z71175] [PN:PhaB] [GN:phaB] [OR:*Pseudomonas putida*] [DE:*Pseudomonas putida* repressor (phaN), regulatory protein (phaM),enoyl-CoA hydratase I (phaA), enoyl-CoA hydratase II (phaB),3-hydroxyacyl-CoA dehydrogenase (phaC), ketothiolase (phaD),phenylacetyl-CoA ligase (phaE), ring-oxidation complex protein 1(phaF), ring-oxidation complex protein 2 (phaG), ring-oxidationcomplex protein 3 (phaH), ring-oxidation complex protein 4 (phaI),permease (phaJ), channel-forming protein (phaK), and ring-openingenzyme (phaL) genes, complete cds.] [NT:Enoyl-CoA hydratase II] |
| Contig146G | 20197127_f3_667 | 2365 | 6491 | 621 | 206 | 155 | 2.70E−11 | pir:[LN:F69985] [AC:F69985] [PN:transcription regulator TetR/AcrR family homolog ysiA] [GN:ysiA] [OR:*Bacillus subtilis*] |
| Contig146G | 20204213_f1_153 | 2366 | 6492 | 1005 | 334 | 415 | 2.20E−46 | pir:[LN:B70678] [AC:B70678] [PN:hypothetical protein Rv3553] [GN:Rv3553] [OR:*Mycobacterium tuberculosis*] |
| Contig146G | 20320125_c3_1365 | 2367 | 6493 | 582 | 193 | 139 | 1.30E−11 | pir:[LN:F70025] [AC:F70025] [PN:conserved hypothetical protein yuxN] [GN:yuxN] [OR:*Bacillus subtilis*] |
| Contig146G | 2032212_f3_573 | 2368 | 6494 | 195 | 64 | | | NO-HIT |
| Contig146G | 20323376_c2_1278 | 2369 | 6495 | 714 | 237 | 257 | 4.30E−22 | sp:[LN:RPC1_BPD3] [AC:Q37906] [GN:CI] [OR:BACTERIOPHAGE D3] [DE:REPRESSOR PROTEIN CI] [SP:Q37906] |
| Contig146G | 20407667_c2_1249 | 2370 | 6496 | 471 | 156 | 382 | 2.40E−35 | gp:[GI:g1209222] [LN:ACCEST] [AC:L38252] [OR:*Acinetobacter lwoffii*] [DE:*Acinetobacter lwoffii* orf1 and esterase (est) genes, complete cds.] [NT:orf1] |

TABLE 2-continued

| Query | Orf | NT ID | AA ID | NT Lgth | AA Lgth | Score | P-value | Subject |
|---|---|---|---|---|---|---|---|---|
| Contig146G | 20422087_f1_98 | 2371 | 6497 | 960 | 319 | 241 | 2.10E−20 | gp:[GI:e1331981:g4106612] [LN:YP102KB] [AC:AL031866] [OR:*Yersinia pestis*] [DE:*Yersinia pestis* 102 kbases unstable region: from 1 to 119443.] [NT:ORF44, len=320, similar to hypothetical] |
| Contig146G | 20492057_f3_614 | 2372 | 6498 | 1179 | 392 | 452 | 9.20E−43 | sp:[LN:YCAQ_ECOLI] [AC:P75843] [GN:YCAQ] [OR:*ESCHERICHIA COLI*] [DE:HYPOTHETICAL 47.7 KD PROTEIN IN MSBA-KDSB INTERGENIC REGION] [SP:P75843] |
| Contig146G | 20500012_f1_39 | 2373 | 6499 | 1110 | 369 | 123 | 0.00063 | gp:[GI:c1325381:g3649757] [LN:PFMAL3P3] [AC:Z98547:Z98548:Z98550] [GN:MAL3P3.5] [OR:*Plasmodium falciparum*] [SR:malaria parasite *P. falciparum*] [DE:*Plasmodium falciparum* MAL3P3, complete sequence.] [NT:predicted using hexExon; MAL3P3.5 (PFC0345w),] |
| Contig146G | 20500182_c3_1433 | 2374 | 6500 | 285 | 94 | | | NO-HIT |
| Contig146G | 20507057_c1_1023 | 2375 | 6501 | 2265 | 754 | 1328 | 1.40E−135 | sp:[LN:YCBY_HAEIN] [AC:P44524:P43945] [GN:HI0116/115] [OR:*HAEMOPHILUS INFLUENZAE*] [DE:HYPOTHETICAL PROTEIN HI0116/115] [SP:P44524:P43945] |
| Contig146G | 20507152_f2_390 | 2376 | 6502 | 354 | 117 | 359 | 6.60E−33 | gp:[GI:g2290999] [LN:AF006000] [AC:AF006000] [PN:unknown] [OR:*Bordetella pertussis*] [DE:*Bordetella pertussis* D-3-phosphoglycerate dehydrogenase homolog(serA) and Brg1 (brg1) genes, complete cds.] [NT:orf1; similar to Eubacterium BaiF] [RE: |
| Contig146G | 20938818_c2_1205 | 2377 | 6503 | 1302 | 433 | 772 | 1.10E−76 | sp:[LN:YHJE_ECOLI] [AC:P37643] [GN:YHJE] [OR:*ESCHERICHIA COLI*] [DE:REGION (O440)] [SP:P37643] |
| Contig146G | 20939132_f1_138 | 2378 | 6504 | 678 | 225 | | | NO-HIT |
| Contig146G | 20968826_f2_257 | 2379 | 6505 | 1611 | 536 | 1288 | 2.40E−131 | pir:[LN:S27612] [AC:S27612] [PN:ketoglutarate semialdehyde dehydrogenase,] [OR:*Pseudomonas putida*] [EC:1.2.1.—] |
| Contig146G | 210762_c1_839 | 2380 | 6506 | 453 | 150 | | | NO-HIT |
| Contig146G | 2135952_c3_1381 | 2381 | 6507 | 1227 | 408 | 947 | 3.20E−95 | gp:[GI:e1374011:g4210608] [LN:BPE9834] [AC:AJ009834] [PN:DapC] [GN:dapC] [FN:succinyldiaminopimelate transaminase] [OR:*Bordetella pertussis*] [EC:2.6.1.17] [DE:*Bordetella pertussis* diaminopimelic acid biosynthesis locusincluding dapC, dapD, and dapE genes, partial.] |
| Contig146G | 21502178_c2_1081 | 2382 | 6508 | 558 | 185 | 474 | 4.30E−45 | sp:[LN:RUVC_HAEIN] [AC:P44633] [GN:RUVC:HI0314] [OR:*HAEMOPHILUS INFLUENZAE*] [EC:3.1.22.4] [DE:JUNCTION NUCLEASE RUVC) (HOLLIDAY JUCTION RESOLVASE RUVC)] [SP:P44633] |

TABLE 2-continued

| Query | Orf | NT ID | AA ID | NT Lgth | AA Lgth | Score | P-value | Subject |
|---|---|---|---|---|---|---|---|---|
| Contig146G | 21523467_f3_747 | 2383 | 6509 | 501 | 166 | 400 | 3.00E−37 | gp:[GI:g1816639] [LN:BJU85623] [AC:U85623] [PN:leucine-responsive regulatory protein] [GN:lrp] [FN:transcription regulator] [OR:*Bradyrhizobium japonicum*] [DE:*Bradyrhizobium japonicum* leucine-responsive regulatory protein(lrp) gene, complete cds.] [NT:LRP] |
| Contig146G | 21533583_c1_929 | 2384 | 6510 | 915 | 304 | 614 | 6.30E−60 | sp:[LN:Y412_METJA] [AC:Q57855] [GN:MJ0412] [OR:*METHANOCOCCUS JANNASCHII*] [DE:HYPOTHETICAL ABC TRANSPORTER ATP-BINDING PROTEIN MJ0412] [SP:Q57855] |
| Contig146G | 21566686_c3_1600 | 2385 | 6511 | 1317 | 438 | 1008 | 1.10E−101 | pir:[LN:B70399] [AC:B70399] [PN:aspartokinase] [GN:lysC] [CL:aspartate kinase:aspartate kinase homology] [OR:*Aquifex aeolicus*] |
| Contig146G | 21569075_f1_170 | 2386 | 6512 | 1437 | 478 | | | NO-HIT |
| Contig146G | 21675035_c1_827 | 2387 | 6513 | 960 | 319 | 781 | 1.30E−77 | sp:[LN:SRPH_SYNP7] [AC:Q59967] [GN:SRPH] [OR:SYNECHOCOCCUS SP] [SR:PCC 7942,ANACYSTIS NIDULANS R2] [EC:2.3.1.30] [DE:SERINE ACETYLTRANSFERASE, PLASMID, (SAT)] [SP:Q59967] |
| Contig146G | 21683402_f3_527 | 2388 | 6514 | 339 | 112 | | | NO-HIT |
| Contig146G | 21692188_f2_364 | 2389 | 6515 | 996 | 331 | | | NO-HIT |
| Contig146G | 21697193_f2_289 | 2390 | 6516 | 1248 | 415 | 746 | 6.50E−74 | sp:[LN:PYR2_PSEAE] [AC:Q51551] [GN:PYRC':PYRX] [OR:*PSEUDOMONAS AERUGINOSA*] [DE:CATALYTIC CHAIN)] [SP:Q51551] |
| Contig146G | 21723425_f1_146 | 2391 | 6517 | 1101 | 366 | 420 | 2.30E−39 | sp:[LN:Y131_HAEIN] [AC:P43951] [GN:HI0131] [OR:*HAEMOPHILUS INFLUENZAE*] [DE:HYPOTHETICAL PROTEIN HI0131 PRECURSOR] [SP:P43951] |
| Contig146G | 21754086_c1_940 | 2392 | 6518 | 195 | 64 | | | NO-HIT |
| Contig146G | 21876040_c3_1616 | 2393 | 6519 | 1902 | 633 | 197 | 1.60E−19 | sp:[LN:LCFH_HAEIN] [AC:P44446] [GN:HI0002] [OR:*HAEMOPHILUS INFLUENZAE*] [EC:6.2.1.3] [DE:ACYL-COA SYNTHETASE) (LACS)] [SP:P44446] |
| Contig146G | 21876500_f3_612 | 2394 | 6520 | 747 | 248 | 367 | 9.40E−34 | sp:[LN:YAHD_ECOLI] [AC:P77736] [GN:YAHD] [OR:*ESCHERICHIA COLI*] [DE:HYPOTHETICAL 21.7 KD PROTEIN IN BETT-PRPR INTERGENIC REGION] [SP:P77736] |

TABLE 2-continued

| Query | Orf | NT ID | AA ID | NT Lgth | AA Lgth | Score | P-value | Subject |
|---|---|---|---|---|---|---|---|---|
| Contig146G | 21882762_c1_861 | 2395 | 6521 | 855 | 284 | 592 | 1.30E−57 | gp:[GI:g3253197] [LN:AF029714] [AC:AF029714:Z71175] [PN:PhaA] [GN:phaA] [OR:*Pseudomonas putida*] [DE:*Pseudomonas putida* repressor (phaN), regulatory protein (phaM),enoyl-CoA hydratase I (phaA), enoyl-CoA hydratase II (phaB),3-hydroxyacyl-CoA dehydrogenase (phaC), ketothiolase (phaD),phenylacetyl-CoA ligase (phaE), ring-oxidation complex protein 1(phaF), ring-oxidation complex protein 2 (phaG), ring-oxidationcomplex protein 3 (phaH), ring-oxidation complex protein 4 (phaI),permease (phaJ), channel-forming protein (phaK), and ring-openingenzyme (phaL) genes, complete cds.] [NT:Enoyl-CoA hydratase I] |
| Contig146G | 21911263_f1_234 | 2396 | 6522 | 216 | 71 | | | NO-HIT |
| Contig146G | 21915633_f2_475 | 2397 | 6523 | 1563 | 520 | 610 | 1.70E−59 | sp:[LN:YJEF_ECOLI] [AC:P31806] [GN:YJEF] [OR:*ESCHERICHIA COLI*] [DE:HYPOTHETICAL 54.7 KD PROTEIN IN PSD-AMIB INTERGENIC REGION (URF1)] [SP:P31806] |
| Contig146G | 22032692_c3_1529 | 2398 | 6524 | 228 | 75 | | | NO-HIT |
| Contig146G | 22292627_c3_1378 | 2399 | 6525 | 801 | 266 | 592 | 1.30E−57 | sp:[LN:YGAZ_ECOLI] [AC:P76630] [GN:YGAZ] [OR:*ESCHERICHIA COLI*] [DE:HYPOTHETICAL 26.1 KD PROTEIN IN PROX-MPRA INTERGENIC REGION] [SP:P76630] |
| Contig146G | 22345087_f3_515 | 2400 | 6526 | 294 | 97 | | | NO-HIT |
| Contig146G | 22460031_c2_1286 | 2401 | 6527 | 1335 | 444 | 395 | 1.00E−36 | gp:[GI:g3253207] [LN:AF029714] [AC:AF029714:Z71175] [PN:PhaK] [GN:phaK] [OR:*Pseudomonas putida*] [DE:*Pseudomonas putida* repressor (phaN), regulatory protein (phaM),enoyl-CoA hydratase I (phaA), enoyl-CoA hydratase II (phaB),3-hydroxyacyl-CoA dehydrogenase (phaC), ketothiolase (phaD),phenylacetyl-CoA ligase (phaE), ring-oxidation complex protein 1(phaF), ring-oxidation complex protein 2 (phaG), ring-oxidationcomplex protein 3 (phaH), ring-oxidation complex protein 4 (phaI),permease (phaJ), channel-forming protein (phaK), and ring-openingenzyme (phaL) genes, complete cds.] [NT:Channel-forming protein] |
| Contig146G | 22663961_c3_1374 | 2402 | 6528 | 690 | 229 | 509 | 8.40E−49 | sp:[LN:YAEE_ECOLI] [AC:P31547] [GN:YAEE] [OR:*ESCHERICHIA COLI*] [DE:HYPOTHETICAL ABC TRANSPORTER PERMEASE PROTEIN YAEE] [SP:P31547] |
| Contig146G | 22687837_f3_734 | 2403 | 6529 | 444 | 147 | | | NO-HIT |
| Contig146G | 22699052_c2_1146 | 2404 | 6530 | 1617 | 538 | 1839 | 9.70E−190 | pir:[LN:F70550] [AC:F70550] [PN:probable accD1 protein] [GN:accD1] [CL:propionyl-CoA carboxylase beta chain] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig146G | 22710457_f3_700 | 2405 | 6531 | 999 | 332 | 957 | 2.80E−96 | gp:[GI:d1037193:g4062976] [LN:AB017138] [AC:AB017138] [PN:beta subunit of malonate decarboxylase] [GN:mdcD] [OR:*Pseudomonas putida*] [SR:*Pseudomonas putida* DNA] [DE:*Pseudomonas putida* malonate decarboxylase gene cluster (mdcA, mdcB,mdcC, mdcD, mdcE, mdcG, mdcH, mdcL and mdcM genes), complete cds.] |
| Contig146G | 22837801_f1_79 | 2406 | 6532 | 195 | 64 | 195 | 1.60E−15 | pir:[LN:A48362] [AC:A48362:S24623] [PN:hypothetical protein 280 (rpoN 5' region)] [CL:unassigned ATP-binding cassette proteins:ATP-binding cassette homology] [OR:*Alcaligenes eutrophus*] |
| Contig146G | 22837832_c3_1462 | 2407 | 6533 | 813 | 270 | 377 | 8.20E−35 | gp:[GI:e242883:g2764829] [LN:ECPAA] [AC:X97452] [PN:enoyl-CoA isomerase] [GN:G] [OR:*Escherichia coli*] [DE:*E.coli* cluster for phenylacetic acid degradation.] [NT:putative] [SP:P77467] |
| Contig146G | 22897915_f2_323 | 2408 | 6534 | 570 | 189 | 654 | 3.60E−64 | gp:[GI:g2317737] [LN:AF013987] [AC:AF013987] [PN:putative ABC transporter ATP-binding protein] [OR:*Vibrio cholerae*] [DE:*Vibrio cholerae* strain 0395 putative ABC transporter ATP-bindingprotein, sigma54 (rpoN), putative sigma54 modulation protein andnitrogen regulatory IIA protein (ptsN) genes, complete cds.] |
| Contig146G | 22898593_f1_128 | 2409 | 6535 | 768 | 255 | 686 | 1.50E−67 | sp:[LN:PAAC_ECOLI] [AC:P76079:O53011] [GN:PAAC] [OR:*ESCHERICHIA COLI*] [DE:PHENYLACETIC ACID DEGRADATION PROTEIN PAAC] [SP:P76079:O53011] |
| Contig146G | 23437893_f2_337 | 2410 | 6536 | 456 | 151 | | | NO-HIT |
| Contig146G | 23438950_c1_999 | 2411 | 6537 | 1251 | 416 | 625 | 4.30E−61 | pir:[LN:B65048] [AC:B65048] [PN:hypothetical protein b2681] [OR:*Escherichia coli*] |
| Contig146G | 23444053_f2_415 | 2412 | 6538 | 243 | 80 | | | NO-HIT |
| Contig146G | 23445902_c1_755 | 2413 | 6539 | 738 | 245 | 548 | 6.20E−53 | gp:[GI:g4155790] [LN:AE001545] [AC:AE001545:AE001439] [PN:putative] [GN:jhp1180] [OR:*Helicobacter pylori* J99] [DE:*Helicobacter pylori*, strain J99 section 106 of 132 of the completegenome.] [NT:similar to *H. pylori* 26695 gene HP1259] |
| Contig146G | 23447187_c3_555 | 2414 | 6540 | 732 | 243 | | | NO-HIT |
| Contig146G | 23469000_c3_1368 | 2415 | 6541 | 237 | 78 | | | NO-HIT |
| Contig146G | 23477192_f3_596 | 2416 | 6542 | 1608 | 535 | 463 | 6.30E−44 | gp:[GI:g2290992] [LN:AF006000] [AC:AF006000] [PN:unknown] [OR:*Bordetella pertussis*] [DE:*Bordetella pertussis* D-3-phosphoglycerate dehydrogenase homolog(serA) and Brg1 (brg1) genes, complete cds.] [NT:orf8; similar to *S. cerevisiae* urea amidolyase] |
| Contig146G | 23494028_c1_752 | 2417 | 6543 | 540 | 179 | 292 | 8.30E−26 | sp:[LN:YAIL_ECOLI] [AC:P51024:P77803] [GN:YAIL] [OR:*ESCHERICHIA COLI*] [DE:HYPOTHETICAL 19.9 KD PROTEIN IN MHPT-ADHC INTERGENIC REGION] [SP:P51024:P77803] |

TABLE 2-continued

| Query | Orf | NT ID | AA ID | NT Lgth | AA Lgth | Score | P-value | Subject |
|---|---|---|---|---|---|---|---|---|
| Contig146G | 23494037_c2_1076 | 2418 | 6544 | 411 | 136 | 96 | 0.00014 | pir:[LN:F69883] [AC:F69883] [PN:conserved hypothetical protein ymaD] [GN:ymaD] [OR:*Bacillus subtilis*] |
| Contig146G | 23525250_f1_59 | 2419 | 6545 | 219 | 72 | 233 | 1.50E−19 | gp:[GI:e1352158:g3892590] [LN:LLY17217] [AC:Y17217] [PN:cold shock protein E] [GN:cspE] [OR:*Lactococcus lactis*] [DE:*Lactococcus lactis* cspE gene.] |
| Contig146G | 23535681_c1_797 | 2420 | 6546 | 924 | 307 | 467 | 2.40E−44 | gp:[GI:e1331986:g4106617] [LN:YP102KB] [AC:AL031866] [OR:*Yersinia pestis*] [DE:*Yersinia pestis* 102 kbases unstable region: from 1 to 119443.] [NT:ORF49, len= 294, propable transcriptional] |
| Contig146G | 23541537_c1_961 | 2421 | 6547 | 1059 | 352 | 284 | 5.90E−25 | sp:[LN:ALBR_KLEOX] [AC:P10488] [OR:*KLEBSIELLA OXYTOCA*] [DE:ALBICIDIN RESISTANCE PROTEIN] [SP:P10488] |
| Contig146G | 235427_f3_712 | 2422 | 6548 | 189 | 62 | | | NO-HIT |
| Contig146G | 23572187_c3_1631 | 2423 | 6549 | 1434 | 477 | 1587 | 4.90E−163 | gp:[GI:e1310884:g3319729] [LN:SC6A9] [AC:AL031035] [PN:aldehyde dehydrogenase] [GN:SC6A9.10c] [OR:*Streptomyces coelicolor*] [DE:*Streptomyces coelicolor* cosmid 6A9.] [NT:SC6A9.10c, probable aldehyde dehydrogenase, len:] |
| Contig146G | 23595201_c3_1483 | 2424 | 6550 | 1227 | 408 | 206 | 1.10E−13 | gp:[GI:g4106928] [LN:AF114794] [AC:AF114794] [PN:orf544] [GN:orf544] [OR:Mitochondrion *Porphyra purpurea*] [SR:*Porphyra purpurea*] [DE:*Porphyra purpurea* mitochondrion, complete genome.] [NT:Related to reverse transcriptases; Orf inside an] |
| Contig146G | 23612917_c2_1137 | 2425 | 6551 | 1020 | 339 | 540 | 4.40E−52 | sp:[LN:HRPX_PLALO] [AC:P04929] [OR:*PLASMODIUM LOPHURAE*] [DE:HISTIDINE-RICH GLYCOPROTEIN PRECURSOR] [SP:P04929] |
| Contig146G | 23625202_f1_134 | 2426 | 6552 | 789 | 262 | | | NO-HIT |
| Contig146G | 23625827_f3_492 | 2427 | 6553 | 1071 | 356 | 448 | 2.50E−42 | gp:[GI:g1657970] [LN:PAU73506] [AC:U73506] [PN:OruR] [GN:oruR] [OR:*Pseudomonas aeruginosa*] [DE:*Pseudomonas aeruginosa* ornithine utilization regulatory (oruR)gene, complete cds.] [NT:regulatory locus for ornithine utilization] |
| Contig146G | 23626412_c3_1459 | 2428 | 6554 | 786 | 261 | 352 | 3.70E−32 | gp:[GI:g510725] [LN:STMPKSO] [AC:L33245] [PN:ketoreductase] [OR:*Streptomyces venezuelae*] [DE:*Streptomyces venezuelae* polyketide synthase genes, five completecds.] [NT:putative] |
| Contig146G | 23632012_c3_1425 | 2429 | 6555 | 951 | 316 | 819 | 1.20E−81 | sp:[LN:LTRA_KLEPN] [AC:P52689] [GN:LTRA] [OR:*KLEBSIELLA PNEUMONIAE*] [DE:PROBABLE TRANSCRIPTIONAL REGULATOR LTRA] [SP:P52689] |
| Contig146G | 23634692_f2_379 | 2430 | 6556 | 1068 | 355 | 462 | 8.10E−44 | sp:[LN:SRPA_SYNP7] [AC:Q55025] [GN:SRPA] [OR:SYNECHOCOCCUS SP] [SR:PCC 7942,ANACYSTIS NIDULANS R2] [DE:SRPA PROTEIN PRECURSOR] [SP:Q55025] |

TABLE 2-continued

| Query | Orf | NT ID | AA ID | NT Lgth | AA Lgth | Score | P-value | Subject |
|---|---|---|---|---|---|---|---|---|
| Contig146G | 23644025_c3_1392 | 2431 | 6557 | 447 | 148 | 502 | 4.60E−48 | gp:[GI:d1025746:g2879921] [LN:AB004659] [AC:AB004659] [PN:ArsC] [GN:arsC] [OR:*Acidiphilium multivorum*] [SR:*Acidiphilium multivorum* (strain:AIU 301) plasmid:pKW301 DNA] [DE:*Acidiphilium multivorum* plasmid pKW301 gene for ArsR, ArsD, ArsA,ArsB, ArsC, complete cds.] [NT:reduces arsenate(As+5) to arsenite(As3+); converts] |
| Contig146G | 23710933_c2_1072 | 2432 | 6558 | 468 | 155 | 188 | 8.70E−15 | gp:[GI:e1237897:g2791988] [LN:SAMECARII] [AC:Y14051] [PN:hypothetical protein] [OR:*Staphylococcus aureus*] [DE:*Staphylococcus aureus* mecA, mecR1, mecI genes and ORF168, ORF142,ORF44, ORF145 and ORF224.] [NT:ORF142] |
| Contig146G | 23832801_c3_1355 | 2433 | 6559 | 855 | 284 | 390 | 3.40E−36 | sp:[LN:BLP2_PSEAE] [AC:P14489] [GN:PSE2:OXA10] [OR:*PSEUDOMONAS AERUGINOSA*] [EC:3.5.2.6] [DE:BETA-LACTAMASE PSE-2 PRECURSOR, (BETA LACTAMASE OXA-10)] [SP:P14489] |
| Contig146G | 23835012_f1_101 | 2434 | 6560 | 738 | 245 | 381 | 3.10E−35 | sp:[LN:YBEQ_ECOLI] [AC:P77234] [GN:YBEQ] [OR:*ESCHERICHIA COLI*] [DE:HYPOTHETICAL 37.3 KD PROTEIN IN LEUS-GLTL INTERGENIC REGION] [SP:P77234] |
| Contig146G | 23847658_c2_1279 | 2435 | 6561 | 1398 | 465 | 233 | 6.90E−17 | pir:[LN:C64552] [AC:C64552] [PN:exonuclease VII, large subunit] [OR:*Helicobacter pylori*] |
| Contig146G | 23866261_c3_1360 | 2436 | 6562 | 1080 | 359 | 395 | 1.00E−36 | sp:[LN:MRKD_KLEPN] [AC:P21648] [GN:MRKD] [OR:*KLEBSIELLA PNEUMONIAE*] [DE:FIMBRIA ADHESIN PROTEIN PRECURSOR] [SP:P21648] |
| Contig146G | 23870462_c1_1064 | 2437 | 6563 | 783 | 260 | 159 | 1.40E−11 | gp:[GI:g2384695] [LN:AF013216] [AC:AF013216:U81372] [PN:unknown] [OR:*Myxococcus xanthus*] [DE:*Myxococcus xanthus* Dog (dog), isocitrate lyase (icl), Mls (mls),Ufo (ufo), fumarate hydratase (fhy), and proteosome major subunit(clpP) genes, complete cds; and acyl-CoA oxidase (aco) gene,partial cds.] |
| Contig146G | 23883555_f1_131 | 2438 | 6564 | 1221 | 406 | 1376 | 1.10E−140 | gp:[GI:g3253200] [LN:AF029714] [AC:AF029714:Z71175] [PN:PhaD] [GN:phaD] [OR:*Pseudomonas putida*] [DE:*Pseudomonas putida* repressor (phaN), regulatory protein (phaM),enoyl-CoA hydratase I (phaA), enoyl-CoA hydratase II (phaB),3-hydroxyacyl-CoA dehydrogenase (phaC), ketothiolase (phaD),phenylacetyl-CoA ligase (phaE), ring-oxidation complex protein 1(phaF), ring-oxidation complex protein 2 (phaG), ring-oxidationcomplex protein 3 (phaH), ring-oxidation complex protein 4 (phaI),permease (phaJ), channel-forming protein (phaK), and ring-openingenzyme (phaL) genes, complete cds.] [NT:Ketothiolase] |

TABLE 2-continued

| Query | Orf | NT ID | AA ID | NT Lgth | AA Lgth | Score | P-value | Subject |
|---|---|---|---|---|---|---|---|---|
| Contig146G | 23947162_f3_713 | 2439 | 6565 | 1038 | 345 | 1144 | 4.30E–116 | pir:[LN:E69220] [AC:E69220] [PN:conserved hypothetical protein MTH900] [GN:MTH900] [CL:conserved hypothetical protein MTH900] [OR:*Methanobacterium thermoautotrophicum*] |
| Contig146G | 24039030_f2_273 | 2440 | 6566 | 1032 | 343 | 181 | 1.50E–11 | pir:[LN:H70882] [AC:H70882] [PN:hypothetical protein Rv2777c] [GN:Rv2777cp] [OR:*Mycobacterium tuberculosis*] |
| Contig146G | 24052_f1_175 | 2441 | 6567 | 900 | 299 | 812 | 6.60E–81 | gp:[GI:g1930092] [LN:CJU93169] [AC:U93169] [PN:outer membrane protein] [GN:ompH1] [OR:*Campylobacter jejuni*] [DE:*Campylobacter jejuni* outer membrane protein (ompH1) gene, completecds.] [NT:glutamine binding protein analog] |
| Contig146G | 24085342_f3_668 | 2442 | 6568 | 684 | 227 | 192 | 3.30E–15 | gp:[GI:d1039056:g4512353] [LN:AB011836] [AC:AB011836] [GN:ycgJ] [OR:*Bacillus halodurans*] [SR:*Bacillus halodurans* (strain:C-125, isolate:xylanase producer) DNA] [DE:*Bacillus halodurans* C-125 genomic DNA, clone ALBAC003.] [NT:similar to *B. subtilis* ycgJ gene(35%-identity)] |
| Contig146G | 24089637_c3_1543 | 2443 | 6569 | 759 | 252 | | | NO-HIT |
| Contig146G | 24093833_c3_1601 | 2444 | 6570 | 276 | 91 | 255 | 6.90E–22 | gp:[GI:g3293579] [LN:AF074437] [AC:AF074437] [PN:RsmA] [GN:rsmA] [OR:*Serratia marcescens*] [DE:*Serratia marcescens* AlaS (alaS) gene, partial cds; and RsmA (rsmA)gene, complete cds.] [NT:involved in the process of swarming and] |
| Contig146G | 24094030_f2_451 | 2445 | 6571 | 645 | 214 | 206 | 1.10E–16 | pir:[LN:C70068] [AC:C70068] [PN:probable chromate transport protein] [GN:ywrA] [CL:probable chromate transport protein ywrA] [OR:*Bacillus subtilis*] |
| Contig146G | 24095687_f1_232 | 2446 | 6572 | 306 | 101 | | | NO-HIT |
| Contig146G | 24219005_f3_598 | 2447 | 6573 | 270 | 89 | | | NO-HIT |
| Contig146G | 24219058_c3_1367 | 2448 | 6574 | 1392 | 463 | | | NO-HIT |
| Contig146G | 24219663_c3_1404 | 2449 | 6575 | 1086 | 361 | 1104 | 7.50E–112 | gp:[GI:e293136:g2208965] [LN:PACIOAB] [AC:Y10528] [PN:cyanide insensitive terminal oxidase] [GN:cioB] [OR:*Pseudomonas aeruginosa*] [DE:*P.aeruginosa* cioA and cioB genes.] |
| Contig146G | 24220400_c3_1618 | 2450 | 6576 | 1332 | 443 | 760 | 2.10E–75 | gp:[GI:g2271502] [LN:AF009672] [AC:AF009672] [PN:unknown] [GN:ORF6] [OR:Acinetobacter sp. ADP1] [DE:Acinetobacter sp. ADP1 vanillate demethylase region, vanillatedemethylase (vanB) and vanillate demethylase (vanA) genes, completecds.] [NT:putative porin] |
| Contig146G | 24222792_c2_1224 | 2451 | 6577 | 1032 | 343 | 348 | 9.70E–32 | pir:[LN:S77447] [AC:S77447] [PN:nitrate transport protein nrtB homolog:protein sl11081:protein sl11081] [CL:Synechococcus nitrate transport protein nrtB] [OR:Synechocystis sp.] [SR:PCC 6803,, PCC 6803] [SR:PCC 6803,] |
| Contig146G | 24225250_f3_555 | 2452 | 6578 | 261 | 86 | | | NO-HIT |
| Contig146G | 24225262_f2_303 | 2453 | 6579 | 216 | 71 | | | NO-HIT |
| Contig146G | 24229627_f1_64 | 2454 | 6580 | 615 | 204 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig146G | 24230438_f1_179 | 2455 | 6581 | 942 | 313 | 554 | 1.40E−53 | sp:[LN:YHJC_ECOLI] [AC:P37641] [GN:YHJC] [OR:*ESCHERICHIA COLI*] [DE:HYPOTHETICAL TRANSCRIPTIONAL REGULATOR IN TREF-KDGK INTERGENIC REGION] [SP:P37641] |
| Contig146G | 24245125_c1_776 | 2456 | 6582 | 954 | 317 | 219 | 1.30E−16 | gp:[GI:g2665650] [LN:AF031571] [AC:AF031571] [PN:unknown] [OR:*Pseudomonas aeruginosa*] [DE:*Pseudomonas aeruginosa* unknown protein genes, complete cds.] [NT:ORF2] |
| Contig146G | 24255432_c1_772 | 2457 | 6583 | 2553 | 850 | 1473 | 5.90E−151 | sp:[LN:MRKC_KLEPN] [AC:P21647] [GN:MRKC] [OR:*KLEBSIELLA PNEUMONIAE*] [DE:OUTER MEMBRANE USHER PROTEIN MRKC PRECURSOR] [SP:P21647] |
| Contig146G | 24256887_c3_1439 | 2458 | 6584 | 345 | 114 | | | NO-HIT |
| Contig146G | 24257137_c2_1319 | 2459 | 6585 | 948 | 315 | 1176 | 1.80E−119 | gp:[GI:e1290213:g3116017] [LN:PFPHCOAHL] [AC:Y13067] [PN:p-hydroxycinnamoyl CoA hydratase/lyase] [OR:*Pseudomonas fluorescens*] [DE:*Pseudomonas fluorescens* genes encoding p-hydroxycinnamoyl CoAhydratase/lyase and vanillin: NAD+ oxidoreductase.] |
| Contig146G | 24257275_c3_1520 | 2460 | 6586 | 2007 | 668 | 178 | 5.80E−10 | pir:[LN:G71620] [AC:G71620] PN:hypothetical protein PFB0195c] [GN:PFB0195c] [OR:*Plasmodium falciparum*] |
| Contig146G | 24301577_f3_566 | 2461 | 6587 | 1491 | 496 | 136 | 7.50E−06 | gp:[GI:g3249594] [LN:AF065411] [AC:AF065411] [PN:large terminase subunit] [OR:Methaneobacterium phage psiM2] [DE:Methanobacterium phage psiM2, complete genome.] [NT:ORF9; similar to *Bacillus subtilis* phage SPP1 large] |
| Contig146G | 24306505_f2_311 | 2462 | 6588 | 282 | 93 | | | NO-HIT |
| Contig146G | 24306526_f1_217 | 2463 | 6589 | 525 | 174 | 240 | 2.70E−20 | sp:[LN:YGB0_YEAST] [AC:P25338] [GN:YGL010W:YGL021] [OR:*SACCHAROMYCES CEREVISIAE*] [SR:,BAKER'S YEAST] [DE:HYPOTHETICAL 20.2 KD PROTEIN IN PRS2-LEU1 INTERGENIC REGION] [SP:P25338] |
| Contig146G | 24306555_f1_72 | 2464 | 6590 | 495 | 164 | | | NO-HIT |
| Contig146G | 24333453_f3_705 | 2465 | 6591 | 1467 | 488 | 274 | 1.60E−31 | pir:[LN:S74046] [AC:S74046] [PN:probable sugar transport protein c0110] [OR:*Sulfolobus solfataricus*] |
| Contig146G | 24334707_f3_580 | 2466 | 6592 | 1563 | 520 | 242 | 1.60E−17 | gp:[GI:e249420:g1405817] [LN:SMHASF] [AC:X98513] [PN:HAS ABC exporter outer membrane component] [GN:hasF] [OR:*Serratia marcescens*] [DE:*S.marcescens* hasF gene.] |
| Contig146G | 24351577_f3_613 | 2467 | 6593 | 483 | 160 | 306 | 2.70E−27 | pir:[LN:F69857] [AC:F69857] [PN:conserved hypothetical protein yknA] [GN:yknA] [CL:hypothetical protein j] [OR:*Bacillus subtilis*] |
| Contig146G | 24400307_f2_380 | 2468 | 6594 | 576 | 191 | 217 | 7.40E−18 | pir:[LN:F64848] [AC:F64848] [PN:probable membrane protein b1057] [OR:*Escherichia coli*] |
| Contig146G | 24406512_f3_490 | 2469 | 6595 | 366 | 121 | | | NO-HIT |
| Contig146G | 24406587_c2_1245 | 2470 | 6596 | 468 | 155 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig146G | 24406683_c1_909 | 2471 | 6597 | 708 | 235 | 895 | 1.10E−89 | sp:[LN:Y882_HAEIN] [AC:P44068] [GN:HI0882] [OR:*HAEMOPHILUS INFLUENZAE*] [DE:HYPOTHETICAL PROTEIN HI0882] [SP:P44068] |
| Contig146G | 24407805_f3_729 | 2472 | 6598 | 792 | 263 | 244 | 1.00E−20 | pir:[LN:S76871] [AC:S76871] [PN:hypothetical protein] [OR:Synechocystis sp.] [SR:PCC 6803,, PCC 6803] [SR:PCC 6803,] |
| Contig146G | 24412590_c1_969 | 2473 | 6599 | 189 | 62 | | | NO-HIT |
| Contig146G | 24413187_c2_1092 | 2474 | 6600 | 1320 | 439 | 390 | 3.40E−36 | sp:[LN:SOXC_RHOSO] [AC:P54998] [GN:SOXC:DSZC] [OR:RHODOCOCCUS SP] [DE:DIBENZOTHIOPHENE DESULFURIZATION ENZYME C (DBT SULFUR DIOXYGENASE)] [SP:P54998] |
| Contig146G | 24414652_f2_362 | 2475 | 6601 | 192 | 63 | | | NO-HIT |
| Contig146G | 24415937_f3_505 | 2476 | 6602 | 1284 | 427 | 1815 | 3.40E−187 | gp:[GI:g2271502] [LN:AF009672] [AC:AF009672] [PN:unknown] [GN:ORF6] [OR:Acinetobacter sp. ADP1] [DE:Acinetobacter sp. ADP1 vanillate demethylase region, vanillatedemethylase (vanB) and vanillate demethylase (vanA) genes, completecds.] [NT:putative porin] |
| Contig146G | 24415962_f2_400 | 2477 | 6603 | 1320 | 439 | | | NO-HIT |
| Contig146G | 24417250_f3_590 | 2478 | 6604 | 4884 | 1627 | 454 | 4.50E−60 | gp:[GI:g2920634] [LN:ECRHSEH2] [AC:AF044501] [PN:core protein] [OR:*Escherichia coli*] [DE:*Escherichia coli* strain cc45 RhsE accessory genetic element coreprotein gene, partial cds, and dsORF-e4, complete cds; and RhsHaccessory genetic element unknown (450), core protein, and dsORF-hlgenes, complete cds.] |
| Contig146G | 24425950_c3_1430 | 2479 | 6605 | 1647 | 548 | 1258 | 3.60E−128 | pir:[LN:C70565] [AC:C70565] [PN:hypothetical protein Rv3454] [GN:Rv3454] [OR:*Mycobacterium tuberculosis*] |
| Contig146G | 24431313_c2_1251 | 2480 | 6606 | 195 | 64 | | | NO-HIT |
| Contig146G | 24431502_f3_558 | 2481 | 6607 | 393 | 130 | | | NO-HIT |
| Contig146G | 24475342_f1_236 | 2482 | 6608 | 603 | 200 | 268 | 2.90E−23 | sp:[LN:YCEI_ECOLI] [AC:P37904] [GN:YCEI] [OR:*ESCHERICHIA COLI*] [DE:18.7 KD PROTEIN IN HTRB-DINI INTERGENIC REGION PRECURSOR] [SP:P37904] |
| Contig146G | 24479687_f1_58 | 2483 | 6609 | 612 | 203 | | | NO-HIT |
| Contig146G | 24495875_c3_1607 | 2484 | 6610 | 216 | 71 | | | NO-HIT |
| Contig146G | 24496055_c1_1006 | 2485 | 6611 | 516 | 171 | 772 | 1.10E−76 | sp:[LN:BENB_ACICA] [AC:P07770] [GN:BENB] [OR:*ACINETOBACTER CALCOACETICUS*] [EC:1.14.12.10] [DE:BENZOATE 1,2-DIOXYGENASE BETA SUBUNIT,] [SP:P07770] |
| Contig146G | 24501342_f1_51 | 2486 | 6612 | 975 | 324 | 1020 | 6.00E−103 | gp:[GI:g2996626] [LN:AF009224] [AC:AF009224:M76991:M76990: M23245:M29848:M29714:M62649] [PN:LysR-type transcriptional activator] [GN:benM] [OR:Acinetobacter sp. ADP1] [DE:Acinetobacter sp. ADP1 ben operon and cat operon, completesequence.] |

TABLE 2-continued

| Query | Orf | NT ID | AA ID | NT Lgth | AA Lgth | Score | P-value | Subject |
|---|---|---|---|---|---|---|---|---|
| Contig146G | 24616387_c1_851 | 2487 | 6613 | 783 | 260 | 638 | 1.80E-62 | sp:[LN:HMGL_PSEMV] [AC:P13703] [GN:MVAB] [OR:*PSEUDOMONAS MEVALONII*] [EC:4.1.3.4] [DE:(3-HYDROXY-3-METHYLGLUTARATE-COA LYASE)] [SP:P13703] |
| Contig146G | 24626577_c2_1244 | 2488 | 6614 | 1275 | 424 | 181 | 1.40E-10 | pir:[LN:F70552] [AC:F70552] [PN:probable lpqF protein] [GN:lpqF] [OR:*Mycobacterium tuberculosis*] |
| Contig146G | 24640675_c2_1183 | 2489 | 6615 | 669 | 222 | 178 | 1.00E-13 | sp:[LN:YDHC_BACSU] [AC:O05494] [GN:YDHC] [OR:*BACILLUS SUBTILIS*] [DE:HYPOTHETICAL TRANSCRIPTIONAL REGULATOR IN DINB-PHOB INTERGENIC REGION] [SP:O05494] |
| Contig146G | 24642177_f3_591 | 2490 | 6616 | 675 | 224 | | | NO-HIT |
| Contig146G | 24642840_c3_1579 | 2491 | 6617 | 207 | 68 | 107 | 3.30E-06 | sp:[LN:MERP_PSEFL] [AC:Q51770] [GN:MERP] [OR:*PSEUDOMONAS FLUORESCENS*] [DE:(PERIPLASMIC MERCURY ION BINDING PROTEIN) (MERCURY SCAVENGER PROTEIN)] [SP:Q51770] |
| Contig146G | 24645967_c2_1316 | 2492 | 6618 | 957 | 318 | 1355 | 1.90E-138 | sp:[LN:VANB_ACICA] [AC:O24840] [GN:VANB] [OR:*ACINETOBACTER CALCOACETICUS*] [EC:1.14.13.—] [DE:DEGRADATION FERREDOXIN-LIKE PROTEIN)] [SP:O24840] |
| Contig146G | 24646003_f1_43 | 2493 | 6619 | 786 | 261 | 109 | 7.00E-07 | pir:[LN:D70955] [AC:D70955] [PN:hypothetical protein Rv3603c] [GN:Rv3603c] [OR:*Mycobacterium tuberculosis*] |
| Contig146G | 24646877_c1_890 | 2494 | 6620 | 429 | 142 | | | NO-HIT |
| Contig146G | 24647802_f2_355 | 2495 | 6621 | 774 | 257 | 224 | 1.30E-18 | sp:[LN:YZ27_MYCTU] [AC:Q10557] [GN:MTCY31.27] [OR:*MYCOBACTERIUM TUBERCULOSIS*] [DE:HYPOTHETICAL 33.6 KD PROTEIN CY31.27] [SP:Q10557] |
| Contig146G | 24648275_c3_1570 | 2496 | 6622 | 201 | 66 | | | NO-HIT |
| Contig146G | 24648882_f1_111 | 2497 | 6623 | 483 | 160 | 231 | 2.40E-19 | gp:[GI:g2708664] [LN:AF037441] [AC:AF037441] [PN:putative 18.8 kDa protein] [GN:eip19] [OR:*Edwardsiella ictaluri*] [DE:*Edwardsiella ictaluri* putative 188 kDa protein (eip19), putative17.8 kDa protein (eip18), putative 54.5 kDa protein (eip55), andputative 19.5 kDa protein (eip20) genes, complete cds.] [NT:EIP19; possibly antigenic to catfish] |
| Contig146G | 24650037_c2_1243 | 2498 | 6624 | 189 | 62 | | | NO-HIT |
| Contig146G | 24656577_f2_302 | 2499 | 6625 | 234 | 77 | | | NO-HIT |
| Contig146G | 24689056_c1_1034 | 2500 | 6626 | 2682 | 893 | 2700 | 5.60E-281 | sp:[LN:SYA_HAEIN] [AC:P43815] [GN:ALAS:HI0814] [OR:*HAEMOPHILUS INFLUENZAE*] [EC:6.1.1.7] [DE:ALANYL-TRNA SYNTHETASE, (ALANINE--TRNA LIGASE) (ALARS)] [SP:P43815] |
| Contig146G | 24725437_f3_714 | 2501 | 6627 | 573 | 190 | 187 | 4.90E-14 | sp:[LN:CHRA_ALCEU] [AC:P17551] [GN:CHRA] [OR:*ALCALIGENES EUTROPHUS*] [DE:CHROMATE TRANSPORT PROTEIN] [SP:P17551] |

TABLE 2-continued

| Query | Orf | NT ID | AA ID | NT Lgth | AA Lgth | Score | P-value | Subject |
|---|---|---|---|---|---|---|---|---|
| Contig146G | 24744025_c1_828 | 2502 | 6628 | 936 | 311 | 1186 | 1.50E−120 | sp:[LN:SRPI_SYNP7] [AC:Q55032] [GN:SRPI] [OR:SYNECHOCOCCUS SP] [SR:PCC 7942,ANACYSTIS NIDULANS R2] [DE:SRPI PROTEIN] [SP:Q55032] |
| Contig146G | 24812750_f1_7 | 2503 | 6629 | 573 | 190 | | | NO-HIT |
| Contig146G | 24822336_c3_1582 | 2504 | 6630 | 804 | 267 | 1036 | 1.20E−104 | sp:[LN:BEND_ACICA] [AC:P07772] [GN:BEND] [OR:*ACINETOBACTER CALCOACETICUS*] [EC:1.3.1.55] [DE:DEHYDROGENASE)] [SP:P07772] |
| Contig146G | 24850402_c1_792 | 2505 | 6631 | 918 | 305 | 766 | 4.90E−76 | gp:[GI:g3046322] [LN:AF010139] [AC:AF010139] [PN:O-acetylserine synthase] [GN:cysE2] [OR:*Azotobacter vinelandii*] [DE:*Azotobacter vinelandii* iron-sulfur cluster assembly gene cluster,suhB, cysE2, iscS, iscU, iscA, hscB, hscA and fdx genes completecds; ndk gene, partial cds.] [NT:CysE2] |
| Contig146G | 24881286_f1_133 | 2506 | 6632 | 420 | 139 | 183 | 3.00E−14 | sp:[LN:YM64_ARCFU] [AC:O28020] [GN:AF2264] [OR:*ARCHAEOGLOBUS FULGIDUS*] [DE:HYPOTHETICAL PROTEIN AF2264] [SP:O28020] |
| Contig146G | 24881542_f1_100 | 2507 | 6633 | 825 | 274 | 676 | 1.70E−66 | sp:[LN:YCSI_BACSU] [AC:P42966] [GN:YCSI] [OR:*BACILLUS SUBTILIS*] [DE:HYPOTHETICAL 28.1 KD PROTEIN IN SIPU-PBPC INTERGENIC REGION] [SP:P42966] |
| Contig146G | 24882812_f2_312 | 2508 | 6634 | 366 | 121 | | | NO-HIT |
| Contig146G | 24883377_c2_1295 | 2509 | 6635 | 363 | 120 | 111 | 1.30E−06 | sp:[LN:ANP_LIMFE] [AC:P09031] [OR:*LIMANDA FERRUGINEA*] [SR:,YELLOWTAIL FLOUNDER] [DE:ANTIFREEZE PROTEIN PRECURSOR (AFP)] [SP:P09031] |
| Contig146G | 24897128_c1_885 | 2510 | 6636 | 303 | 100 | 95 | 6.30E−05 | gp:[GI:g3378268] [LN:AF079317] [AC:AF079317] [PN:unknown] [GN:orf045] [OR:*Sphingomonas aromaticivorans*] [DE:*Sphingomonas aromaticivorans* plasmid pNL1, complete plasmidsequence.] |
| Contig146G | 250002_c3_1541 | 2511 | 6637 | 2676 | 891 | 2134 | 5.30E−221 | sp:[LN:MUTS_AZOVI] [AC:P27345] [GN:MUTS] [OR:*AZOTOBACTER VINELANDII*] [DE:DNA MISMATCH REPAIR PROTEIN MUTS] [SP:P27345] |
| Contig146G | 25276_c1_771 | 2512 | 6638 | 744 | 247 | 464 | 4.90E−44 | gp:[GI:g39717] [LN:BPACCG] [AC:X66729] [PN:*filamentous hemagglutinin*] [GN:FhaD] [OR:*Bordetella pertussis*] [DE:*B.pertussis* fhaD, fhaA and fhaE genes.] [SP:P33409] |
| Contig146G | 25400277_c3_1608 | 2513 | 6639 | 726 | 241 | 567 | 6.00E−55 | pir:[LN:S77110] [AC:S77110] [PN:hypothetical protein s111773] [CL:conserved hypothetical protein s111773] [OR:Synechocystis sp.] [SR:PCC 6803,, PCC 6803] [SR:PCC 6803,] |
| Contig146G | 25406692_c2_1141 | 2514 | 6640 | 1251 | 416 | | | NO-HIT |
| Contig146G | 25424077_f2_356 | 2515 | 6641 | 1095 | 364 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig146G | 25472150_f2_470 | 2516 | 6642 | 879 | 292 | 219 | 4.50E−18 | sp:[LN:HVRB_RHOCA] [AC:P42507] [GN:HVRB] [OR:*RHODOBACTER CAPSULATUS*] [SR:,*RHODOPSEUDOMONAS CAPSULATA*] [DE:AHCY TRANSCRIPTIONAL ACTIVATOR HVRB] [SP:P42507] |
| Contig146G | 25500251_f1_62 | 2517 | 6643 | 477 | 158 | 214 | 1.50E−17 | pir:[LN:F70918] [AC:F70918] [PN:probable regulatoryprotein] [GN:Rv3095] [OR:*Mycobacterium tuberculosis*] |
| Contig146G | 25509701_f3_581 | 2518 | 6644 | 615 | 204 | 217 | 7.40E−18 | sp:[LN:YA64_METJA] [AC:Q58464] [GN:MJ1064] [OR:*METHANOCOCCUS JANNASCHII*] [DE:HYPOTHETICAL PROTEIN MJ1064] [SP:Q58464] |
| Contig146G | 25553503_c3_1351 | 2519 | 6645 | 249 | 82 | | | NO HIT |
| Contig146G | 25553587_f1_97 | 2520 | 6646 | 531 | 176 | | | NO-HIT |
| Contig146G | 2556302_c3_1377 | 2521 | 6647 | 696 | 231 | 160 | 2.40E−11 | pir:[LN:E70790] [AC:E70790] [PN:probable transcription regulator Rv3676] [GN:Rv3676] [OR:*Mycobacterium tuberculosis*] |
| Contig146G | 25566256_f3_551 | 2522 | 6648 | 2541 | 846 | 2647 | 2.30E−275 | gp:[GI:g1353678] [LN:PMU42410] [AC:U42410] [PN:heavy-metal transporting P-type ATPase] [OR:*Proteus mirabilis*] [DE:*Proteus mirabilis* heavy-metal transporting P-type ATPase gene,partial cds.] [RE: |
| Contig146G | 25594062_c2_1073 | 2523 | 6649 | 1053 | 350 | 398 | 4.90E−37 | gp:[GI:g1657970] [LN:PAU73506] [AC:U73506] [PN:OruR] [GN:oruR] [OR:*Pseudomonas aeruginosa*] [DE:*Pseudomonas aeruginosa* ornithine utilization regulatory (oruR)gene, complete cds.] [NT:regulatory locus for ornithine utilization] |
| Contig146G | 25604662_f1_145 | 2524 | 6650 | 1230 | 409 | 1866 | 1.30E−192 | sp:[LN:PHHY_ACICA] [AC:Q03298] [GN:POBA] [OR:*ACINETOBACTER CALCOACETICUS*] [EC:1.14.13.2] [DE:MONOOXYGENASE)] [SP:Q03298] |
| Contig146G | 25664511_f1_20 | 2525 | 6651 | 717 | 238 | 938 | 2.90E−94 | gp:[GI:g2271498] [LN:AF009672] [AC:AF009672] [PN:unknown] [OR:Acinetobacter sp. ADP1] [DE:Acinetobacter sp. ADP1 vanillate demethylase region, vanillatedemethylase (vanB) and vanillate demethylase (vanA) genes, completecds.] [NT:putative regulatory protein; ORF4] |
| Contig146G | 25665937_c3_1420 | 2526 | 6652 | 864 | 287 | 1050 | 4.00E−106 | sp:[LN:YGHU_ECOLI] [AC:Q46845] [GN:YGHU] [OR:*ESCHERICHIA COLI*] [DE:HYPOTHETICAL 34.2 KD PROTEIN IN GSP-HYBG INTERGENIC REGION] [SP:Q46845] |
| Contig146G | 25994013_f1_120 | 2527 | 6653 | 291 | 96 | | | NO-HIT |
| Contig146G | 26071012_f2_419 | 2528 | 6654 | 624 | 207 | 301 | 9.30E−27 | gp:[GI:g862632] [LN:XXU13633] [AC:U13633] [PN:RumA(R391)] [GN:rumA(R391)] [OR:IncJ plasmid R391] [DE:IncJ plasmid R391 rumA(R391) and rumB(R391) genes, complete cds.] [NT:similar to *Escherichia coli* UmuD, Swiss-Prot] |

TABLE 2-continued

| Query | Orf | NT ID | AA ID | NT Lgth | AA Lgth | Score | P-value | Subject |
|---|---|---|---|---|---|---|---|---|
| Contig146G | 26174090_f3_710 | 2529 | 6655 | 699 | 232 | 263 | 9.90E−23 | sp:[LN:YCAC_ECOLI] [AC:P21367] [GN:YCAC] [OR:*ESCHERICHIA COLI*] [DE:HYPOTHETICAL 23.1 KD PROTEIN IN DMSC-PFLA INTERGENIC REGION] [SP:P21367] |
| Contig146G | 26174160_f2_391 | 2530 | 6656 | 888 | 295 | 592 | 1.30E−57 | gp:[GI:g3378447] [LN:AF079317] [AC:AF079317] [PN:unknown] [GN:orf1338] [OR:*Sphingomonas aromaticivorans*] [DE:*Sphingomonas aromaticivorans* plasmid pNL1, complete plasmidsequence.] [NT:putative inner membrane protein similar to B.] |
| Contig146G | 26225262_f2_338 | 2531 | 6657 | 1035 | 344 | 256 | 2.00E−28 | pir:[LN:F64805] [AC:F64805] [PN:hypothetical protein b0703] [OR:*Escherichia coli*] |
| Contig146G | 26258561_f3_536 | 2532 | 6658 | 624 | 207 | 405 | 8.80E−38 | sp:[LN:GT_PROMI] [AC:P15214] [GN:GSTB] [OR:*PROTEUS MIRABILIS*] [EC:2.5.1.18] [DE:GLUTATHIONE S-TRANSFERASE GST-6.0, (GST B1-1)] [SP:P15214] |
| Contig146G | 26265638_f2_457 | 2533 | 6659 | 666 | 221 | 172 | 4.30E−13 | sp:[LN:YD07_HAEIN] [AC:Q57320:O05057] [GN:HI1307] [OR:*HAEMOPHILUS INFLUENZAE*] [DE:HYPOTHETICAL PROTEIN HI1307] [SP:Q57320:O05057] |
| Contig146G | 26348387_c1_766 | 2534 | 6660 | 1188 | 395 | 1500 | 8.20E−154 | sp:[LN:METK_ECOLI] [AC:P04384:P30869] [GN:METK:METX] [OR:*ESCHERICHIA COLI*] [EC:2.5.1.6] [DE:ADENOSYLTRANSFERASE) (ADOMET SYNTHETASE)] [SP:P04384:P30869] |
| Contig146G | 26354500_f2_353 | 2535 | 6661 | 1845 | 614 | | | NO-HIT |
| Contig146G | 26360905_c1_994 | 2536 | 6662 | 201 | 66 | | | NO-HIT |
| Contig146G | 26364693_c2_1102 | 2537 | 6663 | 1482 | 493 | 1440 | 1.90E−147 | pir:[LN:H65000] [AC:H65000] [PN:hypothetical protein b2290] [OR:*Escherichia coli*] |
| Contig146G | 26454055_f1_71 | 2538 | 6664 | 489 | 162 | | | NO-HIT |
| Contig146G | 26579438_c2_1120 | 2539 | 6665 | 936 | 311 | 671 | 5.70E−66 | sp:[LN:MAUR_KLEPN] [AC:P52684] [GN:MAUR] [OR:*KLEBSIELLA PNEUMONIAE*] [DE:MALONATE UTILIZATION TRANSACTING REGULATOR] [SP:P52684] |
| Contig1466 | 265938_f2_250 | 2540 | 6666 | 201 | 66 | | | NO-HIT |
| Contig146G | 26595628_f3_644 | 2541 | 6667 | 729 | 242 | 381 | 3.10E−35 | gp:[GI:g1763080] [LN:STU69493] [AC:U69493] [PN:PhnR] [FN:probable repressor protein of GntR family] [OR:*Salmonella typhimurium*] [DE:*Salmonella typhimurium* ThiJ and Orf1 genes, partial cds, and PhnX,PhnW, PhnR, PhnS, PhnT, PhnU and PhnV genes, complete cds.] |
| Contig146G | 26597550_c1_800 | 2542 | 6668 | 897 | 298 | 427 | 4.10E−40 | pir:[LN:S77111] [AC:S77111] [PN:transcription regulator slr1871:protein slr1871:protein slr1871] [CL:conserved hypothetical protein HI1364] [OR:Synechocystis sp.] [SR:PCC 6803,, PCC 6803] [SR:PCC 6803,] |

TABLE 2-continued

| Query | Orf | NT ID | AA ID | NT Lgth | AA Lgth | Score | P-value | Subject |
|---|---|---|---|---|---|---|---|---|
| Contig146G | 26598562_c2_1340 | 2543 | 6669 | 1338 | 445 | 1165 | 2.60E−118 | sp:[LN:YCJJ_ECOLI] [AC:P76037] [GN:YCJJ] [OR:*ESCHERICHIA COLI*] [DE:HYPOTHETICAL 50.9 KD TRANSPORT PROTEIN IN SAPA-ALDH INTERGENIC REGION] [SP:P76037] |
| Contig146G | 26601383_f1_99 | 2544 | 6670 | 1260 | 419 | 946 | 4.10E−95 | pir:[LN:E69765] [AC:E69765:I39896:I39895] [PN:branched chain amino acids transporter homolog ycsG] [GN:ycsG] [OR:*Bacillus subtilis*] |
| Contig146G | 26601550_f2_401 | 2545 | 6671 | 1224 | 407 | 571 | 2.30E−55 | pir:[LN:D69779] [AC:D69779] [PN:antibiotic resistance protein homolog ydeR] [GN:ydeR] [OR:*Bacillus subtilis*] |
| Contig146G | 26648532_f2_438 | 2546 | 6672 | 786 | 261 | 1006 | 1.80E−101 | gp:[GI:d1037198:g4062981] [LN:AB017138] [AC:AB017138] [PN:malonate transporter] [GN:mdcM] [OR:*Pseudomonas putida*] [SR:*Pseudomonas putida* DNA] [DE:*Pseudomonas putida* malonate decarboxylase gene cluster (mdcA, mdcB,mdcC, mdcD, mdcE, mdcG, mdcH, mdcL and mdcM genes), complete cds.] |
| Contig146G | 267186_c3_1584 | 2547 | 6673 | 1413 | 470 | 1249 | 3.20E−127 | gp:[GI:g2352826] [LN:AF009224] [AC:AF009224:M76991:M76990: M23245:M29848:M29714:M62649] [PN:benzoate transport protein] [GN:benK] [OR:Acinctobacter sp. ADP1] [DE:Acinetobacter sp. ADP1 ben operon and cat operon, completesequence.] |
| Contig146G | 26735812_c3_1437 | 2548 | 6674 | 228 | 75 | | | NO-HIT |
| Contig146G | 26756555_f2_261 | 2549 | 6675 | 1251 | 416 | 941 | 1.40E−94 | gp:[GI:g3097809] [LN:PSEPAHP] [AC:L49465] [PN:hypothetical metabolite transport protein] [OR:*Pseudomonas fluorescens*] [DE:*Pseudomonas fluorescens* hypothetical metabolite transport protein,positive transcriptional regulator (phnR), phosphonoacetatehydrolase (phnA), 2-phosphonopropionate transporter (phnB),putative putrescine/spermidine binding protein, and putativemethionine sulfoxide reductase genes, complete cds.] [NT:Orf1] |
| Contig146G | 26770143_f1_88 | 2550 | 6676 | 966 | 321 | 545 | 1.30E−52 | pir:[LN:E69400] [AC:E69400] [PN:3-hydroxyacyl-CoA dehydrogenase (hbd-8) homolog] [OR:*Archaeoglobus fulgidus*] |
| Contig146G | 2734432_f3_535 | 2551 | 6677 | 2451 | 816 | 438 | 3.90E−60 | pir:[LN:S74915] [AC:S74915] [PN:extraceltular nuclease:protein sl10656:protein sl10656] [GN:nucH] [OR:Synechocystis sp.] [SR:PCC 6803,, PCC 6803] [SR:PCC 6803,] |
| Contig146G | 274192_f2_382 | 2552 | 6678 | 1053 | 350 | 375 | 1.30E−34 | sp:[LN:Y4VJ_RHISN] [AC:Q53218] [GN:Y4VJ] [OR:RHIZOBIUM SP] [DE:HYPOTHETICAL 39.2 KD PROTEIN Y4VJ] [SP:Q53218] |
| Contig146G | 277187_c1_900 | 2553 | 6679 | 2118 | 705 | 1972 | 7.80E−204 | gp:[GI:e242876:g2764822] [LN:ECPAA] [AC:X97452] [GN:Z] [OR:*Escherichia coli*] [DE:*E.coli* cluster for phenylacetic acid degradation.] [SP:P77455] |
| Contig146G | 2772183_c1_785 | 2554 | 6680 | 366 | 121 | 88 | 0.00093 | sp:[LN:H1_LYTPI] [AC:P06144] [OR:*LYTECHINUS PICTUS*] [SR:,PAINTED SEA URCHIN] [DE:LATE HISTONE H1] [SP:P06144] |
| Contig146G | 2772841_f3_606 | 2555 | 6681 | 342 | 113 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig146G | 283550_f1_1 | 2556 | 6682 | 3063 | 1020 | 113 | 6.00E-10 | gp:[GI:d1032561:g3327064] [LN:AB014525] [AC:AB014525] [PN:KIAA0625 protein] [GN:KIAA0625] [OR:*Homo sapiens*] [SR:*Homo sapiens* adult male brain cDNA to mRNA, clone_lib:pBluescriptI] [DE:*Homo sapiens* mRNA for KIAA0625 protein, partial cds.] |
| Contig146G | 29304677_f3_514 | 2557 | 6683 | 1578 | 525 | 919 | 3.00E-92 | pir:[LN:D70861] [AC:D70861] [PN:probable monoxygenase] [GN:Rv3049c] [OR:*Mycobacterium tuberculosis*] |
| Contig146G | 29323305_c1_763 | 2558 | 6684 | 639 | 212 | | | NO-HIT |
| Contig146G | 29376092_f1_149 | 2559 | 6685 | 906 | 301 | 562 | 2.00E-54 | gp:[GI:g1177876] [LN:PAU45309] [AC:U45309] [PN:2-phosphonoacetaldehyde hydrolase] [OR:*Pseudomonas aeruginosa*] [DE:*Pseudomonas aeruginosa* 2-phosphonoacetaldehyde hydrolase gene,complete cds.] [NT:phosphonatase] |
| Contig146G | 29400277_f2_378 | 2560 | 6686 | 609 | 202 | 585 | 7.40E-57 | gp:[GI:e242889:g2764835] [LN:ECPAA] [AC:X97452] [GN:Y] [OR:*Escherichia coli*] [DE:*E.coli* cluster for phenylacetic acid degradation.] |
| Contig146G | 29462750_f1_144 | 2561 | 6687 | 1509 | 502 | 1557 | 7.40E-160 | sp:[LN:GABD_ECOLI] [AC:P25526] [GN:GABD] [OR:*ESCHERICHIA COLI*] [EC:1.2.1.16] [DE:SUCCINATE-SEMIALDEHYDE DEHYDROGENASE (NADP+), (SSDH)] [SP:P25526] |
| Contig146G | 2947158_f1_174 | 2562 | 6688 | 669 | 222 | 515 | 1.90E-49 | pir:[LN:B64666] [AC:B64666] [PN:glutamine ABC transporter, permease protein] [OR:*Helicobacter pylori*] |
| Contig146G | 29562515_f3_739 | 2563 | 6689 | 396 | 131 | | | NO-HIT |
| Contig146G | 29798751_f1_67 | 2564 | 6690 | 570 | 189 | | | NO-HIT |
| Contig146G | 29816507_c1_769 | 2565 | 6691 | 1131 | 376 | 858 | 8.80E-86 | sp:[LN:YJES_ECOLI] [AC:P39288] [GN:YJES] [OR:*ESCHERICHIA COLI*] [DE:HYPOTHETICAL 43.1 KD PROTEIN IN PSD-AMIB INTERGENIC REGION (F379)] [SP:P39288] |
| Contig146G | 29922562_c3_1502 | 2566 | 6692 | 951 | 316 | 344 | 2.60E-31 | sp:[LN:YWFM_BACSU] [AC:P39649] [GN:YWFM:IPA-91D] [OR:*BACILLUS SUBTILIS*] [DE:HYPOTHETICAL 31.3 KD PROTEIN IN PTA 3'REGION] [SP:P39649] |
| Contig146G | 3000008_f2_333 | 2567 | 6693 | 225 | 74 | | | NO-HIT |
| Contig146G | 30084375_f2_325 | 2568 | 6694 | 624 | 207 | 323 | 4.30E-29 | gp:[GI:e1390216:g4467115] [LN:ATF20D10] [AC:AL035538] [PN:putative protein] [GN:F20D10.210] [OR:*Arabidopsis thaliana*] [SR:thale cress] [DE:*Arabidopsis thaliana* DNA chromosome 4, BAC clone F20D10 (ESSAproject).] [NT:similarity to hypothetical protein HI0722 (pepQ) |
| Contig146G | 30500377_f3_685 | 2569 | 6695 | 645 | 214 | 256 | 5.40E-22 | sp:[LN:YIGJ_ECOLI] [AC:P27846] [GN:YIGJ] [OR:*ESCHERICHIA COLI*] [DE:HYPOTHETICAL 22.5 KD PROTEIN IN RECQ-PLDB INTERGENIC REGION] [SP:P27846] |

TABLE 2-continued

| Query | Orf | NT ID | AA ID | NT Lgth | AA Lgth | Score | P-value | Subject |
|---|---|---|---|---|---|---|---|---|
| Contig146G | 30743760_f3_552 | 2570 | 6696 | 417 | 138 | 314 | 3.90E−28 | gp:[GI:g2394312] [LN:AF017747] [AC:AF017747] [PN:heavy metal dependent transcription regulator] [OR:*Proteus mirabilis*] [DE:*Proteus mirabilis* heavy metal dependent transcription regulatorgene, complete cds.] [NT:similar to members of MerR family; HMDTR;] |
| Contig146G | 3145286_f3_605 | 2571 | 6697 | 1026 | 341 | | | NO-HIT |
| Contig146G | 3147207_c1_965 | 2572 | 6698 | 183 | 60 | | | NO-HIT |
| Contig146G | 31522217_f2_363 | 2573 | 6699 | 795 | 264 | 227 | 6.40E−19 | gp:[GI:g4099904] [LN:PLU91412] [AC:U91412] [PN:LuxZ] [GN:luxZ] [OR:*Photobacterium leiognathi*] [DE:*Photobacterium leiognathi* LuxZ (luxZ) gene, complete cds.] [NT:enhances bioluminescence of the lux operon] |
| Contig146G | 3159430_c3_1346 | 2574 | 6700 | 1854 | 617 | 1695 | 1.80E−174 | sp:[LN:YA51_HAEIN] [AC:Q57180:O05043] [GN:HI1051] [OR:*HAEMOPHILUS INFLUENZAE*] [DE:HYPOTHETICAL ABC TRANSPORTER ATP-BINDING PROTEIN HI1051] [SP:Q57180:O05043] |
| Contig146G | 31673453_f3_529 | 2575 | 6701 | 426 | 141 | 151 | 7.30E−11 | gp:[GI:d1006792:g639688] [LN:STMPHNOL] [AC:D29961] [PN:regulatory protein for C-P lyase] [GN:phnO-like] [OR:*Streptomyces griseus*] [SR:*Streptomyces griseus* (strain:B2682) DNA] [DE:*Streptomyces griseus* phnO-like gene for regulatory protein for C-Plyase, complete cds.] |
| Contig146G | 31829692_c2_1095 | 2576 | 6702 | 861 | 286 | 420 | 2.30E−39 | gp:[GI:e1288207:g3087788] [LN:LPN5668] [AC:AJ005668] [PN:29 kDa immunogenic protein] [OR:*Legionella pneumophila*] [DE:*Legionella pneumophila* gene encoding a 29 kDa immunogenic protein.] |
| Contig146G | 32041313_f2_331 | 2577 | 6703 | 717 | 238 | 115 | 5.60E−05 | pir:[LN:B70938] [AC:B70938] [PN:probable regulatory protein] [GN:Rv0238] [OR:*Mycobacterium tuberculosis*] |
| Contig146G | 32212778_f3_524 | 2578 | 6704 | 1023 | 340 | 821 | 7.30E−82 | sp:[LN:G3PP_ALCEU] [AC:P50322] [GN:CBBGP] [OR:*ALCALIGENES EUTROPHUS*] [EC:1.2.1.12] [DE:GLYCERALDEHYDE 3-PHOSPHATE DEHYDROGENASE, PLASMID,] [SP:P50322] |
| Contig146G | 32218827_f3_684 | 2579 | 6705 | 861 | 286 | 706 | 1.10E−69 | gp:[GI:g4155688] [LN:AE001537] [AC:AE001537:AE001439] [PN:AMINO ACID ABC TRANSPORTER, BINDING PROTEIN] [GN:jhp1099] [OR:*Helicobacter pylori* J99] [DE:*Heiicobacter pylori*, strain J99 section 98 of 132 of the completegenome.] [NT:similar to *H. pylori* 26695 gene HP1172] |

TABLE 2-continued

| Query | Orf | NT ID | AA ID | NT Lgth | AA Lgth | Score | P-value | Subject |
|---|---|---|---|---|---|---|---|---|
| Contig146G | 32617838_f1_109 | 2580 | 6706 | 354 | 117 | 259 | 2.60E−22 | gp:[GI:g2708667] [LN:AF037441] [AC:AF037441] [PN:putative 19.5 kDa protein] [GN:eip20] [OR:*Edwardsiella ictaluri*] [DE:*Edwardsiella ictaluri* putative 18.8 kDa protein (eip19), putative17.8 kDa protein (eip18), putative 54.5 kDa protein (eip55), andputative 19.5 kDa protein (eip20) genes, complete cds.] [NT:EIP20; possibly antigenic to catfish] |
| Contig146G | 3297202_f1_123 | 2581 | 6707 | 231 | 76 | 124 | 5.00E−07 | pir:[LN:H71183] [AC:H71183] [PN:probably D-nopaline dehydrogenase] [GN:PH1749] [OR:*Pyrococcus horikoshii*] |
| Contig146G | 3297316_c1_757 | 2582 | 6708 | 222 | 73 | | | NO-HIT |
| Contig146G | 3319002_c3_1361 | 2583 | 6709 | 279 | 92 | | | NO-HIT |
| Contig146G | 33239687_f1_209 | 2584 | 6710 | 864 | 287 | 240 | 2.70E−20 | pir:[LN:D69749] [AC:D69749] [PN:transcription regulator AraC/XylS family homolog ybfI] [GN:ybfI] [OR:*Bacillus subtilis*] |
| Contig146G | 33240943_f2_308 | 2585 | 6711 | 207 | 68 | | | NO-HIT |
| Contig146G | 3324175_f1_156 | 2586 | 6712 | 1362 | 453 | 1321 | 7.60E−135 | gp:[GI:g1842056] [LN:ACU87258] [AC:U87258] [PN:cis,cis-muconate transport protein MucK] [GN:mucK] [OR:Acinetobacter sp. ADP1] [DE:Acinetobacter sp. ADP1 cis,cis-muconate transport protein MucK(mucK) and electron transfer flavoprotein-ubiquinone oxidoreductasehomolog genes, complete cds.] |
| Contig146G | 33395337_c1_902 | 2587 | 6713 | 1605 | 534 | 1654 | 3.90E−170 | pir:[LN:D70035] [AC:D70035] [PN:permease homolog yveA] [GN:yveA] [OR:*Bacillus subtilis*] |
| Contig146G | 33396937_c3_1434 | 2588 | 6714 | 903 | 300 | 859 | 6.90E−86 | sp:[LN:YHDF_BACSU] [AC:O07575] [GN:YHDF] [OR:*BACILLUS SUBTILIS*] [EC:1.—.—.—] [DE:(EC 1.—.—.—)] [SP:O07575] |
| Contig146G | 33401662_f3_604 | 2589 | 6715 | 906 | 301 | 132 | 2.20E−05 | gp:[GI:e1252197:g2897626] [LN:LP22KBICM] [AC:Y15044] [PN:lcmF protein] [GN:icmF] [OR:*Legionella pneumophila*] [DE:*Legionella pneumophila* 22kB DNA fragment from icm gene cluster.] |
| Contig146G | 33480327_f2_348 | 2590 | 6716 | 1824 | 607 | 956 | 1.30E−95 | gp:[GI:g173122] [LN:YSCUAMD] [AC:M64926] [PN:urea amidolyase] [GN:DUR1.2] [FN:hydrolysis of urea to ammonia and CO2] [OR:*Saccharomyces cerevisiae*] [SR:*Saccharomyces cerevisiae* DNA] [EC:6.3.4.6] [DE:Yeast urea amidolyase (DUR1.2) gene, complete cds.] |
| Contig146G | 3364681_f3_586 | 2591 | 6717 | 1398 | 465 | 538 | 1.80E−50 | pir:[LN:S76238] [AC:S76238] [PN:hypothetical protein s110267] [OR:Synechocystis sp.] [SR:PCC 6803,, PCC 6803] [SR:PCC 6803,] |
| Contig146G | 33650302_f2_322 | 2592 | 6718 | 588 | 195 | 222 | 2.20E−18 | sp:[LN:YHBN_HAEIN] [AC:P45074] [GN:HI1149] [OR:*HAEMOPHILUS INFLUENZAE*] [DE:HYPOTHETICAL PROTEIN HI1149 PRECURSOR] [SP:P45074] |
| Contig146G | 33753430_f1_80 | 2593 | 6719 | 1236 | 411 | 358 | 8.40E−33 | sp:[LN:CYAD_BORPE] [AC:P11091] [GN:CYAD] [OR:*BORDETELLA PERTUSSIS*] [DE:CYAD PROTEIN] [SP:P11091] |

TABLE 2-continued

| Query | Orf | NT ID | AA ID | NT Lgth | AA Lgth | Score | P-value | Subject |
|---|---|---|---|---|---|---|---|---|
| Contig146G | 33765633_c1_996 | 2594 | 6720 | 243 | 80 | | | NO-HIT |
| Contig146G | 33843818_c2_1302 | 2595 | 6721 | 1062 | 353 | 903 | 1.50E−90 | sp:[LN:TAS_ECOLI] [AC:Q46933] [GN:TAS] [OR:*ESCHERICHIA COLI*] [DE:TAS PROTEIN] [SP:Q46933] |
| Contig146G | 3392937_f1_78 | 2596 | 6722 | 570 | 189 | | | NO-HIT |
| Contig146G | 3397952_f2_313 | 2597 | 6723 | 483 | 160 | | | NO-HIT |
| Contig146G | 33986305_c2_1273 | 2598 | 6724 | 234 | 77 | | | NO-HIT |
| Contig146G | 33992061_c1_850 | 2599 | 6725 | 2013 | 670 | 783 | 4.30E−143 | gp:[GI:g533707] [LN:ATU12536] [AC:U12536] [PN:3-methylcrotonyl-CoA carboxylase precursor] [FN:carboxylation of 3-methylcrotonyl-CoA] [OR:*Arabidopsis thaliana*] [SR:thale cress] [EC:6.4.1.4] [DE:*Arabidopsis thaliana* 3-methylcrotonyl-CoA carboxylase precursormRNA, complete cds.] |
| Contig146G | 34010467_f1_130 | 2600 | 6726 | 1551 | 516 | 1007 | 1.40E−101 | gp:[GI:g3253199] [LN:AF029714] [AC:AF029714:Z71175] [PN:PhaC] [GN:phaC] [OR:*Pseudomonas putida*] [DE:*Pseudomonas putida* repressor (phaN), regulatory protein (phaM),enoyl-CoA hydratase I (phaA), enoyl-CoA hydratase II (phaB),3-hydroxyacyl-CoA dehydrogenase (phaC), ketothiolase (phaD),phenylacetyl-CoA ligase (phaE), ring-oxidation complex protein 1(phaF), ring-oxidation complex protein 2 (phaG), ring-oxidationcomplex protein 3 (phaH), ring-oxidation complex protein 4 (phaI),permease (phaJ), channel-forming protein (phaK), and ring-openingenzyme (phaL) genes, complete cds.] [NT:3-Hydroxyacyl-CoA dehydrogenase] |
| Contig146G | 34015701_c3_1573 | 2601 | 6727 | 249 | 82 | | | NO-HIT |
| Contig146G | 34025267_c2_1332 | 2602 | 6728 | 1494 | 497 | 965 | 4.00E−97 | gp:[GI:e1312028:g3336914] [LN:PSP6231] [AC:AJ006231] [PN:coniferyl aldehyde dehydrogenase] [GN:calB] [OR:Pseudomonas sp.] [SR:Pseudomonas sp] [DE:Pseudomonas sp. calB gene.] |
| Contig146G | 34026693_f1_66 | 2603 | 6729 | 471 | 156 | | | NO-HIT |
| Contig146G | 34100318_f2_284 | 2604 | 6730 | 2592 | 863 | 2805 | 4.20E−292 | sp:[LN:CLPB_HAEIN] [AC:P44403] [GN:CLPB:HI0859] [OR:*HAEMOPHILUS INFLUENZAE*] [DE:CLPB PROTEIN] [SP:P44403] |
| Contig146G | 34100442_c1_845 | 2605 | 6731 | 303 | 100 | | | NO-HIT |
| Contig146G | 34100917_c2_1086 | 2606 | 6732 | 486 | 161 | | | NO-HIT |
| Contig146G | 34105437_f3_656 | 2607 | 6733 | 684 | 227 | 759 | 2.70E−75 | sp:[LN:PCAI_ACICA] [AC:Q43973:Q43933] [GN:PCAI:CATI] [OR:*ACINETOBACTER CALCOACETICUS*] [EC:2.8.3.6] [DE:KETOADIPATE:SUCCINYL COA TRANSFERASE)] [SP:Q43973:Q43933] |
| Contig146G | 34120317_f1_60 | 2608 | 6734 | 183 | 60 | | | NO-HIT |
| Contig146G | 34157002_f2_383 | 2609 | 6735 | 1431 | 476 | 747 | 5.10E−74 | pir:[LN:E70081] [AC:E70081] [PN:purine-cytosine permease homolog yxlA] [GN:yxlA] [OR:*Bacillus subtilis*] |
| Contig146G | 34164167_f1_127 | 2610 | 6736 | 342 | 113 | 359 | 6.60E−33 | sp:[LN:PAAB_ECOLI] [AC:P76078] [GN:PAAB] [OR:*ESCHERICHIA COLI*] [DE:PHENYLACETIC ACID DEGRADATION PROTEIN PAAB] [SP:P76078] |

TABLE 2-continued

| Query | Orf | NT ID | AA ID | NT Lgth | AA Lgth | Score | P-value | Subject |
|---|---|---|---|---|---|---|---|---|
| Contig146G | 34167325_f2_465 | 2611 | 6737 | 483 | 160 | 180 | 6.10E−14 | sp:[LN:AZLB_BACSU] [AC:O07920] [GN:AZLB] [OR:*BACILLUS SUBTILIS*] [DE:TRANSCRIPTIONAL REGULATOR AZLB] [SP:O07920] |
| Contig146G | 34173187_f3_694 | 2612 | 6738 | 630 | 209 | 383 | 1.90E−35 | gp:[GI:g2897873] [LN:MXU81516] [AC:U81516] [PN:unknown] [OR:*Myxococcus xanthus*] [DE:*Myxococcus xanthus* ABC transporter homolog gene, partial cds andRNA polymerase sigma-54 factor (rpoN) gene, complete cds.] [NT:orf; 3' of rpoN] |
| Contig146G | 34187687_f1_216 | 2613 | 6739 | 543 | 180 | | | NO-HIT |
| Contig146G | 34261527_f1_104 | 2614 | 6740 | 669 | 222 | 155 | 3.00E−10 | pir:[LN:D69758] [AC:D69758] [PN:hypothetical protein ycgI] [GN:ycgI] [OR:*Bacillus subtilis*] |
| Contig146G | 34412653_f1_69 | 2615 | 6741 | 195 | 64 | | | NO-HIT |
| Contig146G | 34412885_c2_1252 | 2616 | 6742 | 489 | 162 | 277 | 3.20E−24 | sp:[LN:Y4TD_RHISN] [AC:P55658] [GN:Y4TD] [OR:RHIZOBIUM SP] [DE:HYPOTHETICAL TRANSCRIPTIONAL REGULATOR Y4TD] [SP:P55658] |
| Contig146G | 34437_c1_1038 | 2617 | 6743 | 225 | 74 | | | NO-HIT |
| Contig146G | 34507750_f2_332 | 2618 | 6744 | 1335 | 444 | 676 | 1.70E−66 | gp:[GI:g3172116] [LN:ACCPCAOP] [AC:L05770:U04359:M33798:U20284:U11554:L13114:L03407] [PN:putative transport protein] [GN:pcaK] [OR:Acinetobacter sp. ADP1] [DE:Acinetobacter sp. ADP1 pca-qui-pob supraoperonic cluster, completesequence.] |
| Contig146G | 34547840_f3_618 | 2619 | 6745 | 1326 | 441 | 217 | 1.00E−29 | gp:[GI:g1519477] [LN:RMU66830] [AC:U66830] [PN:OoxA] [OR:*Rhizobium meliloti*] [DE:*Rhizobium meliloti* octopine catabolism operon: occR, occQ, occM,occP, occT, occB, and occA genes. complete cds.] [NT:opine oxidase subunit; oxidase] |
| Contig146G | 34582503_c3_1349 | 2620 | 6746 | 3783 | 1260 | 3695 | 0 | sp:[LN:PUTA_ECOLI] [AC:P09546:P78296] [GN:PUTA:POAA] [OR:*ESCHERICHIA COLI*] [EC:1.5.99.8:1.5.1.12] [DE:DEHYDROGENASE)] [SP:P09546:P78296] |
| Contig146G | 34616625_c3_1583 | 2621 | 6747 | 1215 | 404 | 1628 | 2.20E−167 | sp:[LN:BENE_ACICA] [AC:P07775] [GN:BENE] [OR:*ACINETOBACTER CALCOACETICUS*] [DE:BENZOATE MEMBRANE TRANSPORT PROTEIN] [SP:P07775] |
| Contig146G | 34619077_c2_1130 | 2622 | 6748 | 1986 | 661 | 1369 | 2.60E−145 | gp:[GI:e335040:g2342628] [LN:MLCB22] [AC:Z98741] [PN:nifS-like protein] [GN:MLCB22.44c] [OR:*Mycobacterium leprae*] [DE:*Mycobacterium leprae* cosmid B22.] [NT:MLCB22.44c, nifS-like protein, len: 611;] |
| Contig146G | 34641881_f3_603 | 2623 | 6749 | 1431 | 476 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig146G | 34662762_f1_65 | 2624 | 6750 | 648 | 215 | 93 | 0.00027 | gp:[GI:g4155836] [LN:AE001547] [AC:AE001547:AE001439] [PN:putative] [GN:jhp1208] [OR:*Helicobacter pylori* J99] [PN:putative] [GN:jhp1208] section 108 of 132 of the completegenome.] [NT:similar to *H. pylori* 26695 gene HP1288] |
| Contig146G | 35275338_c3_1574 | 2625 | 6751 | 195 | 64 | | | NO-HIT |
| Contig146G | 35338437_f2_464 | 2626 | 6752 | 723 | 240 | 450 | 1.50E-42 | sp:[LN:GLTK_ECOLI] [AC:P41075] [GN:GLTK] [OR:*ESCHERICHIA COLI*] [DE:GLUTAMATE/ASPARTATE TRANSPORT SYSTEM PERMEASE PROTEIN GLTK] [SP:P41075] |
| Contig146G | 35343775_c3_1615 | 2627 | 6753 | 1482 | 493 | 1533 | 2.60E-157 | gp:[GI:e1290214:g3116018] [LN:PFPHCOAHL] [AC:Y13067] [PN:vanillin: NAD+ oxidoreductase] [GN:vdh] [OR:*Pseudomonas fluorescens*] [DE:*Pseudomonas fluorescens* genes encoding p-hydroxycinnamoyl CoAhydratase/lyase and vanillin: NAD+ oxidoreductase.] |
| Contig146G | 35359802_c3_1572 | 2628 | 6754 | 348 | 115 | | | NO-HIT |
| Contig146G | 35396888_f2_309 | 2629 | 6755 | 339 | 112 | | | NO-HIT |
| Contig146G | 35431580_f1_57 | 2630 | 6756 | 201 | 66 | | | NO-HIT |
| Contig146G | 35673142_f1_141 | 2631 | 6757 | 1503 | 500 | 957 | 2.80E-96 | gp:[GI:e286198:g1743354] [LN:NTALDEDEH] [AC:Y09876] [PN:aldehyde dehydrogenase (NAD+)] [GN:Aldh 2A] [OR:*Nicotiana tabacum*] [SR:common tobacco] [EC:1.2.1.3] [DE:*N.tabacum* mRNA for aldehyde dehydrogenase.] |
| Contig146G | 35782883_f2_357 | 2632 | 6758 | 849 | 282 | | | NO-HIT |
| Contig146G | 35812507_f3_699 | 2633 | 6759 | 969 | 322 | 691 | 4.40E-68 | gp:[GI:d1037191:g4062974] [LN:AB017138] [AC:AB017138] [GN:mdcB] [FN:involved in biosynthesis of the prothetic group] [OR:*Pseudomonas putida*] [SR:*Pseudomonas putida* DNA] [DE:*Pseudomonas putida* malonate decarboxylase gene cluster (mdcA, mdcB,mdcC, mdcD, mdcE, mdcG, mdcH, mdcL and mdeM genes), complete cds.] |
| Contig146G | 35937512_f1_33 | 2634 | 6760 | 849 | 282 | 372 | 2.80E-34 | pir:[LN:C70814] [AC:C70814] [PN:hypothetical protein Rv0851c] [GN:Rv0851c] [OR:*Mycobacterium tuberculosis*] |
| Contig146G | 36132811_c1_1036 | 2635 | 6761 | 576 | 191 | 259 | 2.60E-22 | pir:[LN:F64848] [AC:F64848] [PN:probable membrane protein b1057] [OR:*Escherichia coli*] |
| Contig146G | 36204682_f2_462 | 2636 | 6762 | 927 | 308 | 588 | 3.60E-57 | sp:[LN:YBEJ_ECOLI] [AC:P37902:P41408:P77612] [GN:YBEJ] [OR:*ESCHERICHIA COLI*] [DE: REGION PRECURSOR] [SP:P37902:P41408:P77612] |
| Contig146G | 36207813_f1_108 | 2637 | 6763 | 705 | 234 | | | NO-HIT |
| Contig146G | 36564437_f1_107 | 2638 | 6764 | 1044 | 347 | 435 | 5.80E-41 | pir:[LN:S77448] [AC:S77448] [PN:hypothetical protein sll1080] [OR:Synechocystis sp.] [SR:PCC 6803,, PCC 6803] [SR:PCC 6803,] |

TABLE 2-continued

| Query | Orf | NT ID | AA ID | NT Lgth | AA Lgth | Score | P-value | Subject |
|---|---|---|---|---|---|---|---|---|
| Contig146G | 36572182_c2_1315 | 2639 | 6765 | 1179 | 392 | 1770 | 2.00E−182 | gp:[GI:g2271500] [LN:AF009672] [AC:AF009672] [PN:vanillate demethylase] [GN:vanA] [OR:Acinetobacter sp. ADP1] [DE:Acinetobacter sp. ADP1 vanillate demethylase region, vanillatedemethylase (vanB) and vanillate demethylase (vanA) genes, completecds.] [NT:vanA subunit] |
| Contig146G | 36602292_f3_600 | 2640 | 6766 | 3624 | 1207 | 2889 | 5.30E−301 | sp:[LN:DUR1_YEAST] [AC:P32528] [GN:DUR1,2:YBR208C:YBR1448] [OR:*SACCHAROMYCES CEREVISIAE*] [SR:,BAKER'S YEAST] [EC:6.3.4.6:3.5.1.54] [DE:HYDROLASE,]] [SP:P32528] |
| Contig146G | 36616525_c2_1119 | 2641 | 6767 | 1464 | 487 | 1575 | 9.20E−162 | gp:[GI:e293295:g2208964] [LN:PACIOAB] [AC:Y10528] [PN:cyanide insensitive terminal oxidase] [GN:cioA] [OR:*Pseudomonas aeruginosa*] [DE:*P. aeruginosa* cioA and cioB genes.] |
| Contig146G | 37752_f2_392 | 2642 | 6768 | 891 | 296 | 447 | 3.10E−42 | gp:[GI:g2290994] [LN:AF006000] [AC:AF006000] [PN:unknown] [OR:*Bordetella pertussis*] [DE:*Bordetella pertussis* D-3-phosphoglycerate dehydrogenase homolog(serA) and Brg1 (brg1) genes, complete cds.] [NT:orf6: similar to *P. putida* PobR; putative IclR type] |
| Contig146G | 3907011_f3_615 | 2643 | 6769 | 495 | 164 | 480 | 1.00E−45 | sp:[LN:SOXR_ECOLI] [AC:P22538] [GN:SOXR:MARC] [OR:*ESCHERICHIA COLI*] [DE:SOXR PROTEIN] [SP:P22538] |
| Contig146G | 3909592_c3_1415 | 2644 | 6770 | 1197 | 398 | 324 | 3.40E−29 | pir:[LN:A69778] [AC:A69778] [PN:metabolite transport protein homolog ydeG] [GN:ydeG] [OR:*Bacillus subtilis*] |
| Contig146G | 3909693_f3_741 | 2645 | 6771 | 555 | 184 | 336 | 1.80E−30 | pir:[LN:C64897] [AC:C64897] [PN:probable phosphinothricin N-acetyltransferase,] [CL:phosphinothricin N-acetyltransferase] [OR:*Escherichia coli*] [EC:2.3.1.—] |
| Contig146G | 3911003_f3_559 | 2646 | 6772 | 249 | 82 | | | NO-HIT |
| Contig146G | 3912588_f3_740 | 2647 | 6773 | 222 | 73 | | | NO-HIT |
| Contig146G | 3913958_f1_70 | 2648 | 6774 | 1209 | 402 | 233 | 1.90E−17 | sp:[LN:YE05_HAEIN] [AC:P44180] [GN:HI1405] [OR:*HAEMOPHILUS INFLUENZAE*] [DE:HYPOTHETICAL PROTEIN HI1405] [SP:P44180] |
| Contig146G | 3915937_f2_440 | 2649 | 6775 | 822 | 273 | | | NO-HIT |
| Contig146G | 3928125_c2_1101 | 2650 | 6776 | 2691 | 896 | 1919 | 3.20E−198 | sp:[LN:NFRX_AZOVI] [AC:P36223] [GN:NFRX] [OR:*AZOTOBACTER VINELANDII*] [EC:2.7.7.59] [DE:TRANSFERASE) (URIDYLYL REMOVING ENZYME)] [SP:P36223] |
| Contig146G | 3928342_f1_34 | 2651 | 6777 | 1329 | 442 | 1176 | 1.80E−119 | sp:[LN:Y326_METJA] [AC:Q57772] [GN:MJ0326] [OR:*METHANOCOCCUS JANNASCHII*] [DE:HYPOTHETICAL PROTEIN MJ0326] [SP:Q57772] |

TABLE 2-continued

| Query | Orf | NT ID | AA ID | NT Lgth | AA Lgth | Score | P-value | Subject |
|---|---|---|---|---|---|---|---|---|
| Contig146G | 3937653_c2_1314 | 2652 | 6778 | 903 | 300 | 488 | 1.40E−46 | sp:[LN:BAH_STRHY] [AC:Q01109] [GN:BAH] [OR:*STREPTOMYCES HYGROSCOPICUS*] [EC:3.1.1.—] [DE:ACETYL-HYDROLASE,] [SP:Q01109] |
| Contig146G | 3940625_f1_227 | 2653 | 6779 | 198 | 65 | | | NO-HIT |
| Contig146G | 3941313_f2_288 | 2654 | 6780 | 1026 | 341 | 1057 | 7.20E−107 | sp:[LN:PYRB_PSEAE] [AC:Q59653] [GN:PYRB] [OR:*PSEUDOMONAS AERUGINOSA*] [EC:2.1.3.2] [DE:TRANSCARBAMYLASE) (ATCASE)] [SP:Q59653] |
| Contig146G | 3944068_f1_121 | 2655 | 6781 | 945 | 314 | 253 | 1.10E−21 | pir:[LN:E70398] [AC:E70398] [PN:dihydrodipicolinate synthase] [GN:dapA] [OR:*Aquifex aeolicus*] |
| Contig146G | 3944142_c2_1215 | 2656 | 6782 | 468 | 155 | 469 | 1.50E−44 | gp:[GI:g2271496] [LN:AF009672] [AC:AF009672] [PN:unknown] [OR:Acinctobacter sp. ADP1] [DE:Acinetobacter sp. ADP1 vanillate demethylase region, vanillatedemethylase (vanB) and vanillate demethylase (vanA) genes, completecds.] [NT:putative acetyl transferase; ORF2] [RE: |
| Contig146G | 3945907_c3_1417 | 2657 | 6783 | 1500 | 499 | 634 | 4.80E−62 | gp:[GI:g3411182] [LN:AF076240] [AC:AF076240] [PN:putative regulatory protein MocR] [GN:mocR] [OR:*Rhizobium leguminosarum* bv. *viciae*] [DE:*Rhizobium leguminosarum* plasmid pSyma MocC (mocC), putativeNADH-inositol dehydrogenase MocA (mocA), putative rhizopineperiplasmic transport protein MocB precursor (mocB), putativeregulatory protein MocR (mocR), putative hydrocarbon oxygenase MocD(mocD), putative Rieske-like ferredoxin MocE (mocE), and putativeferrodoxin reductase MocF (mocF) genes, complete cds; and unknowngenes.] |
| Contig146G | 3948518_f2_307 | 2658 | 6784 | 339 | 112 | | | NO-HIT |
| Contig146G | 3948838_f1_226 | 2659 | 6785 | 873 | 290 | | | NO-HIT |
| Contig146G | 3957567_f2_343 | 2660 | 6786 | 594 | 197 | | | NO-HIT |
| Contig146G | 3957808_c1_981 | 2661 | 6787 | 960 | 319 | 332 | 4.80E−30 | sp:[LN:YF72_HAEIN] [AC:P46495] [GN:HI1572] [OR:*HAEMOPHILUS INFLUENZAE*] [DE:PUTATIVE INTEGRASE/RECOMBINASE HI1572] [SP:P46495] |
| Contig146G | 4002125_f3_589 | 2662 | 6788 | 3162 | 1053 | 304 | 4.20E−30 | gp:[GI:g2921771] [LN:AF044506] [AC:AF044506:U25142] [PN:VgrG protein] [OR:*Escherichia coli*] [DE:*Escherichia coli* strain ECOR-50 hcp gene, partial cds; RhsGaccessory genetic element VgrG protein gene, complete cds; and coreprotein (rhsG) gene, partial cds.] |
| Contig146G | 4010262_c1_968 | 2663 | 6789 | 702 | 233 | 396 | 7.90E−37 | pir:[LN:F70906] [AC:F70906] [PN:probable o-methyltransferase] [GN:Rv0187] [OR:*Mycobacterium tuberculosis*] |
| Contig146G | 401650_f1_63 | 2664 | 6790 | 252 | 83 | | | NO-HIT |
| Contig146G | 4020265_c2_1262 | 2665 | 6791 | 1458 | 485 | 1286 | 3.90E−131 | sp:[LN:SYC_ECOLI] [AC:P21888] [GN:CYSS] [OR:*ESCHERICHIA COLI*] [EC:6.1.1.16] [DE:(CYSRS)] [SP:P21888] |
| Contig146G | 4020331_c2_1312 | 2666 | 6792 | 189 | 62 | | | NO-HIT |
| Contig146G | 4023963_f2_414 | 2667 | 6793 | 453 | 150 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig146G | 4070337_f2_329 | 2668 | 6794 | 918 | 305 | 442 | 1.10E−41 | pir:[LN:E64818] [AC:E64818:I69618] [PN:probable membrane protein ybiF] [GN:ybiF] [OR:*Escherichia coli*] |
| Contig146G | 4072338_c2_1147 | 2669 | 6795 | 813 | 270 | 350 | 5.90E−32 | pir:[LN:A70719] [AC:A70719] [PN:probable enoyl-coA hydratase] [GN:echA7] [CL:enoyl-CoA hydratase homology] [OR:*Mycobacterium tuberculosis*] |
| Contig146G | 4079058_f1_197 | 2670 | 6796 | 1101 | 366 | 871 | 3.70E−87 | sp:[LN:TAUA_ECOLI] [AC:Q47537:P77630] [GN:TAUA:SSIA] [OR:*ESCHERICHIA COLI*] [DE:INDUCED PROTEIN 1) (SSI1)] [SP:Q47537:P77630] |
| Contig146G | 40902_c1_1041 | 2671 | 6797 | 837 | 278 | 370 | 4.50E−34 | pir:[LN:C70814] [AC:C70814] [PN:hypothetical protein Rv0851c] [GN:Rv0851c] [OR:*Mycobacterium tuberculosis*] |
| Contig146G | 40937_f2_385 | 2672 | 6798 | 1299 | 432 | 632 | 7.80E−62 | pir:[LN:H71006] [AC:H71006] [PN:probable ATP-binding transport protein] [GN:PH1350] [CL:inner membrane protein malK:ATP-binding cassette homology] [OR:*Pyrococcus horikoshii*] |
| Contig146G | 4094013_f3_575 | 2673 | 6799 | 600 | 199 | 269 | 2.30E−23 | gp:[GI:g4206094] [LN:AF091240] [AC:AF091240] [PN:unknown] [OR:Acinctobacter sp. ADP1] [DE:Acinetobacter sp. ADP1 transposon Tn5613 unknown gene, completecds.] [NT:ORF1] |
| Contig146G | 4095312_f2_255 | 2674 | 6800 | 1368 | 455 | 1749 | 3.40E−180 | sp:[LN:GUD1_ECOLI] [AC:P76637:Q46914] [GN:YGCX] [OR:*ESCHERICHIA COLI*] [EC:4.2.1.40] [DE:PROBABLE GLUCARATE DEHYDRATASE 1, (GDH)] [SP:P76637:Q46914] |
| Contig146G | 4101638_c2_1145 | 2675 | 6801 | 1185 | 394 | 1227 | 6.90E−125 | sp:[LN:IVD_HUMAN] [AC:P26440] [GN:IVD] [OR:*HOMO SAPIENS*] [EC:1.3.99.10] [DE:ISOVALERYL-COA DEHYDROGENASE PRECURSOR, (IVD)] [SP:P26440] |
| Contig146G | 4103202_f3_560 | 2676 | 6802 | 816 | 271 | 363 | 2.50E−33 | sp:[LN:PROC_PSEAE] [AC:P22008] [GN:PROC] [OR:*PSEUDOMONAS AERUGINOSA*] [EC:1.5.1.2] [DE:PYRROLINE-5-CARBOXYLATE REDUCTASE, (P5CR) (P5C REDUCTASE)] [SP:P22008] |
| Contig146G | 4105262_c1_767 | 2677 | 6803 | 219 | 72 | | | NO-HIT |
| Contig146G | 4114662_f1_61 | 2678 | 6804 | 1158 | 385 | | | NO-HIT |
| Contig146G | 4115943_f1_185 | 2679 | 6805 | 951 | 316 | 757 | 4.40E−75 | gp:[GI:d1037196:g4062979] [LN:AB017138] [AC:AB017138] [PN:epsilon subunit of malonate decarboxylase] [GN:mdcH] [OR:*Pseudomonas putida*] [SR:*Pseudomonas putida* DNA] [DE:*Pseudomonas putida* malonate decarboxylase gene cluster (mdcA, mdcB,mdcC, mdcD, mdcE, mdcG, mdcH, mdcL and mdcM genes), complete cds.] [NT:malonyl-CoA:acyl carrier protein transacylase;] |

TABLE 2-continued

| Query | Orf | NT ID | AA ID | NT Lgth | AA Lgth | Score | P-value | Subject |
|---|---|---|---|---|---|---|---|---|
| Contig146G | 411652_f2_276 | 2680 | 6806 | 594 | 197 | 615 | 4.90E−60 | sp:[LN:RNH2_HAEIN] [AC:P43808:P94808] [GN:RNHB:HI1059] [OR:*HAEMOPHILUS INFLUENZAE*] [EC:3.1.26.4] [DE:RIBONUCLEASE HII, (RNASE HII)] [SP:P43808:P94808] |
| Contig146G | 4117202_f3_602 | 2681 | 6807 | 504 | 167 | 158 | 1.30E−11 | gp:[GI:g2708665] [LN:AF037441] [AC:AF037441] [PN:putative 17.8 kDa protein] [GN:eip18] [OR:*Edwardsiella ictaluri*] [DE:*Edwardsiella ictaluri* putative 18.8 kDa protein (eip19), putative 17.8 kDa protein (eip18), putative 54.5 kDa protein (eip55), andputative 19.5 kDa protein (eip20) genes, complete cds.] [NT:EIP18; possibly antigenic to catfish] |
| Contig146G | 4180432_c1_1002 | 2682 | 6808 | 633 | 210 | 264 | 7.70E−23 | sp:[LN:YRHP_BACSU] [AC:O05406] [GN:YRHP] [OR:*BACILLUS SUBTILIS*] [DE:HYPOTHETICAL 23.4 KD PROTEIN IN AAPA-SIGV INTERGENIC REGION] [SP:O05406] |
| Contig146G | 4181558_f1_173 | 2683 | 6809 | 963 | 320 | 214 | 4.40E−25 | pir:[LN:S75216] [AC:S75216] [PN:regulatory components of sensory transduction system:protein slr1909:protein slr1909] [CL:ompR protein:response regulator homology] [OR:Synechocystis sp.] [SR:PCC 6803,, PCC 6803] [SR:PCC 6803,] |
| Contig146G | 4297303_c2_1118 | 2684 | 6810 | 276 | 91 | | | NO-HIT |
| Contig146G | 4297328_c3_1375 | 2685 | 6811 | 1101 | 366 | 1426 | 5.70E−146 | pir:[LN:164150] [AC:164150] [PN:probable GTP-binding protein HI0393] [CL:yeast probable purine nucleotide-binding protein YBR025c] [OR:*Haemophilus influenzae*] |
| Contig146G | 4300937_c3_1503 | 2686 | 6812 | 231 | 76 | | | NO-HIT |
| Contig146G | 4302260_f3_642 | 2687 | 6813 | 627 | 208 | 462 | 8.10E−44 | pir:[LN:G64892] [AC:G64892:S55810:S55808] [PN:[acyl-carrier-protein] phosphodiesterase, acpD] [GN:acpD] [CL:acyl carrier protein phosphodiesterase] [OR:*Escherichia coli*] [EC:3.1.4.14] |
| Contig146G | 4303193_f1_112 | 2688 | 6814 | 1029 | 342 | | | NO-HIT |
| Contig146G | 4307917_c1_877 | 2689 | 6815 | 189 | 62 | | | NO-HIT |
| Contig146G | 4335032_c1_1011 | 2690 | 6816 | 585 | 194 | 852 | 3.80E−85 | gp:[GI:d1032426:g3298355] [LN:AB010689] [AC:AB010689] [PN:AhpC] [GN:ahpC] [OR:*Pseudomonas putida*] [SR:*Pseudomonas putida* (strain:TOL) DNA] [DE:*Pseudomonas putida* gene for AhpC, AhpF, complete cds.] |
| Contig146G | 4335308_c1_875 | 2691 | 6817 | 921 | 306 | 453 | 7.20E−43 | gp:[GI:g1139588] [LN:HIU20964] [AC:U20964] [PN:ORF2] [OR:*Haemophilus influenzae*] [DE:*Haemophilus influenzae* DNA topoisomerase I (topA) gene, completecds, putative pyridine nucleotide transhydrogenase beta subunit(pntB) gene, partial cds, ORF2 and ORF3 genes, complete cds andputative threonyl-tRNA synthetase (thrS) gene, partial cds.] [NT:ORF2 has a predicted molecular weight of 34.5kd and] |

TABLE 2-continued

| Query | Orf | NT ID | AA ID | NT Lgth | AA Lgth | Score | P-value | Subject |
|---|---|---|---|---|---|---|---|---|
| Contig146G | 4344093_f1_186 | 2692 | 6818 | 426 | 141 | 425 | 6.70E-40 | gp:[GI:d1037197:g4062980] [LN:AB017138] [AC:AB017138] [PN:malonate transporter] [GN:mdcL] [OR:*Pseudomonas putida*] [SR:*Pseudomonas putida* DNA] [DE:*Pseudomonas putida* malonate decarboxylase gene cluster (mdcA, mdcB,mdcC, mdcD, mdcE, mdcG, mdcH, mdcL and mdcM genes), complete cds.] |
| Contig146G | 4344193_c1_754 | 2693 | 6819 | 384 | 127 | 370 | 4.50E-34 | pir:[LN:A70021] [AC:A70021] [PN:glycine cleavage system protein H homolog yusH] [GN:yusH] [CL:glycine cleavage system protein H:lipoyl/biotin-binding homology] [OR:*Bacillus subtilis*] |
| Contig146G | 4344193_f1_198 | 2694 | 6820 | 804 | 267 | 646 | 2.60E-63 | sp:[LN:TAUB_ECOLI] [AC:Q47538] [GN:TAUB:SSIB] [OR:*ESCHERICHIA COLI*] [DE:TAURINE TRANSPORT ATP-BINDING PROTEIN TAUB] [SP:Q47538] |
| Contig146G | 4353433_f1_184 | 2695 | 6821 | 612 | 203 | 399 | 3.80E-37 | gp:[GI:d1037195:g4062978] [LN:AB017138] [AC:AB017138] [PN:holo-acyl carrier protein] [GN:mdcG] [FN:involved in formation of the holo-acyl carrier] [OR:*Pseudomonas putida*] [SR:*Pseudomonas putida* DNA [DE:*Pseudomonas putida* malonate decarboxylase gene cluster (mdcA, mdcB,mdcC, mdcD, mdcE, mdcG, mdcH, mdcL and mdcM genes), complete cds.] |
| Contig146G | 4410927_c1_1025 | 2696 | 6822 | 513 | 170 | 154 | 3.50E-11 | gp:[GI:g940146] [LN:TMU30501] [AC:U30501] [OR:*Thermotoga maritima*] [DE:*Thermotoga maritima* CheA (cheA), CheW (cheW) and CheY (cheY) genes,complete cds.] [NT:orf2; Method: conceptual translation supplied by] |
| Contig146G | 4415887_f1_40 | 2697 | 6823 | 1170 | 389 | 824 | 3.50E-82 | gp[GI:g2459964] [LN:AF010189] [AC:AF010189] [PN:HisX] [GN hisX] [OR:*Pseudomonas stutzeri*] [DE:*Pseudomonas stutzeri* HflC (hflC) gene, partial cds; HisX (hisX)gene, complete cds; and PurA (purA) gene, partial cds.] |
| Contig146G | 4423377_c1_770 | 2698 | 6824 | 1017 | 338 | 1071 | 2.40E-108 | sp:[LN:BIOB_ECOLI] [AC:P12996] [GN:BIOB] [OR:*ESCHERICHIA COLI*] [EC:2.8.1.6] [DE:BIOTIN SYNTHASE, BIOTIN SYNTHASE)] [SP:P12996] |
| Contig146G | 4453213_f3_541 | 2699 | 6825 | 1116 | 371 | 299 | 6.00E-31 | gp:[GI:g4154707] [LN:AE001457] [AC:AE001457:AE001439] [PN:BETA-KETOACYL-ACP SYNTHASE III] [GN:fabH] [OR:*Helicobacter pylori* J99] [DE:*Helicobacter pylori*, strain J99 section 18 of 132 of the completegenome.] [NT:similar to *H. pylori* 26695 gene HP0202] |
| Contig146G | 4474040_f2_421 | 2700 | 6826 | 3483 | 1160 | 711 | 1.90E-69 | pir:[LN:C70565] [AC:C70565] [PN:hypothetical protein Rv3454] [GN:Rv3454] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig146G | 4485625_c1_843 | 2701 | 6827 | 519 | 172 | 165 | 2.40E−12 | gp:[GI:g940146] [LN:TMU30501] [AC:U30501] [OR:*Thermotoga maritima*] [DE:*Thermotoga maritima* CheA (cheA), CheW (cheW) and CheY (cheY) genes,complete cds.] [NT:orf2; Method: conceptual translation supplied by] |
| Contig146G | 4491718_f3_730 | 2702 | 6828 | 852 | 283 | 439 | 2.20E−41 | sp:[LN:GLTJ_ECOLI] [AC:P41074] [GN:GLTJ] [OR:*ESCHERICHIA COLI*] [DE:GLUTAMATE/ASPARTATE TRANSPORT SYSTEM PERMEASE PROTEIN GLTJ] [SP:P41074] |
| Contig146G | 4501027_c2_1264 | 2703 | 6829 | 996 | 331 | 156 | 1.10E−12 | pir:[LN:B69922] [AC:B69922] [PN:conserved hypothetical protein yorA] [GN:yorA] [OR:*Bacillus subtilis*] |
| Contig146G | 4509678_f1_171 | 2704 | 6830 | 2148 | 715 | 2407 | 6.30E−250 | gp:[GI:g1778585] [LN:PPU82622] [AC:U82622] [PN:stationary-phase inducible catalase C] [GN:catC] [OR:*Pseudomonas putida*] [DE:*Pseudomonas putida* stationary-phase inducible catalase C (catC)gene, complete cds.] |
| Contig146G | 4511025_f3_510 | 2705 | 6831 | 1038 | 345 | 430 | 2.00E−40 | sp:[LN:YR12_MYCTU] [AC:P71663] [GN:MTCY21B4.12] [OR:*MYCOBACTERIUM TUBERCULOSIS*] [DE:HYPOTHETICAL TRANSCRIPTIONAL REGULATOR CY21B4.12] [SP:P71663] |
| Contig146G | 453_c3_1554 | 2706 | 6832 | 231 | 76 | | | NO-HIT |
| Contig146G | 4548577_f3_679 | 2707 | 6833 | 456 | 151 | 463 | 6.30E−44 | gp:[GI:e1358530:g3980226] [LN:SCO131213] [AC:AJ131213] [PN:putative transcriptional regulator] [GN:lrpA] [FN:similar to leucine responsive proteins] [OR:*Streptomyces coelicolor*] [DE:*Streptomyces coelicolor* A3(2) mutY (partial), sigE, cseB, cseC andlrpA genes and ORF202 and ORF277.] |
| Contig146G | 4554693_c3_1590 | 2708 | 6834 | 636 | 211 | 289 | 1.70E−25 | pir:[LN:I40180] [AC:I40180] [PN:hypothetical protein 2] [CL:hypothetical protein b0838] [OR:*Pseudomonas cepacia*] |
| Contig146G | 4567807_f3_486 | 2709 | 6835 | 1104 | 367 | 1023 | 2.90E−103 | gp:[GI:e1331954:g4106585] [LN:YP102KB] [AC:AL031866] [GN:aruF] [OR:*Yersinia pestis*] [DE:*Yersinia pestis* 102 kbases unstable region: from 1 to 119443.] [NT:ORF17, len: 350. aruF, probable] |
| Contig146G | 4688133_f1_230 | 2710 | 6836 | 603 | 200 | 180 | 6.10E−14 | gp:[GI:d1032534;g3318590] [LN:AB015670] [AC:AB015670] [OR:Bacillus sp.] [SR:Bacillus sp. DNA] [DE:Bacillus sp. genes for CDase, CGTase, MBP and 15 ORFs, partial andcomplete cds.] [NT:A2-5a orf21; hypothetical protein] |
| Contig146G | 4688140_f3_627 | 2711 | 6837 | 213 | 70 | | | NO-HIT |
| Contig146G | 4691068_f3_593 | 2712 | 6838 | 549 | 182 | | | NO-HIT |
| Contig146G | 4697156_f2_281 | 2713 | 6839 | 789 | 262 | 234 | 1.20E−19 | pir:[LN:S75639] [AC:S75639] [PN:hypothetical protein slr1971] [OR:Syncchocystis sp.] [SR:PCC 6803, PCC 6803] [SR:PCC 6803,] |
| Contig146G | 4698402_c3_1611 | 2714 | 6840 | 1569 | 522 | 1071 | 2.40E−108 | pir:[LN:D70861] [AC:D70861] [PN:probable monoxygenase] [GN:Rv3049c] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig146G | 4723137_f2_377 | 2715 | 6841 | 1314 | 437 | 1472 | 7.60E-151 | gp:[GI:e242887;g2764833] [LN:ECPAA] [AC:X97452] [PN:coenzyme A ligase] [GN:K] [OR:*Escherichia coli*] [DE:*E.coli* cluster for phenylacetic acid degradation.] [NT:putative] |
| Contig146G | 4740660_f3_564 | 2716 | 6842 | 369 | 122 | | | NO-HIT |
| Contig146G | 4859462_c3_1581 | 2717 | 6843 | 1047 | 348 | 1559 | 4.60E-160 | sp:[LN:BENC_ACICA] [AC:P07771] [GN:BENC] [OR:*ACINETOBACTER CALCOACETICUS*] [EC:1.18.1.3] [DE:FERREDOXIN; FERREDOXIN--NAD(+) REDUCTASE,]] [SP:P07771] |
| Contig146G | 4869033_f2_373 | 2718 | 6844 | 504 | 167 | 464 | 4.90E-44 | gp:[GI:e242880;g2764826] [LN:ECPAA] [AC:X97452] [GN:D] [OR:*Eschcrichia coli*] [DE:*E.coli* cluster for phenylacetic acid degradation.] [SP:P76080] |
| Contig146G | 4869377_f3_645 | 2719 | 6845 | 1176 | 391 | 157 | 1.60E-08 | sp:[LN:SAOX_BACSP] [AC:P40859] [OR:BACILLUS SP] [EC:1.5.3.1] [DE:SARCOSINE OXIDASE,] [SP:P40859] |
| Contig146G | 4875053_f3_594 | 2720 | 6846 | 327 | 108 | | | NO-HIT |
| Contig146G | 4875192_c3_1589 | 2721 | 6847 | 759 | 252 | 519 | 7.30E-50 | sp:[LN:YGGH_ECOLI] [AC:P32049] [GN:YGGH] [OR:*ESCHERICHIA COLI*] [DE:HYPOTHETICAL 27.3 KD PROTEIN IN ANSB-MUTY INTERGENIC REGION (F239)] [SP:P32049] |
| Contig146G | 4881266_f3_601 | 2722 | 6848 | 363 | 120 | 237 | 5.60E-20 | pir:[LN:E69868] [AC:E69868] [PN:conserved hypothetical protein ykvN] [GN:ykvN] [CL:conserved hypothetical protein MTH1285] [OR:*Bacillus subtilis*] |
| Contig146G | 4881943_c3_1556 | 2723 | 6849 | 474 | 157 | | | NO-HIT |
| Contig146G | 4883250_f1_692 | 2724 | 6850 | 441 | 146 | 169 | 9.00E-13 | sp:[LN:YWBH_BACSU] [AC:P39591] [GN:YWBH;IPA-23R] [OR:*BACILLUS SUBTILIS*] [DE:HYPOTHETICAL 14.3 KD PROTEIN IN EPR-GALK INTERGENIC REGION] [SP:P39591] |
| Contig146G | 4883562_f3_553 | 2725 | 6851 | 420 | 139 | 123 | 6.70E-08 | gp:[GI:e1132704;g2408054] [LN:SPAC29B12] [AC;Z99164] [PN:hypothetical protein] [GN:SPAC29B12.13] [OR:*Schizosaccharomyces pombe*] [SR:fission yeast] [DE:*S.pombe* chromosome I cosmid c29B12.] [NT:SPAC29B12.13, unknown, len:13] |
| Contig146G | 48842_c3_1371 | 2726 | 6852 | 777 | 258 | 250 | 8.00E-21 | sp:[LN:SOXA_RHOSO] [AC:P54995] [GN:SOXA;DSZA] [OR:RHODOCOCCUS SP] [DE;DIBENZOTHIOPRENE DESULFURIZATION ENZYME A] [SP:P54995] |
| Contig146G | 4885943_f1_159 | 2727 | 6853 | 816 | 271 | | | NO-HIT |
| Contig146G | 4890933_c3_1617 | 2728 | 6854 | 1215 | 404 | 965 | 4.00E-97 | pir:[LN:C70505] [AC:C70505] [PN:probable acyl-coa dehydrogenase] [GN:fadE20] [CL:acyl-CoA dehydrogenase] [OR:*Mycobacterium tuberculosis*] |
| Contig146G | 4898465_f2_358 | 2729 | 6855 | 594 | 197 | 104 | 0.00077 | pir:[LN:A40215] [AC:A40215] [PN:TcD antigen] [OR:*Trypanosoma cruzi*] |

TABLE 2-continued

| Query | Orf | NT ID | AA ID | NT Lgth | AA Lgth | Score | P-value | Subject |
|---|---|---|---|---|---|---|---|---|
| Contig146G | 4901675_f2_314 | 2730 | 6856 | 1347 | 448 | 390 | 3.40E−36 | sp:tLN;YE09_HAEIN] [AC;P44183] [GN:HI1409] [OR:*HAEMOPHILUS INFLUENZAE*] [DE:HYPOTHETICAL PROTEIN HI1409] [SP:P44183] |
| Contig146G | 4941000_c1_874 | 2731 | 6857 | 864 | 287 | 1149 | 1.30E−116 | pir:[LN:A36893] [AC:A36893] [PN:transcription activator pobR] [GN:pobR] [OR:*Acinetobacter calcoaceticus*] |
| Contig146G | 4948442_f3_597 | 2732 | 6858 | 1230 | 409 | 668 | 1.20E−65 | gp:[GI:d1039053:g4512350] [LN:AB011836] [AC:AB011836] [GN:transposase] [OR:*Bacillus halodurans*] [SR:*Bacillus halodurans* (strain:C-125, isolate:xylanase producer) DNA] [DE:*Bacillus halodurans* C-125 genomic DNA, clone ALBAC003.] [NT:similar to *Bordetella paraperlussis* transposase for] |
| Contig146G | 4957802_c3_1414 | 2733 | 6859 | 708 | 235 | | | NO-HIT |
| Contig146G | 4960275_f3_711 | 2734 | 6860 | 1896 | 631 | 396 | 2.20E−36 | pir:[LN:F69989] [AC:F69989] [PN:conserved hypothetical protein ytcJ] [GN:ytcJ] [OR:*Bacillus subtilis*] |
| Contig146G | 4970063_c2_1339 | 2735 | 6861 | 735 | 244 | | | NO-HIT |
| Contig146G | 4970633_c3_1450 | 2736 | 6862 | 348 | 115 | 237 | 5.60E−20 | sp:[LN:HMGL_PSEMV] [AC:P13703] [GN:MVAB] [OR:*PSEUDOMONAS MEVALONII*] [EC:4.1.3.4] [DE:(3-HYDROXY-3-METHYLGLUTARATE-COA LYASE)] [SP:P13703] |
| Contig146G | 500625_c2_1090 | 2737 | 6863 | 609 | 202 | 106 | 0.0005 | pir:[LN:E70476] [AC:E70476] [PN:2-acylglycerophosphoethanolamine acyltransferase] [GNs] [OR:*Aquifex aeolicus*] |
| Contig146G | 5079662_c1_787 | 2738 | 6864 | 369 | 122 | 181 | 4.80E−14 | sp:[LN:YGAH_ECOLI] [AC:P43667:P77323] [GN:YGAH] [OR:*ESCHERICHIA COLI*] [DE:HYPOTHETICAL 12.0 KD PROTEIN IN PROX-EMRR INTERGENIC REGION] [SP:P43667:P77323] |
| Contig146G | 5086532_f2_387 | 2739 | 6865 | 1197 | 398 | 1069 | 3.80E−108 | gp:[GI:g1763079] [LN:STU69493] [AC:U69493] [PN:PhnW] [FN:2-aminoethylphosphonate:pyruvate] [OR:*Salmonella typhimurium*] [DE:*Salmonella typhimurium* ThiJ and Orf1 genes, partial cds, and PhnX,PhnW, PhnR, PhnS, PhnT, PhnU and PhnV genes, complete cds.] |
| Contig146G | 509701_c1_1063 | 2740 | 6866 | 522 | 173 | 244 | 1.00E−20 | gp:[GI:g3128284] [LN:AF010496] [AC:AF010496] [PN:potential regulatory protein] [OR:*Rhodobacter capsulatus*] [DE:*Rhodobacter capsulatus* strain SB1003, partial genome.] |
| Contig146G | 5097302_f3_693 | 2741 | 6867 | 669 | 222 | 250 | 2.40E−21 | sp:[LN:PAIB_BACSU] [AC:P21341] [GN:PAIB] [OR:*BACILLUS SUBTILIS*] [DE:PROTEASE SYNTHASE AND SPORULATION NEGATIVE REGULATORY PROTEIN PAI 2] [SP:P21341] |
| Contig146G | 5116452_f3_731 | 2742 | 6868 | 744 | 247 | 931 | 1.60E−93 | sp:[LN:GLTL_ECOLI] [AC:P41076] [GN:GLTL] [OR:*ESCHERICHIA COLI*] [DE:GLUTAMATE/ASPARTATE TRANSPORT ATP-BINDING PROTEIN GLTL] [SP:P41076] |

TABLE 2-continued

| Query | Orf | NT ID | AA ID | NT Lgth | AA Lgth | Score | P-value | Subject |
|---|---|---|---|---|---|---|---|---|
| Contig146G | 5119028_f3_610 | 2743 | 6869 | 957 | 318 | 140 | 4.10E−09 | pir:[LN:F69755] [AC:F69755] [PN:L-alanoyl-D-glutamate peptidase homolog ycdD] [GN:ycdD] [OR:*Bacillus subtilis*] |
| Contig146G | 5165931_f2_290 | 2744 | 6870 | 1419 | 472 | 235 | 8.40E−19 | gp:[GI:g2641145] [LN:AF030977] [AC:AF030977:UI1759:M90461] [PN:putative outer membrane porin] [GN:ompA] [OR:*Vibrio cholerae*] [DE:*Vibrio cholerae* glutamyl tRNA synthetase (gltX) gene, partial cds;and putative outer membrane porin (ompA), vibriobactin receptorprecursor (viuA), and ViuB protein (viuB) genes, complete cds.] [NT:OmpA; similar to *E. coli* OmpA] |
| Contig146G | 5213202_f3_568 | 2745 | 6871 | 813 | 270 | 369 | 5.80E−34 | pir:[LN:B64122] [AC:B64122] [PN:hypothetical protein HI1407] [OR:*Haemophilus influenzae*] |
| Contig146G | 524182_c3_1612 | 2746 | 6872 | 1686 | 561 | 1152 | 6.10E−117 | pir:[LN:F70736] [AC:F70736] [PN:probable choD protein] [GN:choD] [OR:*Mycobacterium tuberculosis*] |
| Contig146G | 5250128_f1_12 | 2747 | 6873 | 726 | 241 | 286 | 3.60E−25 | gp:[GI:e313067:g1945709] [LN:BSZ94043] [AC:Z94043] [PN:hypothetical protein] [GN:yvfI] [OR:*Bacillus subtilis*] [DE:*B.subtilis* genomic DNA fragment (88 kb).] [NT:probable transcriptional regulator (GntR family)] |
| Contig146G | 5254760_c1_777 | 2748 | 6874 | 195 | 64 | | | NO-HIT |
| Contig146G | 5268828_c3_1394 | 2749 | 6875 | 1479 | 492 | 792 | 8.60E−79 | sp:[LN:YWOE_BACSU] [AC:P94575] [GN:YWOE] [OR:*BACILLUS SUBTILIS*] [DE:HYPOTHETICAL 54.0 KD PROTEIN IN NRGA-USD INTERGENIC REGION] [SP:P94575] |
| Contig146G | 5287566_c3_1379 | 2750 | 6876 | 405 | 134 | 225 | 1.00E−18 | gp:[GI:g3212220] [LN:U32819] [AC:U32819:L42023] [PN:*H. influenzae* predicted coding region HI1388.1] [GN:HI1388.1] [OR:*Haemophilus influenzae* Rd] [DE:*Haemophilus influenzae* Rd section 134 of 163 of the completegenome.] [NT:Brute Force ORF; identified by GeneMark; putative] |
| Contig146G | 5351407_c2_1104 | 2751 | 6877 | 1329 | 442 | 730 | 3.20E−72 | sp:[LN:GLTT_BACCA] [AC:P24944] [GN:GLTT] [OR:*BACILLUS CALDOTENAX*] [DE:PROTEIN)] [SP:P24944] |
| Contig146G | 5879552_f1_640 | 2752 | 6878 | 411 | 136 | 277 | 7.10E−24 | gp:[GI:e1313496:g3367745] [LN:SC3A7] [AC:AL031155] [PN:3-oxoadipate enol-lactone] [GN:SC3A7.07] [OR:*Streptomyccs coelicolor*] [DE:*Streptomyces coelicolor* cosmid 3A7.] [NT:SC3A7.07, probable 3-oxoadipate enol-lactone] |
| Contig146G | 5897943_c2_1093 | 2753 | 6879 | 1236 | 411 | 409 | 3.30E−38 | gp:[GI:g2582423] [LN:AF026067] [AC:AF026067] [PN:putative FMNH2-dependent monooxygenase] [GN:slfC] [OR:*Pseudomonas aeruginosa*] [DE:*Pseudomonas aeruginosa* putative reductase (slfA), putativeFMNH2-dependent monooxygenase (slfB), and putative FMNH2-dependentmonooxygenase (slfC) genes, complete cds.] |

TABLE 2-continued

| Query | Orf | NT ID | AA ID | NT Lgth | AA Lgth | Score | P-value | Subject |
|---|---|---|---|---|---|---|---|---|
| Contig146G | 5899135_c1_773 | 2754 | 6880 | 993 | 330 | 560 | 3.30E−54 | sp:[LN:YYAM_BACSU] [AC:P37511] [GN:YYAM] [OR:*BACILLUS SUBTILIS*] [DE:HYPOTHETICAL 32.9 KD PROTEIN IN TETB-EXOA INTERGENIC REGION] [SP:P37511] |
| Contig146G | 5987687_f3_683 | 2755 | 6881 | 858 | 285 | 730 | 3.20E−72 | pir:[LN:C64666] [AC:C64666] [PN:glutamine transport protein glnQ] [GN:glnQ] [CL:inner membrane protein malK:ATP-binding cassette homology] [OR:*Helicobacter pylori*] |
| Contig146G | 5995427_f3_624 | 2756 | 6882 | 786 | 261 | 681 | 5.00E−67 | sp:[LN:PAAF_ECOLI] [AC:P76082:P78288:O53014] [GN:PAAF] [OR:*ESCHERICHIA COLI*] [EC:4.2.1.17] [DE:PROBABLE ENOYL-COA HYDRATASE PAAF,] [SP:P76082:P78288:O53014] |
| Contig146G | 6015692_f3_538 | 2757 | 6883 | 252 | 83 | | | NO-HIT |
| Contig146G | 6016078_c1_751 | 2758 | 6884 | 504 | 167 | 114 | 1.50E−05 | gp:[GI:g2645696] [LN:AF031940] [AC:AF031940] [PN:hypothetical protein] [OR:*Sinorhizobium meliloti*] [DE:*Sinorhizobium meliloti* alcohol dehydrogenase (adhA) gene, completecds.] [NT:orf1] |
| Contig146G | 6031502_c1_825 | 2759 | 6885 | 954 | 317 | 503 | 3.60E−48 | sp:[LN:YWBI_BACSU] [AC:P39592] [GN:YWBI:IPA-24D] [OR:*BACILLUS SUBTILIS*] [DE:HYPOTHETICAL TRANSCRIPTIONAL REGULATOR IN THIK-EPR INTERGENIC REGION] [SP:P39592] |
| Contig146G | 6048187_c3_1358 | 2760 | 6886 | 657 | 218 | 361 | 4.10E−33 | gp:[GI:g4335906] [LN:AF055307] [AC:AF055307] [PN:F17A fimbrial subunit precursor] [GN:f17A] [OR:*Escherichia coli*] [DE:*Escherichia coli* CK210 F17A fimbrial subunit precursor (f17A) gene,complete cds.] |
| Contig146G | 6070327_f2_287 | 2761 | 6887 | 345 | 114 | | | NO-HIT |
| Contig146G | 6111311_f2_265 | 2762 | 6888 | 1389 | 462 | 1968 | 2.10E−203 | gp:[GI:g2271501] [LN:AF009672] [AC:AF009672] [PN:unknown] [OR:Acinetobacter sp. ADP1] [DE:Acinctobacter sp. ADP1 vanillate demethylase region, vanillatedemethylase (vanB) and vanillate demethylase (vanA) genes, completecds.] [NT:putative transport protein; ORF5] |
| Contig146G | 6118757_c1_791 | 2763 | 6889 | 3609 | 1202 | 2821 | 8.50E−294 | sp:[LN:DP3A_SALTY] [AC:P14567] [GN:DNAE:POLC] [OR:*SALMONELLA TYPHIMURIUM*] [EC:2.7.7.7] [DE:DNA POLYMERASE III, ALPHA CHAIN,] [SP:P14567] |
| Contig146G | 6148505_c2_1311 | 2764 | 6890 | 975 | 324 | 184 | 5.50E−12 | pir:[LN:H70882] [AC:H70882] [PN:hypothetical protein Rv2777c] [GN:Rv2777c] [OR:*Mycobacterium tuberculosis*] |
| Contig146G | 625281_f1_122 | 2765 | 6891 | 1128 | 375 | 272 | 1.60E−23 | pir:[LN:B71184] [AC:B71184] [PN:probable sarcosine oxidase] [GN:PH1751] [OR:*Pyrococcus horikoshii*] |
| Contig146G | 626580_f2_347 | 2766 | 6892 | 510 | 169 | 232 | 1.90E−19 | pir:[LN:E71175] [AC:E71175] [PN:hypothetical protein PH0601] [GN:PH0601] [CL:conserved hypothetical protein MJ0080] [OR:Pyrococcus horikoshii] |

TABLE 2-continued

| Query | Orf | NT ID | AA ID | NT Lgth | AA Lgth | Score | P-value | Subject |
|---|---|---|---|---|---|---|---|---|
| Contig146G | 629800_c1_859 | 2767 | 6893 | 465 | 154 | 124 | 5.30E-08 | gp:[GI:e1247712:g2815353] [LN:SC2E9] [AC:AL021530] [PN:hypothetical protein SC2E9.08] [GN:SC2E9.08] [OR:*Streptomyces coelicolor*] [DE:*Streptomyccs coelicolor* cosmid 2E9.] [NT:SC2E9.08, unknown, len: 194] |
| Contig146G | 6376513_f1_75 | 2768 | 6894 | 783 | 260 | | | NO-HIT |
| Contig146G | 6376557_c1_810 | 2769 | 6895 | 1503 | 500 | 1074 | 1.10E-108 | pir:[LN:B64896] [AC:B64896] [PN:hypothetical protein b1439] [CL:hypothetical protein b1439] [OR:*Eschcrichia coli*] |
| Contig146G | 6441276_c3_1499 | 2770 | 6896 | 1635 | 544 | 1331 | 6.60E-136 | pir:[LN:S27612] [AC:S27612] [PN:ketoglutarate semialdehyde dehydrogenase,] [OR:*Pseudomonas putida*] [EC:1.2.1.—] |
| Contig146G | 648557_f3_517 | 2771 | 6897 | 537 | 178 | | | NO-HIT |
| Contig146G | 651462_c1_967 | 2772 | 6898 | 615 | 204 | | | NO-HIT |
| Contig146G | 6679562_c3_1364 | 2773 | 6899 | 201 | 66 | | | NO-HIT |
| Config146G | 6742327_f3_572 | 2774 | 6900 | 390 | 129 | | | NO-HIT |
| Contig146G | 6836625_f2_412 | 2775 | 6901 | 1770 | 589 | 1419 | 3.10E-145 | pir:[LN:D69187] [AC:D69187] [PN:long-chain-fatty-acid-CoA ligase] [GN:MTH6S7] [CL:acetate—CoA ligase homology] [OR:*Methanobacterium thermoautotrophicum*] |
| Contig146G | 6909468_f3_626 | 2776 | 6902 | 645 | 214 | 189 | 1.40E-14 | sp:[LN:YBEQ_ECOLI] [AC:P77234] [GN:YBEQ] [OR:*ESCHERICHIA COLI*] [DE:HYPOTHETICAL 37.3 KD PROTEIN IN LEUS-GLTL INTERGENIC REGION] [SP:P77234] |
| Contig146G | 7062800_c3_1482 | 2777 | 6903 | 621 | 206 | | | NO-HIT |
| Contig146G | 7062962_f3_503 | 2778 | 6904 | 465 | 154 | 146 | 2.50E-10 | sp:[LN:YX18_MYCTU] [AC:Q10810] [GN:MTCY274.18] [OR:*MYCOBACTERIUM TUBERCULOSIS*] [DE:HYPOTHETICAL TRANSCRIPTIONAL REGULATOR CY274.18] [SP:Q10810] |
| Contig146G | 7079467_c2_1096 | 2779 | 6905 | 1110 | 369 | 726 | 8.50E-72 | sp:[LN:ABC_HAEIN] [AC:P44785] [GN:ABC:HI0621] [OR:*HAEMOPHILUS INFLUENZAE*] [DE:ATP-BINDING PROTEIN ABC] [SP:P44785] |
| Contig146G | 7212962_f3_720 | 2780 | 6906 | 432 | 143 | 384 | 1.50E-35 | pir:[LN:A69195] [AC:A69195] [PN:transcription regulator] [GN:MTH711] [CL:hypthetical protein YCL033c] [OR:*Methanobacterium thermoautotrophicum*] |
| Contig146G | 7303308_c2_1247 | 2781 | 6907 | 747 | 248 | | | NO-HIT |
| Contig146G | 7633_c1_761 | 2782 | 6908 | 1140 | 379 | 979 | 1.30E-98 | sp:[LN:TRMA_ECOLI] [AC:P23003] [GN:TRMA] [OR:*ESCHERICHIA COLI*] [EC:2.1.1.35] [DE:METHYLTRANSFERASE) (RUMT)] [SP:P23003] |
| Contig146G | 7807_c1_762 | 2783 | 6909 | 252 | 83 | | | NO-HIT |
| Contig146G | 781252_f1_561 | 2784 | 6910 | 372 | 123 | | | NO-HIT |
| Contig146G | 782952_c1_864 | 2785 | 6911 | 909 | 302 | 445 | 5.10E-42 | gp:[GI:g2290994] [LN:AF006000] [AC:AF006000] [PN:unknown] [OR:*Bordetella pertussis*] [DE:*Bordetella pertussis* D-3-phosphoglycerate dehydrogenase homolog(serA) and Brg1 (brg1) genes, complete cds.] [NT:orf6; similar to *P. putida* PobR; putative IclR type] |

TABLE 2-continued

| Query | Orf | NT ID | AA ID | NT Lgth | AA Lgth | Score | P-value | Subject |
|---|---|---|---|---|---|---|---|---|
| Contig146G | 801391_c3_1624 | 2786 | 6912 | 1413 | 470 | 1522 | 3.80E−156 | sp:[LN:GUDT_ECOLI] [AC:Q46916] [GN:YGCZ] [OR:*ESCHERICHIA COLI*] [DE:PROBABLE GLUCARATE TRANSPORTER] [SP:Q46916] |
| Contig146G | 828532_c3_1444 | 2787 | 6913 | 192 | 63 | | | NO-HIT |
| Contig146G | 832336_f1_84 | 2788 | 6914 | 288 | 95 | | | NO-HIT |
| Contig146G | 839135_c3_1438 | 2789 | 6915 | 237 | 78 | 143 | 5.10E−10 | pir:[LN:A26892] [AC:A26892] [PN:Mopa box protein] [OR:*Mus musculus*] [SR:, house mouse] |
| Contig146G | 860715_c3_1508 | 2790 | 6916 | 864 | 287 | 354 | 2.20E−32 | gp:[GI:e1359131:g4007673] [LN:SC4B5] [AC:AL034443] [PN:LysR-type transcriptional regulator] (GN:SC4B5.05c) [OR:*Streptomyces coelicolor*] [DE:*Streptomyces coelicolor* cosmid 4B5.] [NT:SC4B5.05c, LysR-type transcriptional regulator,] |
| Contig146G | 89008_c3_1632 | 2791 | 6917 | 756 | 251 | 177 | 1.30E−13 | gp:[GI:e1319710:g3581869] [LN:SCI35] [AC:AL031541] [PN:putative transcriptional regulator] [GN:SCI35.36] [OR:*Streptomyces coelicolor*] [DE:*Streptomyces coelicolor* cosmid 135.] [NT:SCI35.36, probable transcriptional regulator, len:] |
| Contig146G | 908592_c1_1012 | 2792 | 6918 | 228 | 75 | | | NO-HIT |
| Contig146G | 915643_f3_744 | 2793 | 6919 | 759 | 252 | 323 | 4.30E−29 | sp:[LN:YIGE_ECOLI] [AC:P27840:P27839:Q47713:P76 760:P76759] [GN:YIGE] [OR:*ESCHERICHIA COLI*] [DE:HYPOTHETICAL 27.9 KD PROTEIN IN UVRD-CORA INTERGENIC REGION] [SP:P27840:P27839:Q47713:P767 60:P76759] |
| Contig146G | 969388_f1_9 | 2794 | 6920 | 309 | 102 | | | NO-HIT |
| Contig146G | 970052_c3_1350 | 2795 | 6921 | 507 | 168 | | | NO-HIT |
| Contig146G | 974200_c3_1432 | 2796 | 6922 | 186 | 61 | | | NO-HIT |
| Contig146G | 976063_f2_361 | 2797 | 6923 | 447 | 148 | 146 | 2.50E−10 | sp:[LN:YOAF_ECOLI] [AC:P76244] [GN:YOAF] [OR:*ESCHERICHIA COLI*] [DE:HYPOTHETICAL 8.9 KD PROTEIN IN GAPA-RND INTERGENIC REGION] [SP:P76244] |
| Contig146G | 978327_c3_1372 | 2798 | 6924 | 891 | 296 | 423 | 1.10E−39 | gp:[GI:e1288207:g3087788] [LN:LPN5668] [AC:AJ005668] [PN:29 kDa immunogenic protein] [OR:*Legionella pneumophila*] [DE:*Legionella pneumophila* gene encoding a 29 kDa immunogenic protein.] |
| Contig146G | 984625_f2_304 | 2799 | 6925 | 201 | 66 | | | NO-HIT |
| Contig146G | 9851558_f2_354 | 2800 | 6926 | 2955 | 984 | 124 | 7.70E−14 | gp:[GI:e1252197:g2897626] [LN:LP22KBICM] [AC:Y15044] [PN:IcmF protein] [GN:icmF] [OR:*Legionella pneumophila*] [DE:*Legionella pneumophila* 22kB DNA fragment from icm gene cluster.] |
| Contig146G | 995385_f3_681 | 2801 | 6927 | 300 | 99 | 167 | 1.50E−12 | sp:[LN:YJDJ_ECOLI] [AC:P39274] [GN:YJDJ] [OR:*ESCHERICHIA COLI*] [DE:HYPOTHETICAL 10.5 KD PROTEIN IN DCUB-LYSU INTERGENIC REGION (O90A)] [SP:P39274] |
| Contig146G | 9956260_f2_324 | 2802 | 6928 | 2172 | 723 | 772 | 1.10E−76 | gp:[GI:g558153] [LN:APXIIICAB] [AC:X80055] [GN:xIIIB] [OR:*Actinobacillus pleuropneumoniae*] [DE:*A.pleuropneumoniae* apxIIICABD gene.] [SP:Q04473] |

TABLE 2-continued

| Query | Orf | NT ID | AA ID | NT Lgth | AA Lgth | Score | P-value | Subject |
|---|---|---|---|---|---|---|---|---|
| Contig146G | 9960135_c1_939 | 2803 | 6929 | 483 | 160 | 106 | 2.00E−05 | pir:[LN:F70808] [AC:F70808] [PN:hypothetical protein Rv1919c] [GN:Rv1919c] [OR:*Mycobacterium tuberculosis*] |
| Contig146G | 10391086_c2_331 | 2804 | 6930 | 594 | 197 | | | NO-HIT |
| Contig146G | 10437511_f1_29 | 2805 | 6931 | 510 | 169 | 470 | 1.10E−44 | sp:[LN:YEAL_ECOLI] [AC:P76240:O07965:O07967] [GN:YEAL] [OR:*ESCHERICHIA COLI*] [DE:HYPOTHETICAL 15.3 KD PROTEIN IN GAPA-RND INTERGENIC REGION] [SP:P76240:O07965:O07967] |
| Contig146G | 10467_c2_353 | 2806 | 6932 | 1842 | 613 | 557 | 6.90E−54 | sp:[LN:YDCR_ECOLI] [AC:P75906] [GN:YCDR] [OR:*ESCHERICHIA COLI*] [DE:PRECURSOR] [SP:P75906] |
| Contig146G | 10718803_f1_14 | 2807 | 6933 | 288 | 95 | | | NO-HIT |
| Contig146G | 10735937_c1_327 | 2808 | 6934 | 186 | 61 | | | NO-HIT |
| Contig146G | 10973125_c2_372 | 2809 | 6935 | 951 | 316 | 725 | 1.10E−71 | sp:[LN:MIAA_HAEIN] [AC:P44495] [GN:MIAA:TRPX:HI0068] [OR:*HAEMOPHILUS INFLUENZAE*] [EC:2.5.1.8] [DE:(IPP TRANSFERASE)] [SP:P44495] |
| Contig146G | 11745956_c3_423 | 2810 | 6936 | 489 | 162 | 137 | 2.20E−09 | sp:[LN:YCDP_ECOLI] [AC:P75904] [GN:YCDP] [OR:*ESCHERICHIA COLI*] [DE:HYPOTHETICAL 16.1 KD PROTEIN IN PHOH-CSGG INTERGENIC REGION] [SP:P75904] |
| Contig147G | 11759677_c1_258 | 2811 | 6937 | 1704 | 567 | 674 | 2.80E−66 | sp:[LN:PQIB_ECOLI] [AC:P43671:P77534] [GN:PQIB:PQI5B] [OR:*ESCHERICHIA COLI*] [DE:PARAQUAT-INDUCIBLE PROTEIN B] [SP:P43671:P77534] |
| Contig147G | 11834455_c1_268 | 2812 | 6938 | 684 | 227 | | | NO-HIT |
| Contig147G | 12693911_c2_389 | 2813 | 6939 | 231 | 76 | | | NO-HIT |
| Contig147G | 12933301_c3_456 | 2814 | 6940 | 1506 | 501 | 290 | 1.90E−22 | gp:[GI:g1232060] [LN:ECOF17D] [AC:L77091] [PN:transmembrane protein] [GN:F17d-C] [FN:base protein for polymerization of major] [OR:*Escherichia coli*] [SR:*Escherichia coli* (individual_isolate natural isolate, strai] [DE:*Escherichia coli* F17d fimbrial gene cluster encoding the majorfimbrial subunit protein (F17d-A), the chaperone protein (F17d-D),the transmembrane protein (F17d-C), the adhesin (F17d-G), completecds.] [NT:putative] |
| Contig147G | 13063426_c1_263 | 2815 | 6941 | 237 | 78 | | | NO-HIT |
| Contig147G | 1366028_f2_127 | 2816 | 6942 | 207 | 68 | | | NO-HIT |
| Contig147G | 13676301_c1_276 | 2817 | 6943 | 1332 | 443 | 129 | 7.90E−05 | sp:[LN:YCDS_ECOLI] [AC:P75907] [GN:YCDS] [OR:*ESCHERICHIA COLI*] [DE:HYPOTHETICAL 92.2 KD PROTEIN IN PHOH-CSGG INTERGENIC REGION PRECURSOR] [SP:P75907] |
| Contig147G | 13676312_f2_129 | 2818 | 6944 | 651 | 216 | 107 | 3.60E−07 | gp:[GI:g3641340] [LN:AF090329] [AC:AF090329] [PN:cyclohexanone monooxygenase homolog] [OR:*Pseudomonas fluorescens*] [DE:*Pseudomonas fluorescens* cyclohexanone monooxygenase homolog gene,partial cds; lactone-specific esterase (estf1) gene, complete cds;and alkane-1 monooxygenase homolog gene, partial cds.] [NT:Orf1] |

TABLE 2-continued

| Query | Orf | NT ID | AA ID | NT Lgth | AA Lgth | Score | P-value | Subject |
|---|---|---|---|---|---|---|---|---|
| Contig147G | 13694177_f3_251 | 2819 | 6945 | 444 | 147 | 118 | 2.90E−07 | sp:[LN:YDH1_XANAU] [AC:P22645] [OR:*XANTHOBACTER AUTOTROPHICUS*] [DE:HYPOTHETICAL 22.8 KD PROTEIN IN DHLA 5'REGION] [SP:P22645] |
| Contig147G | 13697212_c2_338 | 2820 | 6946 | 1371 | 456 | 1396 | 8.50E−143 | sp:[LN:SNDH_ACELI] [AC:Q44091] [OR:*ACETOBACTER LIQUEFACIENS*] [EC:1.1.1.—] [DE:L-SORBOSONE DEHYDROGENASE, (SNDH)] [SP:Q44091] |
| Contig147G | 1382827_f3_167 | 2821 | 6947 | 444 | 147 | | | NO-HIT |
| Contig147G | 1415765_c1_269 | 2822 | 6948 | 780 | 259 | 488 | 1.40E−46 | pir:[LN:S74354] [AC:S74354] [PN:hypothetical protein sll0069] [OR:Synechocystis sp.] [SR:PCC 6803, PCC 6803] [SR:PCC 6803,] |
| Contig147G | 1444556_f2_113 | 2823 | 6949 | 1443 | 480 | 1016 | 1.60E−102 | sp:[LN:YCJK_ECOLI] [AC:P78061] [GN:YCJK] [OR:*ESCHERICHIA COLI*] [EC:6.3.1.2] [DE:LIGASE)] [SP:P78061] |
| Contig147G | 14500933_c2_356 | 2824 | 6950 | 300 | 99 | | | NO-HIT |
| Contig147G | 14501712_f2_93 | 2825 | 6951 | 1398 | 465 | 1476 | 2.80E−151 | gp:[GI:g403171] [LN:REREUTPBC] [AC:L24492] [PN:ethanolamine ammonia-lyase large subunit] [GN:eutB] [FN:deamination ofethanolamine] [OR:*Rhodococcus erythropolis*] [EC:4.3.1.7] [DE:*Rhodococcus crythropolis* ORF1, ethanolamine permease (cutP),ethanolamine ammonia-lyase large subunit (eutB), ethanolamineammonia-lyase small subunit (eutC) genes, complete cds and ORF2gene, partial cds.] [NT:similar to *Salmonella typhimurium* EutB PIR] |
| Contig147G | 14650302_c1_260 | 2826 | 6952 | 732 | 243 | 594 | 8.30E−58 | sp:[LN:YGEA_ECOLI] [AC:P03813] [GN:YGEA] [OR:*ESCHERICHIA COLI*] [DE:HYPOTHETICAL 25.2 KD PROTEIN IN LYSR-ARAE INTERGENIC REGION] [SP:P03813] |
| Contig147G | 14726550_c1_297 | 2827 | 6953 | 474 | 157 | | | NO-HIT |
| Contig147G | 14730302_f1_63 | 2828 | 6954 | 243 | 80 | 322 | 5.50E−29 | pir:[LN:E64076] [AC:E64076] [PN:ribosomal protein S18 [CL:*Escherichia coli* ribosomal protein S18] [OR:*Haemophilus influenzae*] |
| Contig147G | 15078128_c1_282 | 2829 | 6955 | 1119 | 372 | 1221 | 3.00E−124 | sp:[LN:RF1_HAEIN] [AC:P43917] [GN:PRFA:HI1561] [OR:*HAEMOPHILUS INFLUENZAE*] [DE:PEPTIDE CHAIN RELEASE FACTOR 1 (RF-1)] [SP:P43917] |
| Contig147G | 15125312_c2_386 | 2830 | 6956 | 1038 | 345 | 132 | 3.70E−08 | sp:[LN:PRU_MYXXA] [AC:P27755] [GN:PRU] [OR:*MYXOCOCCUS XANTHUS*] [DE:PROTEIN U PRECURSOR] [SP:P27755] |
| Contig147G | 15682913_c3_410 | 2831 | 6957 | 1563 | 520 | 1107 | 3.60E−112 | gp:[GI:g2996038] [LN:AF054525] [AC:AF054525] [PN:hypothetical protein] [OR:Synechococcus PCC7002] [DE:Synechococcus PCC7002 clone d76eh2.5 hypothetical protein genes.partial and complete cds.] [NT:similar to ORF sll0335 of Syncchocystis sp. PCC6803] |

TABLE 2-continued

| Query | Orf | NT ID | AA ID | NT Lgth | AA Lgth | Score | P-value | Subject |
|---|---|---|---|---|---|---|---|---|
| Contig147G | 16445967_c1_287 | 2832 | 6958 | 1722 | 573 | 1083 | 1.30E−109 | sp:[LN:ATKA_CLOAB] [AC:O32327] [GN:KDPA] [OR:*CLOSTRIDIUM ACETOBUTYLICUM*] [EC:3.6.1.36] [DE:PHOSPHOHYDROLASE [POTASSIUM-TRANSPORTING] A CHAIN)] [SP:O32327] |
| Contig147G | 16504375_c3_411 | 2833 | 6959 | 819 | 272 | 268 | 2.90E−23 | sp:[LN:Y0BW_MYCLE] [AC:Q49757] [GN:B1937_F2_39:MLCL536.03 C] [OR:*MYCOBACTERIUM LEPRAE*] [DE:HYPOTHETICAL 31.1 KD PROTEIN B1937_F2_39] [SP:Q49757] |
| Contig147G | 16516702_c1_325 | 2834 | 6960 | 252 | 83 | | | NO-HIT |
| Contig147G | 16600265_f1_245 | 2835 | 6961 | 1245 | 414 | 189 | 4.30E−12 | sp:[LN:YIDY_ECOLI] [AC:P31462:P76739] [GN:YIDY] [OR:*ESCHERICHIA COLI*] [DE:HYPOTHETICAL 41.5 KD PROTEIN IN TNAB-BGLB INTERGENIC REGION] [SP:P31462:P76739] |
| Contig147G | 16828375_f1_190 | 2836 | 6962 | 1206 | 401 | 658 | 1.40E−64 | pir:[LN:C64923] [AC:C64923] [PN:chloramphenicol resistance protein homolog b1657] [CL:*Streptomyces lividans* chloramphenicol resistance protein] [OR:*Escherichia coli*] |
| Contig147G | 16854752_c1_315 | 2837 | 6963 | 372 | 123 | 114 | 6.10E−07 | pir:[LN:S10709] [AC:S10709] [PN:5-carboxymethyl-2-hydroxymuconate isomerase] [OR:*Escherichia coli*] |
| Contig147G | 195250_c3_447 | 2838 | 6964 | 534 | 177 | 300 | 1.20E−26 | gp:[GI:g1305418] [LN:STU48735] [AC:U48735] [PN:host factor I] [GN:hfq] [OR:*Salmonella typhimurium*] [SR:*Salmonella typhimurium* strain=LT2] [DE:*Salmonella typhimurium* host factor I (hfq) gene, complete cds.] [NT:HF-I; RNA-binding protein] |
| Contig147G | 19557802_c1_261 | 2839 | 6965 | 225 | 74 | | | NO-HIT |
| Contig147G | 19625667_f1_2 | 2840 | 6966 | 246 | 81 | | | NO-HIT |
| Contig147G | 19723825_c1_288 | 2841 | 6967 | 642 | 213 | 370 | 4.50E−34 | sp:[LN:ATKC_MYCTU] [AC:P96369] [GN:KDPC:MTCY10G2.18C] [OR:*MYCOBACTERIUM TUBERCULOSIS*] [EC:3.6.1.36] [DE:PHOSPHOHYDROLASE [POTASSIUM-TRANSPORTING] C CHAIN)] [SP:P96369] |
| Contig147G | 1991263_f1_77 | 2842 | 6968 | 1509 | 502 | 1790 | 1.50E−184 | sp:[LN:PROP_ECOLI] [AC:P30848] [GN:PROP] [OR:*ESCHERICHIA COLI*] [DE:PROLINE/BETAINE TRANSPORTER (PROLINE PORTER II) (PPII)] [SP:P30848] |
| Contig147G | 19970216_c3_460 | 2843 | 6969 | 609 | 202 | 127 | 4.60E−07 | gp:[GI:ef312906:g3355680] [LN:SC1C2] [AC:AL031124] [PN:putative transcriptional regulator] [GN:SC1C2.13] [OR:*Streptomyces coelicolor*] [DE:*Streptomyces coelicolor* cosmid 1C2.] [NT:SC1C2.13, probable transcriptional regulator, len:] |
| Contig147G | 20312875_c2_330 | 2844 | 6970 | 186 | 61 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig147G | 20423817_c3_453 | 2845 | 6971 | 1731 | 576 | 486 | 1.90E−66 | gp:[GI:g558414] [LN:SC9745] [AC:Z38114:Z71257] [GN:PIF1] [OR:*Saccharomyces cerevisiae*] [SR:baker's yeast] [DE:*S.cerevisiae* chromosome XIII cosmid 9745.] [NT:len: 750, CAI: 0.14, incomplete ORF, PIF_YEAST] [SP:P07271] [RE: |
| Contig147G | 20504687_c3_420 | 2846 | 6972 | 198 | 65 | | | NO-HIT |
| Contig147G | 20517562_c2_379 | 2847 | 6973 | 1218 | 405 | 371 | 3.50E−34 | sp:[LN:YTH3_RHOSO] [AC:P46372] [OR:RHODOCOCCUS SP] [DE:HYPOTHETICAL 47.3 KD PROTEIN IN THCA 5'REGION (ORF3)] [SP:P46372] |
| Contig147G | 20895252_f1_3 | 2848 | 6974 | 216 | 71 | | | NO-HIT |
| Contig147G | 2110001_f3_173 | 2849 | 6975 | 861 | 286 | 436 | 4.60E−41 | sp:[LN:THIM_ECOLI] [AC:P76423] [GN:THIM] [OR:*ESCHERICHIA COLI*] [EC.2.7.1.50] [DE:HYDROXYETHYLTHIAZO LE KINASE) (THZ KINASE) (TH KINASE)] [SP:P76423] |
| Contig147G | 212503_c3_462 | 2850 | 6976 | 1239 | 412 | 825 | 2.80E−82 | sp:[LN:YBDG_ECOLI] [AC:P39455:P77602] [GN:YBDG] [OR:*ESCHERICHIA COLI*] [DE:HYPOTHETICAL 46.6 KD PROTEIN IN PHEP-NFNB INTERGENIC REGION] [SP:P39455:P77602] |
| Contig147G | 212767_f1_22 | 2851 | 6977 | 657 | 218 | 494 | 3.30E−47 | sp:[LN:NFNB_SALTY] [AC:P15888] [GN:NFNB:NFSI] [OR:*SALMONELLA TYPHIMURIUM*] [EC:1.—.—.—] [DE:OXYGEN-INSENSITIVE NAD(P)H NITROREDUCTASE,] [SP:P15888] |
| Contig147G | 212802_c3_402 | 2852 | 6978 | 1302 | 433 | 1516 | 1.60E−155 | sp:[LN:DCTA_RHIME] [AC:P20672] [GN:DCTA] [OR:*RHIZOBIUM MELILOTI*] [DE:C4-DICARBOXYLATE TRANSPORT PROTEIN] [SP:P20672] |
| Contig147G | 21515691_f3_163 | 2853 | 6979 | 669 | 222 | 606 | 4.40E−59 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |
| Contig147G | 2157962_f3_217 | 2854 | 6980 | 1014 | 337 | 345 | 2.00E−31 | sp:[LN:SSUA_ECOLI] [AC:P75853] [GN:SSUA] [OR:*ESCHERICHIA COLI*] [DE:PUTATIVE ALIPHATIC SULFONATES BINDING PROTEIN PRECURSOR] [SP:P75853] |
| Contig147G | 21663380_f1_15 | 2855 | 6981 | 1254 | 417 | 1139 | 1.50E−115 | gp:[GI:d1039248:g4519177] [LN:AB023641] [AC:AB023641] [PN:alcohol dehydrogenase] [GN:r-adh] [OR:*Rhodospirillum rubrum*] [SR:*Rhodospirillum rubrum* DNA] [DE:*Rhodospirillum rubrum* hd-ald gene for alcohol dehydrogenase,complete cds.] [NT:r-ADH] |
| Contig147G | 22134625_f1_199 | 2856 | 6982 | 639 | 212 | 166 | 1.90E−12 | sp:[LN:COQ7_CAEEL] [AC:P48376] [GN:CLK-1:ZC395.2] [OR:*CAENORHABDITIS ELEGANS*] [DE:*UBIQUINONE* BIOSYNTHESIS PROTEIN COQ7 HOMOLOG (CLK-1 PROTEIN)] [SP:P48376] |

TABLE 2-continued

| Query | Orf | NT ID | AA ID | NT Lgth | AA Lgth | Score | P-value | Subject |
|---|---|---|---|---|---|---|---|---|
| Contig147G | 22441876_c2_371 | 2857 | 6983 | 1998 | 665 | 588 | 1.70E−88 | pir:[LN:F71650] [AC:F71650] [PN:DNA mismatch repair protein mutl (mutL) RP880] [GN:mutL:RP880] [OR:*Rickettsia prowazckii*] |
| Contig147G | 22454437_f1_28 | 2858 | 6984 | 474 | 157 | 251 | 1.80E−21 | pir:[LN:D69831] [AC:D69831] [PN:conserved hypotbetical protein yhfO] [GN:yhfO] [OR:*Bacillus subtilis*] |
| Contig147G | 22710760_c3_438 | 2859 | 6985 | 2661 | 886 | 1223 | 1.80E−124 | sp:[LN:KDPD_ECOLI] [AC:P21865] [GN:KDPD] [OR:*ESCHERICHIA COLI*] [EC:2.7.3.—] [DE:SENSOR PROTEIN KDPD,] [SP:P21865] |
| Contig147G | 22839765_c1_294 | 2860 | 6986 | 390 | 129 | | | NO-HIT |
| Contig147G | 22850008_c1_300 | 2861 | 6987 | 531 | 176 | 343 | 3.30E−31 | sp:[LN:YJEE_ECOLI] [AC:P31805] [GN:YJEE] [OR:*ESCHERICHIA COLI*] [DE:(URF2)] [SP:P31805] |
| Contig147G | 23437887_c2_341 | 2862 | 6988 | 237 | 78 | | | NO-HIT |
| Contig147G | 23441967_c2_362 | 2863 | 6989 | 777 | 258 | 486 | 2.30E−46 | sp:[LN:KDPE_ECOLI] [AC:P21866:P75739:P76822] [GN:KDPE] [OR:*ESCHERICHIA COLI*] [DE:KDP OPERON TRANSCRIPTIONAL REGULATORY PROTEIN KDPE] [SP:P21866:P75739:P76822] |
| Contig147G | 23558442_f1_61 | 2864 | 6990 | 636 | 211 | 631 | 9.90E−62 | sp:[LN:CYOC_ECOLI] [AC:P18402] [GN:CYOC] [OR:*ESCHERICHIA COLI*] [EC:1.10.3.—] [DE:CYTOCHROME O UBIQUINOL OXIDASE SUBUNIT III,] [SP:P18402] |
| Contig147G | 23598750_c2_345 | 2865 | 6991 | 1926 | 641 | 2373 | 2.50E−246 | sp:[LN:GIDA_PSEPU] [AC:P25756] [GN:GIDA] [OR:*PSEUDOMONAS PUTIDA*] [DE:GLUCOSE INHIBITED DIVISION PROTEIN A] [SP:P25756] |
| Contig147G | 23620135_f1_8 | 2866 | 6992 | 546 | 181 | 315 | 3.00E−28 | gp[GI:d1021388:g2217944] [LN:D89015] [AC:D89015] [PN:Lrp-family transcriptional regulators] [GN:mdeR] [OR:*Pseudomonas putida*] [SR:*Pseudomonas putida* (strain:ICR3460) DNA] [DE:*Pseudomonas putida* genes for MdeR,MdeA and MdeB,complete cds.] [NT:an essential positive regulator allowing the] |
| Contig147G | 23632762_c3_463 | 2867 | 6993 | 246 | 81 | | | NO-HIT |
| Contig147G | 23651375_f3_241 | 2868 | 6994 | 747 | 248 | 485 | 2.90E−46 | sp:[LN:GLO2_SYNY3] [AC:P72933] [GN:GLOB:SLL1019] [OR:SYNECHOCYSTIS SP] [SR:PCC 6803,] [EC:3.1.2.6] [DE:II)(GLX II)] [SP:P72933] |
| Contig147G | 23722938_f3_176 | 2869 | 6995 | 240 | 79 | | | NO-HIT |
| Contig147G | 238817_c3_393 | 2870 | 6996 | 858 | 285 | 108 | 0.001 | sp:[LN:YEHC_ECOLI] [AC:P33342] [GN:YEHC] [OR:*ESCHERICHIA COLI*] [DE:PRECURSOR] [SP:P33342] |
| Contig147G | 2396880_f2_92 | 2871 | 6997 | 1545 | 514 | 1915 | 8.60E−198 | sp:[LN:DHA2_ALCEU] [AC:P46368] [GN:ACOD] [OR:*ALCALIGENES EUTROPHUS*] [EC:1.2.1.3] [DE:ACETALDEHYDE DEHYDROGENASE II, (ACDH-II)] [SP:P46368] |
| Contig147G | 24007962_f1_67 | 2872 | 6998 | 243 | 80 | | | NO-HIT |
| Contig147G | 24032751_f1_16 | 2873 | 6999 | 993 | 330 | 436 | 4.60E−41 | pir:[LN:A70590] [AC:A70590] [PN:hypothetical protein Rv2854] [GN:Rv2854] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig147G | 24082285_c1_322 | 2874 | 7000 | 390 | 129 | | | NO-HIT |
| Contig147G | 242163_c3_419 | 2875 | 7001 | 861 | 286 | 653 | 4.60E−64 | gp:[GI:g2772619] [LN:EHU93355] [AC:U93355] [PN:hypothetical 32.1 kDa protein] [GN:ydiA] [OR:*Erwinia herbicola*] [DE:*Erwinia herbicola* phosphenolpyruvate synthase (ppsA) gene, partialcds, and hypothetical 32.1 kDa protein (ydiA) and3-deoxy-D-arabinoheptulosonate 7-phosphate synthase (aroH) genes,complete cds.] [NT:similar to the *E. coli* hypothetical 19.8 kDa] |
| Contig147G | 24220255_c3_395 | 2876 | 7002 | 252 | 83 | | | NO-HIT |
| Contig147G | 24251640_c2_369 | 2877 | 7003 | 264 | 87 | | | NO-HIT |
| Contig147G | 2429637_f3_188 | 2878 | 7004 | 351 | 116 | 86 | 0.00056 | pir:[LN A64088] [AC:A64088] [PN:hypothetical protein HI0710] [OR:*Haemophilus influenzae*] |
| Contig147G | 24406250_c1_295 | 2879 | 7005 | 1224 | 407 | 1406 | 7.50E−144 | sp:[LN:ACO2_ECOLI] [AC:P36683:P36648:Q59382:P75652] [GN:ACNB] [OR:*ESCHERICHIA COLI*] [EC:4.2.1.3] [DE:(ACONITASE 2)] [SP:P36683:P36648:Q59382:P75652] |
| Contig147G | 24415877_c2_384 | 2880 | 7006 | 708 | 235 | 121 | 1.50E−05 | sp:[LN:LPFB_SALTY] [AC:P43661] [GN:LPFB] [OR:*SALMONELLA TYPHIMURIUM*] [DE:CHAPERONE PROTEIN LPFB PRECURSOR] [SP:P43661] |
| Contig147G | 24490628_c1_254 | 2881 | 7007 | 531 | 176 | 103 | 0.00037 | sp:[LN:PRU_MYXXA] [AC:P27755] [GN:PRU] [OR:*MYXOCOCCUS XANTHUS*] [DE:PROTEIN U PRECURSOR] [SP:P27755] |
| Contig147G | 24494152_c2_366 | 2882 | 7008 | 432 | 143 | | | NO-HIT |
| Contig147G | 2458437_f3_220 | 2883 | 7009 | 1122 | 373 | 856 | 1.40E−85 | sp:[LN:YHBW_ECOLI] [AC:P45529] [GN:YHBW] [OR:*ESCHERCHIA COLI*] [DE:HYPOTHETICAL 37.1 KD PROTEIN IN SOHA-MTR INTERGENIC REGION (O335)] [SP:P45529] |
| Contig147G | 24641535_c2_375 | 2884 | 7010 | 942 | 313 | 1002 | 4.80E−101 | sp:[LN:SYQ_HAEIN] [AC:P43831] [GN:GLNS:HI1354] [OR:*HAEMOPHILUS INFLUENZAE*] [EC:6.1.1.18] [DE:(GLNRS)] [SP:P43831] |
| Contig147G | 24642192_c1_285 | 2885 | 7011 | 1305 | 434 | 541 | 3.40E−52 | sp:[LN:Y16S_MYCTU] [AC:P96936] [GN:RV0647C:MTCY20H10.28C] [OR:*MYCOBACTERIUM TUBERCULOSIS*] [DE:HYPOTHETICAL 54.8 KD PROTEIN CY20H10.28C] [SP:P96936] |
| Contig147G | 24802167_c1_284 | 2886 | 7012 | 201 | 66 | | | NO-HIT |
| Contig147G | 24824007_f3_180 | 2887 | 7013 | 831 | 276 | 411 | 2.00E−38 | gp:[GI:g403172] [LN:REREUTPBC] [AC:L24492] [PN:ethanolamine ammonia-lyase small subunit] [GN:eutC] [FN:deamination of ethanolamine] [OR:*Rhodococcus erythropolis*] [EC:4.3.1.7] [DE:*Rhodococcus erythropolis* ORF1, ethanolamine permease (eutP),ethanolamine ammonia-lyase large subunit (eutB), ethanolamineammonia-lyase small subunit (eutC) genes, comptete cds and ORF2gene, partial cds.] [NT:similar to *Salmonella typhimurium* EutC PIR] |

TABLE 2-continued

| Query | Orf | NT ID | AA ID | NT Lgth | AA Lgth | Score | P-value | Subject |
|---|---|---|---|---|---|---|---|---|
| Contig147G | 24865687_c1_328 | 2888 | 7014 | 303 | 100 | | | NO-HIT |
| Contig147G | 24882285_c1_314 | 2889 | 7015 | 183 | 60 | | | NO-HIT |
| Contig147G | 25058_f1_17 | 2890 | 7016 | 1485 | 494 | 1423 | 1.20E−145 | gp:[GI:g403170] [LN:REREUTPBC] [AC:L24492] [PN:ethanolamine permease] [GN:eutP] [OR:*Rhodococcus erythropolis*] [DE:*Rhodococcus erythropolis* ORF1, ethanolamine permease (cutP),ethanolamine ammonia-lyase large subunit (cutB), ethanolamineammonia-lyase small subunit (eutC) genes, comptete cds and ORF2gene, partial cds.] [NT:member of the APC family of transporters; putative] |
| Contig147G | 25430307_c2_332 | 2891 | 7017 | 2538 | 845 | 364 | 6.40E−30 | gp:[GI:g1850972] [LN:ECU84144] [AC:U84144] [PN:putative fimbrial chaperone] [GN:ralD] [OR:*Escherichia coli*] [DE:*Escherichia coli* plasmid pRAP including putative minor fimbrialsubunit (ralC), putative fimbrial chaperones (ralD, ralE), putativeminor fimbrial subunit (ralF) putative major fimbrial subunit(ralG), putative minor fimbrial subunit (ralH) and RalI (ralI)genes, comptete cds.] [NT:RalD] |
| Contig147G | 25476657_f3_235 | 2892 | 7018 | 1092 | 363 | | | NO-HIT |
| Contig147G | 25547803_f1_74 | 2893 | 7019 | 549 | 182 | 162 | 5.00E−12 | pir:[LN:D70063] [AC:D70063] [PN:hypothetical protein ywnA] [GN:ywnA] [OR:*Bacillus subtilis*] |
| Contig147G | 25587776_f2_145 | 2894 | 7020 | 846 | 281 | | | NO-HIT |
| Contig147G | 25665885_f3_218 | 2895 | 7021 | 843 | 280 | 570 | 2.90E−55 | sp:[LN:SSUC_BACSU] [AC:P40401] [GN:SSUC] [OR:*BACILLUS SUBTILIS*] [DE:PUTATIVE ALIPHATIC SULFONATES TRANSPORT PERMEASE PROTEIN SSUC] [SP:P40401] |
| Contig147G | 25900391_c3_432 | 2896 | 7022 | 780 | 259 | 435 | 5.80E−41 | sp:[LN:MOEB_ECOLI] [AC:P12282] [GN:MOEB:CHLN] [OR:*ESCHERICHIA COLI*] [DE:MOLYBDOPTERIN BIOSYNTHESIS MOEB PROTEIN) [SP:P12282] |
| Contig147G | 26564511_f3_228 | 2897 | 7023 | 381 | 126 | 347 | 1.20E−31 | gp:[GI:g1773113] [LN:ECU82664] [AC:U82664] [PN:cytochrome o ubiquinol oxidase C subunit] [GN:cyoD] [OR:*Escherichia coli*] [DE:*Escherichia coli* minutes 9 to 11 genomic sequence.] |
| Contig147G | 272187_c2_364 | 2898 | 7024 | 2742 | 913 | 345 | 2.60E−62 | sp:[LN:YTFM_ECOLI] [AC:P39320] [GN:YTFM] [OR:*ESCHERICHIA COLI*] [DE:(O577)] [SP:P39320] |
| Contig147G | 29297662_f2_137 | 2899 | 7025 | 1485 | 494 | 1186 | 1.50E−120 | sp:[LN:DNAB_ECOLI] [AC:P03005] [GN:DNAB:GROP:GRPA] [OR:*ESCHERICHIA COLI*] [EC:3.6.1.—] [DE:REPLICATIVE DNA HELICASE,] [SP:P03005] |
| Contig147G | 29406562_f1_194 | 2900 | 7026 | 276 | 91 | | | NO-HIT |
| Contig147G | 29954635_f3_240 | 2901 | 7027 | 1098 | 365 | 799 | 1.60E−79 | pir:[LN:D70020] [AC:D70020] [PN:ABC transporter (ATP-binding protein) homolog yusC] [GN:yusC] [CL:ATP-binding cassette homology] [OR:*Bacillus subtilis*] |

TABLE 2-continued

| Query | Orf | NT ID | AA ID | NT Lgth | AA Lgth | Score | P-value | Subject |
|---|---|---|---|---|---|---|---|---|
| Contig147G | 31757088_f1_239 | 2902 | 7028 | 915 | 304 | 370 | 4.50E−34 | sp:[LN:PLPB_PASHA] [AC:Q08869:Q07364] [GN:PLPB] [OR:*PASTEURELLA HAEMOLYTICA*] [DE:OUTER MEMBRANE LIPOPROTEIN 2 PRECURSOR (PLP2)] [SP:Q08869:Q073641 |
| Contig147G | 32480327_f1_65 | 2903 | 7029 | 1077 | 358 | 642 | 6.80E−63 | sp:[LN:ALR1_ECOLI] [AC:P29743:P78136] [GN:ALR] [OR:*ESCHERICHIA COLI*] [EC:5.1.1.1] [DE:ALANINE RACEMASE, BIOSYNTHETIC,] [SP:P29743:P78136] |
| Contig147G | 3259425_c3_412 | 2904 | 7030 | 210 | 69 | | | NO-HIT |
| Contig147G | 33416538_f2_149 | 2905 | 7031 | 228 | 75 | | | NO-HIT |
| Contig147G | 33448517_f2_148 | 2906 | 7032 | 726 | 241 | 462 | 8.10E−44 | sp:[LN:YAEE_ECOLI] [AC:P31547] [GN:YAEE] [OR:*ESCHERICHIA COLI*] [DE:HYPOTHETICAL ABC TRANSPORTER PERMEASE PROTEIN YAEE] [SP:P31547] |
| Contig147G | 33782787_c3_431 | 2907 | 7033 | 1716 | 571 | 768 | 3.00E−76 | sp:[LN:ACSA_BACSU] [AC:P39062] [GN:ACSA] [OR:*BACILLUS SUBTILIS*] [EC:6.2.1.1] [DE:ACTIVATING ENZYME) (ACETYL-COA SYNTHASE)] [SP:P39062] |
| Contig147G | 33834385_c3_433 | 2908 | 7034 | 462 | 153 | 181 | 4.80E−14 | sp:[LN:FOLB_ECOLI] [AC:P31055:P76659] [GN:FOLB] [OR:*ESCHERICHIA COLI*] [EC:4.1.2.25] [DE:PROBABLE DIHYDRONEOPTERIN ALDOLASE, (DHNA)] [SP:P31055:P76659] |
| Contig147G | 33881927_c3_428 | 2909 | 7035 | 864 | 287 | 514 | 2.50E−49 | sp:[LN:HEMK_ECOLI] [AC:P37186:Q46754] [GN:HEMK] [OR:*ESCHERICHIA COLI*] [DE:HEMK PROTEIN] [SP:P37186:Q46754] |
| Contig147G | 34176910_f1_60 | 2910 | 7036 | 2403 | 800 | 2805 | 4.20E−292 | sp:[LN:PPSA_ECOLI] [AC:P23538] [GN:PPSA:PPS] [OR:*ESCHERICHIA COLI*] [EC:2.7.9.2] [DE:(PEP SYNTHASE)] [SP:P23538] |
| Contig147G | 34195763_c3_443 | 2911 | 7037 | 807 | 268 | | | NO-HIT |
| Contig147G | 34647092_c3_437 | 2912 | 7038 | 2055 | 684 | 1836 | 2.00E−189 | gp:[GI:g2772548] [LN:ECOKDPABC] [AC:K02670] [GN:kdpB] [OR:*Escherichia coli*] [DE:*Escherichia coli* kdpABC operon coding for Kdp-ATPase proteinsKdpA,-B,-C.] |
| Contig147G | 35156901_c2_334 | 2913 | 7039 | 204 | 67 | | | NO-HIT |
| Contig147G | 35355425_f3_226 | 2914 | 7040 | 1086 | 361 | 693 | 2.70E−68 | sp:[LN:CYOA_ECOLI] [AC:P18400] [GN:CYOA] [OR:*ESCHERICHIA COLI*] [EC:1.10.3.—] [DE:OXIDASE SUBUNIT 2)] [SP:P18400] |
| Contig147G | 35361312_c2_391 | 2915 | 7041 | 648 | 215 | | | NO-HIT |
| Contig147G | 35580012_c2_359 | 2916 | 7042 | 843 | 280 | 649 | 1.20E−63 | pir:[LN:A70554] [AC:A70554] [PN:probable dehydrogenase] [GN:Rv1144] [OR:*Mycobacterium tuberculosis*] |
| Contig147G | 36537813_f1_69 | 2917 | 7043 | 1335 | 444 | 1407 | 5.80E−144 | sp:[LN:PUR2_HAEIN] [AC:P43845] [GN:PURD:HI0888] [OR:*HAEMOPHILUS INFLUENZAE*] [EC:6.3.4.13] [DE:RIBONUCLEOTIDE SYNTHETASE) (PHOSPHORIBOSYLGLYCINA MIDE SYNTHETASE)] [SP:P43845] |
| Contig147G | 3885_f1_24 | 2918 | 7044 | 204 | 67 | | | NO-HIT |
| Contig147G | 3907161_f3_187 | 2919 | 7045 | 918 | 305 | 435 | 5.80E−41 | pir:[LN:F70533] [AC:F70533] [PN:probable deaminase] [GN:Rv3300c] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig147G | 3907503_c1_293 | 2920 | 7046 | 4515 | 1504 | 818 | 4.70E−84 | sp:[LN:YTFN_HAEIN] [AC:Q57523] [GN:H10696] [OR:*HAEMOPHILUS INFLUENZAE*] [DE:HYPOTHETICAL PROTEIN HI0696] [SP:Q57523] |
| Contig147G | 3907503_c2_339 | 2921 | 7047 | 462 | 153 | | | NO-HIT |
| Contig147G | 4022142_c1_257 | 2922 | 7048 | 627 | 208 | 211 | 5.30E−17 | pir:[LN:A57146] [AC:A57146:S52911] [PN:paraquat-inducible protein pqi5A] [GN:pqi5A] [OR:*Eschcrichia coli*] |
| Contig147G | 4026465_c2_335 | 2923 | 7049 | 774 | 257 | 124 | 2.50E−06 | gp:[GI:d1036696:g4062520] [LN:D90733] [AC:D90733:AB001340] [OR:*Escherichia coli*] [SR:*Escherichia coli*(strain:K12) DNA, clone:Kohara clone #222] [DE:*Escherichia coli* genomic DNA. (21.7 – 22.1 min).] [NT:ORF_ID:o222#5] |
| Contig147G | 4063588_c2_385 | 2924 | 7050 | 1044 | 347 | 150 | 2.70E−07 | pir:[LN:S76350] [AC:S76350] [PN:hypothetical protein] [OR:Synechocystis sp.] [SR:PCC 6803,, PCC 6803] [SR:PCC 6803,] |
| Contig147G | 40635_f3_237 | 2925 | 7051 | 294 | 97 | 233 | 1.50E−19 | sp:[LN:FIS_HAEIN] [AC:P44966] [GN:FIS:HI0980] [OR:*HAEMOPHILUS INFLUENZAE*] [DE:BINDING PROTEIN) (FIS PROTEIN)] [SP:P44966] |
| Contig147G | 4079088_c1_321 | 2926 | 7052 | 693 | 230 | 111 | 0.00028 | gp:[GI:g3133009] [LN:CELR119] [AC:AF063007] [GN:R119.3] [OR:*Caenorhabditis elegans*] [DE:*Caenorhabditis elegans* cosmid R119.] [NT:similar to the short-chain deydrogenases/reductases] |
| Contig147G | 4100077_c3_458 | 2927 | 7053 | 558 | 185 | 299 | 1.50E−26 | sp:[LN:CHMU_ERWHE] [AC:P42517] [GN:AROQ] [OR:*ERWINIA HERBICOLA*] [EC:5.4.99.5] [DE:MONOFUNCTIONAL CHORISMATE MUTASE PRECURSOR, (CM-F)] [SP:P42517] |
| Contig147G | 4100276_f2_83 | 2928 | 7054 | 537 | 178 | | | NO-HIT |
| Contig147G | 4103378_c3_392 | 2929 | 7055 | 546 | 181 | 114 | 1.10E−05 | sp:[LN:PRU_MYXXA] [AC:P27755] [GN:PRU] [OR:*MYXOCOCCUS XANTHUS*] [DE:PROTEIN U PRECURSOR] [SP:P27755] |
| Contig147G | 4119038_f3_227 | 2930 | 7056 | 1995 | 664 | 2455 | 5.20E−255 | sp:[LN:CYOB_ECOLI] [AC:P18401][GN:CYOB [OR:*ESCHERICHIA COLI*] [EC:1.10.3.—] [DE:SUBUNIT 1)] [SP:P18401] |
| Contig147G | 4119452_c3_457 | 2931 | 7057 | 687 | 228 | 206 | 1.10E−16 | pir:[LN:S76871] [AC:S76871] [PN:hypothetical protein] [OR:Synechocystis sp.] [SR:PCC 6803,, PCC 6803] [SR:PCC 6803,] |
| Contig147G | 4140902_f1_19 | 2932 | 7058 | 732 | 243 | 346 | 1.60E−31 | pir:[LN:D69409] [AC:D69409] [PN:conserved hypothetical protein AF1277] [OR:*Archaeoglobus fulgidus*] |
| Contig147G | 41603591_c1_253 | 2933 | 7059 | 576 | 191 | 584 | 9.50E−57 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |

TABLE 2-continued

| Query | Orf | NT ID | AA ID | NT Lgth | AA Lgth | Score | P-value | Subject |
|---|---|---|---|---|---|---|---|---|
| Contig147G | 4195143_c1_296 | 2934 | 7060 | 1443 | 480 | 1972 | 7.80E−204 | sp:[LN:ACO2__ECOLI] [AC:P36683:P36648:Q59382:P75652] [GN:ACNB] [OR:*ESCHERICHIA COLI*] [EC:4.2.1.3] [DE:(ACONITASE 2)] [SP:P36683:P36648:Q59382:P75652] |
| Contig147G | 4301515_c1_259 | 2935 | 7061 | 927 | 308 | 401 | 2.30E−37 | gp:[GI:d1039057:g4512354] [LN:AB011836] [AC:AB011836] [PN:alkyl hydroperoxide reductase large subunit] [GN:ahpF] [FN:NADH dehydrogenase] [OR:*Bacillus halodurans*] [SR:*Bacillus halodurans* (strain:C-125, isolate:xylanase producer) DNA] [EC:1.6.99.3] [DE:*Bacillus halodurans* C-125 genomic DNA, clone ALBAC003.] [NT:similar to *B.subtilis* ahpF gene(25%-identity)] |
| Contig147G | 4334662_c1_326 | 2936 | 7062 | 198 | 65 | | | NO-HIT |
| Contig147G | 4343778_f3_216 | 2937 | 7063 | 1038 | 345 | 259 | 2.60E−22 | gp:[GI:d1037181:g4062962] [LN:AB014757] [AC:AB014757] [PN:PhbR] [GN:phbR] [OR:Pseudomonas sp. 61-3] [SR:Pseudomonas sp. 61-3 (strain:61-3) DNA] [DE:Pseudomonas sp. 61-3 genes for PhbR, acetoacetyl-CoA reductase,beta-ketothiolase and PHB synthase, complete cds.] |
| Contig147G | 4381512_c3_427 | 2938 | 7064 | 894 | 297 | 169 | 5.60E−11 | gp:[GI:e1251089:g2894296] [LN:SPBC947] [AC:AL021837] [PN:hypothetical protein] [GN:SPBC947.09] [OR:*Schizosaccharomyces pombe*] [SR:fission yeast] [DE:*S.pombe* chromosome II cosmid c947.] [NT:SPBC947.09, unknown, len:26, similar eg. to S.] |
| Contig147G | 440688_c1_286 | 2939 | 7065 | 447 | 148 | | | NO-HIT |
| Contig147G | 4429028_c3_398 | 2940 | 7066 | 816 | 271 | 387 | 7.10E−36 | sp:[LN:PQIA__ECOLI] [AC:P43670:P77566] [GN:PQIA:PQI5A] [OR:*ESCHERICHIA COLI*] [DE:PARAQUAT-INDUCIBLE PROTEIN A] [SP:P43670:P77566] |
| Contig147G | 4459833_c3_396 | 2941 | 7067 | 564 | 187 | 105 | 7.20E−06 | gp:[GI:g1079814] [LN:S79230] [AC:S79230] [PN:BM1P1] [GN:CYP106] [OR:*Bacillus megaterium*] [DE:CYP106=BM1P2 orf...CYP106=P450BM-1 orf {regulatory regions}[*Bacillus megaterium*, mRNA Partial, 3 genes, 1400 nt].] [NT:positive transcription factor involved in] |
| Contig147G | 4472125_f1_51 | 2942 | 7068 | 654 | 217 | 162 | 3.00E−11 | gp:[GI:e1288066:g3087870] [LN:PM413CIRC] [AC:AJ001525] [PN:circumsporozoite] [OR:*Plasmodium malariae*] [DE:*Plasmodium malariae* circumsporozoite gene, isolate 413/Cameroon.] |
| Contig147G | 4478167_f3_198 | 2943 | 7069 | 1332 | 443 | 751 | 7.60E−74 | pir:[LN:E71667] [AC:E71667] [PN:2-acylglycerophosphoethanolamine acyltransferase s) RP620] [GNs:RP620] [OR:*Rickettsia prowazekii*] |

TABLE 2-continued

| Query | Orf | NT ID | AA ID | NT Lgth | AA Lgth | Score | P-value | Subject |
|---|---|---|---|---|---|---|---|---|
| Contig147G | 4687950_f2_146 | 2944 | 7070 | 1617 | 538 | 1877 | 9.10E−194 | sp:[LN:PUR9_ECOLI] [AC:P15639] [GN:PURH] [OR:ESCHERICHIA COLI] [EC:2.1.2.3:3.5.4.10] [DE:(INOSINICASE) (IMP SYNTHETASE) (ATIC)] [SP:P15639] |
| Contig147G | 485667_f3_211 | 2945 | 7071 | 612 | 203 | 379 | 5.00E−35 | sp:[LN:YDDH_ECOLI] [AC:P76121] [GN:YDDH] [OR:ESCHERICHIA COLI] [DE:HYPOTHETICAL 22.8 KD PROTEIN IN TEHB-ANSP INTERGENIC REGION] [SP:P76121] |
| Contig147G | 4884652_f3_168 | 2946 | 7072 | 507 | 168 | 146 | 2.50E−10 | gp:[GI:g662919] [LN:EHCOPAYZ] [AC:Z46807] [GN:ORF U] [OR:Enterococcus hirae] [DE:E.hirae copA, copY and copZ genes.] |
| Contig147G | 4890875_c1_302 | 2947 | 7073 | 240 | 79 | | | NO-HIT |
| Contig147G | 5101505_f1_62 | 2948 | 7074 | 894 | 297 | 784 | 6.10E−78 | gp:[GI:g1773112] [LN:ECU82664] [AC:U82664] [PN:cytochrome o ubiquinol oxidase C subunit] [GN:cyoE] [OR:Escherichia coli] [DE:Escherichia coli minutes 9 to 11 genomic sequence.] |
| Contig147G | 5111303_f1_78 | 2949 | 7075 | 243 | 80 | | | NO-HIT |
| Contig147G | 5272193_c1_317 | 2950 | 7076 | 2616 | 871 | 1578 | 4.40E−162 | sp:[LN:AMPN_ECOLI] [AC:P04825] [GN:PEPN] [OR:ESCHERICHIA COLI] [EC:3.4.11.2] [DE:AMINOPEPTIDASE N, (ALPHA-AMINOACYLPEPTIDE HYDROLASE)] [SP:P04825] |
| Contig147G | 5321076_f1_49 | 2951 | 7077 | 927 | 308 | 360 | 5.20E−33 | pir:[LN:S47741] [AC:S47741:D65150] [PN:hypothetical transcription regulator treF-kdgK intergenic region:hypothetical protein o323] [GN:yhjC] [OR:Escherichia coli] |
| Contig147G | 548782_c1_255 | 2952 | 7078 | 1050 | 349 | | | NO-HIT |
| Contig147G | 581450_c1_320 | 2953 | 7079 | 870 | 289 | 184 | 2.70E−14 | sp:[LN:FAG1_SYNY3] [AC:P73574] [GN:FABG1:SLR0886] [OR:SYNECHOCYSTIS SP] [SR:PCC 6803,] [EC:1.1.1.100] [DE:KETOACYL- ACYL CARRIER PROTEIN REDUCTASE 1)] [SP:P73574] |
| Contig147G | 6047213_f3_183 | 2954 | 7080 | 522 | 173 | 535 | 1.50E−51 | sp:[LN:CYPB_ECOLI] [AC:P23869:P78052] [GN:PPIB] [OR:ESCHERICHIA COLI] [EC:5.2.1.8] [DE:(ROTAMASE B)] [SP:P23869:P78052] |
| Contig147G | 6073387_c2_360 | 2955 | 7081 | 1152 | 383 | 908 | 4.40E−91 | sp:[LN:ACDB_BACSU] [AC:P45857] [GN:MMGC] [OR:BACILLUS SUBTILIS] [EC:1.3.99.—] [DE:ACYL-COA DEHYDROGENASE,] [SP:P45857] |
| Contig147G | 6250153_f1_68 | 2956 | 7082 | 915 | 304 | 683 | 3.10E−67 | sp:[LN:PRMA_HAEIN] [AC:P44402] [GN:PRMA:HI0978] [OR:HAEMOPHILUS INFLUENZAE] [EC:2.1.1.—] [DE:RIBOSOMAL PROTEIN L11 METHYLTRANSFERASE,] [SP:P44402] |
| Contig147G | 6250_c1_291 | 2957 | 7083 | 573 | 190 | | | NO-HIT |
| Contig147G | 6462880_f3_230 | 2958 | 7084 | 450 | 149 | 474 | 4.30E−45 | sp:[LN:RL9_ECOLI] [AC:P02418] [GN:RPL1] [OR:ESCHERICHIA COLI] [DE:50S RIBOSOMAL PROTEIN L9] [SP:P02418] |

TABLE 2-continued

| Query | Orf | NT ID | AA ID | NT Lgth | AA Lgth | Score | P-value | Subject |
|---|---|---|---|---|---|---|---|---|
| Contig147G | 664192_c3_444 | 2959 | 7085 | 717 | 238 | 370 | 4.50E−34 | sp:[LN:RSUA_ECOLI] [AC:P33918] [GN:RSUA] [OR:*ESCHERICHIA COLI*] [EC:4.2.1.70] [DE:HYDROLYASE)] [SP:P33918] |
| Contig147G | 6773388_f3_184 | 2960 | 7086 | 729 | 242 | 455 | 4.40E−43 | sp:[LN:YBBF_HAEIN] [AC:P44046] [GN:HI0735] [OR:*HAEMOPHILUS INFLUENZAE*] [DE:HYPOTHETICAL PROTEIN HI0735] [SP:P44046] |
| Contig147G | 6828937_f1_172 | 2961 | 7087 | 1290 | 429 | | | NO-HIT |
| Contig147G | 6835452_c2_340 | 2962 | 7088 | 567 | 188 | 120 | 4.20E−06 | gp:[GI:e1245750:g2808779] [LN:SC7H1] [AC:AL021411] [PN:putative transcriptional regulator] [GN:SC7H1.21] [OR:*Streptomyces coelicolor*] [DE:*Streptomyces coelicolor* cosmid 7H1.] [NT:SC7H1.21, probable transcriptional regulator, len:] |
| Contig147G | 6836093_c1_279 | 2963 | 7089 | 1260 | 419 | 1210 | 4.40E−123 | gp:[GI:g1185391] [LN:YPU22837] [AC:U22837] [PN:HmsR] [GN:hmsR] [FN:involved the regulation of the hms locus hemin] [OR:*Yersinia pestis*] [DE:*Yersinia pestis* HmsH (hmsH), HmsF (hmsF), HmsR (hmsR), and HmsS(hmsS) genes, complete cds.] [NT:possible integral inner membrane protein; 52 kDa,] |
| Contig147G | 7125387_f1_31 | 2964 | 7090 | 186 | 61 | | | NO-HIT |
| Contig147G | 7226515_c2_383 | 2965 | 7091 | 549 | 182 | 192 | 3.30E−15 | sp:[LN:PRU_MYXXA] [AC:P27755] [GN:PRU] [OR:*MYXOCOCCUS XANTHUS*] [DE:PROTEIN U PRECURSOR] [SP:P27755] |
| Contig147G | 782628_f2_153 | 2966 | 7092 | 927 | 308 | 712 | 2.60E−70 | pir:[LN:D64900] [AC:D64900] [PN:membrane protein yddG] [GN:yddG] [OR:*Escherichia coli*] |
| Contig147G | 817812_c2_374 | 2967 | 7093 | 927 | 308 | 493 | 4.20E−47 | sp:[LN:YD76_HAEIN] [AC:P44170] [GN:HI1376] [OR:*HAEMOPHILUS INFLUENZAE*] [DE:HYPOTHETICAL PROTEIN HI1376] [SP:P44170] |
| Contig147G | 829377_c2_367 | 2968 | 7094 | 945 | 314 | 570 | 2.90E−55 | sp:[LN:METR_HAEIN] [AC:P45349] [GN:METR:HI1739] [OR:*HAEMOPHILUS INFLUENZAE*] [DE:TRANSCRIPTIONAL ACTIVATOR PROTEIN METR] [SP:P45349] |
| Contig147G | 867175_f3_166 | 2969 | 7095 | 2328 | 775 | 1264 | 6.30E−166 | gp:[GI:e238716:g1296432] [LN:AEALEBCYM] [AC:X97499] [PN:ferric alcaligin E] [GN:aleB] [OR:*Ralstonia eutropha*] [DE:*A.eutrophus* aleB and cysM genes.] |
| Contig147G | 882127_c3_449 | 2970 | 7096 | 864 | 287 | 757 | 4.40E−75 | sp:[LN:SYQ_HAEIN] [AC:P43831] [GN:GLNS:HI1354] [OR:*HAEMOPHILUS INFLUENZAE*] [EC:6.1.1.18] [DE:(GLNRS)] [SP:P43831] |
| Contig147G | 959676_c1_298 | 2971 | 7097 | 1080 | 359 | 282 | 8.10E−27 | gp:[GI:g1546837] [LN:CFU69963] [AC:U69963] [PN:delayed rectifier potassium channel protein] [OR:*Canis familiaris*] [DE:*Canis familiaris* delayed rectifier potassium channel protein mRNA,complete cds.] |

TABLE 2-continued

| Query | Orf | NT ID | AA ID | NT Lgth | AA Lgth | Score | P-value | Subject |
|---|---|---|---|---|---|---|---|---|
| Contig147G | 970061_c3_397 | 2972 | 7098 | 915 | 304 | 407 | 5.40E−38 | sp:[LN:YXXF_BACSU] [AC:Q07835] [GN:YXXF:N17F] [OR:*BACILLUS SUBTILIS*] [DE:HYPOTHETICAL 34.3 KD PROTEIN IN BGLH-WAPA INTERGENIC REGION (ORF1)] [SP:Q07835] |
| Contig147G | 9772937_c3_421 | 2973 | 7099 | 1170 | 389 | 367 | 8.70E−33 | sp:[LN:YCDS_ECOLI] [AC:P75907] [GN:YCDS] [OR:*ESCHERICHIA COLI*] [DE:HYPOTHETICAL 92.2 KD PROTEIN IN PHOH-CSGG INTERGENIC REGION PRECURSOR] [SP:P75907] |
| Contig147G | 978452_f1_50 | 2974 | 7100 | 426 | 141 | 156 | 1.20E−10 | sp:[LN:CSP_PLABR] [AC:P14593] [OR:*PLASMODIUM BRASILIANUM*] [DE:CIRCUMSPOROZOITE PROTEIN (CS) (FRAGMENT)] [SP:P14593] |
| Contig147G | 9890776_f2_136 | 2975 | 7101 | 435 | 144 | 425 | 6.70E−40 | sp:[LN:RS6_ECOLI] [AC:P02358] [GN:RPSF] [OR:*ESCHERICHIA COLI*] [DE:30S RIBOSOMAL PROTEIN S6] [SP:P02358) |
| Contig147G | 992762_f2_135 | 2976 | 7102 | 774 | 257 | 101 | 1.40E−07 | pir:[LN:B69767] [AC:B69767] [PN:conserved hypothetical protein yczC] [GN:yczC] [OR:*Bacillus subtilis*] |
| Contig148G | 10675427_f1_5 | 2977 | 7103 | 219 | 72 | | | NO-HIT |
| Contig148G | 1460875_c1_9 | 2978 | 7104 | 372 | 124 | 233 | 1.50E−19 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |
| Contig148G | 1460875_f1_7 | 2979 | 7105 | 476 | 159 | 240 | 2.70E−20 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |
| Contig148G | 24223167_c1_8 | 2980 | 7106 | 2172 | 723 | 1350 | 6.40E−138 | sp:[LN:FHUE_ECOLI] [AC:P16869:P77292] [GN:FHUE] [OR:*ESCHERICHIA COLI*] [DE:AND FE(III)-RHODOTRULIC ACID PRECURSOR] [SP:P16869:P77292] |
| Contig148G | 24258513_c3_14 | 2981 | 7107 | 1044 | 347 | | | NO-HIT |
| Contig148G | 35968802_c2_10 | 2982 | 7108 | 435 | 144 | 94 | 8.00E−05 | gp:[GI:g3193063] [LN:AF064329] [AC:AF064329] [PN:envelope glycoprotein] [GN:env] [OR:Human immunodeficiency virus type 2] [DE:HIV-2 isolate 287 clone 19, from macaque 096 18 weekspostinoculation, from the USA, envelope glycoprotein V1–V2 region(env) gene, partial cds.] T:V1–V2 region] [RE: |
| Contig148G | 5335938_f1_4 | 2983 | 7109 | 528 | 175 | 213 | 2.00E−17 | sp:[LN:YHBS_ECOLI] [AC:P45473] [GN:YHBS] [OR:*ESCHERICHIA COLI*] [DE:HYPOTHETICAL 18.5 KD PROTEIN IN SOHA-MTR INTERGENIC REGION (F167)] [SP:P45473] |
| Contig149G | 10813552_f1_8 | 2984 | 7110 | 219 | 72 | | | NO-HIT |
| Contig149G | 11902187_c3_59 | 2985 | 7111 | 216 | 71 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig149G | 13681383_f1_3 | 2986 | 7112 | 819 | 272 | 127 | 9.10E−07 | sp:[LN:YAIS_ECOLI] [AC:P71311:P75699] [GN:YAIS] [OR:*ESCHERICHIA COLI*] [DE:HYPOTHETICAL 20.5 KD PROTEIN IN ADHC-TAUA INTERGENIC REGION] [SP:P71311:P75699] |
| Contig149G | 1460875_f3_26 | 2987 | 7113 | 687 | 229 | 358 | 8.40E−33 | gp:[GI:e1329745:g3688518] [LN:PST5663] [AC:AJ005663] [PN:putative transposase] [OR:*Pseudomonas stutzeri*] [DE:*Pseudomonas stutzeri* OX1 gene cluster encoding toluene/o-xylenemonooxygenase (touABCDEF) and putative gene encoding a transposase.] |
| Contig149G | 14959818_f1_2 | 2988 | 7114 | 1581 | 526 | 1359 | 7.10E−139 | pir:[LN:D70825] [AC:D70825] [PN:probable methylmalonate semialdehyde dehydrogenase] [GN:mmsA] [OR:*Mycobacterium tuberculosis*] |
| Contig149G | 21673813_f3_25 | 2989 | 7115 | 1260 | 419 | 1041 | 3.60E−105 | sp:[LN:GLTS_HAEIN] [AC:P45240] [GN:GLTS:HI1530] [OR:*HAEMOPHILUS INFLUENZAE*] [DE:SODIUM/GLUTAMATE SYMPORT CARRIER PROTEIN (GLUTAMATE PERMEASE)] [SP:P45240] |
| Contig149G | 23539077_c1_41 | 2990 | 7116 | 918 | 305 | 182 | 6.60E−14 | gp:[GI:g3650450] [LN:MXU43810] [AC:U43810] [PN:OxyR] [GN:oxyR] [OR:*Mycobacterium xenopi*] [DE:*Mycobacterium xenopi* alkyl hydroperoxide reductase (ahpC) gene,partial cds, and oxidative stress regulator (oxyR) gene, partialcds. genes.] [NT:oxidative stress regulator] [RE: |
| Contig149G | 23634637_f2_15 | 2991 | 7117 | 1401 | 466 | 1245 | 8.60E−127 | sp:[LN:GABP_ECOLI] [AC:P25527] [GN:GABP] [OR:*ESCHERICHIA COLI*] [DE:PERMEASE)] [SP:P25527] |
| Contig149G | 23862530_f1_4 | 2992 | 7118 | 678 | 225 | 129 | 9.60E−06 | pir:[LN:B69218] [AC:B69218] [PN:conserved hypothetical protein MTH884] [GN:MTH884] [OR:*Methanobacterium thermoautotrophicum*] |
| Contig149G | 25660682_c1_28 | 2993 | 7119 | 975 | 324 | 424 | 8.60E−40 | pir:[LN:S76006] [AC:S76006] [PN:hypothetical protein] [OR:Syncchocystis sp.] [SR:PCC 6803,, PCC 6803] [SR:PCC 6803,] |
| Contig149G | 2613437_c3_53 | 2994 | 7120 | 972 | 323 | 253 | 1.10E−21 | pir:[LN:D69749] [AC:D69749] [PN:transcription regulator AraC/XylS family homolog ybfI] [GN:ybfI] [OR:*Bacillus subtilis*] |
| Contig149G | 26204177_f2_18 | 2995 | 7121 | 396 | 131 | 165 | 2.40E−12 | sp:[LN:YGIW_HAEIN] [AC:P44293] [GN:HI1709] [OR:*HAEMOPHILUS INFLUENZAE*] [DE:HYPOTHETICAL PROTEIN HI1709 PRECURSOR] [SP:P44293] |
| Contig149G | 30087707_c2_44 | 2996 | 7122 | 717 | 238 | 194 | 2.00E−15 | sp:[LN:YFIK_ECOLI] [AC:P38101] [GN:YFIK] [OR:*ESCHERICHIA COLI*] [DE:HYPOTHETICAL 21.2 KD PROTEIN IN SRMB-UNG INTERGENIC REGION] [SP:P38101] |
| Contig149G | 3915942_c3_54 | 2997 | 7123 | 330 | 109 | | | NO-HIT |
| Contig149G | 4062561_c2_42 | 2998 | 7124 | 372 | 123 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig149G | 4173513_f1_7 | 2999 | 7125 | 744 | 247 | 287 | 2.80E−25 | gp:[GI:g2961083] [LN:AF033674] [AC:AF033674] [PN:unknown] [OR:*Pseudomonas marginalis* pv. *alfalfae*] [DE:*Pseudomonas marginalis* pv. *alfalfae* strain LMG2214 unknown genes.] [NT:orf1] |
| Contig149G | 4734425_f2_16 | 3000 | 7126 | 1023 | 340 | | | NO-HIT |
| Contig149G | 5350062_c1_33 | 3001 | 7127 | 309 | 102 | | | NO-HIT |
| Contig149G | 7071057_f2_13 | 3002 | 7128 | 1389 | 462 | 1598 | 3.40E−164 | pir:[LN:A42800] [AC:A42800] [PN:beta-alanine--pyruvate transaminase,:omega-amino acid--pyruvate aminotransferase] [CL:beta-alanine--pyruvate transaminase] [OR:*Pseudomonas putida*] [EC:2.6.1.18] |
| Contig149G | 812512_f3_23 | 3003 | 7129 | 495 | 164 | 164 | 3.10E−12 | pir:[LN:S75930] [AC:S75930] [PN:hypothetical protein] [OR:Synechocystis sp.] [SR:PCC 6803,, PCC 6803] [SR:PCC 6803,] |
| Contig149G | 9928128_c2_43 | 3004 | 7130 | 1161 | 386 | 380 | 3.90E−35 | gp:[GI:g4160475] [LN:AF109909] [AC:AF109909] [PN:PHA synthase PhaC] [GN:phaC] [OR:*Bacillus megaterium*] [DE:*Bacillus megaterium* polyhydroxyalkanoate gene cluster, completesequence.] |
| Contig149G | 9937828_f2_17 | 3005 | 7131 | 600 | 199 | 155 | 2.70E−11 | sp:[LN:NODS_RHITR] [AC:Q53514] [GN:NODS] [OR:*RHIZOBIUM TROPICI*] [EC:2.1.1.—] [DE:NODULATION PROTEIN S,] [SP:Q53514] |
| Contig150G | 10047812_f3_62 | 3006 | 7132 | 1116 | 371 | 336 | 1.80E−30 | pir:[LN:F64705] [AC:F64705] [PN:conserved hypothetical integral membrane protein HP1486] [OR:*Helicobacter pylori*] |
| Contig150G | 1047676_f2_30 | 3007 | 7133 | 342 | 113 | | | NO-HIT |
| Contig150G | 10978511_c2_107 | 3008 | 7134 | 693 | 230 | 147 | 1.90E−10 | gp:[GI:g3309205] [LN:AF072735] [AC:AF072735] [PN:ThlR] [GN:thlR] [OR:*Clostridium acetobutylicum*] [DE:*Clostridium acetobutylicum* ThlR (thlR) and thiolase B (thlB) genes,complete cds; ThlC (thlC) gene, partial cds; and unknown gene.] [NT:similar to TetR/AcrR family of transcriptional] |
| Contig150G | 1209500_f1_14 | 3009 | 7135 | 387 | 128 | 100 | 1.80E−05 | pir:[LN:F69892] [AC:F69892] [PN:hypothetical protein yngA] [GN:yngA] [OR:*Bacillus subtilis*] |
| Contig150G | 12298775_f3_63 | 3010 | 7136 | 828 | 275 | 116 | 1.80E−06 | sp:[LN:YDJC_ECOLI] [AC:P37794:P77435] [GN:YDJC] [OR:*ESCHERICHIA COLI*] [DE:HYPOTHETICAL 27.8 KD PROTEIN IN CELF-KATE INTERGENIC REGION] [SP:P37794:P77435] |
| Contig150G | 127052_f3_61 | 3011 | 7137 | 1044 | 347 | | | NO-HIT |
| Contig150G | 12766577_f1_6 | 3012 | 7138 | 984 | 327 | 215 | 1.30E−17 | gp:[GI:e334283:g2330641] [LN:PFY14568] [AC:Y14568] [GN:htrB] [OR:*Pseudomonas fluorescens*] [DE:*Pseudomonas fluorescens* tag gene and partial glyQ, htrB genes.] |
| Contig150G | 12781628_f3_71 | 3013 | 7139 | 438 | 145 | 102 | 4.90E−05 | pir:[LN:I53641] [AC:I53641] [PN:mucin] [GN:MUC5AC] [OR:*Homo sapiens*] [SR:, man] [MP:11p15.5-11p15.5] |
| Contig150G | 14276512_c1_92 | 3014 | 7140 | 1266 | 421 | 1302 | 7.80E−133 | sp:[LN:DCDA_PSEAE] [AC:P19572] [GN:LYSA] [OR:*PSEUDOMONAS AERUGINOSA*] [EC:4.1.1.20] [DE:DIAMINOPIMELATE DECARBOXYLASE, (DAP DECARBOXYLASE)] [SP:P19572] |

TABLE 2-continued

| Query | Orf | NT ID | AA ID | NT Lgth | AA Lgth | Score | P-value | Subject |
|---|---|---|---|---|---|---|---|---|
| Contig150G | 14333577_c1_86 | 3015 | 7141 | 1002 | 333 | 692 | 3.40E−68 | pir:[LN:S56383] [AC:S56383:JS0627:A65226:A04437] [PN:lysine--tRNA ligase, genX:lysyl-tRNA synthetase:protein F-162] [GN:yjeA:genX] [OR:*Escherichia coli*] [EC:6.1.1 6] [MP:94 min] |
| Contig150G | 14660677_c3_147 | 3016 | 7142 | 225 | 74 | | | NO-HIT |
| Contig150G | 15634662_f1_13 | 3017 | 7143 | 1134 | 377 | 280 | 1.60E−24 | gp[GI:g4155989] [LN:AE001560] [AC:AE001560:AE001439] [PN:putative] [GN:jhp1380] [OR:*Helicobacter pylori* J99] [DE:*Helicobacter pylori*, strain J99 section 121 of 132 of the completegenome.] [NT:similar to *H. pylori* 26695 gene HP1487] |
| Contig150G | 16304683_c1_85 | 3018 | 7144 | 840 | 279 | 535 | 1.50E−51 | sp:[LN:FDHD_ECOLI] [AC:P32177] [GN:FDHD] [OR:*ESCHERICHIA COLI*] [DE:FDHD PROTEIN] [SP:P32177] |
| Contig150G | 16594062_f3_79 | 3019 | 7145 | 807 | 268 | 355 | 1.80E−32 | gp:[GI:e1316488:g3449276] [LN:SC6G4] [AC:*AL031317*] [PN:putative dehydrogenase] [GN:SC6G4.42c] [OR:*Streptomyces coelicolor*] [DE:*Streptomyces coelicolor* cosmid 6G4.] [NT:SC6G4.42c, probable dehydrogenase, len: 257;] |
| Contig150G | 19551575_f3_76 | 3020 | 7146 | 369 | 122 | | | NO-HIT |
| Contig150G | 20398452_c2_122 | 3021 | 7147 | 1098 | 365 | 406 | 6.90E−38 | pir:[LN:E71697] [AC:E71697] [PN:probable proteinase sohB (sohB) RP398] [GN:sohB:RP398] [OR:*Rickettsia prowazekii*] |
| Contig150G | 21519656_c3_125 | 3022 | 7148 | 237 | 78 | 212 | 2.50E−17 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |
| Contig150G | 21678191_c1_102 | 3023 | 7149 | 1221 | 406 | 481 | 7.80E−46 | pir:[LN:E71668] [AC:E71668] [PN:probable permease perM homolog (perM) RP630] [GN:perM:RP630] [OR:*Rickettsia prowazekii*] |
| Contig150G | 22117206_c1_95 | 3024 | 7150 | 855 | 284 | 813 | 5.10E−81 | sp:[LN:ETFB_BRAJA] [AC:P53575] [GN:ETFB:ETFS] [OR:*BRADYRHIZOBIUM JAPONICUM*] [DE:TRANSFER FLAVOPROTEIN SMALL SUBUNIT) (ETFSS)) [SP:P53575] |
| Contig150G | 22272052_f1_72 | 3025 | 7151 | 1017 | 338 | | | NO-HIT |
| Contig150G | 22693930_f1_7 | 3026 | 7152 | 183 | 60 | | | NO-HIT |
| Contig150G | 22891253_c3_143 | 3027 | 7153 | 753 | 250 | 627 | 2.60E−61 | sp:[LN:YBBA_HAEIN] [AC:P45247] [GN:HI1549] [OR:*HAEMOPHILUS INFLUENZAE*] [DE:HYPOTHETICAL ABC TRANSPORTER ATP-BINDING PROTEIN HI1549] [SP:P45247] |
| Contig150G | 23621090_f1_12 | 3028 | 7154 | 1134 | 377 | 583 | 1.20E−56 | gp:[GI:g4155990] [LN:AE001560] [AC:AE001560:AE001439] [PN:putative] [GN:jhp1381] [OR:*Helicobacter pylori* J99] [DE:*Helicobacter pylori*, strain J99 section 121 of 132 of the completegenome.] [NT:similar to *H. pylori* 26695 gene HP1488] |
| Contig150G | 23875437_c1_90 | 3029 | 7155 | 1518 | 505 | 1462 | 8.70E−150 | sp:[LN:CYCA_ECOLI] [AC:P39312] [GN:CYCA:DAGA] [OR:*ESCHERICHIA COLI*] [DE:D-SERINE/D-ALANINE/GLYCINE TRANSPORTER] [SP:P39312] |

TABLE 2-continued

| Query | Orf | NT ID | AA ID | NT Lgth | AA Lgth | Score | P-value | Subject |
|---|---|---|---|---|---|---|---|---|
| Contig150G | 23957255_f1_3 | 3030 | 7156 | 1098 | 365 | 1250 | 2.50E−127 | gp:[GI:g1562541] [LN:STU68765] [AC:U68765] [PN:5'-phosphoribosyl-5-aminoimidazole synthetase] [GN:purI] [OR:*Salmonella typhimurium*] [DE:*Salmonella* typhimurium 5'-phosphoribosylglycinamide transformylase(purN) and 5'-phosphoribosyl-5-aminoimidazole synthetase (purI)genes, complete cds.] |
| Contig150G | 24072215_c1_56 | 3031 | 7157 | 201 | 66 | | | NO-HIT |
| Contig150G | 24104827_c1_94 | 3032 | 7158 | 927 | 308 | 588 | 3.60E−57 | sp:[LN:XERC_HAEIN] [AC:P44818] [GN:XERC:HI0676] [OR:*HAEMOPHILUS INFLUENZAE*] [DE:INTEGRASE/RECOMBINASE XERC] [SP:P44818] |
| Contig150G | 24395078_f3_69 | 3033 | 7159 | 726 | 241 | 272 | 1.10E−23 | sp:[LN:YRHP_BACSU] [AC:O05406] [GN:YRHP] [OR:*BACILLUS SUBTILIS*] [DE:HYPOTHETICAL 23.4 KD PROTEIN IN AAPA-SIGV INTERGENIC REGION] [SP:O05406] |
| Contig150G | 24423588_c1_84 | 3034 | 7160 | 2421 | 806 | 1957 | 3.00E−202 | gp:[GI:g1620508] [LN:REU60056] [AC:U60056] [PN:CbbBc] [GN:cbbBc] [OR:*Ralstonia eutropha*] [DE:*Ralstonia eutropha* formate dehydrogenase-like protein (cbbBc) gene,complete cds.] [NT:function unknown; formate dehydrogenase-like] |
| Contig150G | 2454625_c2_112 | 3035 | 7161 | 1143 | 380 | 640 | 1.10E−62 | sp:[LN:PDXB_ECOLI] [AC:P05459] [GN:PDXB] [OR:*ESCHERICHIA COLI*] [EC:1.1.1.—] [DE;ERYTHRONATE-4-PHOSPHATE DEHYDROGENASE,] [SP:P05459] |
| Contig150G | 24652180_c1_104 | 3036 | 7162 | 1359 | 452 | | | NO-HIT |
| Contig150G | 25584818_c3_133 | 3037 | 7163 | 858 | 285 | 820 | 9.30E−82 | pir:[LN:S01913] [AC:B65185:S30699:S01913;A37 841:S24977] [PN:diaminopimetate epimerase,] [GN:dapF] [CL:diaminopimelate epimerase] [OR:*Escherichia coli*] [EC:5.1.1.7] [MP:85 min] |
| Contig150G | 25664167_c3_135 | 3038 | 7164 | 966 | 321 | 936 | 4.80E−94 | sp:[LN:ETFA_BRAJA] [AC:P53573] [GN:ETFA:ETFL] [OR:*BRADYRHIZOBIUM JAPONICUM*] [DE:*TRANSFER FLAVOPROTEIN LARGE SUBUNIT) (ETFLS)] [SP:P53573] |
| Contig150G | 26745250_c2_123 | 3039 | 7165 | 828 | 275 | 108 | 0.00021 | pir:[LN:E70010] [AC:E70010] [PN:dihydrolipoamide S-acetyltransferase homolog yugF] [GN:yugF] [OR:*Bacillus subtilis*] |
| Contig150G | 26834632_f1_11 | 3040 | 7166 | 1521 | 506 | 417 | 4.70E−39 | gp:[GI:g4155991] [LN:AE001560] [AC:AE001560:AE001439] [PN:putative] [GN:jhp1382] [OR:*Helicobacter pylori* J99] [DE:*Helicobacter pylori*, strain J99 section 121 of 132 of the completegenome.] [NT:similar to *H. pylori* 26695 gene HP1489] |

TABLE 2-continued

| Query | Orf | NT ID | AA ID | NT Lgth | AA Lgth | Score | P-value | Subject |
|---|---|---|---|---|---|---|---|---|
| Contig150G | 29718812_f1_27 | 3041 | 7167 | 1182 | 393 | 918 | 3.80E-92 | sp:[LN:YXAA_BACSU] [AC:P42100] [GN:YXAA:S14A] [OR:*BACILLUS SUBTILIS*] [DE:HYPOTHETICAL 39.4 KD PROTEIN IN GNTR-HTPG INTERGENIC REGION] [SP:P42100] |
| Contig150G | 30133563_c2_116 | 3042 | 7168 | 2727 | 908 | 2428 | 2.10E-286 | sp:[LN:GYRA_ERWCA] [AC:P41513] [GN:GYRA] [OR:*ERWINIA CAROTOVORA*] [EC:5.99.1.3] [DE:DNA GYRASE SUBUNIT A,] [SP:P41513] |
| Contig150G | 30353162_c3_127 | 3043 | 7169 | 681 | 226 | 91 | 0.00051 | gp:[GI:g1079814] [LN:S79230] [AC:S79230] [PN:BM1P1] [GN:CYP106] [OR:*Bacillus megaterium*] [DE:CYP106=BM1P2 orf...CYP106=P450BM-1 orf {regulatory regions}[*Bacillus megaterium*, mRNA Partial, 3 genes, 1400 nt].] [NT:positive transcription factor involved in] |
| Contig150G | 31912558_c3_134 | 3044 | 7170 | 186 | 61 | | | NO-HIT |
| Contig150G | 32084683_c1_103 | 3045 | 7171 | 1041 | 346 | | | NO-HIT |
| Contig150G | 33302052_c1_97 | 3046 | 7172 | 198 | 65 | | | NO-HIT |
| Contig150G | 34116562_c3_149 | 3047 | 7173 | 765 | 254 | 217 | 7.40E-18 | gp:[GI:g3212215] [LN:U32802] [AC:U32802:L42023] [PN:conserved hypothetical protein] [GN:HI1225.1] [OR:*Haemophilus influenzae* Rd] [DE:*Haemophilus influenzae* Rd section 117 of 163 of the completegenome.] [NT:similar to GB:U00096 PID:1788842 PID:1805556] |
| Contig150G | 36125637_c3_130 | 3048 | 7174 | 420 | 139 | 105 | 5.50E-06 | pir:[LN:S74843] [AC:S74843] [PN:hypothetical protein s110846] [OR:Synechocystis sp.] [SR:PCC 6803,, PCC 6803] [SR:PCC 6803,] |
| Contig150G | 3923438_f1_28 | 3049 | 7175 | 615 | 204 | 458 | 2.10E-43 | pir:[LN:S75047] [AC:S75047] [PN:drgA protein:protein slr1719:protein slr1719] [GN:drgA] [CL:nitroreductase] [OR:Synechocystis sp.] [SR:PCC 6803,, PCC 6803] [SR:PCC 6803,] |
| Contig150G | 4146943_f1_15 | 3050 | 7176 | 1656 | 551 | 386 | 1.80E-34 | gp:[GI:g2921423] [LN:AF036677] [AC:AF036677] [PN:unknown] [OR:*Salmonella typhimurium*] [DE:*Salmonella typhimurium* putative operon regulated by PmrAB,necessary for 4-aminoarabinose lipid A modification and polymyxinresistance, PmrG (pmrG) gene, partial cds; PmrF (pmrF) gene and 6orfs, complete cds; and PmrD (pmrD) gene, partial cds.] [NT:orf5; fifth orf of putative 7 gene PmrAB-regulated] |
| Contig150G | 4148433_f2_51 | 3051 | 7177 | 1482 | 493 | 1527 | 1.10E-156 | sp:[LN:RADA_PSEAE] [AC:P96963] [GN:RADA:SMS] [OR:*PSEUDOMONAS AERUGINOSA*] [DE:DNA REPAIR PROTEIN RADA HOMOLOG (DNA REPAIR PROTEIN SMS HOMOLOG)] [SP:P96963] |
| Contig150G | 4803825_f2_37 | 3052 | 7178 | 1026 | 341 | 714 | 1.60E-70 | sp:[LN:Y501_SYNY3] [AC:Q55487] [GN:SLL0501] [OR:SYNECHOCYSTIS SP] [SR:PCC 6803,] [DE:HYPOTHETICAL 36.7 KD PROTEIN SLL0501] [SP:Q55487] |
| Contig150G | 4883436_c3_150 | 3053 | 7179 | 921 | 306 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig150G | 4884702_f3_58 | 3054 | 7180 | 630 | 209 | 481 | 7.80E−46 | gp:[GI:g387019] [LN:HUMPGFTA] [AC:M32082] [GN:GART] [OR:*Homo sapiens*] [SR:Human, cDNA to mRNA, clone pD546] [DE:Human phosphoribosylglycinamide formyltransferase (PGFT) mRNA, 3′end.] [NT:phosphoribosylglycinamide formyltransferase] |
| Contig150G | 5265702_c1_99 | 3055 | 7181 | 2433 | 810 | 490 | 2.60E−46 | gp:[GI:d1013133:g1303798] [LN:BACJH642] [AC:D84432:D82370] [PN:ComEC] [OR:*Bacillus subtilis*] [SR:*Bacillus subtilis* (strain:JH642(trpC2 PheA1)) DNA] [DE:*Bacillus subtilis* DNA, 283 Kb region containing skin element.] |
| Contig150G | 5944762_c3_141 | 3056 | 7182 | 513 | 170 | 400 | 3.00E−37 | sp:[LN:YAII_ECOLI] [AC:P52088:P75703] [GN:YAII] [OR:*ESCHERICHIA COLI*] [DE:HYPOTHETICAL 17.0 KD PROTEIN IN PROC-AROL INTERGENIC REGION] [SP:P52088:P75703] |
| Contig150G | 5958252_c3_126 | 3057 | 7183 | 810 | 269 | | | NO-HIT |
| Contig150G | 6445292_c1_98 | 3058 | 7184 | 942 | 313 | 235 | 9.10E−20 | sp:[LN:YEDA_ECOLI] [AC:P09185] [GN:YEDA] [OR:*ESCHERICHIA COLI*] [DE:HYPOTHETICAL 32.2 KD PROTEIN IN DSRA-VSR INTERGENIC REGION (ORF 4)] [SP:P09185] |
| Contig150G | 6532312_c3_132 | 3059 | 7185 | 330 | 109 | | | NO-HIT |
| Contig150G | 827_c2_120 | 3060 | 7186 | 1122 | 373 | 1097 | 4.10E−111 | sp:[LN:SERC_SALGL] [AC:P17902] [GN:SERC] [OR:*SALMONELLA GALLINARUM*] [EC:2.6.1.52] [DE:PHOSPHOSERINE AMINOTRANSFERASE, (PSAT)] [SP:P17902] |
| Contig150G | 9792837_c1_93 | 3061 | 7187 | 660 | 219 | 102 | 5.70E−10 | pir:[LN:E70010] [AC:E70010] [PN:dihydrolipoamide S-acetyltransferase homolog yugF] [GN:yugF] [OR:*Bacillus subtilis*] |
| Contig150G | 9863808_f1_2 | 3062 | 7188 | 249 | 82 | | | NO-HIT |
| Contig150G | 9879702_c2_121 | 3063 | 7189 | 1281 | 426 | 769 | 2.40E−76 | sp:[LN:YCFW_ECOLI] [AC:P75958] [GN:YCFW] [OR:*ESCHERICHIA COLI*] [DE:HYPOTHETICAL 45.3 KD PROTEIN IN MFD-COBB INTERGENIC REGION] [SP:P75958] |
| Contig151G | 10037512_f1_25 | 3064 | 7190 | 2352 | 783 | 1478 | 1.70E−151 | pir:[LN:B70838] [AC:B70838] [PN:hypothetical protein Rv0197] [GN:Rv0197] [OR:*Mycobacterium tuberculosis*] |
| Contig151G | 10040885_f2_254 | 3065 | 7191 | 1842 | 613 | 1458 | 2.30E−149 | sp:[LN:KEFX_HAEIN] [AC:P44933] [GN:KEFBC:HI0911] [OR:*HAEMOPHILUS INFLUENZAE*] [DE:ANTIPORTER)] [SP:P44933] |
| Contig151G | 101081_c2_813 | 3066 | 7192 | 267 | 88 | | | NO-HIT |
| Contig151G | 10214525_f2_309 | 3067 | 7193 | 765 | 254 | | | NO-HIT |
| Contig151G | 1048442_c1_607 | 3068 | 7194 | 219 | 72 | | | NO-HIT |
| Contig151G | 1052183_f3_383 | 3069 | 7195 | 2055 | 684 | 2188 | 1.00E−226 | sp:[LN:FADH_ECOLI] [AC:P42593] [GN:FADH] [OR:*ESCHERICHIA COLI*] [EC:1.3.1.34] [DE:A REDUCTASE)] [SP:P42593] |

TABLE 2-continued

| Query | Orf | NT ID | AA ID | NT Lgth | AA Lgth | Score | P-value | Subject |
|---|---|---|---|---|---|---|---|---|
| Contig151G | 10578201_f1_70 | 3070 | 7196 | 450 | 149 | 182 | 3.80E−14 | gp:[GI:g2822324] [LN:AF016485] [AC:AF016485] [OR:Halobacterium sp. NRC-1] [DE:Halobacterium sp. NRC-1 plasmid pNRC100, complete plasmid sequence.] [NT:ORF H0554; same as H1810 in IR-L] |
| Contig151G | 1063762_c2_821 | 3071 | 7197 | 903 | 300 | 162 | 3.10E−14 | pir:[LN:G70407] [AC:G70407] [PN:hypothetical protein aq_1247] [GN:aq_1247] [OR:*Aquifex aeolicus*] |
| Contig151G | 1069702_c2_699 | 3072 | 7198 | 984 | 327 | | | NO-HIT |
| Contig151G | 10725952_f2_181 | 3073 | 7199 | 1197 | 398 | 968 | 1.90E−97 | sp:[LN:DXR_ECOLI] [AC:P45568:P77209] [GN:DXR] [OR:*ESCHERICHIA COLI*] [DE:REDUCTOISOMERASE)] [SP:P45568:P77209] |
| Contig151G | 10726452_f2_170 | 3074 | 7200 | 255 | 84 | 92 | 0.00013 | gp:[GI:e1420096:g4538974] [LN:ATF28M11] [AC:AL049487] [PN:hypothetical protein] [GN:F28M11.20] [OR:*Arabidopsis thaliana*] [SR:thale cress] [DE:*Arabidopsis thaliana* DNA chromosome 4, BAC clone F28M11 (ESSAproject).] |
| Contig151G | 10930_f3_387 | 3075 | 7201 | 420 | 139 | 169 | 9.00E−13 | sp:[LN:YGBQ_HAEIN] [AC:P44035] [GN:HI0673] [OR:*HAEMOPHILUS INFLUENZAE*] [DE:HYPOTHETICAL PROTEIN HI0673] [SP:P44035] |
| Contig151G | 10970768_f1_105 | 3076 | 7202 | 627 | 208 | 160 | 8.10E−12 | pir:[LN:H70042] [AC:H70042] [PN:transcription regulator TetR/AcrR family homolog yvkB] [GN:yvkB] [OR:*Bacillus subtilis*] |
| Contig151G | 10972153_f3_450 | 3077 | 7203 | 467 | 488 | 793 | 6.80E−79 | gp:[GI:g2826753] [LN:AF039169] [AC:AF039169] [PN:indole-3-acetamide hydrolase] [GN:H] [OR:*Agrobacterium vitis*] [DE:*Agrobacterium vitis* plasmid pTiAG162 indole-3-acetamide hydrolase(H) gene, complete cds.] |
| Contig151G | 11047188_c2_750 | 3078 | 7204 | 330 | 109 | 460 | 1.30E−43 | gp:[GI:g2996616] [LN:AF009224] [AC:AF009224:M76991:M76990: M23245:M29848:M29714:M62649] [PN:muconolactone isomerase] [GN:catC] [FN:conversion of muconolactone to ketoadipate] [OR:Acinetobacter sp. ADP1] [DE:Acinetobacter sp. ADP1 ben operon and cat operon, completesequence.] |
| Contig151G | 11142130_c2_785 | 3079 | 7205 | 603 | 200 | 277 | 3.20E−24 | pir:[LN:H70875] [AC:H70875] [PN:hypothetical protein Rv1176c] [GN:Rv1176c] [OR:*Mycobacterium tuberculosis*] |
| Contig151G | 11150313_f1_86 | 3080 | 7206 | 1320 | 439 | 959 | 1.70E−96 | sp:[LN:TUB3_AGRVI] [AC:P70786] [GN:TTUB] [OR:*AGROBACTERIUM VITIS*] [DE:PUTATIVE TARTRATE TRANSPORTER] [SP:P70786] |
| Contig151G | 11768807_c3_881 | 3081 | 7207 | 1332 | 443 | 231 | 8.80E−17 | pir:[LN:C69448] [AC:C69448] [PN:conserved hypothetical protein AF1588] [OR:*Archaeoglobus fulgidus*] |
| Contig151G | 11880442_f2_290 | 3082 | 7208 | 1599 | 532 | 245 | 4.70E−27 | pir:[LN:S74561] [AC:S74561] [PN:hypothetical protein sll0225] [OR:Synechocystis sp.] [SR:PCC 6803,, PCC 6803] [SR:PCC 6803,] |
| Contig151G | 11910927_f1_93 | 3083 | 7209 | 225 | 74 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 11923260_f3_352 | 3084 | 7210 | 1488 | 495 | 1637 | 2.50E−168 | sp:[LN:YLIG_ECOLI] [AC:P75802] [GN:YLIG] [OR:*ESCHERICHIA COLI*] [DE:HYPOTHETICAL 49.6 KD PROTEIN IN MOEA-DACC INTERGENIC REGION] [SP:P75802] |
| Contig151G | 12281636_c2_721 | 3085 | 7211 | 183 | 60 | | | NO-HIT |
| Contig151G | 12555437_f2_258 | 3086 | 7212 | 492 | 163 | | | NO-HIT |
| Contig151G | 126036_f2_204 | 3087 | 7213 | 1131 | 376 | 1017 | 1.20E−102 | sp:[LN:FTSY_ECOLI] [AC:P10121] [GN:FTSY] [OR:*ESCHERICHIA COLI*] [DE:CELL DIVISION PROTEIN FTSY] [SP:P10121] |
| Contig151G | 1286068_c1_622 | 3088 | 7214 | 1599 | 532 | 2205 | 1.60E−228 | sp:[LN:CYDA_AZOVI] [AC:Q09049] [GN:CYDA] [OR:*AZOTOBACTER VINELANDII*] [EC:1.10.3.—] [DE:CYTOCHROME D UBIQUINOL OXIDASE SUBUNIT I,] [SP:Q09049] |
| Contig151G | 12925333_c3_1009 | 3089 | 7215 | 651 | 216 | | | NO-HIT |
| Contig151G | 13672192_c3_998 | 3090 | 7216 | 549 | 182 | 461 | 1.00E−43 | gp:[GI:e1314177:g3395518] [LN:PMAJ84] [AC:AJ000084] [PN:putative acetyl transferase] [GN:pat] [OR:*Proteus mirabilis*] [DE:*Proteus mirabilis* ccm and pat genes and partial ygbA gene.] |
| Contig151G | 13676577_c3_919 | 3091 | 7217 | 1176 | 391 | 196 | 4.60E−15 | gp:[GI:c251801:g1419427] [LN:CCXYLX] [AC:X98879] [GN:xylX] [FN:xylose utilization] [OR:*Caulobacter crescentus*] [DE:*C.crescuntus* xylX gene.] [NT:transcription induced by xylose] [RE: |
| Contig151G | 1369037_f1_129 | 3092 | 7218 | 984 | 327 | 173 | 9.50E−11 | gp:[GI:g4455079] [LN:AF119621] [AC:AF119621] [PN:DitH] [GN:ditH] [OR:*Pseudomonas abietaniphila*] [DE:*Pseudomonas abietaniphila* BKME-9 DitI (ditI), dioxygenase DitAoxygenase component small subunit (ditA2), dioxygenase DitAoxygenase component large subunit (ditA1). DitH (ditH), DitG(ditG), DitF (ditF), DitR (ditR), DitE (ditE), DitD (ditD),aromatic diterpenoid extradiol ring-cleavage dioygenase (ditC),DitB (ditB), and dioxygenase DitA ferredoxin component (ditA3)genes, complete cds; and unknown genes.] [NT:hypthetical protein; C-terminus similar to] |
| Contig151G | 13710887_c3_1041 | 3093 | 7219 | 252 | 83 | | | NO-HIT |
| Contig151G | 13759687_f1_50 | 3094 | 7220 | 600 | 199 | 279 | 2.00E−24 | sp:[LN:YC08_YEAST] [AC:P37261] [GN:YCLX08C:YCLX8C] [OR:*SACCHAROMYCES CEREVISIAE*] [SR:,BAKER'S YEAST] [DE:HYPOTHETICAL 21.1 KD PROTEIN IN FUS1-AGP1 INTERGENIC REGION] [SP:P37261] |
| Contig151G | 13790902_f1_76 | 3095 | 7221 | 957 | 318 | 721 | 2.90E−71 | sp:[LN:VANB_PSESP] [AC:O05617] [GN:VANB] [OR:PSEUDOMONAS SP] [SR:HR199 / DSM 7063,] [EC:1.14.13.—] [DE:DEGRADATION FERREDOXIN-LIKE PROTEIN)] [SP:O05617] |
| Contig151G | 13796918_c1_486 | 3096 | 7222 | 198 | 65 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 13869152_f3_329 | 3097 | 7223 | 1302 | 433 | 370 | 4.50E−34 | pir:[LN:D69856] [AC:D69856] [PN:conserved hypothetical protein ykgB] [GN:ykgB] [OR:*Bacillus subtilis*] |
| Contig151G | 13948343_f1_64 | 3098 | 7224 | 1704 | 567 | 1885 | 1.30E−194 | sp:[LN:PYRG_HAEIN] [AC:P44341] [GN:PYRG:HI1077] [OR:*HAEMOPHILUS INFLUENZAE*] [EC:6.3.4.2] [DE:CTP SYNTHASE, (UTP--AMMONIA LIGASE) (CTP SYNTHETASE)] [SP:P44341] |
| Contig151G | 14066927_c3_1027 | 3099 | 7225 | 1380 | 459 | 226 | 1.20E−26 | gp:[GI:d1006210:g1498192] [LN:PSEOPRC] [AC:D28119] [OR:*Pseudomonas aeruginosa*] [SR:*Pseudomonas aeruginosa*,] (strain PAO1), DNA, (clone pTN100)] [DE:*Pseudomonas aeruginosa* oprC gene for outer membrane protein C,complete cds.] [NT:putative] |
| Contig151G | 14087778_f3_375 | 3100 | 7226 | 330 | 109 | | | NO-HIT |
| Contig151G | 14094467_f3_390 | 3101 | 7227 | 426 | 141 | 608 | 2.70E−59 | sp:[LN:DC4C_ACICA] [AC:P20370] [GN:PCAC] [OR:*ACINETOBACTER CALCOACETICUS*] [EC:4.1.1.44] [DE:4-CARBOXYMUCONOLACTONE DECARBOXYLASE, (CMD)] [SP:P20370] |
| Contig151G | 14119062_f3_462 | 3102 | 7228 | 381 | 126 | | | NO-HIT |
| Contig151G | 14329550_c2_793 | 3103 | 7229 | 1599 | 532 | | | NO-HIT |
| Contig151G | 1443_f2_149 | 3104 | 7230 | 231 | 76 | | | NO-HIT |
| Contig151G | 14459375_c3_971 | 3105 | 7231 | 903 | 300 | 225 | 1.60E−18 | pir:[LN:H70882] [AC:H70882] [PN:hypothetical protein Rv2777c] [GN:Rv2777c] [OR:*Mycobacterium tuberculosis*] |
| Contig151G | 14470708_c1_543 | 3106 | 7232 | 255 | 84 | | | NO-HIT |
| Contig151G | 14486028_f3_432 | 3107 | 7233 | 249 | 82 | | | NO-HIT |
| Contig151G | 14490675_f2_281 | 3108 | 7234 | 975 | 324 | 335 | 2.30E−30 | sp:[LN:GBPR_AZOBR] [AC:P52661] [GN:GBPR] [OR:*AZOSPIRILLUM BRASILENSE*] [DE:GALACTOSE-BINDING PROTEIN REGULATOR (GBP REGULATOR)] [SP:P52661] |
| Contig151G | 14558317_f3_340 | 3109 | 7235 | 354 | 117 | | | NO-HIT |
| Contig151G | 14571000_f1_120 | 3110 | 7236 | 1341 | 446 | 241 | 1.20E−17 | sp:[LN:TOLC_SALEN] [AC:Q54001] [GN:TOLC] [OR:*SALMONELLA ENTERITIDIS*] [DE:OUTER MEMBRANE PROTEIN TOLC PRECURSOR] [SP:Q54001] |
| Contig151G | 14573407_c1_533 | 3111 | 7237 | 1626 | 541 | 1311 | 8.70E−134 | pir:[LN:S27612] [AC:S27612] [PN:ketoglutarate semialdehyde dehydrogenase,] [OR:*Pseudomonas putida*] [EC:1.2.1.—] |
| Contig151G | 14583593_f1_131 | 3112 | 7238 | 3123 | 1040 | 2603 | 1.10E−270 | gp:[GI:g1399758] [LN:PAU57969] [AC:U57969] [PN:RND family exporter Mexd] [GN:mexD] [OR:*Pseudomonas aeruginosa*] [SR:*Pseudomonas aeruginosa* strain=PAO] [DE:*Pseudomonas aeruginosa* membrane fusion protein MexC (mexC), RNDfamily exporter MexD (mexD), and outer membrane protein OprJ (oprJ)genes, complete cds.] [NT:cytoplasmic membrane-associated] |

TABLE 2-continued

| Query | Orf | NT ID | AA ID | NT Lgth | AA Lgth | Score | P-value | Subject |
|---|---|---|---|---|---|---|---|---|
| Contig151G | 14587777_c1_625 | 3113 | 7239 | 300 | 99 | 106 | 4.30E−06 | sp:[LN:YBGE__ECOLI] [AC:P37343:P75755] [GN:YBGE] [OR:*ESCHERICHIA COLI*] [DE:10.9 KD PROTEIN IN CYDB-TOLQ INTERGENIC REGION (ORFD)] [SP:P37343:P75755] |
| Contig151G | 1460875_f1_1 | 3114 | 7240 | 570 | 189 | 254 | 8.90E−22 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |
| Contig151G | 14648537_c3_873 | 3115 | 7241 | 426 | 141 | 489 | 1.10E−46 | gp:[GI:g3241975] [LN:SSU85710] [AC:U85710] [PN:transposase] [OR:*Sulfolobus solfataricus*] [DE:*Sulfolobus solfataricus* insertion element ISC1041, transposasegene, complete cds.] |
| Contig151G | 14875262_f1_41 | 3116 | 7242 | 492 | 163 | 348 | 9.70E−32 | gp:[GI:g1718488] [LN:NMU79481] [AC:U79481] [PN:FabZ] [GN:fabZ] [FN:fatty acid biosynthesis] [OR:*Neisseria meningitidis*] [DE:*Neisseria meningitidis* UDP-3-O-(R-3-hydroxymyristoyl)-glucosamineN-acyltransferase (lpxD) gene, partial cds, and3(R)-hydroxymyristoyl acyl carrier protein dehydrase (fabZ) andUDP-N-acetylglucosamine acyltransferase (lpxA) genes, complete cds.] [NT:3(R)-hydroxymyristoyl acyl carrier protein] |
| Contig151G | 14881306_c3_977 | 3117 | 7243 | 378 | 125 | 115 | 4.80E−07 | pir:[LN:E41858] [AC:E41858] [PN:biphenyl dioxygenase, ferredoxin component] [GN:bphA3:bphF] [CL:toluene dioxygenase ferredoxin component] [OR:Pseudomonas sp] [EC:1.14.—.—] |
| Contig151G | 14881927_c1_677 | 3118 | 7244 | 996 | 331 | 837 | 1.50E−83 | sp:[LN:TAL__ANAVA] [AC:P51778] [GN:TAL] [OR:*ANABAENA VARIABILIS*] [EC:2.2.1.2] [DE:TRANSALDOLASE,] [SP:P51778] |
| Contig151G | 14924077_c2_857 | 3119 | 7245 | 456 | 151 | 480 | 1.00E−45 | gp:[GI:g2599341] [LN:AF010322] [AC:AF010322] [PN:catabolic dehydroquinase] [GN:aroQ] [OR:*Pseudomonas aeruginosa*] [DE:*Pseudomonas aeruginosa* protein-disulfide reductase (dipZ) andcatabolic dehydroquinase (aroQ) genes, complete cds.] [NT:AroQ] |
| Contig151G | 15114037_c1_629 | 3120 | 7246 | 450 | 149 | 283 | 7.50E−25 | pir:[LN:A70684] [AC:A70684] [PN:hypothetical protein Rv2406c] [GN:Rv2406c] [OR:*Mycobacterium tuberculosis*] |
| Contig151G | 15625902_c3_923 | 3121 | 7247 | 957 | 318 | 444 | 6.50E−42 | gp:[GI:g1139588] [LN:HIU20964] [AC:U20964] [PN:ORF2] [OR:*Haemophilus influenzae*] [DE:*Haemophilus influenzae* DNA topoisomerase I (topA) gene, completecds, putative pyridine nucleotide transhydrogenase beta subunit(pntB) gene, partial cds, ORF2 and ORF3 genes, complete cds andputative threonyl-tRNA synthetase (thrS) gene, partial cds.] [NT:ORF2 has a predicted molecular weight of 34.5kd and] |

TABLE 2-continued

| Query | Orf | NT ID | AA ID | NT Lgth | AA Lgth | Score | P-value | Subject |
|---|---|---|---|---|---|---|---|---|
| Contig151G | 15680167_f1_75 | 3122 | 7248 | 1338 | 445 | 647 | 2.00E−63 | gp:[GI:d1013489:g1841362] [LN:D85415] [AC:D85415] [PN:large subunit of terminat dioxygenase] [GN:tdnA1] [OR:*Pseudomonas putida*] [SR:*Pseudomonas putida* (strain:UCC22) DNA] [DE:*Pseudomonas putida* gene for conversion of aniline to catechol.] |
| Contig151G | 157137_f3_330 | 3123 | 7249 | 549 | 182 | 309 | 1.30E−27 | sp:[LN:Y328_SYNY3] [AC:Q55535] [GN:SLR0328] [OR:SYNECHOCYSTIS SP] [SR:PCC 6803,] [EC:3.1.3.48] [DE:(EC 3.1.3.48)] [SP:Q55535] |
| Contig151G | 15906667_f2_284 | 3124 | 7250 | 1029 | 342 | 540 | 4.40E−52 | sp:[LN:YE71_HAEIN] [AC:Q57130:O05065] [GN:HI1471] [OR:*HAEMOPHILUS INFLUENZAE*] [DE:HYPOTHETICAL ABC TRANSPORTER PERMEASE PROTEIN HI1471] [SP:Q57130:O05065] |
| Contig151G | 160126_c1_554 | 3125 | 7251 | 348 | 115 | | | NO-HIT |
| Contig151G | 16054631_f3_479 | 3126 | 7252 | 258 | 85 | | | NO-HIT |
| Contig151G | 16290957_f2_286 | 3127 | 7253 | 723 | 240 | 122 | 1.40E−07 | sp:[LN:NARP_ECOLI] [AC:P31802] [GN:NARP] [OR:*ESCHERICHIA COLI*] [DE:NITRATE/NITRITE RESPONSE REGULATOR PROTEIN NARP] [SP:P31802] |
| Contig151G | 163137_f1_34 | 3128 | 7254 | 216 | 71 | | | NO-HIT |
| Contig151G | 16411083_f2_311 | 3129 | 7255 | 2571 | 856 | 1529 | 6.90E−157 | sp:[LN:MRKC_KLEPN] [AC:P21647] [GN:MRKC] [OR:*KLEBSIELLA PNEUMONIAE*] [DE:OUTER MEMBRANE USHER PROTEIN MRKC PRECURSOR] [SP:P21647] |
| Contig151G | 16485377_f1_33 | 3130 | 7256 | 1440 | 479 | 1608 | 2.90E−165 | gp:[GI:d1025288:g2780773] [LN:AB010203] [AC:AB010203] [OR:*Leptospira interrogans*] [SR:*Leptospira interrogans* (sub_species:*icterohaemorrhagiae*) [DE:*Leptospira interrogans* gene, 19kb region containing 5S rRNA gene.] [NT:ORF7; putative] [RE: |
| Contig151G | 16485932_f2_180 | 3131 | 7257 | 858 | 285 | 415 | 7.70E−39 | sp:[LN:CDSA_PSEAE] [AC:Q59640] [GN:CDSA:CDS] [OR:*PSEUDOMONAS AERUGINOSA*] [EC:2.7.7.41] [DE:SYNTHASE)] [SP:Q59640] |
| Contig151G | 16509417_f1_24 | 3132 | 7258 | 654 | 217 | 220 | 3.50E−18 | sp:[LN:MOBA_HAEIN] [AC:P44899] [GN:MOBA:MOB:HI0844] [OR:*HAEMOPHILUS INFLUENZAE*] [DE:FA)] [SP:P44899] |
| Contig151G | 16800055_f3_444 | 3133 | 7259 | 504 | 167 | 214 | 1.50E−17 | pir:[LN:A69190] [AC:A69190] [PN:hypothetical protein MTH676] [GN:MTH676] [OR:*Methanobacterium thermoautotrophicum*] |
| Contig151G | 16835938_c3_989 | 3134 | 7260 | 222 | 73 | | | NO-HIT |
| Contig151G | 16837676_f3_347 | 3135 | 7261 | 189 | 62 | | | NO-HIT |
| Contig151G | 17052_f3_443 | 3136 | 7262 | 1065 | 354 | 259 | 2.60E−22 | pir:[LN:G70046] [AC:G70046] [PN:iron-binding protein homolog yvrC] [GN:yvrC] [OR:*Bacillus subtilis*] |
| Contig151G | 195327_f3_404 | 3137 | 7263 | 1278 | 425 | | | NO-HIT |
| Contig151G | 19539131_c2_803 | 3138 | 7264 | 1089 | 362 | 680 | 6.40E−67 | sp:[LN:YZ37_SYNY3] [AC:Q55480] [GN:SLR0537] [OR:SYNECHOCYSTIS SP] [SR:PCC 6803,] [DE:HYPOTHETICAL SUGAR KINASE SLR0537] [SP:Q55480] |

TABLE 2-continued

| Query | Orf | NT ID | AA ID | NT Lgth | AA Lgth | Score | P-value | Subject |
|---|---|---|---|---|---|---|---|---|
| Contig151G | 19563556_f3_445 | 3139 | 7265 | 930 | 309 | 380 | 3.90E−35 | sp:[LN:PBEF_HUMAN] [AC:P43490] [GN:PBEF] [OR:*HOMO SAPIENS*] [DE:PRE-B CELL ENHANCING FACTOR PRECURSOR] [SP:P43490] |
| Contig151G | 19642927_f3_475 | 3140 | 7266 | 306 | 101 | | | NO-HIT |
| Contig151G | 19649092_f2_164 | 3141 | 7267 | 1635 | 544 | 937 | 3.70E−94 | sp:[LN:NASD_BACSU] [AC:P42435] [GN:NASD:NIRB:NASBC] [OR:*BACILLUS SUBTILIS*] [EC:1.6.6.4] [DE:NITRITE REDUCTASE (NAD(P)H),] [SP:P42435] |
| Contig151G | 19720313_f3_457 | 3142 | 7268 | 336 | 111 | | | NO-HIT |
| Contig151G | 199040_f2_218 | 3143 | 7269 | 1335 | 444 | 1468 | 2.00E−150 | pir:[LN:NOEC] [AC:G65059:B25608] [PN:phosphopyruvate hydratase,:2-phosphoglycerate dehydratase:enolase] [GN:eno] [CL:enolase] [OR:*Escherichia coli*] [EC:4.2.1.11] [MP:60 min] |
| Contig151G | 1992077_f2_267 | 3144 | 7270 | 435 | 144 | | | NO-HIT |
| Contig151G | 20000901_c3_925 | 3145 | 7271 | 198 | 65 | | | NO-HIT |
| Contig151G | 20312917_c3_950 | 3146 | 7272 | 1377 | 458 | 278 | 2.80E−22 | gp:[GI:e1216739:g2695718] [LN:TMESTAX] [AC:AJ001694] [PN:putative membrane protein] [GN:estX] [OR:*Thermotoga maritima*] [DE:*Thermotoga maritima* estA and estX genes.] |
| Contig151G | 20362953_f2_275 | 3147 | 7273 | 252 | 83 | | | NO-HIT |
| Contig151G | 20423187_c3_993 | 3148 | 7274 | 699 | 232 | 174 | 2.70E−13 | pir:[LN:F69896] [AC:F69896] [PN:conserved hypothetical protein yoaM] [GN:yoaM] [OR:*Bacillus subtilis*] |
| Contig151G | 204388_f3_357 | 3149 | 7275 | 822 | 273 | 724 | 1.40E−71 | sp:[LN:LPXA_ECOLI] [AC:P10440:P78243] [GN:LPXA] [OR:*ESCHERICHIA COLI*] [EC:2.3.1.129] [DE:(EC 2.3.1.129) (UDP-N-ACETYLGLUCOSAMINE ACYLTRANSFERASE)] [SP:P10440:P78243] |
| Contig151G | 20446061_f2_152 | 3150 | 7276 | 2085 | 694 | 1025 | 1.60E−111 | sp:[LN:DP3X_ECOLI] [AC:P06710:Q47721] [GN:DNAX,DNAZ] [OR:*ESCHERICHIA COLI*] [EC:2.7.7.7] [DE:DNA POLYMERASE III SUBUNITS GAMMA AND TAU,] [SP:P06710:Q47721] |
| Contig151G | 20484812_c1_628 | 3151 | 7277 | 225 | 74 | | | NO-HIT |
| Contig151G | 20521932_f2_304 | 3152 | 7278 | 444 | 147 | | | NO-HIT |
| Contig151G | 205285_c2_836 | 3153 | 7279 | 501 | 166 | | | NO-HIT |
| Contig151G | 20737537_c3_938 | 3154 | 7280 | 1113 | 370 | 1606 | 4.80E−165 | gp:[GI:g2996615] [LN:AF009224] [AC:AF009224:M76991:M76990:M23245:M29848:M29714:M62649] [PN:muconate cycloisomerase] [GN:catB] [FN:conversion of muconate to (+)-muconolactone] [OR:Acinetobacter sp. ADP1] [DE:Acinetobacter sp. ADP1 ben operon and cat operon, completesequenec.] [NT:growth with muconate or benzoate] |
| Contig151G | 20792512_f3_356 | 3155 | 7281 | 564 | 187 | 141 | 8.30E−10 | pir:[LN:C71539] [AC:C71539] [PN:probable (ompH-like outer membrane protein)] [GN:CT242] [OR:*Chlamydia trachomatis*] |
| Contig151G | 20906687_f3_458 | 3156 | 7282 | 603 | 200 | | | NO-HIT |
| Contig151G | 20915802_f2_260 | 3157 | 7283 | 498 | 165 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 20942267_f3_359 | 3158 | 7284 | 759 | 252 | 188 | 8.70E−15 | gp:[GI:e1350620:g3880987] [LN:CEY45F10A] [AC:AL021488] [GN:Y45F10A.3] [OR:*Caenorhabditis elegans*] [DE:*Caenorhabditis elegans* cosmid Y45F10A, complete sequence.] |
| Contig151G | 210767_f2_197 | 3159 | 7285 | 513 | 170 | | | NO-HIT |
| Contig151G | 2148438_f3_468 | 3160 | 7286 | 1494 | 497 | 862 | 3.30E−86 | gp:[GI:d1029634:g3184190] [LN:AB011381] [AC:AB011381] [PN:OprM] [GN:oprM] [OR:*Pseudomonas aeruginosa*] [SR:*Pseudomonas aeruginosa* (strain:TNP058) DNA] [DE:*Pseudomonas aeruginosa* gene for OprM, complete cds.] |
| Contig151G | 21522705_f2_283 | 3161 | 7287 | 1401 | 466 | 963 | 6.50E−97 | sp:[LN:TUB3_AGRVI] [AC:P70786] [GN:TTUB] [OR:*AGROBACTERIUM VITIS*] [DE:PUTATIVE TARTRATE TRANSPORTER] [SP:P70786] |
| Contig151G | 21597178_c2_740 | 3162 | 7288 | 597 | 198 | 145 | 3.10E−10 | sp:[LN:YHGD_BACSU] [AC:P32398] [GN:YHGD] [OR:*BACILLUS SUBTILIS*] [DE:(ORFA)] [SP:P32398] |
| Contig151G | 21602340_f2_158 | 3163 | 7289 | 915 | 304 | | | NO-HIT |
| Contig151G | 21647512_f2_219 | 3164 | 7290 | 195 | 64 | | | NO-HIT |
| Contig151G | 21720340_c2_763 | 3165 | 7291 | 567 | 188 | 109 | 2.50E−06 | sp:[LN:MARR_SALTY] [AC:Q56069] [GN:MARR] [OR:*SALMONELLA TYPHIMURIUM*] [DE:MULTIPLE ANTIBIOTIC RESISTANCE PROTEIN MARR] [SP:Q56069] |
| Contig151G | 21722557_f2_215 | 3166 | 7292 | 1101 | 366 | 746 | 6.50E−74 | gp:[GI:e1391695:g4468762] [LN:TNAJ9897] [AC:AJ009897] [PN:N-acetyl-gamma-glutamyl-phosphate reductase] [GN:argC] [OR:*Thermotoga neapolitana*] [EC:1.2.1.38] [DE:*Thermotoga neapolitana* argC, argJ genes and partial argH, argBgenes.] |
| Contig151G | 21722937_f1_11 | 3167 | 7293 | 2283 | 760 | 1004 | 1.20E−175 | sp:[LN:PHLN_PSEAE] [AC:P15713] [GN:PLCN] [OR:*PSEUDOMONAS AERUGINOSA*] [EC:3.1.4.3] [DE:(PHOSPHATIDYLCHOLINE CHOLINEPHOSPHOHYDROLASE)] [SP:P15713] |
| Contig151G | 21876907_f2_150 | 3168 | 7294 | 579 | 192 | | | NO-HIT |
| Contig151G | 21928753_f3_382 | 3169 | 7295 | 1080 | 359 | 813 | 5.10E−81 | sp:[LN:AROF_ECOLI] [AC:P00888] [GN:AROF] [OR:*ESCHERICHIA COLI*] [EC:4.1.2.15] [DE:SYNTHETASE) (3-DEOXY-D-ARABINO-HEPTULOSONATE 7-PHOSPHATE SYNTHASE)] [SP:P00888] |
| Contig151G | 22038953_f1_45 | 3170 | 7296 | 1263 | 420 | 400 | 3.00E−37 | sp:[LN:KYNU_RAT] [AC:P70712] [OR:*RATTUS NORVEGICUS*] [EC:3.7.1.3] [DE:KYNURENINASE, (L-KYNURENINE HYDROLASE)] [SP:P70712] |
| Contig151G | 22072218_f1_78 | 3171 | 7297 | 918 | 305 | 274 | 6.70E−24 | sp:[LN:FEAR_ECOLI] [AC:Q47129] [GN:FEAR:MAOR:MAOB] [OR:*ESCHERICHIA COLI*] [DE:TRANSCRIPTIONAL ACTIVATOR FEAR] [SP:Q47129] |

TABLE 2-continued

| Query | Orf | NT ID | AA ID | NT Lgth | AA Lgth | Score | P-value | Subject |
|---|---|---|---|---|---|---|---|---|
| Contig151G | 22079457_c3_1014 | 3172 | 7298 | 393 | 130 | 177 | 1.30E−13 | gp:[GI:g3228382] [LN:CVU84760] [AC:U84760] [PN:DsrE] [GN:dsrE] [OR:*Chromatium vinosum*] [DE:*Chromatium vinosum* dissimilatory siroheme sulfite reductase alphasubunit (dsrA), dissimilatory siroheme sulfite reductase betasubunit (dsrB), DsrE (dsrE), DsrF (dsrF), DsrH (dsrH), DsrC (dsrC),DsrM (dsrM), and DsrK (dsrK) genes, complete cds.] [NT:similar to YheN: SwissProt Accession Number P45532] |
| Contig151G | 22131892_c1_555 | 3173 | 7299 | 183 | 60 | | | NO-HIT |
| Contig151G | 22270893_c2_869 | 3174 | 7300 | 1611 | 536 | 1381 | 3.30E−141 | pir:[LN:G70938] [AC:G70938] [PN:probable fadA2 protein] [GN:fadA2] [OR:*Mycobacterium tuberculosis*] |
| Contig151G | 22300162_f1_49 | 3175 | 7301 | 1233 | 410 | 814 | 4.00E−81 | pir:[LN:G70301] [AC:G70301] [PN:N-acetylornithine aminotransferase] [GN:argD] [OR:*Aquifex aeolicus*] |
| Contig151G | 22353177_c2_815 | 3176 | 7302 | 474 | 157 | 233 | 1.50E−19 | sp:[LN:Y531_METJA] [AC:Q57951] [GN:MJ0531] [OR:*METHANOCOCCUS JANNASCHII*] [DE:HYPOTHETICAL PROTEIN MJ0531] [SP:Q57951] |
| Contig151G | 22366568_c2_765 | 3177 | 7303 | 1323 | 440 | 402 | 1.80E−37 | gp:[GI:g3253207] [LN:AF029714] [AC:AF029714;Z71175] [PN:PhaK] [GN:phaK] [OR:*Pseudomonas putida*] [DE:*Pseudomonas putida* repressor (phaN), regulatory protein (phaM), enoyl-CoA hydratase I (phaA), enoyl-CoA hydratase II (phaB), 3-hydroxyacyl-CoA dehydrogenase (phaC), ketothiolase (phaD), phenylacetyl-CoA ligase (phaE), ring-oxidation complex protein 1(phaF), ring-oxidation complex protein 2 (phaG), ring-oxidationcomplex protein 3(phaH), ring-oxidation complex protein 4(phaI), permease (phaJ), channel-forming protein (phaK), and ring-openingenzyme (phaL) genes, complete cds.] [NT:Channel-forming protein] |
| Contig151G | 22447125_c3_985 | 3178 | 7304 | 1305 | 434 | 1381 | 3.30E−141 | sp:[LN:BRAZ_PSEAE] [AC:P25185] [GN:BRAZ] [OR:*PSEUDOMONAS AERUGINOSA*] [DE:(LIV-III)] [SP:P25185] |
| Contig151G | 22460887_f3_418 | 3179 | 7305 | 216 | 71 | | | NO-HIT |
| Contig151G | 22471912_f1_122 | 3180 | 7306 | 687 | 228 | 126 | 4.40E−07 | pir:[LN:B70391] [AC:B70391] [PN:transcription regulator TetR/AcrR family] [GN:acrRI] [OR:*Aquifex aeolicus*] |
| Contig151G | 22477181_f2_295 | 3181 | 7307 | 222 | 73 | 128 | 2.00E−08 | sp:[LN:TTR_PSESY] [AC:P16966] [GN:TTR] [OR:*PSEUDOMONAS SYRINGAE*] [EC:2.3.1.-] [DE:ACETYLTRANSFERASE. (TABTOXIN RESISTANCE PROTEIN)] [SP:P16966] |
| Contig151G | 22533438_c1_626 | 3182 | 7308 | 186 | 61 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 22663907_f1_68 | 3183 | 7309 | 765 | 254 | 1223 | 1.80E−124 | gp:[GI:g141782] [LN:ACCPCAOP] [AC:L05770:U04359:M33798:U20284:U11554:L13114:L03407] [PN:protocatechuate 3,4-dioxygenase beta subunit] [GN:pcaH] [OR:Acinetobacter sp. ADPI] [EC:1.99.2.3] [DE:Acinetobacter sp. ADPI pca-qui-pob supraoperonic cluster, completesequence.] [NT:PO] |
| Contig151G | 22673793_f1_140 | 3184 | 7310 | 1023 | 340 | 408 | 4.20E−38 | sp:[LN:MRKD_KLEPN] [AC:P21648] [GN:MRKD] [OR:*KLEBSIELLA PNEUMONIAE*] [DE:FIMBRIA ADHESIN PROTEIN PRECURSOR] [SP:P21648] |
| Contig151G | 22771890_f2_263 | 3185 | 7311 | 744 | 247 | 206 | 1.10E−16 | pir:[LN:D70044] [AC:D70044] [PN:transcription regulator GntR family homolog yvoA] [GN:yvoA] [CL:transcription regulator GntR] [OR:*Bacillus subtilis*] |
| Contig151G | 22845327_f2_289 | 3186 | 7312 | 1548 | 515 | 971 | 9.30E−98 | pir:[LN:B71726] [AC:B71726) [PN:multidrug resistance protein B (emrB) RP157] [GN:emrB:RP157] [OR:*Rickettsia prowazekii*] |
| Contig151G | 22860802_c3_882 | 3187 | 7313 | 933 | 310 | 423 | 1.10E−39 | pir:[LN:B69445] [AC:B69445] [PN:conserved hypothetical protein AF1563] [OR:*Archaeoglobus fulgidus*] |
| Contig151G | 22928427_f1_27 | 3188 | 7314 | 528 | 175 | 320 | 9.00E−29 | pir:[LN:F70918] [AC:F70918] [PN:probable regulatoryprotein] [GN:Rv3095] [OR:*Mycobacterium tuberculosis*] |
| Contig151G | 22931301_c3_928 | 3189 | 7315 | 1398 | 465 | 578 | 4.10E−56 | sp:[LN:ILL2_ARATH) [AC:P54970] [GN:ILL2] [OR:*ARABIDOPSIS THALIANA*] [SR:,MOUSE-EAR CRESS] [DE:IAA-AMINO ACID HYDROLASE HOMOLOG 2 PRECURSOR] [SP:P54970] |
| Contig151G | 23443912_f1_62 | 3190 | 7316 | 432 | 143 | | | NO-HIT |
| Contig151G | 23444517_c3_940 | 3191 | 7317 | 1050 | 349 | 1288 | 2.40E−131 | pir:[LN:S47293) [AC:S47293:S70086] [PN:catechol 1,2-dioxygenase,] [GN:catA] [CL:catechol 1,2-dioxygenase] [OR:*Acinetobacter catcoaceticus*] [EC:1.13.11.1] |
| Contig151G | 23474052_f2_294 | 3192 | 7318 | 285 | 94 | | | NO-HIT |
| Contig151G | 23522911_c2_703 | 3193 | 7319 | 264 | 87 | | | NO-HIT |
| Contig151G | 23557676_f3_423 | 3194 | 7320 | 1497 | 498 | 2221 | 3.20E−230 | sp:[LN:DHGB_ACICA] [AC:P13650] [GN:GDHB] [OR:*ACINETOBACTER CALCOACETICUS*] [EC:1.1.99.17] [DE:(EC 1.1.99.17)] [SP:P13650] |
| Contig151G | 23600206_f1_96 | 3195 | 7321 | 732 | 243 | 121 | 4.90E−05 | gp:[GI:g340613) [LN:LEIKPMURF2] [AC:L07545] [GN:MURF2] [OR:Kinetoplast Leishmania tarentolae] [SR:Kinetoplast Leishmania tarentolae (strain UC, organelle Kinetoplas] [DE:Leishmania tarentolae kinetoplast mitochondrial MURF2 edited mRNA,comptete cds.] [NT:A 'c' was inserted after nt 369 (= nt 10459 in] |
| Contig151G | 23634675_c1_505 | 3196 | 7322 | 681 | 226 | | | NO-HIT |
| Contig151G | 23634677_f2_291 | 3197 | 7323 | 1167 | 388 | | | NO-HIT |
| Contig151G | 23634702_f2_229 | 3198 | 7324 | 1170 | 389 | 457 | 2.70E−43 | pir:[LN:E70918] [AC:E70918] [PN:hypothetical protein Rv3094c] [GN:Rv3094c] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig151G | 23651512_f3_397 | 3199 | 7325 | 759 | 252 | 596 | 5.10E−58 | sp:[LN:YT29_MYCTU] [AC:P71564] [GN:MTCY10D7.29C] [OR:*MYCOBACTERIUM TUBERCULOSIS*] [EC:1.—.—.—] [DE:PUTATIVE OXIDOREDUCTASE CY10D7.29C,] [SP:P71564] |
| Contig151G | 23703330_f3_389 | 3200 | 7326 | 1398 | 465 | 2040 | 4.90E−211 | gp:[GI:g3172116] [LN:ACCPCAOP] [AC:L05770:U04359:M33798:U20284:U11554:L13114:L03407] [PN:putative transport protein] [GN:pcaK] [OR:Acinetobacter sp. ADP1] [DE:Acinetobacter sp. ADP1 pca-qui-pob supraoperonic cluster, completesequence.] |
| Contig151G | 23710952_c2_810 | 3201 | 7327 | 420 | 139 | 249 | 3.00E−21 | sp:[LN:GLCG_ECOLI] [AC:P45504] [GN:GLCG] [OR:*ESCHERICHIA COLI*] [DE:GLCG PROTEIN] [SP:P45504] |
| Contig151G | 23712762_c1_571 | 3202 | 7328 | 720 | 239 | 288 | 2.20E−25 | sp:[LN:DGOR_ECOLI) [AC:P31460:P76735:O32529] [GN:DGOR] [OR:*ESCHERICHIA COLI*] [DE:GALACTONATE OPERON TRANSCRIPTIONAL REPRESSOR) [SP:P31460:P76735:O32529] |
| Contig151G | 23720912_f2_253 | 3203 | 7329 | 942 | 313 | 359 | 6.60E−33 | gp:[GI:g1139588] [LN:HIU20964] [AC:U20964] [PN:ORF2] [OR:*Haemophilus influenzae*] [DE:*Haemophilus influenzae* DNA topoisomerase I (topA) gene, completecds, putative pyridine nucleotide transhydrogenase beta subunit(pntB) gene, partial cds, ORF2 and ORF3 genes, complete cds and putative threonyl-tRNA synthetase (thrS) gene, partial cds.] [NT:ORF2 has a predicted molecular weight of 34.5 kd and] |
| Contig151G | 23726588_f1_32 | 3204 | 7330 | 1026 | 341 | 533 | 2.40E−51 | sp:[LN:GALE_BACSU] [AC:P55180] [GN:GALE] [OR:*BACILLUS SUBTILIS*] [EC:5.1.3.2] [DE:GALACTOSE 4-EPIMEPASE)] [SP:P55180] |
| Contig151G | 23850336_f1_35 | 3205 | 7331 | 474 | 157 | | | NO-HIT |
| Contig151G | 23954700_c2_831 | 3206 | 7332 | 1557 | 518 | 1578 | 4.40E−162 | sp:[LN:NTRC_ECOLI] [AC:P06713] [GN:GLNG:NTRC:GLNT] [OR:*ESCHERICHIA COLI*] [DE:NITROGEN REGULATION PROTEIN NR(1)] [SP:P06713) |
| Contig151G | 24067537_c1_489 | 3207 | 7333 | 1593 | 530 | 1230 | 3.30E−125 | pir:[LN:C70655] [AC:C70655] [PN:probable monooxygenase] [GN:Rv3854c] [OR:*Mycobacterium tuberculosis*] |
| Contig151G | 24071001_c3_1044 | 3208 | 7334 | 351 | 117 | 104 | 7.50E−05 | sp:[LN:Y190_HELPY] [AC:P56117] [GN:HP0190] [OR:*HELICOBACTER PYLORI*] [SR:,*CAMPYLOBACTER PYLORI*] [DE:HYPOTHETICAL PROTEIN HP0190] [SP:P56117] |
| Contig151G | 24100427_c2_718 | 3209 | 7335 | 207 | 68 | | | NO-HIT |
| Contig151G | 24218780_c3_930 | 3210 | 7336 | 1323 | 440 | 742 | 1.70E−73 | pir:[LN:F70982] [AC:F70982] [PN:probable dehydrogenase] [GN:Rv1812c] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig151G | 24218902_f3_405 | 3211 | 7337 | 1518 | 505 | 1094 | 8.60E−111 | sp:[LN:FEAB_ECOLI] [AC:P80668:P46884:P77637:O32 557] [GN:FEAB:PADA:MAOB] [OR:*ESCHERICHIA#COLI*] [EC:1.2.1.39] [DE:PHENYLACETALDEHYDE DEHYDROGENASE, (PAD)] [SP:P80668:P46884:P77637:O32557] |
| Contig151G | 24225000_c1_681 | 3212 | 7338 | 240 | 79 | | | NO-HIT |
| Contig151G | 24225052_f2_189 | 3213 | 7339 | 261 | 86 | | | NO-HIT |
| Contig151G | 24227212_c1_558 | 3214 | 7340 | 186 | 61 | | | NO-HIT |
| Contig151G | 24236375_f2_271 | 3215 | 7341 | 1290 | 429 | | | NO-HIT |
| Contig151G | 24256952_c1_567 | 3216 | 7342 | 438 | 145 | 186 | 1.40E−14 | gp:[GI:g1841790] [LN:SPU86147] [AC:U86147] [PN:mercuric resistance operon regulatory protein] [GN:merR] [OR:Synechococcus PCC7942] [DE:Synechococcus PCC7942 UDP-N-acetylmuramate-alanine ligase (murC)gene, partial cds, UDP-N-acetylenolpyruvylglucosamine reductase(murB), and mercuric resistance operon regulatory protein (merR)genes, complete cds.] |
| Contig151G | 24265811_c3_1042 | 3217 | 7343 | 471 | 156 | 241 | 2.10E−20 | sp:[LN:Y531_METJA] [AC:Q57951] [GN:MJ0531] [OR:*METHANOCOCCUS JANNASCHII*] [DE:HYPOTHETICAL PROTEIN MJ0531] [SP:Q57951] |
| Contig151G | 24299002_c2_806 | 3218 | 7344 | 294 | 97 | 96 | 7.50E−05 | pir:[LN:S57899] [AC:S57899:S50869] [PN:hypothetical protein I] [OR:*Pseudomonas aeruginosa*] |
| Contig151G | 24300017_f1_126 | 3219 | 7345 | 954 | 317 | 224 | 8.30E−18 | sp:[LN:MPC2_ALCEU] [AC:P17296] [GN:MCPII] [OR:*ALCALIGENES EUTROPHUS*] [EC:1.13.11.2] [DE:DIOXYGENASE II)] [SP:P17296] |
| Contig151G | 24322188_f3_315 | 3220 | 7346 | 207 | 68 | | | NO-HIT |
| Contig151G | 24328128_f2_272 | 3221 | 7347 | 4860 | 1619 | 438 | 2.60E−36 | sp:[LN:FRPC_NEIME] [AC:P55127] [GN:FRPC] [OR:*NEISSERIA MENINGITIDIS*] [DE:IRON-REGULATED PROTEIN FRPC] [SP:P55127] |
| Contig151G | 24339463_f1_103 | 3222 | 7348 | 1413 | 470 | 268 | 7.40E−21 | sp:[LN:YHAU_ECOLI] [AC:P42613] [GN:YHAU] [OR:*ESCHERICHIA COLI*] [DE:HYPOTHETICAL 49.0 KD PROTEIN IN RNPB-SOHA INTERGENIC REGION] [SP:P42613] |
| Contig151G | 24392337_c3_920 | 3223 | 7349 | 1800 | 599 | 721 | 2.90E−71 | pir:[LN:S76895] [AC:S76895] [PN:hypothetical protein] [CL:dihydroxy-acid dehydratase] [OR:Synechocystis sp.] [SR:PCC 6803,,PCC 6803] [SR:PCC 6803,] |
| Contig151G | 24395642_c2_711 | 3224 | 7350 | 219 | 72 | | | NO-HIT |
| Contig151G | 24406327_f1_14 | 3225 | 7351 | 1062 | 353 | 631 | 9.90E−62 | sp:[LN:MURB_HAEIN] [AC:P44605] [GN:MURB:H10268] [OR:*HAEMOPHILUS INFLUENZAE*] [EC:1.1.1.158] [DE:ACETYLMURAMATE DEHYDROGENASE)] [SP:P44605] |
| Contig151G | 24413427_f2_224 | 3226 | 7352 | 1383 | 460 | 2004 | 3.20E−207 | pir:[LN:139524] [AC:139524] [PN:probable porin] [GN:quiX] [CL:*Pseudomonas porin* oprB] [OR:*Acinetobacter calcoaceticus*] |

TABLE 2-continued

| Query | Orf | NT ID | AA ID | NT Lgth | AA Lgth | Score | P-value | Subject |
|---|---|---|---|---|---|---|---|---|
| Contig151G | 24414578_f3_358 | 3227 | 7353 | 183 | 60 | 107 | 3.30E−06 | sp:[LN:YCGJ_ECOLI] [AC:P76001] [GN:YCGJ] [OR:*ESCHERICHIA COLI*] [DE:HYPOTHETICAL 13.4 KD PROTEIN IN MINC-SHEA INTERGENIC REGION PRECURSOR] [SP:P76001] |
| Contig151G | 24415927_f1_26 | 3228 | 7354 | 927 | 308 | 387 | 7.10E−36 | sp:[LN:MOCB_SYNP7j [AC:Q56208] [GN:MOACB] [OR:SYNECHOCOCCUS SP] [SR:PCC 7942,ANACYSTIS NIDULANS R2] [DE:MOLYBDENUM COFACTOR BIOSYNTHESIS PROTEIN CB] [SP:Q56208] |
| Contig151G | 24415937_f2_188 | 3229 | 7355 | 219 | 72 | 113 | 7.70E−07 | sp:[LN:YCGJ_ECOLI] [AC:P76001] [GN:YCGJ] [OR:*ESCHERICHIA COLI*] [DE:HYPOTHETICAL 13.4 KD PROTEIN IN MINC-SHEA INTERGENIC REGION PRECURSOR] [SP:P76001] |
| Contig151G | 24415952_f2_292 | 3230 | 7356 | 972 | 323 | 305 | 3.50E−27 | sp:[LN:PHO2_YARLI] [AC:P30887] [GN:PHO2] [OR:*YARROWIA LIPOLYTICA*] [SR:,*CANDIDA LIPOLYTICA*] [EC:3.1.3.2] [DE:ACID PHOSPHATASE PRECURSOR.] [SP:P30887] |
| Contig151G | 24422131_f3_334 | 3231 | 7357 | 1194 | 397 | 337 | 1.40E−30 | gp:[GI:e311274:g2072116] [LN:ECHCAT] [AC:Y11071] [PN:putative transporter of 3-phenylpropionic acid] [GN:hcaT] [OR:*Escherichia coli*] [DE:*E.coli* hcaT gene.] |
| Contig151G | 24492042_c1_631 | 3232 | 7358 | 2886 | 961 | 1241 | 1.70E−148 | sp:[LN:PTF1_RHOCA] [AC:P23388] [GN:FRUB(HI)] [OR:*RHODOBACTER CAPSULATUS*] [SR:,*RHODOPSEUDOMONAS CAPSULATA*] [EC:2.7.3.9:2.7.1.69] [DE:(EIII-FRU)]] [SP:P23388] |
| Contig151G | 24506313_f2_282 | 3233 | 7359 | 993 | 330 | 834 | 3.10E−83 | pir:[LN:139563] [AC:139563] [PN:hypothetical protein 5] [OR:*Alcaligenes eutrophus*] |
| Contig151G | 24507760_c3_877 | 3234 | 7360 | 1128 | 375 | 1751 | 2.10E−180 | pir:[LN:S75250] [AC:S75250] [PN:alcohol dehydrogenase, sll0990:class III alcohol dehydrogenase:protein sll0990:class III alcohol dehydrogenase:protein sll0990] [CL:alcohol dehydrogenase:long-chain alcohol dehydrogenase homology] [OR:Synechocystis sp.] [SR:PCC 6803,, PCC 6803] [SR:PCC 6803,] [EC:1.1.1.1] |
| Contig151G | 24507765_f2_226 | 3235 | 7361 | 1257 | 418 | 1002 | 4.80E−101 | gp:[GI:g1938424] [LN:CELK09H11] [AC:U97002] [GN:K09H11.1] [OR:*Caenorhabditis elegans*] [SR:*Caenorhabditis elegans* strain = Bristol N2] [DE:*Caenorhabditis elegans* cosmid K09H11.] [NT:similar to acyl-CoA dehydrogenases and epoxide] |
| Contig151G | 24510890_f2_270 | 3236 | 7362 | 693 | 230 | 358 | 8.40E−33 | gp:[GI:e1245739:g2808768] [LN:SC7H1] [AC:AL021411] [PN:transferase] [GN:SC7H1.10] [OR:*Streptomyces coelicolor*] [DE:*Streptomyces coelicolor* cosmid 7H1.] [NT:SC7H1.10, probable transferase, len: 219;] |

TABLE 2-continued

| Query | Orf | NT ID | AA ID | NT Lgth | AA Lgth | Score | P-value | Subject |
|---|---|---|---|---|---|---|---|---|
| Contig151G | 24641062_c1_503 | 3237 | 7363 | 681 | 226 | 111 | 0.00017 | gp:[GI:g1707290] [LN:BBU80960] [AC:U80960:L79960] [PN:putative outer surface protein] [GN:ospF] [OR:Borrelia burgdorferi] [SR:Lyme disease spirochete] [DE:Borrelia burgdorferi strain CA12 putative outer membrane protein(ospE) gene, complete cds and putative outer surface protein (ospF)gene, partial cds.] [RE: |
| Contig151G | 24641063_f1_98 | 3238 | 7364 | 318 | 105 | | | NO-HIT |
| Contig151G | 24644040_c1_593 | 3239 | 7365 | 927 | 308 | 254 | 8.90E−22 | gp:[GI:g3643996] [LN:AF087482] [AC:AF087482] [PN:putative regulatory protein] [GN:ohbR] [OR:Pseudomonas aeruginosa] [DE:Pseudomonas aeruginosa clcC and ohbH genes, Lys-R type regulatoryprotein (clcR), chlorocatechol-1,2-dioxygenase (clcA),chloromuconate cycloisomerase (clcB), dienetactone hydrolase (clcD), maleylacetate reductase (clcE), transposase (tnpA), ATP-binding protein (tnpB), putative regulatory protein (ohbR), o-halobenzoate dioxygenase reductase (ohbA), o-halobenzoatedioxygenase alpha subunit (ohbB), o-halobenzoate dioxygenase betasubunit (ohbC), o-halobenzoate dioxygenase ferredoxin (ohbD), putative membrane spanning protein (ohbE), ATP-binding protein (ohbF), putative substrate binding protein (ohbG), and putativedioxygenase genes, complete cds; and unknown gene.] [NT:similar to Lys-R type regulatory proteins.] |
| Contig151G | 24647175_c2_804 | 3240 | 7366 | 231 | 76 | | | NO-HIT |
| Contig151G | 24647632_c1_570 | 3241 | 7367 | 903 | 300 | | | NO-HIT |
| Contig151G | 24651640_c2_732 | 3242 | 7368 | 825 | 274 | 298 | 1.90E−26 | gp:[GI:e1331982:g4106613] [LN:YP102KB] [AC:AL031866] [OR:Yersinia pestis] [DE:Yersinia pestis 102 kbases unstable region: from 1 to 119443.] [NT:0RF45, len = 289, unknown] |
| Contig151G | 24796893_c3_983 | 3243 | 7369 | 549 | 182 | 364 | 2.00E−33 | sp [LN:YDHD_ECOLI] [AC:P37010:P77424] [GN:YDHD] [OR:ESCHERICHIA COLI] [DE:12.9 KD PROTEIN IN LHR-SODB INTERGENIC REGION] [SP:P37010:P77424] |
| Contig151G | 24814682_c3_969 | 3244 | 7370 | 693 | 230 | 447 | 3.10E−42 | sp:[LN:YCAP_ECOLI) [AC:P75839] [GN:YCAP] [OR:ESCHERICHIA COLI) [DE:HYPOTHETICAL 26.3 KD PROTEIN IN FOCA-SERC INTERGENIC REGION] [SP:P75839] |
| Contig151G | 24900936_f1_3 | 3245 | 7371 | 501 | 166 | 309 | 1.30E−27 | gp:[GI:g1816639] [LN:BJU85623] [AC:U85623] [PN:leucine-responsive regulatory protein] [GN:lrp] [FN:transcription regulator] [OR:Bradyrhizobium japonicum] [DE:Bradyrhizobium japonicum leucine-responsive regulatory protein(lrp) gene, complete cds.] [NT:LRP] |

TABLE 2-continued

| Query | Orf | NT ID | AA ID | NT Lgth | AA Lgth | Score | P-value | Subject |
|---|---|---|---|---|---|---|---|---|
| Contig151G | 25392915_f3_388 | 3246 | 7372 | 819 | 272 | 916 | 6.30E-92 | gp:[GI:g3172115] [LN:ACCPCAOP] [AC:L05770:U04359:M33798:U20284:U11554:L13114:L03407] [PN:beta-ketoadipate enol-lactone hydrolase] [GN:pcaD] [OR:Acinetobacter sp. ADP1] [EC:3.1.1.24] [DE:Acinetobacter sp. ADP1 pca-qui-pob supraoperonic cluster, completesequence.] [NT:ELH] |
| Contig151G | 25595068_f3_392 | 3247 | 7373 | 1464 | 487 | 2155 | 3.20E-223 | pir:[LN:139523] [AC:139523] [PN:dehydroshikimate dehydratase.] [GN:quiC] [OR:*Acinetobacter calcoaceticus*] [EC:4.2.1.—] |
| Contig151G | 25648337_f2_163 | 3248 | 7374 | 2574 | 857 | 2724 | 1.60E-283 | sp:[LN:NIRB_KLEPN] [AC:Q06458] [GN:NASB] [OR:*KLEBSIELLA PNEUMONIAE*] [EC:1.6.6.4] [DE:NITRITE REDUCTASE (NAD(P)H) LARGE SUBUNIT,] [SP:Q06458] |
| Contig151G | 25915888_f2_144 | 3249 | 7375 | 231 | 76 | | | NO-HIT |
| Contig151G | 25955086_c1_501 | 3250 | 7376 | 270 | 89 | | | NO-HIT |
| Contig151G | 25980288_c1_646 | 3251 | 7377 | 1128 | 375 | 655 | 2.80E-64 | sp:[LN:NTRB_VIBAL] [AC:P19906] [GN:NTRB] [OR:VIBRIO ALGINOLYTICUS] [EC:2.7.3.—] [DE:NITROGEN REGULATION PROTEIN NTRB,] [SP:P19906] |
| Contig151G | 26031915_f1_77 | 3252 | 7378 | 1002 | 333 | 432 | 1.20E-40 | sp:[LN:NTAB_CHEHE] [AC:P54990] [GN:NTAB:NMOB] [OR:CHELATOBACTER HEINTZII] [EC:1.14.13.—] [DE:MONOOXYGENASE COMPONENT B)(NTA-MO B)] [SP:P54990] |
| Contig151G | 26032830_f3_353 | 3253 | 7379 | 780 | 259 | 740 | 2.80E-73 | gp:[GI:d1033306:g3417448] [LN:AB010087] [AC:AB010087] [PN:UMP kinase] [GN:pyrH] [OR:*Pseudomonas aeruginosa*] [SR:*Pseudomonas aeruginosa* (strain:PAO1) DNA] [DE:*Pseudomonas aeruginosa* rpsB, tsf, pyrH, frr genes for ribosomalprotein S2, elongation factor Ts, UMP kinase, ribosome recyclingfactor, complete cds.] |
| Contig151G | 260942_c1_499 | 3254 | 7380 | 648 | 215 | 286 | 2.80E-24 | sp:[LN:Y002_MYCTU] [AC:Q10384] [GN:MTCY190.02] [OR:MYCOBACTERIUM TUBERCULOSIS] [DE:HYPOTHETICAL 69.2 KD PROTEIN CY190.02] [SP:Q10384] |
| Contig151G | 26172005_f1_95 | 3255 | 7381 | 618 | 205 | 118 | 5.90E-06 | pir:[LN:G70325] [AC:G70325] [PN:transcription regulator TetR/AcrR family] [GN:acrR3] [OR:*Aquifex aeolicus*] |
| Contig151G | 26174076_f3_447 | 3256 | 7382 | 828 | 275 | 297 | 2.50E-26 | pir:[LN:S75926] [AC:S75926] [PN:hypothetical protein] [OR:Synechocystis sp.] [SR:PCC 6803, , PCC 6803] [SR:PCC 6803,] |
| Contig151G | 26207805_f2_306 | 3257 | 7383 | 1344 | 447 | 681 | 5.00E-67 | sp:[LN:ACRE_ECOLI] [AC:P24180] [GN:ACRE:ENVC] [OR:*ESCHERICHIA COLI*] [DE:ACRIFLAVIN RESISTANCE PROTEIN E PRECURSOR (ENVC PROTEIN)] [SP:P24180] |

TABLE 2-continued

| Query | Orf | NT ID | AA ID | NT Lgth | AA Lgth | Score | P-value | Subject |
|---|---|---|---|---|---|---|---|---|
| Contig151G | 26369028_f2_171 | 3258 | 7384 | 492 | 163 | 246 | 6.20E−21 | gp:[GI:g4262373] [LN:AF091871] [AC:AF091871] [PN :molybdopterin-synthase large subunit] [GN:MOCS2] [FN:molybdenum cofactor biosynthesis] [OR:*Homo sapiens*] [DE:*Homo sapiens* molybdopterin-synthase small and large subunit (MOCS2)bicistronic mRNA, complete cds.] [NT:MOCS2B] |
| Contig151G | 26445292_f2_198 | 3259 | 7385 | 207 | 68 | | | NO-HIT |
| Contig151G | 26578192_f3_396 | 3260 | 7386 | 822 | 273 | | | NO-HIT |
| Contig151G | 26597705_c1_661 | 3261 | 7387 | 426 | 141 | 257 | 4.30E−22 | gp:[GI:g1399830] [LN:SPU59235] [AC:U59235] [PN:biotin carboxyl carrier protein] [GN:accB] [OR:Synechococcus PCC7942] [DE:Synechococcus PCC7942 ORF327, ORF249, ORF376, elongation factor P(efp), biotin carboxyl carrier protein (accB), ORF1000, and ORF409genes, complete cds.] [NT:the only biotin-containing protein in Synechococcus] |
| Contig151G | 26750211_f2_233 | 3262 | 7388 | 504 | 167 | 132 | 7.50E−09 | gp:[GI:e311034:g758211] [LN:PCCBDABC] [AC:X79076] [PN:2-halobenzoate 1,2-dioxygenase] [GN:cbdB] [OR:*Burkholderia cepacia*] [DE:*P.cepacia* (2CBS) cbdA, cbdB and cbdC genes.] |
| Contig151G | 26752177_f1_37 | 3263 | 7389 | 573 | 190 | 617 | 3.00E−60 | gp:[GI:d1033307:g3417449] [LN:AB010087] [AC:AB010087] [PN:ribosome recycling factor] [GN:frr] [OR:*Pseudomonas aeruginosa*] [SR:*Pseudomonas aeruginosa* (strain:PAO1) DNA] [DE:*Pseudomonas aeruginosa* rpsB, tsf, pyrH, frr genes for ribosomalprotein S2, elongation factor Ts, UMP kinase, ribosome recyclingfactor, complete cds.] |
| Contig151G | 26753175_f2_223 | 3264 | 7390 | 873 | 290 | 936 | 4.80E−94 | pir:[LN:139522] [AC:139522] [PN:3-dehydroquinate dehydratase,, catabolic] [GN:quiB] [CL:3-dehydroquinate dehydratase:3-dehydroquinate dehydratase homology] [OR:*Acinetobacter calcoaceticus*] [EC:4.2.1.10] |
| Contig151G | 26775312_f1_2 | 3265 | 7391 | 360 | 119 | 132 | 1.60E−07 | sp:[LN:ATMA_SALTY] [AC:P36640] [GN:MGTA] [OR:*SALMONELLA TYPHIMURIUM*] [EC:3.6.1.—] [DE:MG(2+) TRANSPORT ATPASE, P-TYPE 1,] [SP:P36640] |
| Contig151G | 26828193_f3_474 | 3266 | 7392 | 1296 | 431 | 501 | 7.60E−66 | gp:[GI:g598251] [LN:MBOOMPE] [AC:L31788] [PN:outer membrane protein E] [OR:*Moraxella catarrhalis*] [SR:*Moraxella catarrhalis* (strain 25240) DNA] [DE:*Moraxella catarrhalis* outer membrane protein E gene, complete cds.] |
| Contig151G | 26830318_f2_222 | 3267 | 7393 | 1224 | 407 | 1770 | 2.00E−182 | gp:[GI:g141777] [LN:ACCPCAOP) [AC:L05770:U04359:M33798:U20284:U11554:L13114:L03407] [PN:beta-ketoadipyl CoA thiolase] [GN:pcaF] [OR:Acinetobacter sp. ADP1) [EC:3.1.2.000] [DE:Acinetobacter sp. ADP1 pca-qui-pob supraoperonic cluster, completesequence.] |

TABLE 2-continued

| Query | Orf | NT ID | AA ID | NT Lgth | AA Lgth | Score | P-value | Subject |
|---|---|---|---|---|---|---|---|---|
| Contig151G | 26831250_c1__679 | 3268 | 7394 | 1200 | 399 | 797 | 2.60E−79 | pir:[LN:D64895] [AC:D64895] [PN:probable membrane protein b1433] [OR:*Escherichia coli*] |
| Contig151G | 281282_f2__196 | 3269 | 7395 | 189 | 62 | | | NO-HIT |
| Contig151G | 2853167_c1__680 | 3270 | 7396 | 1632 | 543 | 523 | 2.80E−50 | pir:[LN:S44975] [AC:S69834:S44975] [PN:lmrC protein] [GN:lmrC] [CL:ATP-binding cassette homology] [OR:*Streptomyces lincolnensis*] |
| Contig151G | 2867253_c1__493 | 3271 | 7397 | 774 | 257 | 392 | 2.10E−36 | sp:[LN:YCBL_BACSU] [AC:P42244] [GN:YCBL] [OR:BACILLUS SUBTILIS] [DE:HYPOTHETICAL 25.8 KD SENSORY TRANSDUCTION PROTEIN (ORF11)] [SP:P42244] |
| Contig151G | 2929206_f2__209 | 3272 | 7398 | 189 | 62 | | | NO-HIT |
| Contig151G | 29301632_c2__859 | 3273 | 7399 | 642 | 213 | 143 | 5.10E−10 | gp:[GI:g3293540] [LN:AF072709] [AC:AF072709] [PN:putative transcriptional regulator] [OR:*Streptomyces lividans*] [DE:*Streptomyces lividans* amplifiable element AUD4: putativetranscriptional regulator, putative ferredoxin, putative cytochromeP450 oxidoreductase, and putative oxidoreductase genes, completecds; and unknown genes.] [NT:ORF2; similar to transcriptional repressor] |
| Contig151G | 2933127_f1__65 | 3274 | 7400 | 729 | 242 | 453 | 7.20E−43 | sp:[LN:YGBP_HAEIN] [AC:O05029] [GN:HI0672] [OR:*HAEMOPHILUS INFLUENZAE*] [DE:HYPOTHETICAL PROTEIN HI0672] [SP:O05029] |
| Contig151G | 29354807_f2__151 | 3275 | 7401 | 1314 | 437 | 342 | 2.80E−40 | pir:[LN:A44832] [AC:A44832] [PN:esterase estA] [OR:Pseudomonas sp.] |
| Contig151G | 2938125_c2__853 | 3276 | 7402 | 603 | 200 | 305 | 3.50E−27 | pir:[LN:S52249] [AC:S70540:S52249] [PN:response regulator nasT] [GN:nasT] [CL:response regulator homology] [OR:*Azotobacter vinelandii*] |
| Contig151G | 29421890_f2__211 | 3277 | 7403 | 3027 | 1008 | 1175 | 2.20E−119 | gp:[GI:g4377308] [LN:AE001678] [AC:AE001678:AE001363] [PN:Zinc Metalloprotease (insulinase family)] [GN:CPn0981] [OR:*Chlamydia pneumoniae*] [DE:*Chlamydia pneumoniae* section 94 of 103 of the complete genome.] |
| Contig151G | 29459837_c2__839 | 3278 | 7404 | 363 | 120 | | | NO-HIT |
| Contig151G | 29488387_f1__111 | 3279 | 7405 | 846 | 281 | 416 | 6.00E−39 | sp:[LN:YC72_HAEIN] [AC:Q57243:O05049] [GN:HI1272] [OR:*HAEMOPHILUS INFLUENZAE*] [DE:HYPOTHETICAL ABC TRANSPORTER ATP-BINDING PROTEIN HI1272] [SP:Q57243:O05049] |
| Contig151G | 29854192_f1__56 | 3280 | 7406 | 699 | 232 | 156 | 960E−17 | gp:[GI:g4155298] [LN:AE001505] [AC:AE001505:AE001439] [PN:putative] [6N:jhp0742] [OR:*Helicobacter pylori* J99] [DE:*Helicobacter pylori*, strain J99 section 66 of 132 of the completegenome.] [NT:similar to *H. pylori* 26695 gene HP0806] |

TABLE 2-continued

| Query | Orf | NT ID | AA ID | NT Lgth | AA Lgth | Score | P-value | Subject |
|---|---|---|---|---|---|---|---|---|
| Contig151G | 29901017_f1_108 | 3281 | 7407 | 900 | 299 | 604 | 7.20E−59 | gp:[6I:d1035162:g3845577] [LN:AB015439] [AC:AB015439] [PN:D-threonine dehydrogenase] [GN:dtdS] [OR:*Pseudomonas cruciviae*] [SR:*Pseudomonas cruciviae* (strain:IFO12047)DNA] [DE:*Pseudomonas cruciviae* gene for D-threonine dehydrogenase, partialcds.] [RE: |
| Contig151G | 30470890_c1_674 | 3282 | 7408 | 615 | 204 | 110 | 0.00015 | gp:[GI:e1420006:g4539179] [LN:SC6A5] [AC:AL049485] [PN:putative transcriptional regulator] [6N:SC6A5.24c] [OR:*Streptomyces coelicolor*] [DE:*Streptomyces coelicolor* cosmid 6A5.] [NT:SC6A5.24c, probable transcriptional regulator, len:] |
| Contig1516 | 30503512_c2_807 | 3283 | 7409 | 432 | 143 | | | NO-HIT |
| Contig151G | 30735912_f3_321 | 3284 | 7410 | 735 | 244 | 398 | 4.90E−37 | sp:[LN:Y014_SYNY3] [AC:Q57208] [6N:SLR0014] [OR:SYNECHOCYSTIS SP] [SR:PCC 6803,] [DE:HYPOTHETICAL 25.5 KD PROTEIN SLR0014] [SP:Q57208] |
| Contig151G | 31269787_c1_638 | 3285 | 7411 | 519 | 172 | 228 | 5.00E−19 | sp:[LN:RECX_VIBCH] [AC:Q56647] [GN:RECX] [OR:*VIBRIO CHOLERAE*] [DE:REGULATORY PROTEIN RECX] [SP:Q56647] |
| Contig151G | 31445302_f2_288 | 3286 | 7412 | 1098 | 365 | 460 | 1.30E−43 | gp:[G1:g3414725] [LN:AF047693] [AC:AF047693] [PN:multidrug resistance efflux pump homolog PmrA] [GN:pmrA] [OR:*Pseudomonas aeruginosa*] [DE:*Pseudomonas aeruginosa* multidrug resistance efflux pump homologPmrA (pmrA) and multidrug resistance efflux pump homolog PmrB(pmrB) genes, complete cds.] [NT:membrane fusion protein; similar to EmrA of] |
| Contig151G | 3151875_c2_860 | 3287 | 7413 | 1731 | 576 | 738 | 7.10E−88 | pir:[LN:C69794] [AC:C69794] [PN:glutamate synthase (ferredoxin) homolog yerD] [GN:yerD] [OR:*Bacillus subtilis*] |
| Contig151G | 31645682_c3_888 | 3288 | 7414 | 594 | 197 | 158 | 1.30E−11 | pir:[LN:C70065] [AC:C70065] [PN:transcription regulator MarR family homolog ywoH] [GN:ywoH] [OR:*Bacillus subtilis*] |
| Contig151G | 3166031_f3_403 | 3289 | 7415 | 843 | 280 | 355 | 1.80E−32 | sp:[LN:FABG_ECOLI] [AC:P25716:P78221] [GN:FABG] [OR:*ESCHERICHIA COLI*] [EC:1.1.1.100] [DE:ACYL CARRIER PROTEIN REDUCTASE)] [SP:P25716:P78221] |
| Contig151G | 3183552_f3_325 | 3290 | 7416 | 915 | 304 | 382 | 2.40E−35 | gp:[GI:e1287199:g3063881] [LN:MLCB1883] [AC:AL022486] [PN:hypothetical protein MLCB1883.17c] [GN:MLCB1883.17c] [OR:*Mycobacterium leprae*] [DE:*Mycobacterium leprae* cosmid B1883.] [NT:MLCB1883.17c, unknown, len: 280; equivalent to] |
| Contig151G | 32225001_c3_1011 | 3291 | 7417 | 351 | 116 | | | NO-HIT |
| Contig151G | 32454511_f1_58 | 3292 | 7418 | 420 | 139 | 272 | 1.10E−23 | sp:[LN:YLJA_ECOLI] [AC:P75832] [GN:YLJA] [OR:*ESCHERICHIA COLI*] [DE:12.2 KD PROTEIN IN CSPD-CLPA INTERGENIC REGION] [SP:P75832] |

TABLE 2-continued

| Query | Orf | NT ID | AA ID | NT Lgth | AA Lgth | Score | P-value | Subject |
|---|---|---|---|---|---|---|---|---|
| Contig151G | 32595337_f3_395 | 3293 | 7419 | 468 | 155 | 189 | 6.80E−15 | gp:[GI:g2822322] [LN:AF016485] [AC:AF016485] [OR:Halobacterium sp. NRC-1] [DE:Halobacterium sp. NRC-1 plasmid pNRC100, complete plasmid sequence.] [NT:ORF H0549; same as H1813 in IR-L] |
| Contig151G | 32656288_f3_446 | 3294 | 7420 | 651 | 216 | 289 | 3.10E−25 | sp:[LN:Y037_MYCPN] [AC:P75067] [OR:*MYCOPLASMA PNEUMONIAE*] [DE:HYPOTHETICAL PROTEIN MG037 HOMOLOG] [SP:P75067] |
| Contig151G | 32775_f3_320 | 3295 | 7421 | 2442 | 813 | 2585 | 8.60E−269 | sp:[LN:ATMA_ECOLI] [AC:P39168] [GN:MGTA:MGT:CORB] [OR:*ESCHERICHIA COLI*] [EC:3.6.1.—] [DE:MG(2+) TRANSPORT ATPASE, P-TYPE 1,] [SP:P39168] |
| Contig151G | 32785_c2_688 | 3296 | 7422 | 183 | 60 | | | NO-HIT |
| Contig151G | 33180_f3_460 | 3297 | 7423 | 210 | 60 | | | NO-HIT |
| Contig151G | 33193_c1_546 | 3298 | 7424 | 1020 | 339 | 598 | 3.10E−58 | pir:[LN:E71011] [AC:E71011] [PN:probable phosphoglycerate dehydrogenase] [GN:PH1387] [OR:*Pyrococcus horikoshii*] |
| Contig151G | 33212577_c2_783 | 3299 | 7425 | 504 | 167 | 147 | 1.00E−09 | gp:[GI:e1364429:g4138732] [LN:ZMPROPR] [AC:Y17332] [PN:proline-rich protein] [GN:PRP] [OR:*Zea mays*] [DE:*Zea mays* mRNA for proline-rich protein.] |
| Contig151G | 33334687_c2_698 | 3300 | 7426 | 1107 | 368 | 332 | 5.60E−30 | gp:[GI:g2182835] [LN:LLU81166] [AC:U81166] [PN:histidine kinase LlkinA] [GN:llkinA] [OR:*Lactococcus tactis cremoris*] [DE:*Lactococcus lactis* subsp. *cremoris* MG1363 histidine kinase (llkinA)gene, complete cds.] |
| Contig151G | 33360387_c2_833 | 3301 | 7427 | 1017 | 338 | 963 | 6.50E−97 | pir:[LN:OWPSAA] [AC:A32013] [PN:ornithine carbamoyltransferase,, anabolic:anabolic citrulline phosphorylase:anabolic ornithine transcarbamylase] [CL:ornithine carbamoyltransferase:aspartate/ornithine carbamoyltransferase homology] [OR:*Pseudomonas aeruginosa*] [EC:2.1.3.3] |
| Contig151G | 33365652_c1_506 | 3302 | 7428 | 642 | 213 | | | NO-HIT |
| Contig151G | 33400277_c1_500 | 3303 | 7429 | 435 | 144 | | | NO-HIT |
| Contig151G | 33401077_c2_719 | 3304 | 7430 | 885 | 294 | 367 | 9.40E−34 | sp[LN:YQHC_ECOLI] [AC:Q46855] [GN:YQHC] [OR:*ESCHERICHIA COLI*] [DE:HYPOTHETICAL TRANSCRIPTIONAL REGULATOR IN METC-SUF1 INTERGENIC REGION] [SP:Q46855] |
| Contig151G | 33438178_f3_350 | 3305 | 7431 | 204 | 67 | | | NO-HIT |
| Contig151G | 33458187_c1_648 | 3306 | 7432 | 234 | 77 | | | NO-HIT |
| Contig151G | 3367162_f2_192 | 3307 | 7433 | 1428 | 475 | 843 | 3.40E−84 | pir:[LN C69997] [AC:C69997] [PN probable proline transport protein:probable proline-specific permease] [GN.ytnA] [CL:arginine permease] [OR:*Bacillus subtilis*] |
| Contig151G | 33830052_f3_354 | 3308 | 7434 | 819 | 272 | 582 | 1.50E−56 | sp:[LN:YAES_ECOLI] [AC:Q47675:P75668] [GN:YAES] [OR:*ESCHERICHIA COLI*] [DE:HYPOTHETICAL 18.8 KD PROTEIN IN FRR-CDSA INTERGENIC REGION] [SP:Q47675:P75668] |
| Contig151G | 33838441_f3_332 | 3309 | 7435 | 201 | 66 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 33862526_c3_990 | 3310 | 7436 | 2118 | 705 | 673 | 3.50E−66 | pir:[LN:S74707] [AC:S74707] [PN:nitrogen fixation positive activator protein:protein slr1305:protein slr1305] [GN:nifL] [CL:response regulator homotogy] [OR:Synechocystis sp.] [SR:PCC 6803, , PCC 6803] [SR:PCC 6803,] |
| Contig151G | 33987830_f1_127 | 3311 | 7437 | 1188 | 395 | 292 | 8.30E−26 | gp:[GI:g987090] [LN:SHGCPIR] [AC:X86780] [GN:orfZ] [OR:*Streptomyces hygroscopicus*] [DE:*S.hygroscopicus* gene cluster for polyketide immunosuppressantrapamycin.] |
| Contig151G | 34017813_f1_71 | 3312 | 7438 | 1149 | 382 | 439 | 2.20E−41 | pir:[LN:B70801] [AC:B70801] [PN:probable fadE36 protein] [GN:fadE36] [OR:*Mycobacterium tuberculosis*] |
| Contig151G | 34173451_c3_924 | 3313 | 7439 | 906 | 301 | 367 | 9.40E−34 | sp:[LN:SM30_MOUSE] [AC:Q64374:Q60944] [GN:RGN:SMP30] [OR:*MUS MUSCULUS*] [DE:SENESCENCE MARKER PROTEIN-30 (SMP-30) (REGUCALCIN) (RC)] [SP:Q64374:Q60944] |
| Contig151G | 34179753_f3_316 | 3314 | 7440 | 630 | 209 | 622 | 8.90E−61 | gp:[GI:g32419751 [LN:SSU85710] [AC:U85710] [PN:transposase) [OR:*Sulfotobus solfataricus*] [DE:*Sulfolobus solfataricus* insertion element 1SC1041, transposasegene, complete cds.] |
| Contig151G | 34254761_c1_666 | 3315 | 7441 | 480 | 159 | 328 | 1.30E−29 | pir:[LN:G70903] [AC:G70903] [PN:hypothetical protein Rv0163] [GN:Rv0163] [OR:*Mycobacterium tuberculosis*] |
| Contig151G | 34381_c2_796 | 3316 | 7442 | 795 | 264 | 397 | 6.20E−37 | pir:[LN:C70005] [AC:C70005] [PN:conserved hypothetical protein yuaA] [GN:yuaA] [CL:conserved hypothetical protein MG323] [OR:*Bacillus subtilis*] |
| Contig151G | 34553177_f1_51 | 3317 | 7443 | 693 | 230 | | | NO-HIT |
| Contig151G | 34612765_c1_614 | 3318 | 7444 | 936 | 311 | 124 | 3.70E−11 | pir:[LN:D69790] [AC:D69790] [PN :probable halide peroxidase, ydjP] [GN:ydjP] [OR:*Bacillus subtilis*] [EC:1.11.1.—] |
| Contig151G | 34617058_f2_220 | 3319 | 7445 | 690 | 229 | 988 | 1.50E−99 | sp:[LN:PCAI_ACICA] [AC:Q43973:Q43933] [GN:PCAI:CATI] [OR:*ACINETOBACTER CALCOACETICUS*] [EC:2.8.3.6] [DE:KETOADIPATE:SUCCINYL COA TRANSFERASE)] [SP:Q43973:Q43933] |
| Contig151G | 34647183_c2_752 | 3320 | 7446 | 672 | 223 | 1043 | 2.20E−105 | pir:[LN:B44570] [AC:B44570] [PN:3-oxoadipate CoA-transferase, beta chain] [GN:catJ] [CL:3-oxoadipate CoA-transferase beta chain:3-oxoadipate CoA-transferase beta chain homology] [OR:*Acinetobacter calcoaccticus*] [EC:2.8.3.6] |
| Contig151G | 34647183_f2_221 | 3321 | 7447 | 672 | 223 | 1043 | 2.20E−105 | pir:[LN:B44570] [AC:B44570] [PN:3-oxoadipate CoA-transferase, beta chain] [GN:catJ] [CL:3-oxoadipate CoA-transferase beta chain:3-oxoadipate CoA-transferase beta chain homology] [OR:*Acinetobacter calcoaceticus*] [EC:2.8.3.6] |
| Contig151G | 34647311_f1_121 | 3322 | 7448 | 663 | 220 | | | NO-HIT |
| Contig151G | 34647837_f2_203 | 3323 | 7449 | 378 | 125 | | | NO-HIT |
| Contig151G | 35328276_f3_425 | 3324 | 7450 | 882 | 293 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 35969132_c2_795 | 3325 | 7451 | 1563 | 520 | 1282 | 1.00E−130 | pir:[LN:S77559] [AC:S77559] [PN:threonine dehydratase,:L-threonine deaminase:protein slr2072:L-threonine deaminase:protein slr2072] [GN:ilvA] [CL:threonine dehydratase] [OR:Synechocystis sp.] [SR:PCC 6803, , PCC 6803] [SR:PCC 6803,] [EC:4.2.1.16] |
| Contig151G | 36025302_f3_345 | 3326 | 7452 | 1236 | 411 | 488 | 1.40E−46 | sp:[LN:MOEA_HAEIN] [AC:P45210] [GN:MOEA:CHLE:HI1448] [OR:*HAEMOPHILUS INFLUENZAE*] [DE:MOLYBDOPTERIN BIOSYNTHESIS MOEA PROTEIN] [SP:P45210] |
| Contig151G | 36136677_f2_165 | 3327 | 7453 | 2799 | 932 | 1173 | 2.30E−155 | sp:[LN:NASA_KLEPN] [AC:Q06457] [GN:NASA] [OR:*KLEBSIELLA PNEUMONIAE*] [EC:1.7.99.4] [DE:NITRATE REDUCTASE,] [SP:Q06457] |
| Contig151G | 36198436_f2_145 | 3328 | 7454 | 462 | 153 | 290 | 1.40E−25 | gp:[GI:g1100876] [LN:VCU39068] [AC:U39068] [OR:*Vibrio cholerae*] [SR:*Vibrio cholerae* strain=Ogawa 395] [DE:*Vibrio cholerae* pathogenicity island, partial and complete cds.] [NT:hypothetical OrfY] |
| Contig151G | 36213200_f1_15 | 3329 | 7455 | 1047 | 348 | 180 | 4.20E−12 | pir:[LN:H69468] [AC:H69468] [PN:lysophospholipase homolog] [OR:*Archaeoglobus fulgidus*] |
| Contig151G | 36459700_f2_310 | 3330 | 7456 | 816 | 271 | 430 | 2.00E−40 | sp:[LN:MRKB_KLEPN] [AC:P21646] [GN:MRKB] [OR:*KLEBSIELLA PNEUMONIAE*] [DE:CHAPERONE PROTEIN MRKB PRECURSOR] [SP:P21646] |
| Contig151G | 36521880_c3_895 | 3331 | 7457 | 1194 | 397 | 122 | 0.00014 | pir:[LN:E69501] [AC:E69501] [PN:sugar transporter homolog] [OR:*Archaeoglobus fulgidus*] |
| Contig151G | 3930307_c3_987 | 3332 | 7458 | 975 | 324 | 504 | 2.90E−48 | sp:[LN:KIPF_ECOLI) [AC:P23539] [GN:FRUK:FPK] [OR:*ESCHERICHIA COLI*] [EC:2.7.1.56] [DE:1-PHOSPHOFRUCTOKINASE, (FRUCTOSE 1-PHOSPHATE KINASE)] [SP:P23539] |
| Contig151G | 3939077_f2_228 | 3333 | 7459 | 1110 | 369 | 340 | 2.90E−46 | pir:[LN:A69541] [AC:A69541] [PN:Glu-tRNA amidotransferase, subunit A (gatA-2) homolog] [CL:indoteacetamide hydrolase] [OR:*Archaeoglobus fulgidus*] |
| Contig151G | 3944151_f3_473 | 3334 | 7460 | 615 | 204 | 201 | 3.70E−16 | pir:[LN:D70655] [AC:D70655] [PN:probable regulatory protein] [GN:Rv3855] [OR:*Mycobacterium tuberculosis*] |
| Contig151G | 3947892_c3_1008 | 3335 | 7461 | 534 | 177 | | | NO-HIT |
| Contig151G | 3954062_c2_841 | 3336 | 7462 | 1449 | 482 | 450 | 1.50E−42 | pir:[LN:B69780] [AC:B69780] [PN:transcription regulator GntR family homolog ydfD] [GN:ydfD] [OR:*Bacillus subtilis*] |
| Contig151G | 3991637_c2_864 | 3337 | 7463 | 1200 | 399 | 549 | 4.90E−53 | gp:[GI:g2995637] [LN:AF052750] [AC:AF052750] [PN:alcohol dehydrogenase] [GN:adhA] [OR:*Pseudomonas putida*] [DE:*Pseudomonas putida* plasmid pPGH1 insertion sequence IS1383transposase (tnpA), alcohol dehydrogenase (adhA), and insertionsequence IS1382 transposase (tnpA) genes, complete cds.] [NT:putative] |

TABLE 2-continued

| Query | Orf | NT ID | AA ID | NT Lgth | AA Lgth | Score | P-value | Subject |
|---|---|---|---|---|---|---|---|---|
| Contig151G | 3994012_c2_797 | 3338 | 7464 | 1341 | 446 | 943 | 8.60E−95 | pir:[LN:B70007] [AC:B70007] [PN:Na+-transporting ATP synthase homolog yubG] [GN:yubG] [L:Na+-ATP synthase chain J] [OR:*Bacillus subtilis*] |
| Contig151G | 4020313_f1_139 | 3339 | 7465 | 543 | 180 | 341 | 5.30E−31 | gp:[GI:g4335908] [LN:AF055308] [AC:AF055308] [PN:F17A fimbrial subunit precursor [GN:f17A] [OR:*Escherichia coli*] [DE:*Escherichia coli* CK377 F17A fimbrial subunit precursor (f17A) gene,complete cds.] |
| Contig151G | 4024143_f3_364 | 3340 | 7466 | 1452 | 483 | 2385 | 1.30E−247 | sp:[LN:DHGB_ACICA] [AC:P13650] [GN:GDHB] [OR:*ACINETOBACTER CALCOACETICUS*] [EC:1.1.99.17] [DE:(EC 1.1.99.17)] [SP:P13650] |
| Contig151G | 4063441_f3_380 | 3341 | 7467 | 2112 | 703 | 768 | 3.00E−76 | pir:[LN:S74450] [AC:S744501 [PN:ferrichrome-iron receptor 2:protein sll1406:protein sll1406 [GN:fhuA_2] [CL:ferrichrome-iron receptor 1:tonB-dependent receptor amino-terminal homology:tonB-dependent receptor carboxyl-terminal homology] [OR:Synechocystis sp.] [SR:PCC 6803, , PCC 6803] [SR:PCC 6803,] |
| Contig151G | 4063577_c1_566 | 3342 | 7468 | 549 | 182 | 209 | 660E−17 | gp:[GI:d1039058:g4512355] [LN:AB011836] [AC:AB011836] [OR:*Bacillus halodurans*] [SR:*Bacillus halodurans* (strain:C-125, isotate:xylanase producer) DNA] [DE:*Bacillus halodurans* C-125 genomic DNA, clone ALBAC003.] [NT:similar to *B. subtilis* ywgB gene(27% identity)] |
| Contig151G | 4083437_c2_715 | 3343 | 7469 | 825 | 274 | 268 | 2.90E−23 | sp:[LN:YEAM_ECOLI] [AC:P76241] [GN:YEAM] [OR:*ESCHERICHIA COLI*] [DE:HYPOTHETICAL TRANSCRIPTIONAL REGULATOR IN GAPA-RND INTERGENIC REGION] [SP:P76241] |
| Contig151G | 4086000_f3_326 | 3344 | 7470 | 1518 | 505 | 1348 | 1.00E−137 | sp:[LN:SMVA_SALTY] [AC:P37594] [GN:SMVA) [OR:*SALMONELLA TYPHIMURIUM*] [DE:METHYL VIOLOGEN RESISTANCE PROTEIN SMVA] [SP:P37594] |
| Contig151G | 4095327_f1_137 | 3345 | 7471 | 1374 | 457 | 414 | 9.80E−39 | gp:[GI:e1314854:g3413306] [LN:SC8B7] [AC:AL031225] [PN:putative oxidoreductase [GN:SC8B7.07c] [OR:*Streptomyces coelicolor*] [DE:*Streptomyces coelicolor* cosmid 8B7.] [NT:SC8B7.07c, possible oxidoreductase, len: 475;] |
| Contig151G | 4099026_f3_355 | 3346 | 7472 | 1389 | 462 | 887 | 7.40E−89 | sp:[LN:YAEL_ECOLI] [AC:P37764] [GN:YAEL] [OR:*ESCHERICHIA COLI*] [DE:HYPOTHETICAL 49.1 KD PROTEIN IN CDSA-HLPA INTERGENIC REGION] [SP:P37764] |

TABLE 2-continued

| Query | Orf | NT ID | AA ID | NT Lgth | AA Lgth | Score | P-value | Subject |
|---|---|---|---|---|---|---|---|---|
| Contig151G | 4101588_f3_442 | 3347 | 7473 | 1062 | 353 | 941 | 1.40E−94 | gp:[GI:d1033097:g3401952) [LN:AB011413] [AC:AB011413] [PN:Orf8] [FN:alcohol dehydrogenase] [OR:*Streptomyces griseus*] [SR:*Streptomyces griseus* DNA] [DE:*Streptomyces griseus* genes for Orf2, Orf3, Orf4, Orf5, AfsA, Orf8,partial and complete cds.] |
| Contig151G | 4103461_c3_1036 | 3348 | 7474 | 897 | 298 | 318 | 1.50E−28 | gp:[GI:g3660461] [LN:PSAF001355] [AC:AF001355:U16026:U03465: U87170] [PN:DNA binding protein HpkR] [GN:hpkR] [OR:*Pseudomonas syringae* pv. *syringae*] [DE:*Pseudomonas syringae* pv. *syringae* DNA binding protein HpkR (hpkR),hybrid histidine protein kinase-phosphate acceptor regulatoryprotein CvgSY (cvgSY), ankyrin AnkF (ankF), and catalase isozymecatalytic subunit CatF (catF) genes, complete cds.] [NT:similarity suggests this is a member of the HTH] |
| Contig151G | 4103462_c2_724 | 3349 | 7475 | 1581 | 526 | 351 | 2.30E−30 | gp:]GI:g3414726] [LN:AF047693] [AC:AF047693] [PN:multidrug resistance efflux pump homolog PmrB] [GN:pmrB] [OR:*Pseudomonas aeruginosa*] [DE:*Pseudomonas aeruginosa* multidrug resistance efflux pump homologPmrA (pmrA) and multidrug resistance efflux pump homolog PmrB(mmrB) genes, complete cds.] [NT:14 TMS efflux pump; similar to EmrB of Escherichia] |
| Contig151G | 4105312_f3_402 | 3350 | 7476 | 375 | 124 | | | NO-HIT |
| Contig151G | 4110142_c2_814 | 3351 | 7477 | 558 | 185 | 120 | 1.40E−07 | gp:[GI:g4139249] [LN:AF110185] [AC:AF110185] [PN:unknown] [OR:*Burkholderia pseudomallei*] [DE:*Burkholderia pseudomallei* strain 1026b DbhB (dbhB), generalsecretory pathway protein D (gspD), general secretory pathwayprotein E (gspE), general secretory pathway protein F (gspF), GspC(gspC), general secretory pathway protein G (gspG), generalsecretory pathway protein H (gspH), general secretory pathwayprotein I (gspl), general secretory pathway protein J (gspJ),general secretory pathway protein K (gspK), general secretorypathway protein L (gspL), general secretory pathway protein M(gspM), and general secretory pathway protein N (gspN) genes,complete cds; and unknown genes.] [NT:similar to *Escherichia coli* MarR protein; orfE] |
| Contig151G | 4118800_f1_63 | 3352 | 7478 | 1104 | 367 | 304 | 4.50E−27 | gp:[GI:g2852632] [LN:AF007152] [AC:AF007152] [PN:unknown] [OR:*Homo sapiens*] [DE:*Homo sapiens* clone 23649 and 23755 unknown mRNA, partial cds.] |
| Contig151G | 4140712_c2_739 | 3353 | 7479 | 336 | 111 | 114 | 6.10E−07 | sp:[LN:YH83_SYNY3] [AC:P73602] [GN:SLL1783] [OR:SYNECHOCYSTIS SP] [SR:PCC 6803,] [DE:HYPOTHETICAL 16.8 KD PROTEIN SLL1783] [SP:P73602] |
| Contig151G | 4142840_f2_257 | 3354 | 7480 | 528 | 175 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 4147318_c2_733 | 3355 | 7481 | 1350 | 449 | 923 | 1.10E-92 | sp:[LN:TUB3_AGRVI] [AC:P70786] [GN:TTUB] [OR:*AGROBACTERIUM VITIS*] [DE:PUTATIVE TARTRATE TRANSPORTER] [SP:P70786] |
| Contig151G | 4156377_c2_174 | 3356 | 7482 | 891 | 296 | 877 | 8.50E-88 | pir:[LN:E69778] [AC:E69778] [PN:conserved hypothetical protein ydeK] [GN:ydeK] [OR:*Bacillus subtilis*] |
| Contig151G | 42087_f1_88 | 3357 | 7483 | 858 | 285 | 1169 | 970E-119 | pir:[LN:JC4161] [AC:JC4161:PC4038] [PN:probable chloride peroxidase,:esterase (misidentification)] [CL:peroxidase] [OR:*Pseudomonas putida*] [EC:1.11.1.10] |
| Contig151G | 4335950_f2_156 | 3358 | 7484 | 1155 | 384 | 138 | 5.40E-07 | pir:[LN:E70470] [AC:E70470] [PN:conserved hypothetical protein aq_1986] [GN:aq_1986] [OR:*Aquifex aeolicus*] |
| Contig151G | 4339132_c1_621 | 3359 | 7485 | 639 | 212 | 133 | 1.50E-07 | pir:[LN:H65092] [AC:H65092] [PN:hypothetical protein b3050] [OR:*Escherichia coli*] |
| Contig151G | 4344568_c1_568 | 3360 | 7486 | 816 | 271 | 337 | 1.40E-30 | pir:[LN:S69588] [AC:S69588] [PN:hypothetical protein YDR533c] [CL:conserved hypothetical protein YMR322c] [OR:*Saccharomyces cerevisiae*] [MP:4R] |
| Contig151G | 4375258_c3_994 | 3361 | 7487 | 1464 | 487 | 1670 | 7.90E-172 | gp:[GI:e321556:g2208982] [LN:YEY13308] [AC:Y13308] [PN:sulfate permease] [OR:*Yersinia enterocolitica*] [DE:*Yersinia enterocolitica* plasmid DNA fragment, strain 15673.] [NT:ORF3] |
| Contig151G | 439452_f1_57 | 3362 | 7488 | 792 | 263 | | | NO-HIT |
| Contig151G | 4398376_f1_335 | 3363 | 7489 | 513 | 170 | | | NO-HIT |
| Contig151G | 4429088_f2_268 | 3364 | 7490 | 468 | 155 | | | NO-HIT |
| Contig151G | 4429642_f3_419 | 3365 | 7491 | 1269 | 422 | 601 | 1.50E-58 | gp:[GI:g2291144] [LN:CELF17A9] [AC:AF016417] [GN:F17A9.4] [OR:*Caenorhabditis elegans*] [SR:*Caenorhabditis elegans* strain=Bristol N2] [DE:*Caenorhabditis elegans* cosmid F17A9.] [NT:similar to NADH oxidases] |
| Contig151G | 4471093_f1_59 | 3366 | 7492 | 2286 | 761 | 2332 | 5.60E-242 | sp:[LN:CLPA_ECOLI] [AC:P15716:P77686] [GN:CLPA:LOPD] [OR:*ESCHERICHIA COLI*] [DE:ATP-DEPENDENT CLP PROTEASE ATP-BINDING SUBUNIT CLPA] [SP:P15716:P77686] |
| Contig151G | 4492137_c2_735 | 3367 | 7493 | 198 | 65 | | | NO-HIT |
| Contig151G | 4538937_c1_560 | 3368 | 7494 | 846 | 281 | 115 | 0.00039 | gp:[GI:g1236921] [LN:SDU49822] [AC:U49822] [PN:Var1p] [GN:var1] [FN:mitochondrial ribosomal protein] [OR:*Mitochondrion Saccharomyces douglasii*] [SR:baker's yeast [DE:*Saccharomyces douglasii* mitochondrial tRNA-Ser and tRNA-Phe genes,partial sequence. and Var1p (var1) gene, mitochondrial geneencoding mitochondrial protein, complete cds.] |
| Contig151G | 4566057_c3_953 | 3369 | 7495 | 183 | 60 | | | NO-HIT |
| Contig151G | 4687625_f1_22 | 3370 | 7496 | 186 | 61 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 4687763_c1_630 | 3371 | 7497 | 912 | 303 | 349 | 7.60E−32 | sp:[LN:LTRA__KLEPN] [AC:P52689] [GN:LTRA] [OR:*KLEBSIELLA PNEUMONIAE*] [DE:PROBABLE TRANSCRIPTIONAL REGULATOR LTRA] [SP:P52689] |
| Contig151G | 4688751_f1_39 | 3372 | 7498 | 2598 | 865 | 808 | 2.00E−117 | gp:[GI:g2231186] [LN:HIU60831] [AC:U60831] [PN:D15] [GN:d15] [OR:*Haemophilus influenzae*] [DE:*Haemophilus influenzae* CDP diglyceride synthetase (cds) and D15(d15) genes. complete cds, and (skp) gene, partial cds.] |
| Contig151G | 4688800_c2_738 | 3373 | 7499 | 666 | 221 | 298 | 1.90E−26 | sp:[LN:YCAC__ECOLI] [AC:P21367] [GN:YCAC] [OR:*ESCHERICHIA COLI*] [DE:HYPOTHETICAL 23.1 KD PROTEIN IN DMSC-PFLA INTERGENIC REGION] [SP:P21367] |
| Contig151G | 4689700_f2_261 | 3374 | 7500 | 774 | 257 | 116 | 1.10E−06 | pir:[LN:F64973] [AC:F64973] [PN:hypothetical protein b2071] [OR:*Escherichia coli*] |
| Contig151G | 4692250_f3_391 | 3375 | 7501 | 654 | 217 | 938 | 2.90E−94 | gp;[GI;g141783] [LN:ACCPCAOP] [AC:L05770:U04359:M33798:U20284:U11554:L13114:L03407] [PN:protocatechuate 3,4-dioxygenase alpha subunit] [GN:pcaG] [OR:Acinetobacter sp. ADP1 ] [EC:1.99.2.3] [DE:Acinetobacter sp. ADP1 pca-qui-pob supraoperonic cluster, completesequence.] [NT:PO] |
| Contig151G | 4695262_f1_40 | 3376 | 7502 | 1080 | 359 | 637 | 2.30E−62 | sp:[LN:LPXD__HAEIN] [AC:P43888] [GN:LPXD:HI0915] [OR:*HAEMOPHILUS INFLUENZAE*] [EC:2.3.1.—] [DE:(EC 2.3.1.—)] [SP:P43888] |
| Contig151G | 4697125_f1_60 | 3377 | 7503 | 366 | 121 | 326 | 2.10E−29 | sp:[LN:YNFA__ECOLI] [AC:P76169] [GN:YNFA] [OR:*ESCHERICHIA COLI*] [DE:HYPOTHETICAL 11.9 KD PROTEIN IN RSPA-SPEG INTERGENIC REGION] [SP:P76169] |
| Contig151G | 4703425_c2_749 | 3378 | 7504 | 1770 | 589 | 904 | 1.20E−90 | pir:[LN:C64459] [AC:C64459] [PN:dihydroxy-acid dehydratase,] [CL:dihydroxy-acid dehydratase] [OR:*Methanococcus jannaschii*] [EC:4.2.1.9] [MP:REV1222335-1220650] |
| Contig151G | 4705338_f1_66 | 3379 | 7505 | 1368 | 455 | 1869 | 6.40E−193 | gp:[GI:g141778] [LN:ACCPCAOP] [AC:L05770:U04359:M33798:U20284:U11554:L13114:L03407] [PN:beta-carboxy-cis,cis-muconate cycloisomerase] [GN:pcaB] [FN:lactonizing enzyme] [OR:Acinetobacter sp. ADP1] [EC:5.5.1.2] [DE:Acinetobacter sp. ADP1 pca-qui-pob supraoperonic cluster, completesequence.] [NT:CMLE] |
| Contig151G | 4709467_f3_424 | 3380 | 7506 | 471 | 156 | | | NO-HIT |
| Contig151G | 4711003_f3_459 | 3381 | 7507 | 192 | 63 | | | NO-HIT |
| Contig151G | 4722883_f2_176 | 3382 | 7508 | 207 | 68 | | | NO-HIT |
| Contig151G | 4725052_f2_312 | 3383 | 7509 | 1047 | 348 | | | NO-HIT |
| Contig151G | 4725338_f1_10 | 3384 | 7510 | 1404 | 467 | 1039 | 5.80E−105 | pir:[LN:F70938] [AC:F70938] [PN:probable fabG4 protein] [GN:fabG4] [OR:*Mycobacterium tuberculosis*] |
| Contig151G | 4725657_f3_384 | 3385 | 7511 | 765 | 254 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 4736275_c1_551 | 3386 | 7512 | 1350 | 449 | 397 | 6.20E−37 | gp:[GI:g1657608] [LN:SPU66846] [AC:U66846] [OR:*Streptococcus pneumoniae*] [DE:*Streptococcus pneumoniae* cps3E and rpt pseudogenes, partialsequence, Cps3C (cps3C), Cps3P (cps3P) genes, partial cds.] [NT:orf5] |
| Contig151G | 4782632_c1_651 | 3387 | 7513 | 339 | 112 | | | NO-HIT |
| Contig151G | 48265_f3_448 | 3388 | 7514 | 1422 | 473 | 135 | 1.30E−05 | sp:[LN:YD2A_SCHPO] [AC:Q10258] [GN:SPAC56F8.10] [OR:*SCHIZOSACCHAROMYCES POMBE*] [SR:,FISSION YEAST] [DE:HYPOTHETICAL 69.0 KD PROTEIN C56F8.10 IN CHROMOSOME 1] [SP:Q10258] |
| Contig151G | 4863576_f3_393 | 3389 | 7515 | 2481 | 826 | 3836 | 0 | pir:[LN:A55547] [AC:A55547] [PN:quinate-shikimate dehydrogenase,] [GN:quiA] [OR:*Acinetobacter calcoaceticus*] [EC:1.1.99.—] |
| Contig151G | 4869037_f2_248 | 3390 | 7516 | 1002 | 333 | 847 | 1.30E−84 | gp:[GI:g1916310] [LN:ATU91632] [AC:U91632] [GN:gguC] [OR:*Agrobacterium tumefaciens*] [DE:*Agrobacterium tumefaciens* sugar transporter (gguA),membrane-spanning permease (gguB), and (gguC) genes, complete cds.] |
| Contig151G | 4881443_f3_317 | 3391 | 7517 | 435 | 144 | 178 | 1.00E−13 | sp:[LN:YCGK_ECOLI] [AC:P76002] [GN:YCGK] [OR:*ESCHERICHIA COLI*] [DE:HYPOTHETICAL 14.9 KD PROTEIN IN MINC-SHEA INTERGENIC REGION PRECURSOR] [SP:P76002] |
| Contig151G | 4882713_c3_898 | 3392 | 7518 | 450 | 149 | 142 | 1.10E−08 | pir:[LN:G64616] [AC:G64616] [PN:penta-phosphate guanosine-3′-pyrophosphohydrolase] [CL:guanosine 3′,5′-bis(diphosphate) 3′-pyrophosphatase] [OR:*Helicobacter pylori*] |
| Contig151G | 4883452_f3_413 | 3393 | 7519 | 795 | 264 | 131 | 5.40E−07 | gp:[GI:g945392] [LN:MTFMAUF] [AC:L37428] [OR:Methylobacillus sp.] [SR:*Methylobacillus flagellatum* (strain KT) DNA] [DE:*Methylobacillus flagellatum* orf-1 gene, complete cds and mauF gene,5′ end of cds.] [NT:orf-1; putative] |
| Contig151G | 4884708_f2_190 | 3394 | 7520 | 297 | 98 | | | NO-HIT |
| Contig151G | 4885012_c3_997 | 3395 | 7521 | 459 | 152 | 230 | 3.10E−19 | sp:[LN:AZLB_BACSU] [AC:O07920] [GN:AZLB]. [OR:BACILLUS SUBTILIS] [DE:TRANSCRIPTIONAL REGULATOR AZLB] [SP:O07920] |
| Contig151G | 4886018_f1_89 | 3396 | 7522 | 702 | 233 | 326 | 2.10E−29 | pir:[LN:S69588] [AC:S69588] [PN :hypothetical protein YDR533c] [CL:conserved hypothetical protein YMR322C] [OR:*Saccharomyces cerevisiae*] [MP:4R] |
| Contig151G | 4886526_c1_535 | 3397 | 7523 | 1104 | 367 | 436 | 4.60E−41 | gp:[GI:g3414725] [LN:AF047693] [AC:AF047693] [PN:multidrug resistance efflux pump homolog PmrA] [GN:pmrA] [OR:*Pseudomonas aeruginosa*] [DE:*Pseudomonas aeruginosa* multidrug resistance efflux pump homologPmrA (pmrA) and multidrug resistance efflux pump homolog PmrB(pmrB) genes, complete cds.] [NT:membrane fusion protein; similar to EmrA of] |

TABLE 2-continued

| Query | Orf | NT ID | AA ID | NT Lgth | AA Lgth | Score | P-value | Subject |
|---|---|---|---|---|---|---|---|---|
| Contig151G | 4892343_c1_660 | 3398 | 7524 | 1341 | 446 | 703 | 2.30E−69 | gp:[GI:g862633] [LN:XXU13633] [AC:U13633] [PN:RumB(R391)] [GN:rumB(R391)] [OR:IncJ plasmid R391] [DE:IncJ plasmid R391 rumA(R391) and rumB(R391) genes, complete cds.] [NT:similar to *Escherichia coli* UmuC, Swiss-Prot] |
| Contig151G | 4898253_f2_186 | 3399 | 7525 | 213 | 70 | | | NO-HIT |
| Contig151G | 4901552_f2_225 | 3400 | 7526 | 885 | 294 | 174 | 4.60E−21 | gp:[GI:e1344248:g3874677] [LN:CEC33A12] [AC:Z68493] [GN:C33A12.7] [OR:*Caenorhabditis elegans*] [DE:*Caenorhabditis elegans* cosmid C33A12, complete sequence.] [NT:cDNA EST yk301h4.5 comes from this gene; cDNA EST] |
| Contig151G | 5082665_f3_394 | 3401 | 7527 | 495 | 164 | | | NO-HIT |
| Contig151G | 5085902_c1_637 | 3402 | 7528 | 465 | 154 | 340 | 6.80E−31 | sp:[LN:YRFH_HAEIN] [AC:P44754] [GN:HI0562] [OR:*HAEMOPHILUS INFLUENZAE*] [DE:HYPOTHETICAL PROTEIN HI0562] [SP:P44754] |
| Contig151G | 5095328_c1_632 | 3403 | 7529 | 1728 | 575 | 1382 | 2.60E−141 | sp:[LN:PTFB_ECOLI] [AC:P20966] [GN:FRUA:PTSF] [OR:*ESCHERICHIA COLI*] [EC:2.7.1.69] [DE:(EC 2.7.1.69) (EII-FRU)] [SP:P20966] |
| Contig151G | 5109642_f3_453 | 3404 | 7530 | 828 | 275 | 192 | 3.30E−15 | pir:[LN:S76242] [AC:S76242] [PN:hypothetical protein] [OR:Synechocystis sp.] [SR:PCC 6803, , PCC 6803] [SR:PCC 6803,] |
| Contig151G | 5117078_f2_169 | 3405 | 7531 | 1041 | 346 | 580 | 2.50E−56 | sp:[LN:NARA_BACSU] [AC:P39757] [GN:NARA:NARAB] [OR:*BACILLUS SUBTILIS*] [DE:NARA PROTEIN] [SP:P39757] |
| Contig151G | 5290687_f1_52 | 3406 | 7532 | 1167 | 388 | 489 | 1.10E−46 | gp:[GI:g4104238] [LN:AF034414] [AC:AF034414] [PN:outer membrane phospholipase A precursor] [GN:pldA] [OR:*Enterobacter agglomerans*] [EC:3.1.1.32] [DE:*Enterobacter agglomerans* outer membrane phospholipase A precursor(pldA) gene, complete cds.] [NT:detergent resistant phospholipase A; PldA: OMPLA] |
| Contig151G | 5290885_f3_360 | 3407 | 7533 | 1194 | 397 | 911 | 2.10E−91 | sp:[LN:AQL1_THEAQ] [AC:P08594] [GN:PSTI] [OR:*THERMUS AQUATICUS*] [EC:3.4.21.—] [DE:AQUALYSIN I PRECURSOR,] [SP:P08594] |
| Contig151G | 5351577_f2_238 | 3408 | 7534 | 2325 | 774 | 2586 | 6.80E−269 | sp:[LN:AMO_ECOLI] [AC:P46883:P78153:O53008] [GN:TYNA:MAOA] [OR:*ESCHERICHIA COLI*] [EC:1.4.3.6] [DE:(2-PHENYLENTHYLAMINE OXIDASE)] [SP:P46883:P78153:O53008] |
| Contig151G | 54807_f1_9 | 3409 | 7535 | 219 | 72 | | | NO-HIT |
| Contig151G | 563527_c3_942 | 3410 | 7536 | 2517 | 838 | 1537 | 9.80E−158 | gp:[GI:g2435408] [LN:AFU93881] [AC:U93881] [PN:penicillin G acylase precursor] [GN:pac] [OR:*Alcaligenes faecalis*] [EC:3.5.1.11] [DE:*Alcaligenes faecalis* penicillin G acylase precursor (pac) gene,complete cds.] |

TABLE 2-continued

| Query | Orf | NT ID | AA ID | NT Lgth | AA Lgth | Score | P-value | Subject |
|---|---|---|---|---|---|---|---|---|
| Contig151G | 572062_c1_678 | 3411 | 7537 | 723 | 240 | 573 | 1.40E−55 | sp:[LN:YCAR_PSEAE] [AC:P38102] [OR:*PSEUDOMONAS AERUGINOSA*] [DE:HYPOTHETICAL 23.3 KD PROTEIN IN CARA-CARB INTERGENIC REGION] [SP:P38102] |
| Contig151G | 578431_c2_811 | 3412 | 7538 | 879 | 292 | 120 | 7.10E−05 | pir:[LN:E65030] [AC:E65030] [PN:hypothetical protein b2534] [OR:*Escherichia coli*] |
| Contig151G | 579163_c1_483 | 3413 | 7539 | 234 | 77 | | | NO-HIT |
| Contig151G | 585092_c1_494 | 3414 | 7540 | 858 | 285 | 466 | 3.00E−44 | gp:[GI:e1311682:g3334832] [LN:SAR7932] [AC:AJ007932] [PN:cyclase] [GN:mtmY] [OR:*Streptomyces argillaceus*] [DE:*Streptomyces argillaceus* mithramycin biosynthetic genes.] |
| Contig151G | 5860637_f1_48 | 3415 | 7541 | 420 | 139 | | | NO-HIT |
| Contig151G | 6064700_f2_213 | 3416 | 7542 | 684 | 227 | 6.49 | 1.20E−63 | sp:[LN:RPIA_ECOLI] [AC:P27252] [GN:RPIA] [OR:*ESCHERICHIA COLI*] [EC:5.3.1.6] [DE:RIBOSE 5-PHOSPHATE ISOMERASE A, (PHOSPHORIBOISOMERASE A)] [SP:P27252] |
| Contig151G | 6095953_f3_420 | 3417 | 7543 | 1080 | 359 | 165 | 3.50E−11 | pir:[LN:F70669] [AC:F70669:S73068:S73067] [PN:hypothetical protein Rv2953:hypothetical protein u0002m:hypothetical protein u0002n) [GN:Rv2953] [OR:*Mycobacterium tuberculosis*] |
| Contig151G | 6281883_c1_594 | 3418 | 7544 | 837 | 278 | 1160 | 8.70E−118 | gp:[GI:g3264839] [LN:ACCPCAOP] [AC:L05770:U04359:M33798:U20284:U11554:L13114.L03407] [PN:regulatory protein PcaU] [GN:pcaU] [FN:activation of the expression of the pca operon] [OR:Acinetobacter sp. ADP1] [DE:Acinetobacter sp. ADP1 pca-qui-pob supraoperonic cluster, completesequence.] |
| Contig151G | 6304561_c3_896 | 3419 | 7545 | 930 | 309 | | | NO-HIT |
| Contig151G | 6446925_c1_572 | 3420 | 7546 | 816 | 271 | 886 | 9.50E−89 | gp:[GI:g2996620] [LN:AF009224] [AC:AF009224:M76991:M76990:M23245:M29848:M29714:M62649] [PN:beta-ketoadipate enol-lactone hydrolase] [GN:catD] [FN:hydrolysis of beta-ketoadipate enol-lactone] [OR:Acinetobacter sp.ADP1] [DE:Acinetobacter sp. ADP1 ben operon and cat operon, completesequence.] |
| Contig151G | 6454713_c2_683 | 3421 | 7547 | 1884 | 627 | | | NO-HIT |
| Contig151G | 6526917_c3_999 | 3422 | 7548 | 705 | 234 | 326 | 2.10E−29 | sp:[LN:YRFG_ECOLI] [AC:P45801] [GN:YRFG] [OR:*ESCHERICHIA COLI*] [DE:HYPOTHETICAL 25.4 KD PROTEIN IN MRCA-PCKA INTERGENIC REGION] [SP:P45801] |
| Contig151G | 664658_c2_692 | 3423 | 7549 | 1377 | 458 | 562 | 2.00E−54 | gp:[GI:d1032429:g3298360] [LN:AB010716] [AC:AB010716] [PN:Tyramine oxidase] [GN:tyo] [OR:*Micrococcus luteus*] [SR:*Micrococcus luteus* DNA] [EC:1.4.3.9] [DE:*Micrococcus luteus* tyo gene for Tyramine oxidase, complete cds.] |
| Contig151G | 667160_3f2_313 | 3424 | 7550 | 207 | 68 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 6673387_c2_840 | 3425 | 7551 | 336 | 111 | 207 | 8.50E−17 | sp:[LN:YCCK_HAEIN] [AC:P45184] [GN:HI1371] [OR:*HAEMOPHILUS INFLUENZAE*] [DE:HYPOTHETICAL PROTEIN HI1371] [SP:P45184] |
| Contig151G | 6680438_c1_502 | 3426 | 7552 | 828 | 275 | | | NO-HIT |
| Contig151G | 673187_f2_285 | 3427 | 7553 | 885 | 294 | 199 | 6.00E−16 | sp:[LN:Y902_HAEIN] [AC:P44070] [GN:HI0902] [OR:*HAEMOPHILUS INFLUENZAE*] [DE:HYPOTHETICAL PROTEIN HI0902] [SP:P44070] |
| Contig151G | 6741505_c1_624 | 3428 | 7554 | 198 | 65 | 106 | 4.30E−06 | sp:[LN:YBGT_ECOLI] [AC:P56100] [GN:YBGT] [OR:*ESCHERICHIA COLI*] [DE:4.0 KD PROTEIN IN CYDB-TOLQ INTERGENIC REGION (ORFC)] [SP:P56100] |
| Contig151G | 679002_f2_259 | 3429 | 7555 | 543 | 180 | | | NO-HIT |
| Contig151G | 680465_c3_978 | 3430 | 7556 | 1161 | 386 | 1348 | 1.00E−137 | pir:[LN:B38170] [AC:B38170] [PN:cytochrome d complex terminal oxidase, chain II] [CL:cytochrome d ubiquinol oxidase] [OR:*Azotobacter vinclandii*] [EC:1.10.3.—] |
| Contig151G | 6817627_c3_874 | 3431 | 7557 | 189 | 62 | | | NO-HIT |
| Contig151G | 6831412_f3_463 | 3432 | 7558 | 1170 | 389 | 403 | 1.40E−37 | pir:[LN:B69799] [AC:B69799] [PN:salicylate 1-monooxygenase homolog yetM] [GN:yetM] [OR:*Bacillus subtilis*] |
| Contig151G | 6835342_c3_941 | 3433 | 7559 | 1230 | 409 | 1770 | 200E−182 | gp:[GI:g141777] [LN:ACCPCAOP] [AC:L05770:U04359:M33798:U20284:U11554:L13114:L03407] [PN:beta-ketoadipyl CoA thiolase] [GN:pcaF] [OR:Acinetobacter sp. ADP1] [EC:3.1.2.000] [DE:Acinetobacter sp. ADP1 pca-qui-pob supraoperonic cluster, completesequence.] |
| Contig151G | 6914137_f1_87 | 3434 | 7560 | 1671 | 556 | 1311 | 8.70E−134 | pir:[LN:S27612) [AC:S27612) [PN:ketoglutaratc semialdehyde dehydrogenase,] [OR:*Pseudomonas putida*] [EC:1.2.1.—] |
| Contig151G | 6914837_f3_351 | 3435 | 7561 | 498 | 165 | 455 | 4.40E−43 | sp:[LN:YACN_BACSU] [AC:Q06756] [GN:YACN] [OR:*BACILLUS SUBTILIS*] [DE:HYPOTHETICAL 17.1 KD PROTEIN IN MECB-GLTX INTERGENIC REGION] [SP:Q06756] |
| Contig151G | 7110905_c2_858 | 3436 | 7562 | 1425 | 474 | 1537 | 9.80E−158 | sp:[LN:ACCC_PSEAE] [AC:P37798] [GN:ACCC:FABG] [OR:PSEUDOMONAS AERUGINOSA] [EC:6.3.4.14:6.4.1.2] [DE:CARBOXYLASE,) (ACC)] [SP:P37798] |
| Contig151G | 7234642_c2_820 | 3437 | 7563 | 1068 | 355 | 1611 | 1.40E−165 | sp:[LN:RECA_ACICA) [AC:P42438] [GN:RECA] [OR:*ACINETOBACTER CALCOACETICUS*] [DE:RECA PROTEIN] [SP:P42438] |
| Contig151G | 791331_c1_647 | 3438 | 7564 | 672 | 223 | 132 | 1.80E−07 | pir:[LN:F70622) [AC:F70622) [PN:probable transcription regulator Rv1019] [GN:Rv1019] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig151G | 814812_f3_412 | 3439 | 7565 | 927 | 308 | 1127 | 2.70E-114 | gp:[GI:g2996614] [LN:AF009224] [AC:AF009224:M76991:M76990: M23245:M29848:M29714:M62649] [PN:transcriptional activator protein] [GN:catM] [FN:activator of cat-gene expression] [OR:Acinetobacter sp. ADP1] [DE:Acinetobacter sp. ADP1 ben operon and cat operon, completesequence.] |
| Contig151G | 834837_f3_349 | 3440 | 7566 | 1332 | 443 | 520 | 5.80E-50 | sp:[LN:DADA_ECOLI] [AC:P29011] [GN:DADA:DADR] [OR:*ESCHERICHIA COLI*] [EC:1.4.99.1] [DE:D-AMINO ACID DEHYDROGENASE SMALL SUBUNIT,] [SP:P29011] |
| Contig151G | 8562_c3_922 | 3441 | 7567 | 1332 | 443 | 1045 | 1.30E-105 | sp:[LN:TUB3_AGRVI] [AC:P70786] [GN:TTUB] [OR:*AGROBACTERIUM VITIS*] [DE:PUTATIVE TARTRATE TRANSPORTER] [SP:P70786] |
| Contig151G | 89128_f3_339 | 3442 | 7568 | 183 | 60 | | | NO-HIT |
| Contig151G | 892150_f2_269 | 3443 | 7569 | 741 | 246 | 178 | 2.70E-18 | sp:[LN:YCSO_BACSU] [AC:P42968] [GN:YCSO] [OR:*BACILLUS SUBTILIS*] [DE:HYPOTHETICAL TRANSCRIPTIONAL REGULATOR IN SIPU-PBPC INTERGENIC REGION] [SP:P42968] |
| Contig151G | 960077_f2_217 | 3444 | 7570 | 858 | 285 | 1094 | 8.60E-111 | gp:[GI:g4235471] [LN:AF098791] [AC:AF098791] [PN:2-dehydro-3-deoxyphosphooctonate aldolase] [GN:kdsA] [OR:Pseudomonas aeruginosa] [DE:Pseudomonas aeruginosa 2-dehydro-3-deoxyphosphooctonate aldolase(kdsA) gene, complete cds.] |
| Contig151G | 973787_f1_115 | 3445 | 7571 | 1002 | 333 | 144 | 2.00E-12 | sp:[LN:KPRS_MYCPN] [AC:P75044] [GN:PRSA:PRS] [OR:*MYCOPLASMA PNEUMONIAE*] [EC:2.7.6.1] [DE:PYROPHOSPHATE SYNTHETASE)] [SP:P75044] |
| Contig151G | 974077_c2_854 | 3446 | 7572 | 1011 | 336 | 369 | 2.90E-33 | sp:[LN:NRTC_SYNY3] [AC:P73450] [GN:NRTC:SLL1452] [OR:SYNECHOCYSTIS SP] [SR:PCC 6803,] [DE:NITRATE TRANSPORT ATP-BINDING PROTEIN NRTC] [SP:P73450] |
| Contig151G | 975702_f2_314 | 3447 | 7573 | 1164 | 387 | 500 | 7.60E-48 | sp:[LN:Y4IL_RHISN] [AC:P55495] [GN:Y4IL] [OR:RHIZOBIUM SP] [DE:HYPOTHETICAL 47.8 KD PROTEIN Y4IL] [SP:P55495] |
| Contig151G | 975901_c2_751 | 3448 | 7574 | 771 | 256 | 975 | 3.50E-98 | sp [LN PCAI_ACICA] [AC:Q43973:Q43933] [GN:PCAI:CATI] [OR:*ACINETOBACTER CALCOACETICUS*] [EC:2.8.3.6] [DE:KETOADIPATE:SUCCINYL COA TRANSFERASE)] [SP:Q43973:Q43933] |
| Contig151G | 9845302_f1_47 | 3449 | 7575 | 528 | 175 | | | NO-HIT |
| Contig151G | 9899077_f3_371 | 3450 | 7576 | 795 | 264 | 798 | 2.00E-79 | sp:[LN:AMPM_ECOLI] [AC:P07906] [GN:MAP] [OR:*ESCHERICHIA COLI*] [EC:3.4.11.18] [DE:METHIONINE AMINOPEPTIDASE, (MAP) (PEPTIDASE M)] [SP:P07906] |
| Contig151G | 9923502_f2_230 | 3451 | 7577 | 558 | 185 | | | NO-HIT |
| Contig151G | 9945301_c3_986 | 3452 | 7578 | 288 | 95 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig151G | 9953308_c1_565 | 3453 | 7579 | 1077 | 358 | 678 | 1.00E−66 | gp:[GI:e1420007:g45391801] [LN:SC6A5] [AC:AL049485] [PN:hypothetical protein] [GN:SC6A5.25] [OR:*Streptomyces coelicolor*] [DE:*Streptomyces coelicolor* cosmid 6A5.] [NT:SC6A5.25, unknown, len: 37; similar to] |
| Contig152G | 10437890_c2_664 | 3454 | 7580 | 714 | 237 | 585 | 7.40E−57 | sp:[LN:MODB_HAEIN] [AC:P45322] [GN:MODB.HI1692] [OR:*HAEMOPHILUS INFLUENZAE*] [DE:MOLYBDENUM TRANSPORT SYSTEM PERMEASE PROTEIN MODB] [SP:P45322] |
| Contig152G | 10629077_f1_9 | 3455 | 7581 | 1416 | 471 | 2338 | 1.30E−242 | gp:[GI:g3511232] [LN:AF071556] [AC:AF071556] [PN:anthranilate dioxygenase large subunit] [GN:antA] [OR:Acinetobacter sp. ADP1] [DE:Acinetobacter sp. ADP1 anthranilate dioxygenase large subunit(antA), anthranilate dioxygenase small subunit (antB), andanthranilate dioxygenase reductase (antC) genes, complete cds.] [NT:terminal dioxygenase] |
| Contig152G | 10743755_c3_710 | 3456 | 7582 | 594 | 197 | | | NO-HIT |
| Contig152G | 10975305_c1_450 | 3457 | 7583 | 510 | 169 | 393 | 1.70E−36 | sp:[LN:YFHC_ECOLI] [AC:P30134] [GN:YFHC] [OR:ESCHERICIA COLI] [DE:HYPOTHETICAL 20.0 KD PROTEIN IN PURL-DPJ INTERGENIC REGION (ORF178)] [SP:P30134] |
| Contig152G | 11875461_c3_756 | 3458 | 7584 | 384 | 127 | | | NO-HIT |
| Contig152G | 1204677_c1_554 | 3459 | 7585 | 345 | 114 | | | NO-HIT |
| Contig152G | 1204762_c1_457 | 3460 | 7586 | 1149 | 382 | 869 | 6.00E−87 | sp:[LN:YHCM_ECOLI] [AC:P46442] [GN:YHCM] OR:*ESCHERICHIA COLI*] [DE:HYPOTHETICAL 43.1 KD PROTEIN IN RPLM-HHOA INTERGENIC REGION (F375)] [SP:P46442] |
| Contig152G | 1208438_c1_519 | 3461 | 7587 | 1131 | 376 | 369 | 5.80E−34 | sp:[LN:RND_HAEIN] [AC:P44442] [GN:RND:HI0390] [OR:*HAEMOPHILUS INFLUENZAE*] [EC:3.1.26.3] [DE:RIBONUCLEASE D, (RNASE D)] [SP:P44442] |
| Contig152G | 12533327_c3_704 | 3462 | 7588 | 2250 | 749 | 129 | 1.60E−06 | pir:[LN:B69844] [AC:B69844] [PN:lytic transglycosylase homolog yjbJ] [GN:yjbJ] [OR:*Bacillus subtilis*] |
| Contig152G | 12579693_f1_98 | 3463 | 7589 | 1494 | 497 | 129 | 4.90E−11 | sp:[LN:UVRD_MYCGE] [AC:P47486] [GN:UVRD:MG244] [OR:*MYCOPLASMA GENITALIUM*] [EC:3.6.2.—] [DE:PUTATIVE DNA HELICASE II HOMOLOG,] [SP:P47486] |
| Contig152G | 1260_f1_20 | 3464 | 7590 | 1371 | 456 | 300 | 1.80E−44 | sp:[LN:CHRA_PSEAE] [AC:P14285] [GN:CHRA] [OR:*PSEUDOMONAS AERUGINOSA*] [DE:CHROMATE TRANSPORT PROTEIN] [SP:P14285] |
| Contig152G | 12761078_c1_520 | 3465 | 7591 | 1005 | 334 | 539 | 4.60E−76 | sp:[LN:YFCB_ECOLI] [AC:P39199:P78252:P76939] [GN:YFCB] [OR:*ESCHERICHIA COLI*] [EC:2.1.1.72] [DE:(EC 2.1.2.72)] [SP:P39199:P78252:P76939] |

TABLE 2-continued

| Query | Orf | NT ID | AA ID | NT Lgth | AA Lgth | Score | P-value | Subject |
|---|---|---|---|---|---|---|---|---|
| Contig152G | 13086578_c3_749 | 3466 | 7592 | 1770 | 589 | 1247 | 5.30E−127 | sp:[LN:YBHF_ECOLI] [AC:P75776] [GN:YBHF] [OR:*ESCHERICHIA COLI*] [DE:HYPOTHETICAL ABC TRANSPORTER ATP-BINDING PROTEIN YBHF] [SP:P75776] |
| Contig152G | 134652_c2_644 | 3467 | 7593 | 249 | 82 | 139 | 1.40E−09 | gp:[GI:e221397:g1183904] [LN:DVAPSAB] [AC:Z69372] [PN:adenylylsulphate reductase beta-subunit] [GN:apsB] [FN:reduction of aps to amp and sulfite] [OR:*Desulfovibrio vulgaris*] [EC:1.8.99.2] [DE:*D.vulgaris* apsA and apsB genes.] |
| Contig152G | 1359625_c1_532 | 3468 | 7594 | 198 | 65 | | | NO-HIT |
| Contig152G | 13730438_c1_474 | 3469 | 7595 | 414 | 137 | | | NO-HIT |
| Contig152G | 1377186_c1_518 | 3470 | 7596 | 255 | 84 | | | NO-HIT |
| Contig152G | 13798437_f3_328 | 3471 | 7597 | 234 | 77 | | | NO-HIT |
| Contig152G | 13914182_c3_679 | 3472 | 7598 | 414 | 137 | 229 | 3.90E−19 | gp:[GI:g9727791 [LN:PSEPILZ] [AC:L42622] [GN:pilZ] [OR:*Pseudomonas aeruginosa*] [SR:*Pseudomonas aeruginosa* (strain PAO1) DNA] [DE:*Pseudomonas aeruginosa* pilZ and holB genes, complete cds.] [NT:involved in biogenesis of type 4 fimbriae] |
| Contig152G | 13947952_f1_100 | 3473 | 7599 | 294 | 97 | | | NO-HIT |
| Contig152G | 14094068_c3_718 | 3474 | 7600 | 951 | 316 | 266 | 6.70E−47 | gp:[GI:g4154809] [LN:AE001465] [AC:AE001465:AE001439] [PN:DIPEPTIDE TRANSPORT SYSTEM PERMEASE PROTEIN] [GN:dppB] [OR:*Helicobacter pylori* J99] [DE:*Helicobacter pylori*, strain J99 section 26 of 132 of the completegenome.] [NT:similar to *H. pylori* 26695 gene HP0299] |
| Contig152G | 1443807_c3_792 | 3475 | 7601 | 420 | 139 | 145 | 3.10E−10 | sp:[LN:FUR_YERPE] [AC:P33086] [GN:FUR] [OR:*YERSINIA PESTIS*] [DE:FERRIC UPTAKE REGULATION PROTEIN (FERRIC UPTAKE REGULATOR)] [SP:P33086] |
| Contig152G | 14468750_f3_417 | 3476 | 7602 | 702 | 233 | | | NO-HIT |
| Contig152G | 14584812_c2_595 | 3477 | 7603 | 2190 | 729 | 2385 | 1.30E−247 | gp:[GI:e308976:g1906369] [LN:PFFC2] [AC:Y11998] [PN:hypothetical protein] [GN:FC2.4] [OR:*Pseudomonas fluorescens*] [DE:*P.fluorescens* FC2.1, FC2.2, FC2.3c, FC2.4 and FC2.5c open readingframes.] [NT:most probably a malate synthase cds: insertion of a] |
| Contig152G | 1460875_c3_672 | 3478 | 7604 | 1038 | 345 | 834 | 3.10E−83 | gp:[GI:g3241975] [LN:SSU85710] [AC:U85710] [PN:transposase] [OR:*Sulfolobus solfataricus*] [DE:*Sulfolobus solfataricus* insertion etement ISC1041, transposasegene, complete cds.] |
| Contig152G | 14634642_c2_646 | 3479 | 7605 | 285 | 94 | 84 | 0.00092 | pir:[LN:S29304] [AC:S29304:S28376] [PN:hypothetical protein 2 (phaC1 5' region)] [OR:*Pseudomonas aeruginosa*] |
| Contig152G | 14662557_f3_382 | 3480 | 7606 | 1050 | 349 | 236 | 4.00E−17 | gp:[GI:g2529416] [LN:S5U73935] [AC:U73935] [PN:unknown] [OR:Shewanella sp SCRC-2738] [DE:Shewanella sp. SCRC-2738 eicosapentaenoic acid (EPA) synthesis genecluster, complete sequence.] [NT:ORF3] |

TABLE 2-continued

| Query | Orf | NT ID | AA ID | NT Lgth | AA Lgth | Score | P-value | Subject |
|---|---|---|---|---|---|---|---|---|
| Contig152G | 14875757_c3_734 | 3481 | 7607 | 471 | 156 | 454 | 5.70E−43 | sp:[LN:YBAK_ECOLI] [AC:P37175:P77281] [GN:YBAK] [OR:ESCHERICHIA COLI] [DE:HYPOTHETICAL 17.1 KD PROTEIN IN USHA-TESA INTERGENIC REGION] [SP:P37175:P77281] |
| Contig152G | 14877125_c2_671 | 3482 | 7608 | 1161 | 386 | 1940 | 1.90E−200 | sp:[LN:PQQE_ACICA] [AC:P07782:Q43987] [GN:PQQE:PQQIII] [OR:ACINETOBACTER CALCOACETICUS] [DE:COENZYME PQQ SYNTHESIS PROTEIN E (COENZYME PQQ SYNTHESIS PROTEIN III)] [SP:P07782:Q43987] |
| Contig152G | 14884692_c2_585 | 3483 | 7609 | 276 | 91 | | | NO-HIT |
| Contig152G | 14886505_c2_569 | 3484 | 7610 | 729 | 242 | 656 | 2.20E−64 | sp:[LN:UNG_HAEIN] [AC:P43731] [GN:UNG:HI0018] [OR:HAEMOPHILUS INFLUENZAE] [EC:3.2.2.—] [DE:URACIL-DNA GLYCOSYLASE, (UDG)] [SP:P43731] |
| Contig152G | 14978432_c3_685 | 3485 | 7611 | 963 | 320 | 325 | 2.70E−29 | sp:[LN:YF72_HAEIN] [AC:P46495] [GN:HI1572] [OR:HAEMOPHILUS INFLUENZAE] [DE:PUTATIVE INTEGRASE/RECOMBINASE HI1572] [SP:P46495] |
| Contig152G | 15087800_f3_365 | 3486 | 7612 | 540 | 179 | 249 | 3.00E−21 | sp [LN HSCB_ECOLI] [AC:P36540] [GN.HSCB] [OR:ESCHERICHIA COLI] [DE:CHAPERONE PROTEIN HSCB (HSC20)] [SP:P36540] |
| Contig152G | 15625661_f2_197 | 3487 | 7613 | 195 | 64 | | | NO-HIT |
| Contig152G | 15630327_c1_507 | 3488 | 7614 | 339 | 112 | | | NO-HIT |
| Contig152G | 15641001_c2_587 | 3489 | 7615 | 357 | 118 | | | NO-HIT |
| Contig152G | 15711693_c1_543 | 3490 | 7616 | 798 | 265 | 358 | 8.40E−33 | sp:[LN:YWFD_BACSU] [AC:P39640] [GN:YWFD:IPA-82D] [OR:BACILLUS SUBTILIS] [EC:1.—.—.—] [DE:(ED 1.—.—.—)] [SP:P39640] |
| Contig15S2G | 15714787_f3_418 | 3491 | 7617 | 1008 | 335 | 417 | 4.70E−39 | sp:[LN:YQAJ_BACSU] [AC.P45907] [GN:YQAJ] [OR:BACILLUS SUBTILIS] [DE:HYPOTHETICAL 37.0 KD PROTEIN IN SPOIIIC-CWLA INTERGENIC REGION] [SP:P45907] |
| Contig152G | 15828390_c2_581 | 3492 | 7618 | 1584 | 527 | 333 | 8.50E−30 | pir:[LN:S53867] [AC:S53867] [PN:cytosine methyltransferase Dcm5a] [OR:Halobacterium salinarium] |
| Contig152G | 16120181_f1_66 | 3493 | 7619 | 309 | 102 | 257 | 4.30E−22 | pir:[LN:R3EC20] [AC:A30425:A02748:S40547:G64 722:507374] [PN:ribosomal protein S20] [GN:rpsT] [CL:Escherichia coli ribosomal protein 520] [OR:Escherichia coli] [MP:0 min] |
| Contig152G | 16135905_c1_452 | 3494 | 7620 | 1704 | 567 | 1983 | 5.40E−205 | sp:[LN:RS1_ECOLI] [AC:P02349:P77352] [GN:RPSA:SSYF] [OR:ESCHERICHIA COLI] [DE:30S RIBOSOMAL PROTEIN S1] [SP:P02349:P77352] |
| Contig152G | 16439765_c3_789 | 3495 | 7621 | 942 | 313 | 550 | 3.80E−53 | sp:[LN:MODA_ECOLI] [AC:P37329] [GN:MODA] [OR:ESCHERICHIA COLI] [DE:MOLYBDATE-BINDING PERIPLASMIC PROTEIN PRECURSOR] [SP:P37329] |

TABLE 2-continued

| Query | Orf | NT ID | AA ID | NT Lgth | AA Lgth | Score | P-value | Subject |
|---|---|---|---|---|---|---|---|---|
| Contig152G | 16516080_c3_695 | 3496 | 7622 | 1665 | 554 | 184 | 1.80E−12 | gp:[GI:g3249594] [LN:AF065411] [AC:AF065411] [PN:large terminase subunit] [OR:Methanobacterium phage psiM2] [DE:Methanobacterium phage psiM2, complete genome.] [NT:ORF9; similar to *Bacilius subtilis* phage SPP1 large] |
| Contig152G | 16587706_c3_786 | 3497 | 7623 | 699 | 232 | 340 | 6.80E−31 | sp [LN:NTAB_CHEHE] [AC:P54990] [GN:NTAB:NMOB] [OR:CHELATOBACTER HEINTZII] [EC:1.14.13.—] [DE:MONOOXYGENASE COMPONENT B) (NTA-MO B)] [SP:P54990] |
| Contig152G | 16600276_c3_723 | 3498 | 7624 | 3480 | 1159 | 2898 | 5.90E−302 | sp:[LN:MFD_ECOLI] [AC:P30958:P77592] [GN:MFD] [OR:*ESCHERICHIA COLI*] [DE:TRANSCRIPTION-REPAIR COUPLING FACTOR (TRCF)] [SP:P30958:P77592] |
| Contig152G | 16801027_c2_620 | 3499 | 7625 | 1182 | 393 | 787 | 2.90E−78 | pir:[LN:SYECLA] [AC:F64742:B28389:D33171:A28390] [PN:lipid-A-disaccharide synthase,] [GN:lpxB] [CL:lipid A disaccharide synthase) [OR:*Escherichia coli*] [EC:2.4.1.182] [MP:4 min] |
| Contig152G | 16833125_c1_528 | 3500 | 7626 | 861 | 286 | 840 | 7.10E−84 | gp:[GI:g4323638] [LN:AF102513] [AC:AF102513] [PN:regulatory protein GdhBR] [GN:gdhBR] [OR:*Pantoea citrea*] [DE:*Pantoea citrea* regulatory protein GdhBR (gdhBR) gene, complete cds.] [NT:similar to the AraC-like transcriptional] |
| Contig152G | 16834650_c2_568 | 3501 | 7627 | 966 | 321 | 411 | 2.00E−38 | sp:[LN:GSPK_PSEAE] [AC:Q00518] [GN:XCPX] [OR:*PSEUDOMONAS AERUGINOSA*] [DE:GENERAL SECRETION PATHWAY PROTEIN K] [SP:Q00518] |
| Contig152G | 16896043_f3_274 | 3502 | 7628 | 501 | 166 | 311 | 1.70E−27 | sp:[LN:YMDC_ECOLI) [AC:P75919] [GN:YMDC] [OR:*ESCHERICHIA COLI*] [DE:HYPOTHETICAL 55.9 KD PROTEIN IN CSGC-MDOG [NTERGENIC REGION] [SP:P75919] |
| Contig152G | 17065702_f1_35 | 3503 | 7629 | 183 | 60 | | | NO-HIT |
| Contig152G | 182801_c2_571 | 3504 | 7630 | 717 | 238 | 524 | 2.20E−50 | sp:[LN:KCY_ECOLI] [AC:P23863:P03823:P78263] [GN:CMK:MSSA] [OR:*ESCHERICHIA COLI*] [EC:2.7.4.14] [pE:(CMP KINASE) (MSSA PROTEIN) (P25)] [SP:P23863:P03823:P78263] |
| Contig152G | 187763_c2_670 | 3505 | 7631 | 924 | 307 | 1518 | 1.00E−155 | sp:[LN PQQB_ACICA] [AC P07779] [GN:PQQB:PQQV] [OR:*ACINETOBACTER CALCOACETICUS*] [DE:COENZYME PQQ SYNTHESIS PROTEIN B (COENZYME PQQ SYNTHESIS PROTEIN V)] [SP:P07779] |
| Contig152G | 19557942_c1_438 | 3506 | 7632 | 1200 | 399 | 1286 | 3.90E−131 | pir:[LN:D64074] [AC:D64074] [PN:phosphoglycerate kinase,] [CL:phosphoglycerate kinase] [OR:*Haemophilus influenzae*] [EC:2.7.2.3] |
| Contig152G | 19571877_f3_293 | 3507 | 7633 | 204 | 67 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig152G | 19578177_c1_444 | 3508 | 7634 | 705 | 234 | 242 | 1.70E−20 | sp:[LN:EXB1_SYNY3] [AC:Q55834] [GN:SLL0477] [OR:SYNECHOCYSTIS SP] [SR:PCC 6803,] [DE:PUTATIVE BIOPOLYMER TRANSPORT EXBB-LIKE PROTEIN 1] [SP:Q55834] |
| Contig152G | 19689376_c3_727 | 3509 | 7635 | 528 | 175 | 188 | 8.70E−15 | gp:[GI:e1357075:g3955017] [LN:POL010393] [AC:AJ010393] [PN:phaF protein] [GN:phaF] [FN:regulator associated to the] [OR:*Pseudomonas oleovorans*] [DE:*Pseudomonas oleovorans* phaI and phaF genes, and ORF1, ORF2(partial) and ORF3.] |
| Contig152G | 19719687_c3_715 | 3510 | 7636 | 1803 | 600 | 164 | 3.70E−17 | sp:[LN:DPPA_ECOLI] [AC:P23847] [GN:DPPA] [OR:*ESCHERICHIA COLI*] [DE:PROTEIN) (DBP)] [SP:P23847] |
| Contig152G | 19953811_f2_250 | 3511 | 7637 | 930 | 309 | 294 | 5.10E−26 | sp:[LN:YBJE_ECOLI] [AC:P75826] [GN:YBJE] [OR:*ESCHERICHIA COLI*] [DE:HYPOTHETICAL 34.4 KD PROTEIN IN POXB-AQPZ INTERGENIC REGION] [SP:P75826] |
| Contig152G | 20031282_c1_471 | 3512 | 7638 | 513 | 170 | | | NO-HIT |
| Contig152G | 20080050_f2_156 | 3513 | 7639 | 453 | 150 | 263 | 9.90E−23 | gp:[GI:e1316902:g3451442] [LN:SC1F2] [AC:AL031350] [PN:hypothetical protein SC1F2.10] [GN:SC1F2.10] [OR:*Streptomyces coelicolor*] [DE:*Streptomyces coelicolor* cosmid 1F2.] [NT:SC1F2.10, unknown, len: 135; similar to] |
| Contig152G | 20101528_f2_249 | 3514 | 7640 | 603 | 200 | | | NO-HIT |
| Contig152G | 20187827_c3_795 | 3515 | 7641 | 1077 | 358 | 1494 | 3.50E−153 | pir:[LN:JC4222] [AC:JC4222] [PN:membrane dipeptidase, homolog] [GN:acdp] [CL:membrane dipeptidase] [OR:*Acinetobacter calcoaceticus*] [EC:3.4.13.19] |
| Contig152G | 20397293_f2_160 | 3516 | 7642 | 960 | 319 | 455 | 4.40E−43 | pir:[LN:C64906] [AC:C64906] [PN:probable membrane protein b1520] [OR:*Escherichia coli*] |
| Contig152G | 20447160_f1_44 | 3517 | 7643 | 417 | 138 | 221 | 2.80E−18 | sp:[LN:HNT1_YEAST] [AC:Q04344] [GN:HNTI:HITI:YDL125C] [OR:*SACCHAROMYCES CEREVISIAE*] [SR:,BAKER'S YEAST] [DE:HIT FAMILY PROTEIN 1] [SP:Q04344] |
| Contig152G | 20579426_c3_729 | 3518 | 7644 | 1257 | 418 | 1850 | 6.60E−191 | gp:[GI:e1i73487:g2623971] [LN:ASAJ2316] [AC:AJ002316] [PN:terminal alkane hydroxylase] [GN:alkM] [FN:necessary for growth on alkanes] [OR:Acinetobacter sp. ADP1] [DE:Acinetobacter sp. ADP1 alkR & alkM genes, ORF1 & ORF4.] |
| Contig152G | 2127202_c2_609 | 3519 | 7645 | 294 | 97 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig152G | 21492187_c1_542 | 3520 | 7646 | 1302 | 433 | 405 | 880E−38 | gp[GI:g3643991] [LN:AF087482] [AC:AF087482] [PN:dienelactone hydrolase] [GN:clcD] [OR:*Pseudomonas aeruginosa*] [DE:*Pseudomonas aeruginosa* clcC and ohbH genes, Lys-R type regulatoryprotein (clcR), chlorocatechol-1,2-dioxygenase (clcA),chloromuconate cycloisomerase (clcB), dienelactone hydrolase(clcD), maleylacetate reductase (clcE), transposase (tnpA),ATP-binding protein (tnpB), putative regulatory protein (ohbR),o-halobenzoate dioxygenase reductase (dhbA), o-halobenzoatedioxygenase alpha subunit (ohbB), o-halobenzoate dioxygenase betasubunit (ohbC), o-halobenzoate dioxygenase ferredoxin (ohbD),putative membrane spanning protein (ohbE), ATP-binding protein(ohbF), putative substrate binding protein (ohbG), and putativedioxygenase genes, complete cds; and unknown gene.] |
| Contig152G | 21535205_c1_464 | 3521 | 7647 | 795 | 264 | 234 | 1.20E−19 | gp:[GI:g3294483] [LN:STAF001386] [AC:AF001386] [PN:unknown] [OR:*Salmonella typhimurium*] [DE:*Salmonella typhimurium* sigma-E factor regulatory protein (rseA)gene, partial cds; sigma-E factor regulatory protein (rseB),sigma-F factor regulatory protein (rseC), truncated GTP-bindingprotein (lepA), complete cds; Gifsy-1 prophage left-end portion:putative integrase (int), putative excisionase (xis), andexodeoxyribonuclease VIII (recE) genes, complete cds; and unknowngenes.] [NT:ORF-9; similar to *Escherichia coli* DnaC protein] |
| Contig152G | 21603412_c1_553 | 3522 | 7648 | 762 | 253 | 1314 | 4.20E−134 | sp [LN PQQC_ACICA] [AC:P07780] [GN:PQQC:PQQI] [OR:*ACINETOBACTER CALCOACETICUS*] [DE:COENZYME PQQ SYNTHESIS PROTEIN C (COENZYME PQQ SYNTHESIS PROTEIN 1)] [SP:P07780] |
| Contig152G | 21619437_c2_647 | 3523 | 7649 | 2244 | 747 | 703 | 2.30E−69 | gp:[GI:g1753160] [LN:BBU79564] [AC:U79564] [PN:unidentified ferric siderophore receptor] [GN:bfrC] [OR:*Bordetella bronchiseptica*] [DE:*Bordetetia bronchiseptica* unidentified ferric siderophore receptor(bfrC) gene, complete cds.] |
| Contig152G | 21673933_c2_608 | 3524 | 7650 | 2280 | 759 | 888 | 1.20E−96 | gp:[GI:d1038436:g4239823] [LN:AB010890] [AC:AB010890 [PN:IutA] [GN:lutA] [OR:*Vibrio orientalis*] [SR:*Vibrio orientalis* (isolate:SD004) DNA] [DE:*Vibrio orientalis* gene for IutA, complete cds.] |
| Contig152G | 21676556_f1_73 | 3525 | 7651 | 765 | 254 | 206 | 2.00E−16 | sp:[LN:TONB_PSEAE] [AC:Q51368] [GN:TONB] [OR:*PSEUDOMONAS AERUGINOSA*] [DE:TONB PROTEIN] [SP:Q51368] |
| Contig152G | 21678193_c3_689 | 3526 | 7652 | 234 | 77 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig152G | 21678303_c2_560 | 3527 | 7653 | 273 | 90 | | | NO-HIT |
| Contig152G | 21694215_c1_445 | 3528 | 7654 | 444 | 147 | 141 | 8.30E−10 | pir:[LN:S74451] [AC:S74451] [PN:hypothetical protein sll1405] [OR:Synechocystis sp.] [SR:PCC 6803, , PCC 6803] [SR:PCC 6803,] |
| Contig152G | 2177_f1_32 | 3529 | 7655 | 222 | 73 | | | NO-HIT |
| Contig152G | 21914213_c1_490 | 3530 | 7656 | 1743 | 580 | 1272 | 1.20E−129 | gp:[GI:g2665708] [LN:AF035413] [AC:AF035413] [PN:AgaD] [GN:agaD] [OR:*Agrobacterium tumefaciens*] [DE:*Agrobacterium tumefaciens* AgaA, AgaC, AgaB, AgaD, AgaE, AgaF, AgaG,MoaR; MoaB, MoaC, MoaD, and MoaA genes, complete cds.] |
| Contig152G | 22085077_c2_589 | 3531 | 7657 | 186 | 61 | | | NO-HIT |
| Contig152G | 22150408_c2_643 | 3532 | 7658 | 747 | 248 | 342 | 4.20E−31 | pir:[LN:D70044] [AC:D70044] [PN:transcription regulator GntR family homolog yvoA] [GN:yvoA] [CL:transcription regulator GntR] [OR:*Bacilius subtilis*] |
| Contig152G | 22305438_f1_288 | 3533 | 7659 | 1356 | 451 | 915 | 8.00E−92 | gp:[GI:g3172116] [LN:ACCPCAOP] [AC:L05770:U04359:M33798:U20284:U11554:L13114:L03407] [PN:putative transport protein] [GN:pcaK] [OR:Acinetobacter sp. ADP1] [DE:Acinctobacter sp. ADP1 pca-qui-pob supraoperonic cluster, completesequence.] |
| Contig152G | 22459512_f3_430 | 3534 | 7660 | 2553 | 850 | 566 | 2.60E−53 | sp:[LN:OSTA_HAEIN] [AC:P44846] [GN:IMP:OSTA:HI0730] [OR:*HAEMOPHILUS INFLUENZAE*] [DE:ORGANIC SOLVENT TOLERANCE PROTEIN HOMOLOG PRECURSOR] [SP:P44846] |
| Contig152G | 22541086_c3_754 | 3535 | 7661 | 237 | 78 | | | NO-HIT |
| Contig152G | 22547318_c1_521 | 3536 | 7662 | 1104 | 367 | 1298 | 2.10E−132 | pir:[LN:SYECKR] [AC:G65005:S00509:S28890:JV0091:141140] [PN:chorismate synthase,:5-enolpyruvylshikimate-3-phosphate phospholyase] [GN:aroC] [CL:chorismate synthase] [OR:*Escherichia coli*] [EC:4.6.1.4] [MP:51 min] |
| Contig152G | 22657582_c3_693 | 3537 | 7663 | 792 | 263 | 108 | 2.90E−07 | sp:[LN:TERS_BPSF6] [AC:Q38627] [GN:1] [OR:BACTERIOPHAGE SF6:BACTERIOPHAGE RHO-i5] [DE:TERMINASE SMALL SUBUNIT (G1P)] [SP:Q38627] |
| Contig152G | 22662502_c2_562 | 3538 | 7664 | 1026 | 341 | 518 | 9.40E−50 | gp:[GI:g4545243] [LN:AF116284] [AC:AF116284] [PN:unknown] [OR:*Pseudomonas aeruginosa*] [DE:*Pseudomonas aeruginosa* DnaJ-like protein gene, complete cds; andunknown genes.] NT:Orf338; similar to *Chlorobium tepidum* OrfT] |
| Contig152G | 22665900_c2_611 | 3539 | 7665 | 522 | 173 | 376 | 1.00E−34 | sp:[LN COBP_PSEDE] [AC:P29931] [GN:COBP] [OR:*PSEUDOMONAS DENITRIFICANS*] [DE:COBINAMIDE KINASE/ COBINAMIDE PHOSPHATE GUANYLYLTRANSFERASE] [SP:P29931] |
| Contig152G | 22695375_c2_629 | 3540 | 7666 | 312 | 103 | 146 | 2.50E−10 | sp:[LN:YCGL_ECOLI] [AC:P76003] [GN:YCGL] [OR:*ESCHERICHIA COLI*] [DE:HYPOTHETICAL 12.4 KD PROTEIN IN MINC-SHEA INTERGENIC REGION] [SP:P76003] |

TABLE 2-continued

| Query | Orf | NT ID | AA ID | NT Lgth | AA Lgth | Score | P-value | Subject |
|---|---|---|---|---|---|---|---|---|
| Contig152G | 22775276_c3_771 | 3541 | 7667 | 1851 | 616 | 326 | 6.20E−43 | gp:[GI:g2576391] [LN:CVU84759] [AC:U84759] [PN:adenylylsulfate reductase alpha subunit] [GN:aprA] [OR:*Chromatium vinosum*] [DE:*Chromatium vinosum* sulfate adenylyltransferase (sat),adenylylsulfate reductase beta subunit (aprB), and adenylylsulfatereductase alpha subunit (aprA) genes, complete cds.] [NT:flavoprotein subunit] |
| Contig152G | 22863175_f3_435 | 3542 | 7668 | 189 | 62 | | | NO-HIT |
| Contig152G | 22890955_c3_684 | 3543 | 7669 | 609 | 202 | 404 | 1.10E−37 | gp:[GI:g4155434] [LN:AE001516] [AC:AE001516:AE001439] [PN:putative] [GN:jhp0867] [OR:*Helicobacter pylori* J99] [DE:*Helicobacter pylori*, strain J99 section 77 of 132 of the completegenome.] [NT:similar to *H. pylori* 26695 gene HP0933] |
| Contig152G | 22933308_f3_291 | 3544 | 7670 | 660 | 219 | 725 | 1.10E−71 | gp:[GI:e321777:g2370587] [LN:XCLPS1J] [AC:Y11313] [PN:IpsJ protein] [GN:IpsJ] [OR:*Xanthomonas campestris*] [DE:*X.campestris* lpsl, lpsJ, xanA genes and orfX.] |
| Contig152G | 23445377_c2_621 | 3545 | 7671 | 1071 | 356 | 554 | 1.40E−53 | pir:[LN:C64816] [AC:C64816] [PN:hypothetical protein b0795 precursor] [OR:*Escherichia coli*] |
| Contig152G | 23469026_c1_541 | 3546 | 7672 | 222 | 73 | | | NO-HIT |
| Contig152G | 23476686_f2_220 | 3547 | 7673 | 909 | 302 | 434 | 7.50E−41 | gp:[GI:g3916254] [LN:AF087669] [AC:AF087669] [PN:ExbB] [GN:exbB] [OR:*Bordetella bronchiseptica*] [DE:*Bordetella bronchiseptica* TonB (tonB), ExbB (exbB), and ExbD (exbD)genes, complete cds.] |
| Contig152G | 23489678_c1_446 | 3548 | 7674 | 996 | 331 | 331 | 6.10E−30 | sp:[LN:HOLB_PSEAE] [AC:P52024] [GN:HOLB] [OR:*PSEUDOMONAS AERUGINOSA*] [EC:2.7.7.7] [DE:DNA POLYMERASE III, DELTA'SUBUNIT,] [SP:P52024] |
| Contig152G | 23519067_f2_248 | 3549 | 7675 | 960 | 319 | 110 | 0.00095 | pir:[LN:JN0845] [AC:JN0845:S31825] [PN:enterohemolysin 1:33K enterohemolysin protein] [OR:*Escherichia coli*] |
| Contig152G | 23523452_c1_447 | 3550 | 7676 | 381 | 126 | 140 | 1.10E−09 | sp:[LN:GSPI_KLEPN] [AC:P15748] [GN:PULI] [OR:*KLEBSIELLA PNEUMONIAE*] [DE:PROTEIN PULI)] [SP:P15748] |
| Contig152G | 23538275_c1_335 | 3551 | 7677 | 231 | 76 | | | NO-HIT |
| Contig152G | 23600187_c3_681 | 3552 | 7678 | 639 | 212 | 126 | 3.20E−07 | pir:[LN:B70391] [AC:B70391] [PN:transcription regulator TetR/AcrR family] [GN:acrR1] [OR:*Aquifex aeolicus*] |
| Contig152G | 23609385_f1_51 | 3553 | 7679 | 1161 | 386 | 1020 | 6.00E−103 | sp:[LN:AROF_ECOLI] [AC:P00888] [GN:AROF) [OR:*ESCHERICHIA COLI*] [EC:4.1.2.15] [DE:SYNTHETASE) (3-DEOXY-D-ARABINO-REPTULOSONATE 7-PHOSPHATE SYNTHASE)] [SP:P00888] |
| Contig152G | 23610943_c2_645 | 3554 | 7680 | 852 | 283 | 638 | 1.80E−62 | sp:[LN:Y412_METJA] [AC:Q57855] [GN:MJ0412] [OR:*METHANOCOCCUS JANNASCHII*] [DE:HYPOTHETICAL ABC TRANSPORTER ATP-BINDING PROTEIN MJ0412] [SP:Q57855] |

TABLE 2-continued

| Query | Orf | NT ID | AA ID | NT Lgth | AA Lgth | Score | P-value | Subject |
|---|---|---|---|---|---|---|---|---|
| Contig152G | 23619003_f2_186 | 3555 | 7681 | 1560 | 519 | 133 | 1.30E−05 | sp:[LN:YFPB_PSEAE] [AC:P42514] [OR:*PSEUDOMONAS AERUGINOSA*] [DE:HYPOTHETICAL 42.2 KD PROTEIN IN FPTB 3'REGION] [SP:P42514] |
| Contig152G | 23634700_c3_779 | 3556 | 7682 | 831 | 276 | | | NO-HIT |
| Contig152G | 23853760_f3_436 | 3557 | 7683 | 261 | 86 | | | NO-HIT |
| Contig152G | 24062537_f2_135 | 3558 | 7684 | 1107 | 368 | 433 | 9.50E−41 | gp:[GI:e314019:g2072731] [LN:PPY12655] [AC:Y12655] [PN:putative regulatory protein] [GN:oxoS] [OR:*Pseudomonas putida*] [DE:*P.putida* oxoS, oxoO, oxoH genes.] |
| Contig152G | 24071001_f1_126 | 3559 | 7685 | 966 | 321 | 395 | 1.00E−36 | sp:[LN:YMDC_ECOLI] [AC:P75919] [GN:YMDC] [OR:*ESCHERICHIA COLI*] [DE:HYPOTHETICAL 55.9 KD PROTEIN IN CSGC-MDOG INTERGENIC REGION] [SP:P75919] |
| Contig152G | 24222212_f1_40 | 3560 | 7686 | 198 | 65 | | | NO-HIT |
| Contig152G | 24234807_c2_590 | 3561 | 7687 | 579 | 192 | | | NO-HIT |
| Contig152G | 24238758_c2_593 | 3562 | 7688 | 2679 | 892 | 138 | 0.00036 | gp:[GI:e229492:g1765916] [LN:ECELIM] [AC:X96495] [PN:eliminase] [OR:*Escherichia coli*] [DE:*E.coli* gene encoding eliminase.] |
| Contig152G | 24240635_c1_462 | 3563 | 7689 | 339 | 112 | | | NO-HIT |
| Contig152G | 24245875_f1_15 | 3564 | 7690 | 1221 | 406 | 1330 | 8.40E−136 | gp:[GI:g1857942] [LN:PAU88653] [AC:U88653] [PN:thiolase] [GN:phaA] [OR:*Pseudomonas aeruginosa*] [DE:*Pseudomonas aeruginosa* thiolase (phaA) gene, complete cds.] |
| Contig152G | 24253217_c3_701 | 3565 | 7690 | 378 | 125 | | | NO-HIT |
| Contig152G | 24257958_c2_612 | 3566 | 7692 | 612 | 203 | 200 | 4.70E−16 | pir:[LN:D70450] [AC:D70450] [PN:phosphoglycerate mutase] [GN:gpmA] [CL:phosphoglycerate mutase homology] [OR:*Aquifex aeolicus*] |
| Contig152G | 24258468_c3_721 | 3567 | 7693 | 519 | 172 | 393 | 1.70E−36 | sp:[LN:MENG_ECOLI] [AC:P32165] [GN:MENG] [OR:*ESCHERICHIA COLI*] [EC:2.1.—.—] [DE:(EC 2.1.—.—)] [SP:P32165] |
| Contig152G | 24260453_f1_50 | 3568 | 7694 | 900 | 299 | 418 | 3.70E−39 | pir:[LN:E69853] [AC:E69853] [PN:conserved hypothetical protein yjnA] [GN:yjnA] [OR:*Bacillus subtitis*] |
| Contig152G | 24306512_f1_121 | 3569 | 7695 | 570 | 189 | 160 | 8.10E−12 | gp:[GI:e1312906:g3355680] [LN:SC1C2] [AC:AL031124] [PN:putative transcriptional regulator] [GN:SC1C2.13] [OR:*Streptomyces coelicolor*] [DE:*Streptomyces coelicolor* cosmid 1C2.] [NT:SC1C2.13, probable transcriptional regulator, len:] |
| Contig152G | 24319701_c1_466 | 3570 | 7696 | 222 | 73 | | | NO-HIT |
| Contig152G | 24322188_c2_555 | 3571 | 7697 | 207 | 68 | | | NO-HIT |
| Contig152G | 24398316_f2_219 | 3572 | 7698 | 1734 | 577 | 295 | 3.30E−27 | gp:[GI:g2529416] [LN:SSU73935] [AC:U73935] [PN:unknown] [OR:Shewanella sp. SCRC-2738] [DE:Shewanella sp. SCRC-2738 eicosapentaenoic acid (EPA) synthesis genecluster, complete sequence.] [NT:ORF3] |
| Contig152G | 24423387_c2_594 | 3573 | 7699 | 402 | 133 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig152G | 24424176_c2_655 | 3574 | 7700 | 1002 | 333 | 288 | 2.20E−25 | gp:[GI:e314019:g2072731] [LN:PPY12655] [AC:Y12655] [PN:putative regulatory protein] [GN:oxoS] [OR:*Pseudomonas putida*] [DE:*P.putida* oxoS, oxoO, oxoH genes.] |
| Contig152G | 24616337_c2_668 | 3575 | 7701 | 201 | 66 | | | NO-HIT |
| Contig152G | 24619033_c1_516 | 3576 | 7702 | 771 | 256 | 488 | 1.40E−46 | sp:[LN:YAFE_ECOLI] [AC:P30866] [GN:YAFE] [OR:*ESCHERICHIA COLI*] [DE:HYPOTHETICAL 23.0 KD PROTEIN IN ASPU-MLTD INTERGENIC REGION (ORF207)] [SP:P30866] |
| Contig152G | 24642278_c3_682 | 3577 | 7703 | 561 | 186 | 107 | 4.00E−06 | sp:[LN:GSPG_KLEPN] [AC:P15746] [GN:PULG] [OR:*KLEBSIELLA PNEUMONIAE*] [DE:PROTEIN PULG)] [SP:P15746] |
| Contig152G | 2461537_f2_179 | 3578 | 7704 | 1092 | 363 | 378 | 6.40E−35 | gp:[GI:g4160475] [LN:AF109909] [AC:AF109909] [PN:PHA synthase PhaC] [GN:phaC] [OR:*Bacillus megaterium*] [DE:*Bacillus megaterium* polyhydroxyalkanoate gene cluster, completesequence.] |
| Contig152G | 24787932_c3_738 | 3579 | 7705 | 1884 | 627 | 589 | 2.80E−57 | gp:[GI:g4151936] [LN:AF110737] [AC:AF110737] [PN:RhsF] [GN:rhsF] [FN:siderophore biosynthesis] [OR:*Sinorhizobium meliloti*] [DE:*Rhizobium melitoti* strain 2011 rhizobactin regulon completesequence.] [NT:similar to IucC] |
| Contig152G | 24823375_c3_700 | 3580 | 7706 | 423 | 140 | | | NO-HIT |
| Contig152G | 24890887_f1_43 | 3581 | 7707 | 330 | 109 | | | NO-HIT |
| Contig152G | 25415878_c2_607 | 3582 | 7708 | 1437 | 478 | 886 | 9.50E−89 | gp:[GI:g4151935] [LN:AF110737] [AC:AF110737] [PN:RhsE] [GN:rhsE] [FN:siderophore biosynthesis] [OR:*Sinorhizobium meliloti*] [DE:*Rhizobium melitoti* strain 2011 rhizobactin regulon, completesequence] [NT:similar to AlcA] |
| Contig152G | 25500952_c1_453 | 3583 | 7709 | 303 | 100 | 292 | 8.30E−26 | sp:[LN:IHFB_ERWCH] [AC:P37983] [GN:HIMD] [OR:*ERWINIA CHRYSANTHEMI*] [DE:INTEGRATION HOST FACTOR BETA-SUBUNIT (IHF-BETA)] [SP:P37983] |
| Contig152G | 25570302_c1_508 | 3584 | 7710 | 2175 | 724 | 224 | 1.70E−17 | sp:[LN:CBBY_RHOCA] [AC:O33513] [GN:CBBY] [OR:*RHODOBACTER CAPSULATUS*] [SR:,*RHODOPSEUDOMONAS CAPSULATA*] [DE:CBBY PROTEIN] [SP:O33513] |
| Contig152G | 25626662_f2_159 | 3585 | 7711 | 1293 | 430 | 634 | 4.50E−62 | pir:[LN:B70195] [AC:B70195] [PN:response regulatory protein (rrp-2) homolog] [CL:nitrogen assimilation regulatory protein ntrC:response regulator homology:RNA polymerase sigma factor interaction domain homology] [OR:*Borrelia burgdorferi*] [SR:, Lyme disease spirochete] |
| Contig152G | 25660050_c3_683 | 3586 | 7712 | 723 | 240 | 172 | 4.30E−13 | gp:[GI:g3978484] [LN:AF092918] [AC:AF092918] [PN:outer membrane secretion protein W] [GN:xcpW] [OR:*Pseudomonas alcaligenes*] [DE:*Pseudomonas alcaligenes* outer membrane Xcp-secretion system genecluster.] NT:XcpW] |

TABLE 2-continued

| Query | Orf | NT ID | AA ID | NT Lgth | AA Lgth | Score | P-value | Subject |
|---|---|---|---|---|---|---|---|---|
| Contig152G | 25665968_f1_99 | 3587 | 7713 | 216 | 71 | | | NO-HIT |
| Contig152G | 25785967_f1_33 | 3588 | 7714 | 1152 | 383 | 328 | 1.30E−29 | sp:[LN:YTH3_RHOSO] [AC:P46372] [OR:RHODOCOCCUS SP] [DE:HYPOTHETICAL 47.3 KD PROTEIN IN THCA 5'REGION (ORF3)] [SP:P46372] |
| Contig152G | 25879758_f2_205 | 3589 | 7715 | 414 | 137 | 562 | 2.00E−54 | pir:[LN:H65029] [AC:H65029] [PN:hypothetical protein b2529] [CL:Yeast nitrogen fixation protein:nitrogen fixation protein homology] [OR:*Escherichia coli*] |
| Contig152G | 26056532_c3_698 | 3590 | 7716 | 669 | 222 | 131 | 1.30E−08 | gp:[GI:g262360I] [LN:AF027874] [AC:AF027874] [PN:mucin-like protein] [OR:*Trypanosoma cruzi*] [DE:*Trypanosoma cruzi* mucin-like protein mRNA, partial cds.] [RE: |
| Contig152G | 26211712_c1_533 | 3591 | 7717 | 912 | 303 | 361 | 4.10E−33 | sp:[LN:YJIE_ECOLI] [AC:P39376] [GN:YJIE] [OR:*ESCHERICHIA COLI*] [DE:HYPOTHETICAL TRANSCRIPTIONAL REGULATOR IN UXUR-IADA INTERGENIC REGION] [SP:P39376] |
| Contig152G | 26257638_f3_358 | 3592 | 7718 | 1227 | 408 | 1888 | 6.20E−195 | gp:[GI:e1173388:g2623972] [LN:ASAJ2316] [AC:AJ002316] [PN:putative acyl-CoA dehydrogenase] [GN:ORF4] [OR:Acinetobacter sp. ADP1] [DE:Acinetobacter sp. ADP1 alkR & alkM genes, ORF1 & ORF4.] |
| Contig152G | 26305318_f3_420 | 3593 | 7719 | 396 | 131 | | | NO-HIT |
| Contig152G | 26305430_f2_221 | 3594 | 7720 | 438 | 145 | 255 | 6.90E−22 | gp:[GI:g3916255] [LN:AF087669] [AC:AF087669] [PN:ExbD] [GN:exbD] [OR:*Bordetella bronchiseptica*] [DE:*Bordetella bronchiseptica* TonB (tonB), ExbB (exbB), and ExbD (exbD)genes, complete cds.] |
| Contig152G | 26345328_c3_677 | 3595 | 7721 | 1728 | 575 | 1141 | 9.00E−116 | sp:[LN:MSBA_HAEIN] [AC:P44407] [GN:MSBA:MSH-1:HI0060] [OR:*HAEMOPHILUS INFLUENZAE*] [DE:PROBABLE TRANSPORT ATP-BINDING PROTEIN MSBA] [SP:P44407] |
| Contig152G | 26359375_f1_4 | 3596 | 7722 | 1893 | 630 | 963 | 6.50E−97 | sp:[LN:YPQL_ACICA] [AC:P07778] [OR:*ACINETOBACTER CALCOACETICUS*] [DE:HYPOTHETICAL PROTEIN IN PQQ-V 5'REGION (ORF L) (FRAGMENT)] [SP:P07778] |
| Contig152G | 26360952_c3_793 | 3597 | 7723 | 285 | 94 | 455 | 4.40E−43 | sp:[LN:PQQD_ACICA] [AC:P07781] [GN:PQQD:PQQII] [OR:*ACINETOBACTER CALCOACETICUS*] [DE:COENZYME PQQ SYNTHESIS PROTEIN D (COENZYME PQQ SYNTHESIS PROTEIN II)] [SP:P07781] |
| Contig152G | 26369017_f1_122 | 3598 | 7724 | 312 | 103 | 188 | 8.70E−15 | sp:[LN:HLYU_VIBCH] [AC:P52695] [GN:HLYU] [OR:*VIBRIO CHOLERAE*] [DE:TRANSCRIPTIONAL ACTIVATOR HLYU] [SP:P52695] |
| Contig152G | 26565930_f2_270 | 3599 | 7725 | 1332 | 443 | 522 | 3.50E−50 | sp:[LN:SURA_ECOLI] [AC:P21202:P75630] [GN:SURA] [OR:*ESCHERICHIA COLI*] [EC:52.1.8] [DE:SURA), (PPIASE) (ROTAMASE C)] [SP:P21202:P75630] |

TABLE 2-continued

| Query | Orf | NT ID | AA ID | NT Lgth | AA Lgth | Score | P-value | Subject |
|---|---|---|---|---|---|---|---|---|
| Contig152G | 26594062_c2_658 | 3600 | 7726 | 1257 | 418 | 409 | 3.30E−38 | gp:[GI:e304489:g2154927] [LN:PFSTYABCD] [AC:Z92524] [PN:StyA protein] [GN:styA] [FN:Main component of styrene monooxygenase] [OR:*Pseudomonas fluorescens*] [DE:*P.fluorescens* styA, styB, styC and styD genes.] |
| Contig152G | 26648462_c1_505 | 3601 | 7727 | 612 | 203 | 191 | 4.20E−15 | pir:[LN:F69218] [AC:F69218] [PN:conserved hypothetical protein MTH888] [GN:MTH888] [CL:*Methanococcus jannasehii* conserved hypothetical protein MJ0644] [OR:*Methanobacterium thermoautotrophicum*] |
| Contig152G | 26695153_c1_534 | 3602 | 7728 | 915 | 304 | 493 | 4.20E−47 | sp:[LN:NAHR_PSEPU] [AC:P10183] [GN:NAHR] [OR:*PSEUDOMONAS PUTIDA*] [DE:TRANSCRIPTIONAL ACTIVATOR PROTEIN NAHR] [SP:P10183] |
| Contig152G | 26775387_c3_724 | 3603 | 7729 | 1485 | 494 | 329 | 4.20E−27 | gp:[GI:d1014695:g1754636] [LN:D89622] [AC:D89622] [PN:adenylate cyclase] [GN:cyaA] [OR:Anabaena sp.] [SR:Anabaena sp. (strain:PCC7120) DNA] [EC:4.6.1.1] [DE:Anabaena sp. cyaA gene for adenylate cyctase, complete cds.] |
| Contig152G | 2869026_f2_207 | 3604 | 7730 | 1863 | 620 | 1583 | 1.30E−162 | sp:[LN:HSCA_HAEIN] [AC:P44669] [GN:HSCA:HI0373] [OR:*HAEMOPHILUS INFLUENZAE*] [DE:CHAPERONE PROTEIN HSCA (HSC66)] [SP:P44669] |
| Contig152G | 2929077_c3_781 | 3605 | 7731 | 786 | 261 | 882 | 2.50E−88 | sp:[LN:YXJF_BACSU] [AC:P42317] [GN:YXJF:N15M] [OR:*BACILLUS SUBTILIS*] [EC:1,—.—.—] [DE:(EC 1.—.—.—)] [SP:P42317] |
| Contig152G | 2931583_c2_641 | 3606 | 7732 | 612 | 203 | 358 | 8.40E−33 | sp:[LN:ACPD_ECOLI] [AC:P41407:P77143] [GN:ACPD] [OR:*ESCHERICHIA COLI*] [DE:ACYL CARRIER PROTEIN PHOSPHODIESTERASE (ACP PHOSPHODIESTERASE)] [SP:P41407:P77143] |
| Contig152G | 29723305_c2_613 | 3607 | 7733 | 1584 | 527 | 136 | 3.90E−07 | gp:[GI:g4191340] [LN:AF084943] [AC:AF084943] [PN:multiple inositol polyphosphate phosphatase] [OR:*Homo sapiens*] [DE:*Homo sapiens* multiple inositol polyphosphate phosphatase mRNA,complete cds.] NT:similar to histidine acid phosphatase] |
| Contig152G | 29860957_c1_465 | 3608 | 7734 | 300 | 99 | | | NO-HIT |
| Contig152G | 29971010_c3_703 | 3609 | 7735 | 684 | 227 | | | NO-HIT |
| Contig152G | 3001408_c1_449 | 3610 | 7736 | 1149 | 382 | 409 | 3.30E−38 | gp:[GI:g485111] [LN:CELF09F7] [AC:U00050] [GN:F09F7.4] [OR:*Caenorhabditis elegans*] [SR:*Caenorhabditis elegans* strain=Bristol N2] [DE:*Caenorhabditis elegans* cosmid F09F7.]NT:similar to enoyl-CoA hydratases; highest similarity] |
| Contig152G | 3004692_c2_653 | 3611 | 7737 | 297 | 98 | 86 | 0.00056 | gp:[GI:g3883021] [LN:AF074611] [AC:AF074611] [PN:unknown] [GN:Y1020] [OR:*Yersinia pestis*] [DE:*Yersinia pestis* plasmid pMT-1, complete plasmid sequence.] [NT:f140; 35 pct identical (1 gap) to 48 residues of an] |

TABLE 2-continued

| Query | Orf | NT ID | AA ID | NT Lgth | AA Lgth | Score | P-value | Subject |
|---|---|---|---|---|---|---|---|---|
| Contig152G | 3018817_c1_524 | 3612 | 7738 | 1149 | 382 | 753 | 1.20E−74 | pir:[LN:H69789] [AC:H69789] [PN:L-iditol 2-dehydrogenase, homolog ydjL:sorbitol dehydrogenase homolog] [GN:ydjL] [CL:alcohol dehydrogenase:long-chain alcohol dehydrogenase homology] [OR:*Bacillus subtilis*] [EC:1.1.1.14] |
| Contig152G | 30270442_c2_649 | 3613 | 7739 | 240 | 79 | | | NO-HIT |
| Contig152G | 30292177_c3_722 | 3614 | 7740 | 795 | 264 | 340 | 5.10E−39 | gp:[GI:e1419919:g4539003] [LN:ATT5L19] [AC:AL049481] [PN:putative protein] [GN:T5L19.130] [OR:*Arabidopsis thaliana*] [SR:thale cress] [DE:*Arabidopsis thaliana* DNA chromosome 4, BAC clone T5L19 (ESSAproject).] [NT:contains EST gb:Aa394790,R30123] |
| Contig152G | 30745325_c3_796 | 3615 | 7741 | 192 | 63 | | | NO-HIT |
| Contig152G | 31251577_c2_610 | 3616 | 7742 | 1524 | 507 | 104 | 2.80E−05 | sp:[LN:YFPB_PSEAE] [AC:P42514] [OR:*PSEUDOMONAS AERUGINOSA*] [DE:HYPOTHETICAL 42.2 KD PROTEIN IN FPTB 3'REGION] [SP:P42514] |
| Contig152G | 31254592_c3_719 | 3617 | 7743 | 747 | 248 | 173 | 3.40E−13 | pir:[LN:F69896] [AC:F69896] [PN:conserved hypothetical protein yoaM] [GN:yoaM] [OR:*Bacillus subtilis*] |
| Contig152G | 31416011_f1_62 | 3618 | 7744 | 489 | 162 | 406 | 6.90E−38 | gp:[GI:g3046321] [LN:AF010139] [AC:AF010139.] [PN:unknown] [OR:*Azotobacter vinelandii*] [DE:*Azotobacter vinelandii* iron-sulfur cluster assembly gene cluster,suhB, cysE2, iscS, iscU, iscA, hscB, hscA and fdx genes completecds; ndk gene, partial cds.] [NT:orf2] |
| Contig152G | 31527277_f3_419 | 3619 | 7745 | 252 | 83 | 121 | 1.10E−07 | gp[GI:g2731435] [LN PHU73302] [AC:U73302] [PN.FIS] [OR:*Pasteurella haemolytica*] [DE:*Pasteurella haemolytica* RNAse T, transferrin binding protein B,transferrin binding protein A and FIS genes, completecds.] [NT:similar to factor for inversion stimulation] |
| Contig152G | 31888_f2_198 | 3620 | 7746 | 1386 | 461 | 434 | 2.60E−45 | gp:[GI:g3859609] [LN:T15B16] [AC:AF104919] [GN:T15B16.14] [OR:*Arabidopsis thaliana*] [SR:thale cress] [DE:*Arabidopsis thaliana* BAC TI5B16.] [NT:*Arabidopsis thaliana* ABCI protein (GB:AJ001158)] |
| Contig152G | 32039582_c2_586 | 3621 | 7747 | 387 | 128 | | | NO-HIT |
| Contig152G | 32067926_f3_334 | 3622 | 7748 | 1149 | 382 | 215 | 2.70E−15 | gp:[GI:e235755:g1922276] [LN:EVPORIN] [AC:X97062] [PN:porin] [OR:*Ectothiorhodospira vacuolata*] [DE:*E. vacuolata* gene encoding porin.] |
| Contig152G | 32071000_c3_772 | 3623 | 7749 | 1446 | 481 | 222 | 2.40E−16 | gp:[GI:g3420605] [LN:AF075709] [AC:AF075709] [PN:putative sulfonate binding protein precursor] [GN:ssuA] [OR:*Pseudomonas putida*] [DE:*Pseudomonas putida* LsfA (lsfA), complete cds; and ssu locus,complete sequence.] NT:SsuA |
| Contig152G | 32143875_c1_463 | 3624 | 7750 | 408 | 135 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig152G | 33205150_f2_134 | 3625 | 7751 | 1068 | 355 | 1550 | 4.10E−159 | gp:[GI:g3511234] [LN:AF071556] [AC:AF071556] [PN:anthranilate dioxygenase reductase] [GN:antC] [OR:Acinetobacter sp. ADP1] [DE:Acinetobacter sp. ADP1 anthranilate dioxygenase large subunit(antA), anthranilate dioxygenase small subunit (antB), andanthranilate dioxygenase reductase (antC) genes, complete cds.] |
| Contig152G | 33225002_c1_442 | 3626 | 7752 | 657 | 218 | 401 | 2.30E−37 | sp:[LN:GIDB_ECOLI] [AC:P17113] [GN:GIDB] [OR:*ESCHERICHIA COLI*] [DE:GLUCOSE INHIBITED DIVISION PROTEIN B] [SP:P17113] |
| Contig152G | 33297167_f2_157 | 3627 | 7753 | 960 | 319 | 235 | 9.10E−20 | pir:[LN:G69897] [AC:G69897] [PN:conserved hypothetical protein yoaV] [GN:yoaV] [OR:*Bacillus subtilis*] |
| Contig152G | 33297312_f3_296 | 3628 | 7754 | 1326 | 441 | 1205 | 1.50E−122 | gp:[GI:g1206033] [LN:PPU48776] [AC:U48776] [PN:dicarboxylic acid transport protein] [GN:pcaT] [OR:*Pseudomonas putida*] [SR:*Pseudomonas putida* strain=PRS2000 (PRS1)] [DE:*Pseudomonas putida* dicarboxylic acid transport protein (pcaT) gene,complete cds.] [NT:; PcaT; associated with aromatic hydrocarbon] |
| Contig152G | 33364432_c2_599 | 3629 | 7755 | 780 | 259 | | | NO-HIT |
| Contig152G | 33446052_c1_501 | 3630 | 7756 | 1800 | 599 | 805 | 3.60E−80 | gp:[GI:g4151933] [LN:AF110737] [AC:AF110737] [PN:RhsC] [GN:rhsC] [FN:siderophore biosynthesis] [OR:*Sinorhizobium meliloti*] [DE:*Rhizobium melitoti* strain 2011 rhizobactin regulon, completesequence.] [NT:similar to IucA] |
| Contig152G | 33448750_c3_766 | 3631 | 7757 | 1425 | 474 | 1440 | 1.90E−147 | pir:[LN:JC4793] [AC:JC4793] [PN:dihydrolipoamide dehydrogenase,:diaphorase:lipoamide reductase (NADH):lipog1 dehydrogenase] [GN:acoD] [CL:dihydrolipoamide dehydrogenase:dihydrolipoamide dehydrogenase homology] [OR:*Klebsiella pneumoniae*] [EC:1.8.1.4] |
| Contig152G | 33478441_c1_530 | 3632 | 7758 | 858 | 285 | 421 | 1.80E−39 | sp:[LN:Y413_METJA] [AC:Q57856] [GN:MJ0413] [OR:*METHANOCOCCUS JANNASCHII*] [DE:PUTATIVE ABC TRANSPORTER PERMEASE PROTEIN MJ0413] [SP:Q57856] |
| Contig152G | 33712785_c1_517 | 3633 | 7759 | 1215 | 404 | 1289 | 1.90E−131 | sp:[LN:METZ_PSEAE] [AC:P55218] [GN:METZ] [OR:*PSEUDOMONAS AERUGINOSA*] [EC:4.2.99.—] [DE:O-SUCCINYLHOMOSERINE SULFHYDRYLASE, (OSH SULFHYDRYLASE)] [SP:P55218] |
| Contig152G | 33785938_f2_141 | 3634 | 7760 | 717 | 238 | 857 | 1.10E−85 | gp:[GI:e321778:g2370588] [LN:XCLPSIJ] [AC:Y11313] [PN:IpsJ protein] [GN:lpsI] [OR:*Xanthomonas campestris*] [DE:*X.campestris* lpsI, lpsJ, xanA genes and orfX.] |
| Contig152G | 33790818_f1_8 | 3635 | 7761 | 249 | 82 | | | NO-HIT |
| Contig152G | 33834427_c1_478 | 3636 | 7762 | 222 | 73 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig152G | 33985836_c2_592 | 3637 | 7763 | 6567 | 2188 | 118 | 1.60E−06 | gp:[GI:g2773363] [LN:AF041382] [AC:AF041382] [PN:microtubule binding protein D-CLIP-190] [OR:*Drosophila melanogaster*] [SR:fruit fly] [DE:*Drosophila melanogaster* microtubule binding protein D-CLIP-190mRNA, complete cds.] [NT:CLIP-170 homolog] |
| Contig152G | 33991443_c2_564 | 3638 | 7764 | 1023 | 340 | 539 | 5.60E−52 | sp:[LN:LPXK_HAEIN] [AC:P44491] [GN:LPXK:HI10059] [OR:*HAEMOPHILUS INFLUENZAE*] [EC:2.7.1.130] [DE:TETRAACYLDISACCHARIDE 4'-KINASE, (LIPID A 4'-KINASE)] [SP:P44491] |
| Contig152G | 34234676_f3_294 | 3639 | 7765 | 1434 | 477 | 1519 | 7.90E−156 | sp:[LN:ASPA_PSEFL] [AC:P07346] [GN:ASPA] [OR:*PSEUDOMONAS FLUORESCENS*] [EC:4.3.1.1] [DE:ASPARTATE AMMONIA-LYASE, (ASPARTASE)] [SP:P07346] |
| Contig152G | 34267186_f3_372 | 3640 | 7766 | 387 | 128 | | | NO-HIT |
| Contig152G | 34381667_c2_636 | 3641 | 7767 | 1578 | 525 | 1279 | 2.10E−130 | gp:[GI:g501026] [LN:KPU00985] [AC:U00985] [PN:dihydrolipoamide acetyltransferase] [GN:acoC] [FN:essential for utilization of acetoin] [OR:*Klebsiella pneumoniae*] [DE:*Klebsiella pneumoniac* CG43 acetoin:DCPIP oxidoreductase alphasubunit (acoA), acetoin:DCPIP oxidoreductase beta subunit (acoB)and dihydrolipoamide acetyltransferase (acoC) genes, cornplete cds.] [NT:putative lipoyl-binding site] |
| Contig152G | 34406257_f2_203 | 3642 | 7768 | 654 | 217 | | | NO-HIT |
| Contig152G | 34408518_c2_582 | 3643 | 7769 | 891 | 296 | 113 | 0.00043 | sp:[LN YDAU_ECOLI] [AC:P76065] [GN:YDAU] [OR:*ESCHERICHIA COLI*] [DE:HYPOTHETICAL 32.5 KD PROTEIN IN SIEB-TRKG INTERGENIC REGION] [SP:P76065] |
| Contig152G | 34413187_f3_416 | 3644 | 7770 | 885 | 294 | | | NO-HIT |
| Contig152G | 34414677_f2_142 | 3645 | 7771 | 1437 | 478 | 612 | 1.00E−59 | sp:[LN:ATOE_ECOLI] [AC:P76460] [GN:ATOE] [OR:*ESCHERICHIA COLI*] [DE:SHORT-CHAIN FATTY ACIDS TRANSPORTER] [SP:P76460] |
| Contig152G | 34570250_c2_632 | 3646 | 7772 | 1224 | 407 | 1141 | 9.00E−116 | sp:[LN:TRPB_PSEAE] [AC:P07345] [GN:TRPB] [OR:*PSEUDOMONAS AERUGINOSA*] [EC:4.2.1.20] [DE:TRYPTOPHAN SYNTHASE BETA CHAIN,] [SP:P07345] |
| Contig152G | 35157652_c2_637 | 3647 | 7773 | 852 | 283 | 690 | 5.60E−68 | sp:[LN:BUDC_KLEPN] [AC:Q48436] [GN:BUDC] [OR:*KLEBSIELLA PNEUMONIAE*] [EC:1.1.1.5] [DE:ACETOIN(DIACETYL) REDUCTASE, (ACETOIN DEHYDROGENASE) (AR)] [SP:Q48436] |
| Contig152G | 35704681_c1_476 | 3648 | 7774 | 261 | 86 | | | NO-HIT |
| Contig152G | 35941437_c2_624 | 3649 | 7775 | 306 | 101 | | | NO-HIT |
| Contig152G | 36125443_c3_688 | 3650 | 7776 | 351 | 116 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig152G | 37758_c2_665 | 3651 | 7777 | 906 | 301 | 480 | 1.00E−45 | sp:[LN:DHBA_BACSU] [AC:P39071] [GN:DHBA:ENTA] [OR:*BACILLUS SUBTILIS*] [EC:1.3.1.28] [DE:(COLD SHOCK PROTEIN CS114)] [SP:P39071] |
| Contig152G | 390842_f3_333 | 3652 | 7778 | 258 | 85 | | | NO-HIT |
| Contig152G | 3912542_c2_598 | 3653 | 7779 | 867 | 288 | 365 | 1.50E−33 | pir:[LN:A70330] [AC:A70330] [PN:CysQ protein] [GN:cysQ] [OR:*Aquifex aeolicus*] |
| Contig152G | 3922130_f2_199 | 3654 | 7780 | 1002 | 333 | 1006 | 1.80E−101 | gp:[GI:e1173486:g2623970] [LN:A5AJ2316] [AC:AJ002316] [PN:transcriptional regulator of XylS /AraC family] [GN:alkR] [FN:necessary for growth on alkanes] [OR:Acinetobacter sp. ADP1] [DE:Acinetobacter sp. ADP1 alkR & alkM genes, ORF1 & ORF4.] |
| Contig152G | 3945952_f2_185 | 3655 | 7781 | 2166 | 721 | 1104 | 7.50E−112 | sp:[LN FHUE_ECOLI] [AC:P16869:P77292] [GN:FHUE] [OR:*ESCHERICHIA COLI*] [DE:AND FE(III)- RHODOTRULIC ACID PRECURSOR] [SP:P16869:P77292] |
| Contig152G | 3954703_f2_247 | 3656 | 7782 | 384 | 127 | | | NO-HIT |
| Contig152G | 3960888_c2_622 | 3657 | 7783 | 1128 | 375 | 726 | 8.50E−72 | sp:[LN:YBHR_ECOLI] [AC:P75774] [GN:YBHR] [OR:ESCHERICHIA COLI] [DE:HYPOTHETICAL 41.6 KD PROTEIN IN MOAE-RHLE INTERGENIC REGION] [SP:P75774] |
| Contig152G | 397010_c3_780 | 3658 | 7784 | 1449 | 482 | 1488 | 1.50E−152 | sp:[LN:YXJC_BACSU] [AC:P42314] [GN:YXJC:N15J] [OR:BACILLUS SUBTILIS] [DE:HYPOTHETICAL 48.3 KD PROTEIN IN KATB 3'REGION] [SP:P42314) |
| Contig152G | 39762_f3_319 | 3659 | 7785 | 1002 | 333 | 931 | 1.60E−93 | gp:[GI:g146625] [LN:ECOLIPAB] [AC:L07636] [PN:LIPA protein] [GN:lipA] [OR:*Escherichia coli*] [SR:*Escherichia coli* (sub_strain W3110, strain K-12) (library: Kohar] [DE:*E.coli* lipoic acid biosynthesis lipA, lipB, and ORFs 1, 2 and 3genes, complete cds, dacA gene, 3'end.] |
| Contig152G | 3990638_c3_739 | 3660 | 7786 | 1920 | 639 | 153 | 1.80E−13 | gp:[GI:g1755194] [LN:LPU76559] [AC:U76559] [PN:FrgA] [GN:frgA] [OR:*Legionella pneumophila*] [DE:*Legionella pneumophila* iron repressed FrgA (frgA) gene, completecds.] [NT:iron repressed gene. similar to aerobactin] |
| Contig152G | 3995257_c1_546 | 3661 | 7787 | 360 | 119 | 183 | 3.00E−14 | sp:[LN:MODE_ECOLI] [AC:P46930] [GN:MODE:MODR] [OR:*ESCHERICHIA COLI*] [DE:MOLYBDENUM TRANSPORT PROTEIN MODE] [SP:P46930] |
| Contig152G | 400277_c2_638 | 3662 | 7788 | 699 | 232 | 576 | 6.70E−56 | pir:[LN:574892] [AC:S74892] [PN:hypothetical protein slr1259] [OR:Synechocystis sp.] [SR:PCC 6803, , PCC 6803] [SR:PCC 6803,] |
| Contig152G | 4009828_c2_584 | 3663 | 7789 | 438 | 145 | | | NO-HIT |
| Contig152G | 4025312_c3_720 | 3664 | 7790 | 669 | 222 | 271 | 1.40E−23 | sp:[LN:YRAR_ECOLI] [AC:P45469] [GN:YRAR] [OR:*ESCHERICHIA COLI*] [DE:HYPOTHETICAL 24.8 KD PROTEIN IN AGAI-MTR INTERGENIC REGION (F226)] [SP:P45469] |

TABLE 2-continued

| Query | Orf | NT ID | AA ID | NT Lgth | AA Lgth | Score | P-value | Subject |
|---|---|---|---|---|---|---|---|---|
| Contig152G | 4062668__f1__123 | 3665 | 7791 | 1212 | 403 | 1156 | 2.30E−117 | sp:[LN:YGJU__ECOLI] [AC:P42602] [GN:YGJU] [OR:*ESCHERICHIA COLI*] [DE:HYPOTHETICAL 43.5 KD PROTEIN IN EBGC-UXAA INTERGENIC REGION (O414)] [SP:P42602] |
| Contig152G | 4064553__c1__515 | 3666 | 7792 | 435 | 144 | | | NO-HIT |
| Contig152G | 4093758__c3__770 | 3667 | 7793 | 801 | 266 | 223 | 1.70E−18 | pir:[LN:574895] [AC:574895] [PN:hypothetical protein slr1262] [OR:Synechocystis sp.] [SR:PCC 6803, , PCC 6803] [SR:PCC 6803,] |
| Contig152G | 4094430__f1__120 | 3668 | 7794 | 408 | 135 | 341 | 5.30E−31 | pir:[LN:S76180] [AC:S76180] [PN:hypothetical protein] [OR:Synechocystis sp.] [SR:PCC 6803, , PCC 6803] [SR:PCC 6803,] |
| Contig152G | 4097203__f2__208 | 3669 | 7795 | 348 | 115 | 392 | 2.10E−36 | sp:[LN:FER__PSEAE] [AC:Q51383] [GN:FDX] [OR:PSEUDOMONAS AERUGINOSA] [DE:FERREDOXIN, 2FE−2S] [SP:Q51383] |
| Contig152G | 4099143__c2__639 | 3670 | 7796 | 1665 | 554 | 945 | 5.30E−95 | pir:[LN:S77262] [AC:S77262] [PN:hypothetical protein slr0876] [OR:Synechocystis sp.] [SR:PCC 6803, , PCC 6803] [SR:PCC 6803,] |
| Contig152G | 4120432__c1__503 | 3671 | 7797 | 1455 | 484 | 729 | 4.10E−72 | gp:[GI:d1039127:g4514352] [LN:AB013375] [AC:AB013375] [PN:YhcA] [GN:yhcA] [OR:*Bacillus halodurans*] [SR:*Bacillus halodurans* (strain:C-125) DNA] [DE:*Bacillus halodurans* C-125 ydiH, ydiI, ydij, yhcA and yxaA genes,complete and partial cds.] |
| Contig152G | 4173515__c2__601 | 3672 | 7798 | 480 | 159 | 100 | 0.00018 | pir:[LN:D71092] [AC:D71092] [PN:hypothetical protein PH1001] [GN:PH1001] [CL:histidine triad homology] [OR:*Pyrococcus horikoshii*] |
| Contig152G | 4179677__c1__443 | 3673 | 7799 | 804 | 267 | 782 | 9.90E−78 | sp:[LN:YGII__PSEPU] [AC:P31856] [OR:*PSEUDOMONAS PUTIDA*] [DE:HYPOTHETICAL 28.9 KD PROTEIN IN GIDB-UNCI INTERGENIC REGION] [SP:P31856] |
| Contig152G | 426382__c3__751 | 3674 | 7800 | 492 | 163 | | | NO-HIT |
| Contig152G | 4297818__c1__451 | 3675 | 7801 | 453 | 150 | | | NO-HIT |
| Contig152G | 4318838__c3__752 | 3676 | 7802 | 600 | 199 | 191 | 4.20E−15 | sp:[LN:YIDB__ECOLI] [AC:P09996:P76738] [GN:YIDB] [OR:*ESCHERICHIA COLI*] [DE:HYPOTHETICAL 13.8 KD PROTEIN IN IBPA-GYRB INTERGENIC REGION] [SP:P09996:P76738] |
| Contig152G | 4320302__c1__454 | 3677 | 7803 | 390 | 129 | 89 | 0.00084 | pir:[LN:S74701] [AC:S74701] [PN:hypothetical protein sl11191] [OR:Synechocystis sp.] [SR:PCC 6803, , PCC 6803] [SR:PCC 6803,] |
| Contig152G | 4339052__c3__716 | 3678 | 7804 | 1833 | 610 | 160 | 6.40E−18 | pir:[LN:A38447] [AC:A38447:S15230:G69668] [PN:oligopeptide ABC transport system substrate-binding protein oppA precursor:oppA homolog:sporulation initiation protein spo0KA] [GN:oppA:spo0KA] [CL:dipeptide transport protein] [OR:*Bacillus subtilis*] |
| Contig152G | 4354143__c3__691 | 3679 | 7805 | 837 | 278 | 389 | 4.40E−36 | pir:[LN:S71506] [AC:S71506:S78438] [PN:site-specific DNA-methyltransferase (cytosine-specific), BalI] [GN:BalI] [OR:*Brevibacterium albidum*] [EC:2.1.1.73] |

TABLE 2-continued

| Query | Orf | NT ID | AA ID | NT Lgth | AA Lgth | Score | P-value | Subject |
|---|---|---|---|---|---|---|---|---|
| Contig152G | 4398952_c1_475 | 3680 | 7806 | 453 | 150 | | | NO-HIT |
| Contig152G | 4406503_f3_434 | 3681 | 7807 | 1173 | 390 | 844 | 2.70E−84 | sp:[LN:YCFD_HAEIN] [AC:P44683] [GN:HI0396] [OR:*HAEMOPHILUS INFLUENZAE*] [DE:HYPOTHETICAL PROTEIN HI0396] [SP:P44683] |
| Contig152G | 4406625_f2_206 | 3682 | 7808 | 255 | 84 | 266 | 4.70E−23 | gp:[GI:g2271523] [LN:AF010139] [AC:AF010139] [PN:IscA] [GN;iscA] [OR:*Azotobacter vinelandii*] [DE:*Azotobacter vinelandii* iron-sulfur cluster assembly gene cluster,suhB, cysE2, iscS, iscU, iscA, hscB, hscA and fdx genes completecds; ndk gene, partial cds.] [NT:hypothetical protein involved in FeS cluster] |
| Contig152G | 4412893_f3_284 | 3683 | 7809 | 501 | 166 | 795 | 4.20E−79 | gp:[GI:g3511233] [LN:AF071556] [AC:AF071556] [PN:anthranilate dioxygenase small subunit] [GN:antB] [OR:Acinetobacter sp. ADP1] [DE:acinetobacter sp. ADP1 anthranilate dioxygenase large subunit(antA), anthranilate dioxygenase small subunit (antB), andanthranilate dioxygenase reductase (antC) genes, complete cds.] [NT:terminal dioxygenase] |
| Contig152G | 4456393_c2_630 | 3684 | 7810 | 861 | 286 | 221 | 1.70E−29 | gp:[GI:g706846] [LN:RSU21071] [AC:U21071] [PN:unknown] [OR:*Rhodococcus erythropolis*] [DE:*Rhodococcus erythropolis* alcohol:N,N'-dimethyl-4-nitrosoanilineoxidoreductase (thcE), complete cds.] [NT:ORF1] |
| Contig152G | 4485458_c3_697 | 3685 | 7811 | 1701 | 566 | | | NO-HIT |
| Contig152G | 4567518_c1_441 | 3686 | 7812 | 702 | 233 | 581 | 2.00E−56 | gp:[GI:g4545244] [LN:AF116284] [AC:AF116284] [PN:unknown] [OR:*Pseudomonas aeruginosa*] [DE:*Pseudomonas aeruginosa* DnaJ-like protein gene, complete cds; and unknown genes.] [NT:Orf224; similar to mannose-1-phosphate] |
| Contig152G | 4572142_c3_676 | 3687 | 7813 | 891 | 296 | 783 | 7.80E−78 | sp:[LN:YGI2_PSEPU] [AC:P31857] [OR:*PSEUDOMONAS PUTIDA*] [DE:HYPOTHETICAL 32.4 KD PROTEIN IN GIDB-UNCI INTERGENIC REGION] [SP:P31857] |
| Contig152G | 4572762_f2_246 | 3688 | 7814 | 828 | 275 | 194 | 2.00E−15 | sp:[LN:PRTR_PSEAE] [AC:Q06553] [GN:PRTR] [OR:*PSEUDOMONAS AERUGINOSA*] [DE:TRANSCRIPTION REGULATORY PROTEIN PRTR (PYOSIN REPRESSOR PROTEIN)] [SP:Q06553] |
| Contig152G | 4694817_f1_34 | 3689 | 7815 | 1242 | 413 | 465 | 3.90E−44 | pir:[LN:574653] [AC:S74653] [PN:sensory transduction system regulatory protein sl11673] [CL:response regulator homology] [OR:Synechocystis sp.] [SR:PCC 6803, , PCC 6803] [SR:PCC 6803,] |
| Contig152G | 4709562_c2_628 | 3690 | 7816 | 294 | 97 | | | NO-HIT |
| Contig152G | 4722788_f3_357 | 3691 | 7817 | 1305 | 434 | 808 | 1.70E−80 | pir:[LN:D70646] [AC:D70646] [PN:probable acyl-CoA dehydrogenase] [GN:fadE24] [OR:*Mycobacterium tuberculosis*] |

TABLE 2-continued

| Query | Orf | NT ID | AA ID | NT Lgth | AA Lgth | Score | P-value | Subject |
|---|---|---|---|---|---|---|---|---|
| Contig152G | 4725000_c3_765 | 3692 | 7818 | 996 | 331 | 1260 | 2.20E−128 | gp:[GI:g397641] [LN:KPU00985] [AC:U00985] [PN:acetoin:DCPIP oxidoreductase alpha subunit] [GN:acoA] [FN:essential for utilization of acetoin] [OR:*Klebsiella pneumoniae*] [DE:*Klebsiella pneumoniae* CG43 acetoin:DCPIP oxidoreductase alphasubunit (acoA), acetoin:DCPIP oxidoreductase beta subunit (acoB)and dihydrolipoamide acetyltransferase (acoC) genes, complete cds.] [NT:putative thiamine pyrophosphate binding] |
| Contig152G | 476057_c3_694 | 3693 | 7819 | 552 | 183 | | | NO-HIT |
| Contig152G | 4784681_f1_48 | 3694 | 7820 | 354 | 117 | | | NO-HIT |
| Contig152G | 48588_c1_498 | 3695 | 7821 | 288 | 95 | 317 | 1.90E−28 | sp:[LN:DBHB_ECOLI] [AC:P02341] [GN:HUPB:HOPD] [OR:*ESCHERICHIA COLI*] [DE:DNA-BINDING PROTEIN HU-BETA (NS1) (HU-1)] [SP:P02341] |
| Contig152G | 4863425_c3_758 | 3696 | 7822 | 423 | 140 | | | NO-HIT |
| Contig152G | 4875003_c1_479 | 3697 | 7823 | 204 | 67 | | | NO-HIT |
| Contig152G | 4877293_c3_790 | 3698 | 7824 | 633 | 210 | 466 | 3.00E−44 | sp:[LN:MODC_HAEIN] [AC:P45321] [GN:MODC:HI1691] [OR:*HAEMOPHILUS INFLUENZAE*] [DE:MOLYBDENUM TRANSPORT ATP-BINDING PROTEIN MODC] [SP:P45321] |
| Contig152G | 4881563_c1_509 | 3699 | 7825 | 1065 | 354 | 389 | 3.70E−54 | gp:[GI:g3128321] [LN:AF010496] [AC:AF010496] [PN:nicotinate-nucleotide--dimethylbenzimidazole] [OR:*Rhodobacter capsulatus*] [EC:2.4.2.21] [DE:*Rhodobacter capsulatus* strain SB1003, partial genome.] |
| Contig152G | 4882827_c3_717 | 3700 | 7826 | 2034 | 677 | 855 | 1.80E−85 | sp:[LN:MEPD_RAT] [AC:P24155] [GN:THOP1] [OR:RATTUS NORVEGICUS] [EC:3.4.24.15] [DE:(ENDOPEPTIDASE 24.15) (PZ-PEPTIDASE) (SOLUBLE METALLO-ENDOPEPTIDASE)] [SP:P24155] |
| Contig152G | 4882938_c2_565 | 3701 | 7827 | 771 | 256 | 544 | 1.60E−52 | sp:[LN:KDSB_ECOLI] [AC:P04951] [GN:KDSB] [OR:*ESCHERICHIA COLI*] [EC:2.7.7.38] [DE:SYNTHETASE) (CMP-2-KETO-3-DEOXYOCTULOSONIC ACID SYNTHETASE) (CKS)] [SP:P04951] |
| Contig152G | 4884382_c1_549 | 3702 | 7828 | 219 | 72 | | | NO-HIT |
| Contig152G | 4886562_c2_666 | 3703 | 7829 | 657 | 218 | 580 | 2.50E−56 | sp:[LN:ENTB_ECOLI] [AC:P15048] [GN:ENTB:ENTG] [OR:*ESCHERICHIA COLI*] [EC:3.3.2.1] [DE:SYNTHASE)] [SP:P15048] |
| Contig152G | 4892813_c1_526 | 3704 | 7830 | 1014 | 337 | 426 | 5.30E−40 | pir:[LN:A64500] [AC:A64500] [PN:homoserine dehydrogenase,] [CL:homoserine dehydrogenase:homoserine dehydrogenase homology] [OR:*Methanococcus jannaschii*] [EC:1.1.1.3] [MP:FOR1574042-1575052] |

TABLE 2-continued

| Query | Orf | NT ID | AA ID | NT Lgth | AA Lgth | Score | P-value | Subject |
|---|---|---|---|---|---|---|---|---|
| Contig152G | 4898467_f2_140 | 3705 | 7831 | 891 | 296 | 365 | 1.50E−33 | sp:[LN:YBHD_ECOLI] [AC:P52696:P75761] [GN:YBHD] [OR:*ESCHERICHIA COLI*] [DE:HYPOTHETICAL TRANSCRIPTIONAL REGULATOR IN MODC-BIOA INTERGENIC REGION] [SP:P52696:P75761] |
| Contig152G | 4944068_c1_531 | 3706 | 7832 | 1008 | 335 | 175 | 6.10E−13 | pir:[LN:S75919] [AC:S75919] [PN:hypothetical protein slr1687] [OR:Synechocystis sp.] [SR:PCC 6803, , PCC 6803] [SR:PCC 6803,] |
| Contig152G | 4955436_c3_674 | 3707 | 7833 | 1074 | 357 | 1517 | 1.30E−155 | gp:[GI:e1332422:g3758880] [LN:PST011927] [AC:AJ011927] [PN:fructose-1,6-bisphosphate aldolase] [GN:fda] [OR:*Pseudomonas stutzeri*] [DE:*Pseudomonas stutzeri* fda gene and gene encoding hypotheticalprotein.] [NT:class II aldolase] |
| Contig152G | 4956933_c2_659 | 3708 | 7834 | 1023 | 340 | | | NO-HIT |
| Contig152G | 4960088_c1_552 | 3709 | 7835 | 2085 | 694 | 2507 | 1.60E−260 | gp:[GI:e245927:g2462047] [LN:ACRBDOXN] [AC:Z46863] [PN:polyphosphate kinase] [GN:ppk] [OR:Acinetobacter sp. ADP1] [DE:Acinetobacter sp. cysD, cobQ, sodM, lysS, rubA, rubB, estB, oxyR,ppk, mtgA, ORF2 and ORF3 genes.] NT:putative; transcription of ppk is induced by] |
| Contig152G | 4969012_c3_728 | 3710 | 7836 | 1881 | 626 | 2256 | 6.30E−234 | gp:[GI:e1173385:g2623969] [LN:ASAJ2316] [AC:AJ002316] [PN:putative peptidyl-prolyl cis-trans isomerase] [OR:Acinetobacter sp. ADP1] [DE:Acinetobacter sp. ADP1 alkR & alkM genes, ORF1 & ORF4.] [NT:ORF1] |
| Contig152G | 500877_c2_600 | 3711 | 7837 | 978 | 325 | 755 | 7.20E−75 | pir:[LN:F70520] [AC:F70520] [PN:hypothetical protein Rv0799c] [GN:Rv0799c] [OR:*Mycobacterium tuberculosis*] |
| Contig152G | 5086582_c1_523 | 3712 | 7838 | 1146 | 381 | 1455 | 4.80E−149 | gp:[GI:g397642] [LN:KPU00985] [AC:U00985] [PN:acetoin:DCPIP oxidoreductase beta subunit] [GN:acoB] [FN:essential for utilization of acetoin] [OR:*Klebsiella pneumoniae*] [DE:*Klebsiella pneumoniae* CG43 acetoin:DCPIP oxidoreductase alphasubunit (acoA), acetoin:DCPIP oxidoreductase beta subunit (acoB)and dihydrolipoamide acetyltransferase (acoC) genes, complete cds.] |
| Contig152G | 5109375_c3_797 | 3713 | 7839 | 594 | 197 | | | NO-HIT |
| Contig152G | 5126250_c1_455 | 3714 | 7840 | 708 | 235 | 662 | 5.20E−65 | sp:[LN:DCOP_HAEIN] [AC:P43812] [GN:PYRF:HI1224] [OR:*HAEMOPHILUS INFLUENZAE*] [EC:4.1.1.23] [DE:DECARBOXYLASE)] [SP:P43812] |
| Contig152G | 517186_c2_652 | 3715 | 7841 | 192 | 63 | | | NO-HIT |
| Contig152G | 5188327_c2_588 | 3716 | 7842 | 1023 | 340 | | | NO-HIT |
| Contig152G | 5197010_c3_740 | 3717 | 7843 | 780 | 259 | 173 | 2.90E−12 | gp:[GI:e245969:g1621211] [LN:BIBIRII] [AC:X98086] [GN:atr] [OR:*Bacillus intermedius*] [DE:*B.intermedius* birII, atr, fbiD & fbiC genes.] |

TABLE 2-continued

| Query | Orf | NT ID | AA ID | NT Lgth | AA Lgth | Score | P-value | Subject |
|---|---|---|---|---|---|---|---|---|
| Contig152G | 5257326_f2_204 | 3718 | 7844 | 1260 | 419 | 1509 | 9.10E−155 | gp:[GI:g2271521] [LN:AF010139] [AC:AF010139] [PN:IscS] [GN:iscS] [OR:*Azotobacter vinelandii*] [DE:*Azotobacter vinelandii* iron-sulfur cluster assembly gene cluster,suhB, cysE2, iscS, iscU, iscA, hscB, hscA and fdx genes completecds; ndk gene, partial cds.] [NT:pyridoxal phosphate-dependent L-cysteine] |
| Contig152G | 5282890_c1_492 | 3719 | 7845 | 366 | 121 | | | NO-HIT |
| Contig152G | 553462_f1_47 | 3720 | 7846 | 687 | 228 | 127 | 8.40E−08 | pir:[LN:PC2359] [AC:PC2359] [PN:Na+/H+ antiporter. hypothetical 175 protein] [OR:*Vibrio parahaemolyticus*] |
| Contig152G | 5869031_c2_631 | 3721 | 7847 | 1191 | 396 | | | NO-HIT |
| Contig152G | 5976502_c3_745 | 3722 | 7848 | 660 | 219 | | | NO-HIT |
| Contig152G | 6070325_f2_180 | 3723 | 7849 | 894 | 297 | | | NO-HIT |
| Contig152G | 631882_f3_433 | 3724 | 7850 | 663 | 220 | 394 | 1.30E−36 | sp:[LN:YCEF_ECOLI] [AC:P27244] [GN:YCEF] [OR:*ESCHERICHIA COLI*] [DE:HYPOTHETICAL 23.2 KD PROTEIN IN RNE-RPMF INTERGENIC REGION (ORFY)] [SP:P27244] |
| Contig152G | 6445327_c3_755 | 3725 | 7851 | 375 | 124 | | | NO-HIT |
| Contig152G | 6515_f3_381 | 3726 | 7852 | 186 | 61 | | | NO-HIT |
| Contig152G | 6650937_f1_102 | 3727 | 7853 | 1560 | 519 | 1078 | 4.30E−109 | pir:[LN:D70861] [AC:D70861] [PN:probable monoxygenase] [GN:Rv3049c] [OR:*Mycobacterium tuberculosis*] |
| Contig152G | 6726568_c2_626 | 3728 | 7854 | 606 | 201 | 529 | 6.40E−51 | sp:[LN:RECR_ECOLI] [AC:P12727] [GN:RECR] [OR:*ESCHERICHIA COLI*] [DE:RECOMBINATION PROTEIN RECR] [SP:P12727] |
| Contig152G | 6758438_c2_566 | 3729 | 7855 | 783 | 260 | 593 | 1.10E−57 | sp:[LN:YCFH_ECOLI] [AC:P37346:P78057] [GN:YCFH] [OR:*ESCHERICHIA COLI*] [DE:HYPOTHETICAL 29.8 KD PROTEIN IN HOLB-PTSG INTERGENIC REGION] [SP:P37346:P78057] |
| Contig152G | 6926317_c2_625 | 3730 | 7856 | 348 | 115 | 266 | 4.70E−23 | sp:[LN:YBAB_HAEIN] [AC:P44711] [GN:HI0442] [OR:*HAEMOPHILUS INFLUENZAE*] [DE:HYPOTHETICAL PROTEIN HI0442] [SP:P44711] |
| Contig152G | 7074062_c2_623 | 3731 | 7857 | 216 | 71 | 74 | 0.00044 | pir:[LN:S60892] [AC:S60892] [PN:nucleosome assembly protein 1] [OR:Glycine max] [SR:, soybean] |
| Contig152G | 7267811_f1_97 | 3732 | 7858 | 357 | 118 | | | NO-HIT |
| Contig152G | 7277142_c1_489 | 3733 | 7859 | 1155 | 384 | 413 | 1.40E−44 | pir:[LN:S16649] [AC:S16649:S18271:E69618:140001] [PN:dipeptide ABC transporter (permease):dciAC protein] [GN:dppC:dciAC] [CL:oligopeptide permease protein oppB] [OR:*Bacillus subtilis*] |
| Contig152G | 7290918_c1_512 | 3734 | 7860 | 1149 | 382 | 638 | 1.80E−62 | sp:[LN:YBHS_ECOLI] [AC:P75775] [GN:YBHS] [OR:*ESCHERICHIA COLI*] [DE:HYPOTHETICAL 42.1 KD PROTEIN IN MOAE-RHLE INTERGENIC REGION] [SP:P75775] |
| Contig152G | 870902_f3_383 | 3735 | 7861 | 510 | 169 | 255 | 6.90E−22 | gp:[GI:g3916255] [LN:AF087669] [AC:AF087669] [PN:ExbD] [GN:exbD] [OR:*Bordetella bronchiseptica*] [DE:*Bordetella bronchiseptica* TonB (tonB), ExbB (exbB), and ExbD (exbD)genes, complete cds.] |

TABLE 2-continued

| Query | Orf | NT ID | AA ID | NT Lgth | AA Lgth | Score | P-value | Subject |
|---|---|---|---|---|---|---|---|---|
| Contig152G | 954051_c3_743 | 3736 | 7862 | 564 | 187 | 333 | 3.80E−30 | gp:[GI:g4151934] [LN:AF110737] [AC:AF110737] [PN:RhsD] [GN:rhsD] [FN:siderophore biosynthesis] [OR:*Sinorhizobium meliloti*] [DE:*Rhizobium melitoti* strain 2011 rhizobactin regulon, completesequence.] [NT:similar to lucB] |
| Contig152G | 964502_c2_576 | 3737 | 7863 | 1086 | 361 | 209 | 9.10E−15 | pir:[LN:B70990] [AC:B70990] [PN:probable transcription activator protein] [GN:Rv1395] [OR:*Mycobacterium tuberculosis*] |
| Contig152G | 976563_f2_139 | 3738 | 7864 | 399 | 132 | | | NO-HIT |
| Contig152G | 977302_c3_762 | 3739 | 7865 | 768 | 255 | 107 | 0.00075 | sp:[LN:Y358_HAEIN] [AC:P44659] [GN:H10358] [OR:*HAEMOPHILUS INFLUENZAE*] [DE:HYPOTHETICAL PROTEIN H10358] [SP:P44659] |
| Contig152G | 984375_c1_510 | 3740 | 7866 | 843 | 280 | 298 | 1.90E−26 | sp:[LN:COBS_SALTY] [AC:Q05602] [GN:COBS] [OR:*SALMONELLA TYPHIMURIUM*] [DE:COBALAMIN [5'-PHOSPHATE]SYNTHASE] [SP:Q05602] |
| Contig152G | 989757_f3_356 | 3741 | 7867 | 315 | 104 | | | NO-HIT |
| Contig152G | 9929577_c2_591 | 3742 | 7868 | 2016 | 671 | | | NO-HIT |
| Contig154 | 100442_f3_625 | 3743 | 7869 | 1359 | 452 | 817 | 1.90E−81 | gp:[GI:d1032414:g3298336] [LN:AB010463] [AC:AB010463] [PN:NorM] [GN:norM] [OR:*Vibrio parahaemolyticus*] [SR:*Vibrio parahaemolyticus* (strain:AQ3334) DNA] [DE:*Vibrio parahaemolyticus* gene for NorM, complete cds.] |
| Contig154G | 10049217_c2_936 | 3744 | 7870 | 393 | 130 | 281 | 1.20E−24 | sp:[LN:CRCB_ECOLI] [AC:P37002] [GN:CRCB] [OR:*ESCHERICHIA COLI*] [DE:CRCB PROTEIN] [SP:P37002] |
| Contig154G | 10157130_c1_703 | 3745 | 7871 | 702 | 233 | 421 | 1.80E−39 | sp:[LN:PGSA_HAEIN] [AC:P44528] [GN:PGSA:H10123] [OR:*HAEMOPHILUS INFLUENZAE*] [EC:2.7.8.5] [DE:(EC 2.7.8.5) (PHOSPHATIDYLGLYCEROPH OSPHATE SYNTHASE) (PGP SYNTHASE)] [SP:P44528] |
| Contig154G | 103207_f2_345 | 3746 | 7872 | 1755 | 584 | 1107 | 1.90E−151 | sp:[LN:LEU1_CORGL] [AC:P42455] [GN:LEUA] [OR:*CORYNEBACTERIUM GLUTAMICUM*] [EC:4.1.3.12] [DE:SYNTHASE) (ALPHA-IPM SYNTHETASE)] [SP:P42455] |
| Contig154G | 10337768_c2_898 | 3747 | 7873 | 333 | 110 | 242 | 1.70E−20 | sp:[LN:SECG_ECOLI] [AC:P33582] [GN:SECG] [OR:*ESCHERICHIA COLI*] [DE:SUBUNIT) (P12)] [SP:P33582] |
| Contig154G | 10353418_c2_911 | 3748 | 7874 | 3702 | 1233 | 779 | 1.20E−87 | sp:[LN:EX5B_HAEIN] [AC:P45157] [GN:RECB:H11321] [OR:*HAEMOPHILUS INFLUENZAE*] [EC:31.11.5] [DE:EXODEOXYRIBONUCLEA SE V BETA CHAIN,] [SP:P45157] |
| Contig154G | 10428160_f2_405 | 3749 | 7875 | 261 | 86 | | | NO-HIT |
| Contig154G | 1049050_c2_865 | 3750 | 7876 | 561 | 186 | 589 | 2.80E−57 | sp:[LN:NUSG_ECOLI] [AC:P16921] [GN:NUSG] [OR:*ESCHERICHIA COLI*] [DE:TRANSCRIPTION ANTITERMINATION PROTEIN NUSG] [SP:P16921] |

TABLE 2-continued

| Query | Orf | NT ID | AA ID | NT Lgth | AA Lgth | Score | P-value | Subject |
|---|---|---|---|---|---|---|---|---|
| Contig154G | 1054677_c1_723 | 3751 | 7877 | 1443 | 480 | 552 | 2.30E−53 | pir:[LN:577243] [AC:577243] [PN:hypothetical protein slr1363] [OR:Synechocystis sp.] [SR:PCC 6803,, PCC 6803] [SR:PCC 6803,] |
| Contig154G | 10554702_c1_713 | 3752 | 7878 | 525 | 174 | 243 | 4.20E−32 | gp:[GI:g1835603] [LN:PSU85643] [AC:U85643] [PN:15 kDa protein] [OR:*Pseudomonas syringae* pv. syringae] [DE:*Pseudomonas syringae* pv. syringae putative dihydropteroate synthasegene, partial cds, regulatory protein MrsA (mrsA), triose phosphateisomerasc (tpiA), transport protein SecG (secG), tRNA-Leu,tRNA-Met, and 15 kDa protein genes, complete cds.] |
| Contig154G | 10728325_c2_1038 | 3753 | 7879 | 1083 | 360 | 1117 | 3.10E−113 | pir:[LN:E69220] [AC:F69220] [PN:conserved hypothetical protein MTH900] [GN:MTH900] [CL:conserved hypothetical protein MTH900] [OR:*Methanobacterium thermoautotrophicum*] |
| Contig154G | 110452_f1_217 | 3754 | 7880 | 1173 | 390 | 1309 | 1.40E−133 | sp:[LN:THIK_PSEFR] [AC:P28790] [GN:FAOB] [OR:*PSEUDOMONAS FRAGI*] [EC:2.3.1.16] [DE:SUBUNIT) (BETA-KETOTHIOLASE) (ACETYL-COA ACYLTRANSFERASE)] [SP:P28790] |
| Contig154G | 11087_f2_357 | 3755 | 7881 | 1722 | 573 | 1223 | 1.80E−124 | sp:[LN:YBAL_ECOLI] [AC:P39830:P52068:P77724] [GN:YBAL] [OR:*ESCHERICHIA COLI*] [DE:HYPOTHETICAL 59.4 KD PROTEIN IN GSK-FSR INTERGENIC REGION] [SP:P39830:P52068:P77724] |
| Contig154G | 11125055_f3_601 | 3756 | 7882 | 1947 | 648 | 1658 | 1.50E−170 | sp:[LN:UUPL_HAEIN] [AC:Q57242:O05056] [GN:UUP-A:H11300] [OR:*HAEMOPHILUS INFLUENZAE*] [DE:ABC TRANSPORTER ATP-BINDING PROTEIN UUP-1] [SP:Q57242:O05056] |
| Contig154G | 11136305_c2_1010 | 3757 | 7883 | 486 | 161 | | | NO-HIT |
| Contig154G | 11140910_f3_631 | 3758 | 7884 | 864 | 287 | 536 | 1.20E−51 | sp:[LN:YBEX_ECOLI] [AC:P77392] [GN:YBEX] [OR:*ESCHERICHIA COLI*] [DE:HYPOTHETICAL 33.3 KD PROTEIN IN CUTE-ASNB INTERGENIC REGION] [SP:P77392] |
| Contig154G | 11745958_c1_689 | 3759 | 7885 | 4224 | 1407 | 5117 | 0 | sp:[LN:RPOC_ECOLI] [AC:P00577:P00578:P78134] [GN:RPOC:TABB] [OR:*ESCHERICHIA COLI*] [EC:2.7.7.6] [DE:BETA'CHAIN) (RNA POLYMERASE BETA' SUBUNIT)] [SP:P00577:P00578:P78134] |
| Contig154G | 11803192_f2_254 | 3760 | 7886 | 381 | 126 | 520 | 5.80E−50 | gp:[GI:g144989] [LN:CORTC2] [AC:J02801] [OR:*Corynebacterium nephridii*] [SR:*C.nephridii* DNA, clone JF510/pLCN41] [DE:*Corynebacterium nephridii* thioredoxin C-2 gene.] [NT:thioredoxin C-2] |
| Contig154G | 11914177_f2_367 | 3761 | 7887 | 1158 | 385 | 130 | 7.00E−05 | pir:[LN:S49313] [AC:S52076:S49313] [PN:protein kinase] [CL:unassigned Ser/Thr or Tyr-specific protein kinases:protein kinase homotogy] [OR:Dictyostelium discoideum] |
| Contig154G | 1193756_f1_91 | 3762 | 7888 | 348 | 115 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig154G | 120218_c1_801 | 3763 | 7889 | 810 | 269 | 250 | 2.40E−21 | pir:[LN:JC5302] [AC:JC5302] [PN:PilF protein] [GN:pilF] [CL:hypothetical protein H10366:tetratricopeptide repeat homology] [OR:*Pseudomonas aeruginosa*] |
| Contig154G | 1212908_f3_650 | 3764 | 7890 | 1818 | 605 | 739 | 1.00E−84 | gp:[GI:g3128270] [LN:AF010496] [AC:AF010496] [PN:potential poly(3-hydroxyalkanoate) polymerase] [OR:*Rhodobacter capsulatus*] [EC:2.3.1.—] [DE:*Rhodobacter capsulatus* strain SB1003, partial genome.] |
| Contig154G | 1226012_c1_853 | 3765 | 7891 | 1029 | 342 | 1102 | 1.20E−111 | gp:[GI:d1016204:g1742794] [LN:D90813] [AC:D90813:AB001340] [PN:Phenylatanine--tRNA ligase (EC 6.1.1.20)a] [GN:pheS] [OR:*Escherichia coli*] [SR:*Escherichia coli* (strain:K12) DNA, clone_lib:Kohara lambda minise] [DE:*E.coli* genomic DNA, Kohara clone #322(38.4–38.8 min.).] [NT:ORF_ID:o322#15; similar to [PIR Accession Number] |
| Contig154G | 12352167_f2_392 | 3766 | 7892 | 1602 | 533 | 891 | 2.80E−89 | gp:[GI:g4033729] [LN:AF038595] [AC:AF038595] [PN:apolipoprotein N-acyltransferase] [GN:cutE] [FN:confers temperature resistance and copper] [OR:*Pseudomonas aeruginosa*] [DE:*Pseudomonas aeruginosa* apolipoprotein N-acyltransferase (cutE)gene, complete cds.] [NT:third enzyme in lipoprotein modification pathway] |
| Contig154G | 12381563_c3_1215 | 3767 | 7893 | 1143 | 380 | 355 | 1.80E−32 | pir:[LN:E69725] [AC:E69725] [PN:potassium uptake trkA] [GN:trkA] [OR:*Bacillus subtilis*] |
| Contig154G | 12678801_f1_187 | 3768 | 7894 | 735 | 244 | | | NO-HIT |
| Contig154G | 12688452_c1_762 | 3769 | 7895 | 246 | 81 | 96 | 4.90E−05 | sp:[LN:SLYX_HAEIN] [AC:P44759] [GN:SLYX:H10573] [OR:*HAEMOPHILUS INFLUENZAE*] [DE:SLYX PROTEIN HOMOLOG] [SP:P44759] |
| Contig154G | 12689176_f1_126 | 3770 | 7896 | 567 | 188 | 425 | 6.70E−40 | pir:[LN:S74472] [AC:S74472] [PN:protein-methionine-S-oxide reductase,:peptide methionine sulfoxide reductase msrA:protein s111394:peptide methionine sulfoxide reductase msrA:protein st11394] [GN:msrA] [CL:peptide methionine sulfoxide reductase] [OR:Synechocystis sp.] [SR:PCC 6803, PCC 6803] [SR:PCC 6803,] [EC:1.8.4.6] |
| Contig154G | 12750007_f1_82 | 3771 | 7897 | 1359 | 452 | 610 | 6.00E−66 | pir:[LN:F64826] [AC:F64826] [PN:probable membrane protein b0878] [OR:*Escherichia coli*] |
| Contig154G | 1302250_f2_438 | 3772 | 7898 | 1689 | 562 | 942 | 1.10E−94 | sp:[LN:RECN_ECOLI] [AC:P05824:P76602] [GN:RECN:RADB] [OR:*ESCHERICHIA COLI*] [DE:DNA REPAIR PROTEIN RECN (RECOMBINATION PROTEIN N)] [SP:P05824:P76602] |
| Contig154G | 1308505_f3_586 | 3773 | 7899 | 450 | 149 | | | NO-HIT |
| Contig154G | 13096050_f3_648 | 3774 | 7900 | 1395 | 464 | 225 | 9.30E−16 | pir:[LN:S28007] [AC:S28007:S22964] [PN:probable ATP-binding protein] [OR:*Escherichia coli*] |

TABLE 2-continued

| Query | Orf | NT ID | AA ID | NT Lgth | AA Lgth | Score | P-value | Subject |
|---|---|---|---|---|---|---|---|---|
| Contig154G | 13129760_f2_356 | 3775 | 7901 | 285 | 94 | 296 | 3.10E−26 | pir:[LN:E64104] [AC:E64104] [PN:ribosomal protein L28] [CL:*Escherichia coli* ribosomal protein L28] [OR:*Haemophilus influenzae*] |
| Contig154G | 1359390_c3_1185 | 3776 | 7902 | 768 | 255 | 333 | 3.80E−30 | gp:[GI:g1110441] [LN:STMBLDA] [AC:M80628] [OR:*Streptomyces griseus*] [DE:*Streptomyces griseus* transfer RNA-Leu (bldA) gene and ORF, completecds.] [NT:hypothetical product] |
| Contig154G | 13675051_f3_570 | 3777 | 7903 | 210 | 69 | | | NO-HIT |
| Contig154G | 13710805_f2_382 | 3778 | 7904 | 819 | 272 | 351 | 4.70E−32 | gp:[GI:g4210942] [LN:AF069518] [AC:AF069518] [PN:17beta-hydroxysteroid dehydrogenase] [FN:catalyzes NADPH dependent reduction of] [OR:*Cochliobolus lunatus*] [DE:*Cochliobolus lunatus* 17beta-hydroxysteroid dehydrogenase mRNA,complete cds.] [NT:short chain alcohol dehydrogenase/reductase family] |
| Contig154G | 13712662_c3_1166 | 3779 | 7905 | 1695 | 564 | 564 | 1.30E−54 | sp:[LN:GAPN_STRMU] [AC:Q59931] [GN:GAPN] [OR:*STREPTOCOCCUS MUTANS*] [EC:1.2.1.9] [DE:DEHYDROGENASE)] [SP:Q59931] |
| Contig154G | 1376410_c3_1177 | 3780 | 7906 | 1137 | 378 | 1209 | 5.60E−123 | gp:[GI:g1531668] [LN:PSU67933] [AC:U67933] [PN:AarC] [GN:rC] [OR:*Providencia stuartii*] [DE:*Providencia stuartii* AarC rC) gene, complete cds.] [NT:similar to *E. coli* GcpE protein encoded by GenBank] |
| Contig154G | 1376437_c1_845 | 3781 | 7907 | 2337 | 778 | 1411 | 2.20E−144 | sp:[LN:RELA_ECOLI] [AC:P11585] [GN:RELA] [OR:*ESCHERICHIA COLI*] [EC:2.7.6.5] [DE:(PPGPP SYNTHETASE I)] [SP:P11585] |
| Contig154G | 13792812_f1_1 | 3782 | 7908 | 990 | 329 | 197 | 2.40E−13 | pir:[LN:G70038] [AC:G70038] [PN:conserved hypothetical protein yvfP] [[GN:yvfP] [OR:*Bacillus subtilis*] |
| Contig154G | 1384662_f3_482 | 3783 | 7909 | 1647 | 548 | 1256 | 5.90E−128 | gp:[GI:e308446:g1903034] [LN:BNACSF8] [AC:X94625] [PN:amp-binding protein] [OR:*Brassica napus*] [DE:*B.napus* mRNA for amp-binding protein.] |
| Contig154G | 14062586_f2_263 | 3784 | 7910 | 1107 | 368 | | | NO-HIT |
| Contig154G | 14220258_c2_1039 | 3785 | 7911 | 861 | 286 | | | NO-HIT |
| Contig154G | 14455375_c1_737 | 3786 | 7912 | 933 | 310 | 516 | 1.50E−49 | pir:[LN:S47741] [AC:S47741:D65150] [PN:hypothetical transcription regulator treF-kdgK intergenic region:hypothetical protein o323] [GN:yhjC] [OR:*Escherichia coli*] |
| Contig154G | 14573388_c3_1238 | 3787 | 7913 | 582 | 193 | 223 | 1.70E−18 | sp:[LN:YGGT_HAEIN] [AC:P44097] [GN:H11036] [OR:*HAEMOPHILUS INFLUENZAE*] [DE:HYPOTHETICAL PROTEIN H11036] [SP:P44097] |
| Contig154G | 14632937_f2_420 | 3788 | 7914 | 1326 | 441 | 198 | 4.40E−13 | gp:[GI:g2271503] [LN:AF009672] [AC:AF009672] [PN:unknown] [OR:*Acinetobacter sp.* ADPI] [DE:*Acinetobacter sp.* ADPI vanillate demethylase region, vanillate demethylase (vanB) and vanillate demethylase (vanA) genes, completecds.] [NT:similar to salicylate hydroxylase; ORF7] |

TABLE 2-continued

| Query | Orf | NT ID | AA ID | NT Lgth | AA Lgth | Score | P-value | Subject |
|---|---|---|---|---|---|---|---|---|
| Contig154G | 14648342_f2_364 | 3789 | 7915 | 1113 | 370 | 437 | 3.60E−41 | pir:[LN:B71691] [AC:B71691] [PN:capm protein (capM1) RP344] [GN:capM1:RP344] [OR:*Rickettsia prowazekii*] |
| Contig154G | 14650275_c1_849 | 3790 | 7916 | 852 | 283 | 653 | 4.60E−64 | pir:[LN:G70482] [AC:G70482] [PN:pantothenate synthetase] [GN:panC] [CL:pantoate--beta-alanine ligase] [OR:*Aquifex aeolicus*] |
| Contig154G | 14720012_c3_1085 | 3791 | 7917 | 1344 | 447 | | | NO-HIT |
| Contig154G | 14730262_c3_1173 | 3792 | 7918 | 564 | 187 | 153 | 1.80E−10 | gp:[GI:g1049369] [LN:CELT13C5] [AC:U39648] [GN:T13C5.6] [OR:*Caenorhabditis elegans*] [SR:*Caenorhabditis elegans* strain=Bristol N2] [DE:*Caenorhabditis elegans* cosmid T13C5.] |
| Contig154G | 14851562_f2_455 | 3793 | 7919 | 513 | 170 | | | NO-HIT |
| Contig154G | 14875658_f2_397 | 3794 | 7920 | 2235 | 744 | 1552 | 2.50E−159 | pir:[LN:A35505] [AC:S40878:A35505:A35506:B65200] [PN:primosomal replication factor Y:protein n'] [GN:priA] [CL:unassigned DEAD/H box helicases:DEAD/H box helicase homology] [OR:*Escherichia coli*] [MP:88.5 min] |
| Contig154G | 14881250_f1_527 | 3795 | 7921 | 1023 | 340 | 911 | 2.10E−91 | sp:[LN:Y926_SYNY3] [AC:P72872] [GN:SLL0926] [OR:SYNECHOCYSTIS SP] [SR:PCC 6803,] [DE:HYPOTHETICAL 37.9 KD PROTEIN SLL0926] [SP:P72872] |
| Contig154G | 15020636_c3_1198 | 3796 | 7922 | 2784 | 927 | 1711 | 0 | sp:[LN:ACON_LEGPN] [AC:P37032] [GN:ACN] [OR:*LEGIONELLA PNEUMOPHILA*] [EC:4.2.1.3] [DE:(MAJOR IRON-CONTAINING PROTEIN) (MICP) (IP210)] [SP:P37032] |
| Contig154G | 15053438_c1_735 | 3797 | 7923 | 1269 | 422 | 498 | 1.20E−47 | sp:[LN:SOXC_RHOSO] [AC:P54998] [GN:SOXC:DSZC] [OR:RHODOCOCCUS SP] [DE:DIBENZOTHIOPHENE DESULFURIZATION ENZYME C (DBT SULFUR DIOXYGENASE)] [SP:P54998] |
| Contig154G | 15634837_f3_572 | 3798 | 7924 | 696 | 231 | 646 | 2.60E−63 | gp:[GI:g2981041] [LN:AF051690] [AC:AF051690] [PN:iron-uptake factor] [GN:piuC] [OR:*Pseudomonas aeruginosa*] [DE:*Pseudomonas aeruginosa* iron-uptake factor (piuC), hydroxamate-typeferrisiderophore receptor (piuA), and iron-uptake factor (piuB)genes, complete cds.] [NT:PiuC] |
| Contig154G | 15675917_c3_1125 | 3799 | 7925 | 729 | 242 | 170 | 7.10E−13 | sp:[LN:GPHC_ALCEU] [AC:P40852] [GN:CBBZC] [OR:*ALCALIGENES EUTROPHUS*] [EC:3.1.3.18] [DE:PHOSPHOGLYCOLATE PHOSPHATASE, CHROMOSOMAL, (PGP)] [SP:P40852] |

TABLE 2-continued

| Query | Orf | NT ID | AA ID | NT Lgth | AA Lgth | Score | P-value | Subject |
|---|---|---|---|---|---|---|---|---|
| Contig154G | 157500_c2_1031 | 3800 | 7926 | 393 | 130 | 132 | 7.50E−09 | gp:[GI:g4206628] [LN:AF067954] [AC:AF067954] [PN:unknown] [GN:ORF96] [OR:*Salmonella typhimurium*] [DE:*Salmonella typhimurium* plasmid pMG101 silver binding proteinprecursor SilE (silE), silRS operon, silC(ORF96)BA(ORF105)P operon,complete sequence; and ORF191 gene, partial cds.] [NT:similar to *Escherichia coli* ORF110, ylcC.] |
| Contig154G | 157567_f1_172 | 3801 | 7927 | 324 | 107 | | | NO-HIT |
| Contig154G | 15782282_c3_1109 | 3802 | 7928 | 696 | 231 | 376 | 1.00E−34 | sp:[LN:GSPG_PSEAE] [AC:Q00514] [GN:XCPT:PDDA] [OR:*PSEUDOMONAS AERUGINOSA*] [DE:PDDA)] [SP:Q00514] |
| Contig154G | 15812518_c3_1181 | 3803 | 7929 | 702 | 233 | 204 | 1.80E−16 | sp:[LN:GSP_BACBR] [AC:P40683] [GN:GSP] [OR:*BACILLUS BREVIS*] [DE:GSP PROTEIN] [SP:P40683] |
| Contig154G | 15820300_f3_555 | 3804 | 7930 | 1278 | 425 | 1043 | 2.20E−105 | pir:[LN:C70392] [AC:C70392] [PN:gamma-glutamyl phosphate reductase] [GN:proA] [CL:glutamate-5-semialdehyde dehydrogenase] [OR:*Aquifex aeolicus*] |
| Contig154G | 159437_c3_1112 | 3805 | 7931 | 282 | 93 | 177 | 1.30E−13 | sp:[LN:YHHP_ECOLI] [AC:P37618] [GN:YHHP] [OR:*ESCHERICHIA COLI*] [DE:HYPOTHETICAL 9.1 KD PROTEIN IN FTSY-NIKA INTERGENIC REGION] [SP:P37618] |
| Contig154G | 161392_f2_346 | 3806 | 7932 | 615 | 204 | 184 | 5.40E−14 | sp:[LN:YBEQ_ECOLI] [AC:P77234] [GN:YBEQ] [OR:*ESCHERICHIA COLI*] [DE:HYPOTHETICAL 37.3 KD PROTEIN IN LEUS-GLTL INTERGENIC REGION] [SP:P77234] |
| Contig154G | 16454686_f3_551 | 3807 | 7933 | 1086 | 361 | 726 | 8.50E−72 | sp:[LN:YCFO_ECOLI] [AC:P75949] [GN:YCFO] [OR:*ESCHERICHIA COLI*] [DE:HYPOTHETICAL 37.6 KD PROTEIN IN FHUE-NDH INTERGENIC REGION] [SP:P75949] |
| Contig154G | 16507258_f1_235 | 3808 | 7934 | 369 | 122 | 147 | 1.90E−10 | pir:[LN:546966] [AC:546966] [PN:microfilarial sheath protein] [OR:*Litomosoides carinii*] |
| Contig154G | 16520662_c1_771 | 3809 | 7935 | 441 | 146 | 272 | 1.10E−23 | gp:[GI:g3916255] [LN:AF087669] [AC:AF087669] [PN:ExbD] [GN:exbD] [OR:*Bordetella bronchiseptica*] [DE:*Bordetella bronchiseptica* TonB (tonB), ExbB (exbB), and ExbD (exbD)genes, complete cds.] |
| Contig154G | 16695138_f1_124 | 3810 | 7936 | 834 | 277 | 757 | 4.40E−75 | gp:[GI:e1296740:g3201564] [LN:VCH6514] [AC:AJ006514] [PN:prolipoprotein diacylglyceryl transferase] [GN:lgt] [OR:*Vibrio cholerae*] [DE:*Vibrio cholerae* lgt and thyA genes.] |
| Contig154G | 16828412_f1_173 | 3811 | 7937 | 963 | 320 | 295 | 1.10E−52 | sp:[LN:DNAJ_LACLA] [AC:P35514] [GN:DNAJ] [OR:*LACTOCOCCUS LACTIS*] [SR:,SUBSPLACTIS:STREPTOC OCCUS LACTIS] [DE:DNAJ PROTEIN] [SP:P35514] |

TABLE 2-continued

| Query | Orf | NT ID | AA ID | NT Lgth | AA Lgth | Score | P-value | Subject |
|---|---|---|---|---|---|---|---|---|
| Contig154G | 16831538_f1_211 | 3812 | 7938 | 780 | 259 | 144 | 4.20E−08 | sp:[LN:YAGI_ECOLI] [AC:P77300] [GN:YAGI] [OR:*ESCHERICHIA COLI*] [DE:HYPOTHETICAL TRANSCRIPTIONAL REGULATOR IN PERR-ARGF INTERGENIC REGION] [SP:P77300] |
| Contig154G | 191458_c2_1000 | 3813 | 7939 | 182 | 393 | 370 | 4.50E−34 | sp:[LN:YFGL_ECOLI] [AC:P77774] [GN:YFGL] [OR:*ESCHERICHIA COLI*] [DE:HYPOTHETICAL 41.9 KD PROTEIN IN XSEA-HISS INTERGENIC REGION] [SP:P77774] |
| Contig154G | 19531451_f3_607 | 3814 | 7940 | 996 | 331 | 216 | 3.90E−16 | sp:[LN:ASPG_BACSU] [AC:P26900] [GN:ANSA] [OR:*BACILLUS SUBTILIS*] [EC:3.5.1.1] [DE:L-ASPARAGINASE, (L-ASPARAGINE AMIDOHYDROLASE)] [SP:P26900] |
| Contig154G | 195325_c3_1178 | 3815 | 7941 | 747 | 248 | 217 | 7.40E−18 | sp:[LN:GC_NEIGO] [AC:O87406] [GN:GC] [OR:*NEISSERIA GONORRHOEAE*] [DE:GC PROTEIN] [SP:O87406] |
| Contig154G | 195387_f2_421 | 3816 | 7942 | 2889 | 962 | 1727 | 7.20E−178 | gp:[GI:g3128268] [LN:AF010496] [AC:AF010496] [PN:NADH-quinone oxidoreductase chain 5] [OR:*Rhodobacter capsulatus*] [EC:1.6.5.3] [DE:*Rhodobacter capsulatus* strain SB1003, partial genome.] |
| Contig154G | 19553175_c2_1024 | 3817 | 7943 | 360 | 119 | | | NO-HIT |
| Contig154G | 19555303_f1_188 | 3818 | 7944 | 1632 | 543 | 980 | 1.00E−98 | sp:[LN:AARF_ECOLI] [AC:P27854:P27855:P76764:P27853] [GN:AARF] [OR:*ESCHERICHIA COLI*] [DE:UBIQUINONE BIOSYNTHESIS PROTEIN AARF] [SP:P27854:P27855:P76764:P27853] |
| Contig154G | 19610632_c2_958 | 3819 | 7945 | 426 | 141 | | | NO-HIT |
| Contig154G | 19652042_c1_848 | 3820 | 7946 | 855 | 284 | 751 | 1.90E−74 | gp:[GI:e1358024:g3970812] [LN:PFL130846] [AC:AJ130846] [PN:3-methyl-2-oxobutanoate] [GN:panB] [FN:pantothenate biosynthesis] [OR:*Pseudomonas fluorescens*] [EC:2.1.2.11] [DE:*Pseudomonas fluorescens* folK (partial), panB and panC (partial)genes.] |
| Contig154G | 19771953_f2_385 | 3821 | 7947 | 306 | 101 | 259 | 2.60E−22 | gp:[GI:g1657496] [LN:ECU73857] [AC:U73857] [OR:*Escherichia coli*] [DE:*Escherichia coli* chromosome minutes 6–8.] [NT:hypothetical protein] |
| Contig154G | 19944657_f2_255 | 3822 | 7948 | 1302 | 433 | 1783 | 8.40E−184 | sp:[LN:RHO_PSEFL] [AC:P52155] [GN:RHO] [OR:*PSEUDOMONAS FLUORESCENS*] [DE:TRANSCRIPTION TERMINATION FACTOR RHO] [SP:P52155] |
| Contig154G | 20022643_f2_449 | 3823 | 7949 | 381 | 126 | 158 | 6.10E−11 | pir:[LN:S77011] [AC:S77011] [PN:mercuric resistance operon regulatory protein merR-1:protein s110794:protein s110794] [GN:merR_1] [OR:Synechocystis sp.] [SR:PCC 6803,,PCC 6803] [SR:PCC 6803,] |

TABLE 2-continued

| Query | Orf | NT ID | AA ID | NT Lgth | AA Lgth | Score | P-value | Subject |
|---|---|---|---|---|---|---|---|---|
| Contig154G | 20085430_c3_1230 | 3824 | 7950 | 285 | 94 | 193 | 2.60E-15 | sp:[LN:RL35_PSESY] [AC:P52830] [GN:RPMI] [OR:*PSEUDOMONAS SYRINGAE*] [DE:50S RIBOSOMAL PROTEIN L35] [SP:P52830] |
| Contig154G | 20102177_f1_204 | 3825 | 7951 | 1260 | 419 | 1294 | 5.50E-132 | sp:[LN:PILC_PSEAE] [AC:P22609] [GN:PILC] [OR:*PSEUDOMONAS AERUGINOSA*] [DE:FIMBRIAL ASSEMBLY PROTEIN PILC] [SP:P22609] |
| Contig154G | 2011056_c2_931 | 3826 | 7952 | 657 | 218 | 595 | 6.50E-58 | sp:[LN:YCBL_ECOLI] [AC:P75849] [GN:YCBL] [OR:*ESCHERICHIA COLI*] [DE:HYPOTHETICAL 23.8 KD PROTEIN IN MUKB-ASPC INTERGENIC REGION] [SP:P75849] |
| Contig154G | 20211551_f1_69 | 3827 | 7953 | 291 | 96 | | | NO-HIT |
| Contig154G | 20313536_f1_142 | 3828 | 7954 | 321 | 106 | 92 | 0.00033 | sp:[LN:GRPE_METMA] [AC:P42367] [GN:GRPE] [OR:*METHANOSARCINA MAZEI*] [DE:GRPE PROTEIN HOMOLOG] [SP:P42367] |
| Contig154G | 20336563_c1_811 | 3829 | 7955 | 1647 | 548 | 786 | 5.00E-83 | pir:[LN:A69861] [AC:A69861] [PN:conserved hypothetical protein ykoW] [GN:ykoW] [OR:*Bacillus subtilis*] |
| Contig154G | 20363542_c1_820 | 3830 | 7956 | 732 | 243 | | | NO-HIT |
| Contig154G | 204755_c1_827 | 3831 | 7957 | 1389 | 462 | 179 | 9.00E-11 | pir:[LN:JC4698] [AC:JC4698] [PN:divalent cation resistant determinant protein C] [GN:czcC] [OR:Alcaligenes sp.] |
| Contig154G | 20705216_c2_866 | 3832 | 7958 | 456 | 151 | 531 | 3.90E-51 | gp:[GI:g42814] [LN:ECRPOBC] [AC:V00339:J01678:K00449] [GN:rplK (L11)] [OR:*Escherichia coli*] [DE:*E. coli* operon rpoBC coding for the beta- and beta'-subunits of RNApolymerase (genes rpoC and rpoB), and genes rplL, rlpJ, rplA, andrplK coding for 50S ribosomal subunit proteins L7/L12, L10, L1, andL11, respectively. (Map position 89–90 min.).] [SP:P02409] |
| Contig154G | 20791075_f1_83 | 3833 | 7959 | 1494 | 497 | 510 | 6.60E-49 | sp:[LN:YE62_HAEIN] [AC:P45217] [GN:H11462] [OR:*HAEMOPHILUS INFLUENZAE*] [DE:HYPOTHETICAL PROTEIN H11462] [SP:P45217] |
| Contig154G | 2146892_c2_997 | 3834 | 7960 | 462 | 153 | 530 | 5.00E-51 | sp:[LN:NKD_PSEAE] [AC:Q59636] [GN:NDK] [OR:*PSEUDOMONAS AERUGINOSA*] [EC:2.7.4.6] [DE:NUCLEOSIDE DISPHOSPHATE KINASE, (NKD) (NDP KINASE)] [SP:Q59636] |
| Contig154G | 214527_f1_169 | 3835 | 7961 | 270 | 89 | | | NO-HIT |
| Contig154G | 21493817_f1_43 | 3836 | 7962 | 1842 | 613 | 1488 | 1.50E-152 | gp:[GI:g3128348] [LN:AF010496] [AC:AF010496] [PN:ferrous iron transport protein b] [OR:*Rhodobacter capsulatus*] [DE:*Rhodobacter capsulatus* strain SB1003, partial genome.] |
| Contig154G | 21603462_f1_56 | 3837 | 7963 | 1380 | 459 | 777 | 3.40E-77 | pir:[LN:S52258] [AC:S70165S:S52258] [PN:copper resistance sensor kinase pcoS:copper sensor] [GN:pcoS] [OR:*Escherichia coli*] |

TABLE 2-continued

| Query | Orf | NT ID | AA ID | NT Lgth | AA Lgth | Score | P-value | Subject |
|---|---|---|---|---|---|---|---|---|
| Contig154G | 21642183_f1_14 | 3838 | 7964 | 1278 | 425 | 362 | 3.20E−33 | gp:[GI:e1292364:g3127848] [LN:SC1A6] [AC:AL023496] [PN:hypothetical protein] [OR:*Streptomyces coelicolor*] [DE:*Streptomyces coelicolor* cosmid 1A6.] [NT:SC1A6.16, probable transmembrane protein, len: 431] |
| Contig154G | 21679062_c3_1134 | 3839 | 7965 | 1152 | 383 | | | NO-HIT |
| Contig154G | 21683382_c2_944 | 3840 | 7966 | 639 | 212 | 186 | 1.40E−14 | pir:[LN:JC5114] [AC:J5114] [PN:glutathione transferase,:glutathione S-transferase] [GN:gst] [CL:plaice gluathione transferase] [OR:Coccomyxa sp.] [EC:2.5.1.18] |
| Contig154G | 21908577_c2_910 | 3841 | 7967 | 3636 | 1211 | 593 | 1.90E−55 | sp:[LN:EX5C_ECOLI] [AC:P07648] [GN:RECC] [OR:*ESCHERICHIA COLI*] [EC:3.1.11.5] [DE:V GAMMA CHAIN)] [SP:P07648] |
| Contig154G | 21911386_f1_88 | 3842 | 7968 | 486 | 161 | 360 | 5.20E−33 | sp:[LN:SECB_ECOLI] [AC:P15040] [GN:SECB] [OR:*ESCHERICHIA COLI*] [DE:PROTEIN-EXPORT PROTEIN SECB] [SP:P15040] |
| Contig154G | 2191501_f1_129 | 3843 | 7969 | 186 | 61 | | | NO-HIT |
| Contig154G | 22143941_f3_630 | 3844 | 7970 | 1869 | 622 | 2837 | 1.70E−295 | sp:[LN:ETFD_ACICA] [AC:P94132] [OR:*ACINETOBACTER CALOACETICUS*] [EC:1.5.5.1] [DE:DEHYDROGENASE) (ELECTRON-TRANSFERRING-FLAVOPROTEIN DEHYDROGENASE)] [SP:P94132] |
| Contig154G | 22145462_c2_1047 | 3845 | 7971 | 867 | 288 | 635 | 3.70E−62 | gp:[GI:e1364074:g4138364] [LN:PPU007699] [AC:AJ007699] [PN:hypothetical protein] [OR:*Pseudomonas putida*] [DE:*Pseudomonas putida* ORF284, ptsO gene & ORF96.] [NT:ORF284] |
| Contig154G | 22265930_c3_1065 | 3846 | 7972 | 417 | 138 | 411 | 2.00E−38 | pir:[LN:F64083] [AC:F64083] [PN:ribosomal protein L12] [CL:*Escherichia coli* ribosomal protein L12] [OR:*Haemophilus influenzae*] |
| Contig154G | 22285385_f3_491 | 3847 | 7973 | 2841 | 946 | 1083 | 1.30E−109 | gp:[GI:d1035700:g3953516] [LN:AB002529] [AC:AB002529] [PN:sensor kinase rtpA] [GN:rtpA] [OR:*Pseudomonas tosii*] [SR:*Pseudomonas tosii* (strain:PT814) DNA] [DE:*Pseudomonas tosii* gene for sensor kinase rtpA, complete cds.] [NT:putative sensor kinase; regulator for tosin and] |
| Contig154G | 22378415_f2_340 | 3848 | 7974 | 1278 | 425 | 831 | 6.40E−83 | sp:[LN:ACKA_CLOTS] [AC:Q59331] [GN:ACKA] [OR:CLOSTRIDIUM THERMOSACCHAROLYTICUM] [SR:,THERMOANAEROBACTERIUM THERMOSACCHAROLYTICUM] [EC:2.7.2.1] [DE:ACETATE KINASE,(ACETOKINASE)] [SP:Q59331] |

TABLE 2-continued

| Query | Orf | NT ID | AA ID | NT Lgth | AA Lgth | Score | P-value | Subject |
|---|---|---|---|---|---|---|---|---|
| Contig154G | 22383466_c2_1009 | 3849 | 7975 | 1029 | 342 | 1074 | 1.10E−108 | gp:[GI:d1023669:g2529237] [LN:D50654] [AC:D50654] [PN:acetohydroxy acid isomeroreductase] [GN:ilvC] [OR:*Phaeospirillum molischianum*] [SR:*Rhodospirillum molischianum* DNA] [DE:*Rhodospirillum molischianum* bchZ, pufB, pufA, pufL, pufM, pufC andilvC genes, partial and complete cds.] |
| Contif154G | 22453461_c3_1174 | 3850 | 7976 | 255 | 74 | 218 | 5.80E−18 | sp:[LN:YFHJ_PSEAE] [AC:Q51384] [GN:YFHJ] [OR:*PSEUDOMONAS AERUGINOSA*] [DE:HYPOTHETICAL 7.8 KD PROTEIN IN PEPB-FDX INTERGENIC REGION] [SP:Q51384] |
| Contig154G | 22457203_f2_439 | 3851 | 7977 | 555 | 184 | 342 | 4.20E−31 | sp:[LN:YQGE_ECOLI] [AC:P52049:P76648] [GN:YQGE] [OR:*ESCHERICHIA COLI*] [DE:HYPOTHETICAL 20.7 KD PROTEIN IN GSHB-ANSB INTERGENIC REGION (O211)] SP:P52049:P76648] |
| Contig154G | 22479677_f1_6 | 3852 | 7978 | 186 | 61 | | | NO-HIT |
| Contig154G | 22531500_c3_1075 | 3853 | 7979 | 1101 | 366 | | | NO-HIT |
| Contig154G | 22542766_c2_1046 | 3854 | 7980 | 1482 | 493 | 841 | 5.50E−84 | gp:[GI:e1325654:g3650360] [LN:PPY18131] [AC:Y18131] [PN:polynucleotide adenylyltransferase] [GN:pcnB] [OR:*Pseudomonas putida*] [EC:2.7.7.19] [DE:*Pseudomonas putida* pcnB gene and partial folK gene.] |
| Contig154G | 22657558_f1_120 | 3855 | 7981 | 186 | 61 | | | NO-HIT |
| Contig154G | 22676577_c3_1170 | 3856 | 7982 | 192 | 63 | | | NO-HIT |
| Contig154G | 22697252_c1_860 | 3857 | 7983 | 1497 | 498 | 2034 | 2.10E−210 | gp:[GI:279978:g1657238] [LN:ACXCPR] [AC:Y09102] [PN:secretion protein XcpR] [GN:xcpR] [OR:Acinetobacter sp. ADP1] [DE:Acinetobacter sp. xcpR gene and two unknown open reading frames.] [RE: |
| Contig154G | 22789842_c3_1194 | 3858 | 7984 | 507 | 168 | 532 | 3.10E−51 | sp:[LN:ILVH_HAEIN] [AC:P45260] [GN:ILVH:H11584] [OR:*HAEMOPHILUS INFLUENZAE*] [EC:4.1.3.18] [DE:(ACETOHYDROXY-ACID SYNTHASE SMALL SUBUNIT) (ALS)] [SP:P45260] |
| Contig154G | 22851640_f1_197 | 3859 | 7985 | 303 | 100 | 175 | 2.10E−13 | gp:[GI:g1072400] [LN:RMPHA] [AC:X93358] [GN:phaF] [OR:*Sinorhizobium meliloti*] [DE:*Rhizobium meliloti* pha[A,B,C,D,E,F,G] genes.] |
| Contig154G | 22870630_c3_1072 | 3860 | 7986 | 507 | 168 | | | NO-HIT |
| Contig154G | 22929757_c3_1116 | 3861 | 7987 | 1035 | 344 | 742 | 1.70E−73 | sp:[LN:HEMZ_ECOLI] [AC:P23871:P78232] [GN:HEMH:POPA:VISA] [OR:*ESCHERICHIA COLI*] [EC:4.99.1.1] [DE:SYNTHETASE)] [SP:P23871:P78232] |
| Contig154G | 23444692_f3_575 | 3862 | 7988 | 630 | 209 | 120 | 4.50E−05 | gp:[GI:g3608402] [LN:AF071085] [AC:AF071085] [PN:Orfde14] [OR:*Enterococcus faecalis*] [DE:*Enterococcus faecalis* strain OGIRF polysaccharide biosynthetic genecluster, partial sequence.] [NT:hypothetical protein] |
| Contig154G | 23447017_f1_4 | 3863 | 7989 | 858 | 285 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig154G | 23460756_f3_498 | 3864 | 7990 | 465 | 154 | 282 | 9.60E−25 | pir:[LN:139736] [AC:S68185:I39736] [PN:hypothetical protein 6] [OR:*Anabaena variabilis*] |
| Contig154G | 2350702_f3_635 | 3865 | 7991 | 1842 | 613 | 1213 | 2.10E−123 | gp:[GI:g1145264] [LN:MXU37008] [AC:U37008] [PN:KefC] [GN:kefC] [OR:*Myxococcus xanthus*] [SR:*Myxococcus xanthus* strain=LS500] [DE:*Myxococcus xnathus* socD (socD500 allele) and kefC genes, completecds.] |
| Contig154G | 2359411_f1_108 | 3866 | 7992 | 201 | 66 | | | NO-HIT |
| Contig154G | 23598376_c1_812 | 3867 | 7993 | 900 | 299 | | | NO-HIT |
| Contig154G | 23604686_f2_434 | 3868 | 7994 | 1767 | 588 | 1694 | 2.30E−174 | gp:[GI:e1372039:g4186120] [LN:PST132364] [AC:AJ132364] [PN:PilB protein] [GN:pilB] [FN:involved in the translocation of the type IV] [OR:*Pseudomonas stutzeri*] [DE:*Pseudomonas stutzeri* (strain JM300) pilD, pilD, pilB and pilA genesand ORFX.] |
| Contig154G | 2362654_f1_24 | 3869 | 7995 | 819 | 272 | 466 | 3.00E−44 | sp:[LN:YGB4_ALCEU] [AC:Q44015] [OR:*ALCALIGENES EUTROPHUS*] [DE:HYPOTHETICAL 28.3 KD PROTEIN IN GBD 5'REGION (ORF4)] [SP:Q44015] |
| Contig154G | 23628387_f2_292 | 3870 | 7996 | 942 | 313 | 146 | 7.80E−08 | pir:[LN:H64945] [AC:H64945] [PN:probable membrane protein b1840] [OR:*Escherichia coli*] |
| Contig154G | 23628458_c1_733 | 3871 | 7997 | 441 | 146 | 94 | 0.00039 | gp:[GI:e1132704:g2408054] [LN:SPAC29B12] [AC:Z99164] [PN:hypothethical protein] [GN:SPAC29B12.13] [OR:*Schizosaccharomyces pombe*] [SR:fission yeast] [DE:*S.pombe* chromosome I cosmid c29B12.] [NT:SPAC29B12.13, unknown, len:13] |
| Contig154G | 23630177_f2_432 | 3872 | 7998 | 183 | 60 | | | NO-HIT |
| Contig154G | 23632000_f3_594 | 3873 | 7999 | 186 | 61 | | | NO-HIT |
| Contig154G | 23636500_f2_250 | 3874 | 8000 | 447 | 148 | 592 | 1.30E−57 | gp:[GI:e279979:g1657239] [LN:ACXCPR] [AC:Y09102] [PN:hypothethical protein] [OR:Acinetobacter sp. ADP1] [DE:Acinetobacter sp. xcpR gene and two unknown open reading frames.] [NT:orf2] |
| Contig154G | 23707806_f2_380 | 3875 | 8001 | 726 | 241 | | | NO-HIT |
| Contig154G | 23707963_f1_68 | 3876 | 8002 | 993 | 330 | | | NO-HIT |
| Contig154G | 23712927_f1_25 | 3877 | 8003 | 435 | 144 | 271 | 1.40E−23 | sp:[LN:YBEB_ECOLI] [AC:P05848:P77107] [GN:YBEB] [OR:*ESCHERICHIA COLI*] [DE:HYPOTHETICAL 11.6 KD PROTEIN IN MRDA-PHPB INTERGENIC REGION] [SP:P05848:P77107] |
| Contig154G | 23725056_f3_523 | 3878 | 8004 | 243 | 80 | | | NO-HIT |
| Contig154G | 23851562_f2_418 | 3879 | 8005 | 1080 | 359 | 899 | 4.00E−90 | sp:[LN:UBIE_ECOLI] [AC:P27851] [GN:UBIE] [OR:*ESCHERICHIA COLI*] [EC:2.1.1.—] [DE:(EC 2.1.1.—)] [SP:P27851] |
| Contig154G | 23852012_f2_349 | 3880 | 8006 | 2223 | 740 | 319 | 9.10E−47 | gp:[GI:e1371100:g4160586] [LN:VCA012458] [AC:AJ012458] [PN:alkaline phosphatase] [GN:phoX] [OR:*Volvox carteri*] [EC:3.1.3.1] [DE:*Volvox carteri* mRNA for alkaline phosphatase.] [NT:extracellular phosphatase] |
| Contig154G | 23885968_f1_198 | 3881 | 8007 | 417 | 138 | 174 | 2.70E−13 | pir:[LN:E70008] [AC:E70008] [PN:conserved hypothetical protein yufB] [GN:yufB] [OR:*Bacillus subtilis*] |

TABLE 2-continued

| Query | Orf | NT ID | AA ID | NT Lgth | AA Lgth | Score | P-value | Subject |
|---|---|---|---|---|---|---|---|---|
| Contig154G | 23931933_f2_393 | 3882 | 8008 | 198 | 65 | | | NO-HIT |
| Contig154G | 23932800_c2_870 | 3883 | 8009 | 381 | 126 | 167 | 4.90E−12 | sp:[LN:GRP_ARATH] [AC:P27483] [OR:ARABIDOPSIS THALIANA] [SR:,MOUSE-EAR CRESS] [DE:GLYCINE-RICH CELL WALL STRUCTURAL PROTEIN PRECURSOR] [SP:P27483] |
| Contig154G | 239387_f2_365 | 3884 | 8010 | 1215 | 404 | 1321 | 7.60E−135 | sp:[LN:DHAS_ECOLI] [AC:P00353] [GN:ASD:HOM] [OR:ESCHERICHIA COLI] [EC:1.2.1.11] [DE:DEHYDROGENASE)] [SP:P99353] |
| Contig154G | 23945212_f1_87 | 3885 | 8011 | 288 | 95 | 205 | 1.40E−16 | sp:[LN:GLR3_ECOLI] [AC:P37687] [GN:GRXC] [OR:ESCHERICHIA COLI] [DE:GLUTAREDOXIN 3 (GRX3)] [SP:P37687] |
| Contig154G | 23962758_f3_610 | 3886 | 8012 | 225 | 74 | 280 | 1.60E−24 | sp:[LN:IFI_HAEIN] [AC:P44322] [GN:INFA:H10548] [OR:HAEMOPHILUS INFLUENZAE] [DE:TRANSLATION INITIATION FACTOR IF-1] [SP:P44322] |
| Contig154G | 24006942_f1_100 | 3887 | 8013 | 879 | 292 | | | NO-HIT |
| Contig154G | 24025927_c1_766 | 3888 | 8014 | 2091 | 696 | 590 | 6.60E−77 | sp:[LN:PCRA_BACST] [AC:P56255] [GN:PCRA] [OR:BACILLUS STEAROTHERMOPHILUS] [EC:3.6.1.—] [DE:ATP-DEPENDENT HELICASE PCRA,] [SP:P56255] |
| Contig154G | 24223817_c2_883 | 3889 | 8015 | 939 | 312 | 185 | 1.70E−11 | sp:[LN:ASPH_HUMAN] [AC:Q12797] [GN:ASPH] [OR:HOMO SAPIENS] [EC:1.14.11.16] [DE:DIOXYGENASE)] [SP:Q12797] |
| Contig154G | 24224062_c1_826 | 3890 | 8016 | 420 | 139 | | | NO-HIT |
| Contig154G | 24226433_c1_707 | 3891 | 8017 | 387 | 128 | 136 | 2.80E−09 | sp:[LN:YAIE_COLI] [AC:P36768:P77343] [GN:YAIE] [OR:ESCHERICHIA COLI] [DE:HYPOTHETICAL 10.2 KD PROTEIN IN AROM-ARAJ INTERGENIC REGION] [SP:P36768:P77343] |
| Contig154G | 24250018_c1_854 | 3892 | 8018 | 2394 | 797 | 1949 | 2.10E−201 | sp:[LN:SYFB_ECOLI] [AC:P07395:Q59407] [GN:PHET] [OR:ESCHERICHIA COLI] [EC:6.1.1.20] [DE:TRNA LIGASE BETA CHAIN) (PHERS)] [SP:P07395:Q59407] |
| Contig154G | 24258407_f2_295 | 3893 | 8019 | 222 | 73 | | | NO-HIT |
| Contig154G | 24259427_f3_624 | 3894 | 8020 | 474 | 157 | 107 | 3.30E−06 | sp:[LN:YDCZ_ECOLI] [AC:P76111] [GN:YDCZ] [OR:ESCHERICHIA COLI] [DE:HYPOTHETHICAL 15.9 KD PROTEIN IN TEHB-ANSP INTERGENIC REGION] [SP:P76111] |
| Contig154G | 24265625_f1_186 | 3895 | 8021 | 741 | 246 | | | NO-HIT |
| Contig154G | 24272937_c1_815 | 3896 | 8022 | 810 | 269 | 628 | 2.10E−61 | sp:[LN:YGDL_ECOLI] [AC:Q46927] [GN:YGDL] [OR:ESCHERICHIA COLI] [DE:HYPOTHETHICAL 28.6 KD PROTEIN IN GCVA-MLTA INTERGENIC REGION] [SP:Q46927] |
| Contig154G | 24275257_c2_928 | 3897 | 8023 | 615 | 204 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig154G | 24334430_c2_956 | 3898 | 8024 | 1581 | 526 | 1563 | 1.70E−160 | sp:[LN:LEU2__RHIPU] [AC:P55251] [GN:LEUA] [OR:*RHIZOMUCOR PUSILLUS*] [EC:4.2.1.33] [DE:ISOMERASE) (ALPHA-IPM ISOMERASE) (IPMI)] [SP:P55251] |
| Contig154G | 24353413_c2_867 | 3899 | 8025 | 699 | 232 | 763 | 1.00E−75 | pir:[LN:164073] [AC:164073] [PN:ribosomal protein L1] [CL:*Escherichia coli* ribosomal protein L1] [OR:*Haemophilus influenzae*] |
| Contig154G | 24414192_f2_272 | 3900 | 8026 | 786 | 261 | 339 | 8.70E−31 | pri:[LN:G70515] [AC:G70515] [PN:probable dehydrogenase] [GN:Rv1882c] [OR:*Mycobacterium tuberculosis*] |
| Contig154G | 24430325_c1_843 | 3901 | 8027 | 831 | 276 | 302 | 7.30E−27 | gp:[GI:g4155184] [LN:AE001495] [AC:AE001495:AE001439] [PN:putative] [GN:jhp0628] [OR:*Helicobacter pylori* J99] [DE:*Helicobacter pylori*, strain J99 section 56 or 132 of the completegenome.] [NT:similar to *H. pylori* 26695 gene HP0688 and HP0689] |
| Contig154G | 24473425_f3_636 | 3902 | 8028 | 921 | 306 | 471 | 9.00E−45 | sp:[LN:YRFI_ECOLI] [AC:P45803] [GN:YRFI] [OR:*ESCHERICHIA COLI*] [DE:HYPOTHETICAL 32.5 KD PROTEIN IN MRCA-PCKA INTERGENIC REGION] [SP:P45803] |
| Contig154G | 24485077_c2_1028 | 3903 | 8029 | 1908 | 635 | 1303 | 6.10E−133 | sp:[LN:COPA__PSESM] [AC:P12374] [GN:COPA] [OR:*PSEUDOMONAS SYRINGAE*] [DE:COPPER RESISTANCE PROTEIN A PRECURSOR] [SP:P12374] |
| Contig154G | 24490937_c3_1196 | 3904 | 8030 | 864 | 287 | | | NO-HIT |
| Contig154G | 24492177_f1_178 | 3905 | 8031 | 1326 | 441 | 600 | 1.90E−58 | pir:[LN:C70695] [AC:C70695] [PN:probable hydrolase] [GN:lipE] [OR:*Mycobacterium tuberculosis*] |
| Contig154G | 24492252_c1_736 | 6906 | 8032 | 1284 | 427 | 291 | 2.20E−24 | sp:[LN:SOXC__RHOSO] [AC:P54998] [GN:SOXC:DSZC] [OR:RHODOCOCCUS SP] [DE:DIBENZOTIOPHENE DESULFURIZATION ENZYME C (DBT SULFUR DIOXYGENZSE)] [SP:P54998] |
| Contig154G | 245930_f1_121 | 3907 | 8033 | 1290 | 429 | 945 | 5.30E−95 | gp:[GI:e293807:g1835114] [LN:LMMETYX] [AC:Y10744] [PN:homoserine O-acetyltransferase] [GN:metX] [FN:involved in methionine biosynthesis] [OR:*Leptospira meyeri*] [DE:*L.meyeri* metY and metX genes.] |
| Contig154G | 24628900_f1_189 | 3908 | 8034 | 780 | 259 | 484 | 3.80E−46 | sp:[LN:HIS3__AZOCH] [AC:Q43925] [GN:HISI] [OR:*AZOTOBACTER CHROOCOCCUM* MCD 1] [EC:3.5.4.19] [DE:PHOSPHORIBOSYL-AMP CYCLOHYDROLASE,] [SP:Q43925] |
| Contig154G | 24630306_c2_933 | 3909 | 8035 | 1266 | 421 | 165 | 1.30E−09 | pir:[LN:A69992] [AC:A69992] [PN:conserved hypothetical protein ytfP] [GN:ytfP] [OR:*Bacillus subtilis*] |
| Contig154G | 24640688_c2_996 | 3910 | 8036 | 2190 | 729 | 463 | 8.20E−90 | sp:[LN:PRC__HAEIN] [AC:P45306] [GN:PRC:H11668] [OR:*HAEMOPHILUS INFLUENZAE*] [EC:3.4.21.—] [DE:TAIL-SPECIFIC PROTEASE PRECURSOR,(PROTEASE RE)] [SP:P45306] |
| Contig154G | 24640912_f3_643 | 3911 | 8037 | 513 | 170 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig154G | 24641878_f2_341 | 3912 | 8038 | 2151 | 716 | 1756 | 6.10E−181 | sp:[LN:PTA_HAEIN] [AC:P45107] [GN:PTA:H11203] [OR:*HAEMOPHILUS INFLUENZAE*] [EC:2.3.1.8] [DE:PHOSPHATE ACETYLTRANSFERASE, (PHOSPHOTRANSACETYLASE)] [SP:P45107] |
| Contig154G | 24650803_f3_591 | 3913 | 8039 | 201 | 66 | | | NO-HIT |
| Contig154G | 24692591_f3_505 | 3914 | 8040 | 303 | 100 | | | NO-HIT |
| Contig154G | 24703137_c2_929 | 3915 | 8041 | 894 | 297 | 395 | 1.00E−36 | pir:[LN:JC5587] [AC:JC5587:PC4481] [PN:glutamate racemase,] [GN:murI] [CL:glutamate racemase] [OR:*Bacillus pumilus*] [EC:5.1.1.3] |
| Contig154G | 24814188_c2_923 | 3916 | 8042 | 357 | 118 | 264 | 7.70E−23 | sp:[LN:CSAA_BACSU] [AC:P37584] [GN:CSAA] [OR:*BACILLUS SUBTILIS*] [DE:CSAA PROTEIN] [SP:P37584] |
| Contig154G | 24820762_f3_499 | 3917 | 8043 | 1200 | 399 | 604 | 7.20E−59 | pri:[LN:B65048] [AC:B65048] [PN:hypothetical protein b2681] [OR:*Escherichia coli*] |
| Contig154G | 24881341_f3_465 | 3918 | 8044 | 915 | 304 | 325 | 2.70E−29 | gp:[GI:g4378158] [LN:AF102543] [AC:AF102543] [PN:lipoprotein precursor] [GN:vacJ] [OR:*Zymomonas mobilis*] [DE:*Zymomonas mobilis* 5,10-methylenetetrahydrofolate reductase (metF)gene, partial cds; lipoprotein precursor (vacJ), ferredoxin-NADP+reductase (fpr), succinic semialdehyde dehydrogenase (gabD),thymidylate synthetase (thyA), gluconate permease (gntP),UTP-glucose-1-phosphate uridyltransferase, diaminopimelatedecarboxylase (lysA), arginosuccinate lyase (argH), NADH-dependentbutanol dehydrogenase (yugJ), and morphine 6-dehydrogenase (mdh)genes, complete cds; tRNA-Ala gene, complete sequence;aminopeptidase N (pepN) gene, complete cds; and unknown genes.] [NT:VacJ] |
| Contig154G | 24885937_c3_1201 | 3919 | 8045 | 1011 | 336 | 120 | 6.90E−12 | sp:[LN:RC11_ECOLI] [AC:P10487] [GN:RCI] [OR:*ESCHERICHIA COLI*] [DE:SHUFFLON-SPECIFIC DNA RECOMBINASE] [SP:P10487] |
| Contig154G | 24892527_c1_818 | 3920 | 8046 | 249 | 82 | | | NO-HIT |
| Contig154G | 24901387_c1_846 | 3921 | 8047 | 429 | 142 | 155 | 2.70E−11 | sp:[LN:YBAV_HAEIN] [AC:Q57134] [GN:H11008] [OR:*HAEMOPHILUS INFLUENZAE*] [DE:HYPOTHETICAL PROTEIN H11008] [SP:Q57134] |
| Contig154G | 2531340_f3_661 | 3922 | 8048 | 972 | 323 | 751 | 1.90E−74 | sp:[LN:LEP3_AERHY] [AC:P45794] [GN:TAPD] [OR:*AEROMONAS HYDROPHILA*] [EC:3.4.99.—] [DE:TYPE 4 PREPILIN-LIKE PROTEIN SPECIFIC LEADER PEPTIDASE,] [SP:P45794] |
| Contig154G | 25392130_c2_1016 | 3923 | 8049 | 912 | 303 | 320 | 9.00E−29 | sp:[LN:ALSR_BACSU] [AC:Q04778] [GN:ALSR] [OR:*BACILLUS SUBTILIS*] [DE:ALS OPERON REGULATORY PROTEIN] [SP:Q04778] |

TABLE 2-continued

| Query | Orf | NT ID | AA ID | NT Lgth | AA Lgth | Score | P-value | Subject |
|---|---|---|---|---|---|---|---|---|
| Contig154G | 25396088_c1_838 | 3924 | 8050 | 1467 | 488 | 1212 | 2.70E−123 | gp:[GI:G452574] [LN:RRU05294] [AC:U05294] [PN:proton-translocating nicotinamide nucleotide] [GN:pntB] [OR:*Rhodospirillum rubrum*] [EC:1.6.1.1] [DE:*Rhodospirillum rubrum* S1 proton-translocating nicotinamidenucleotide transhydrotenase subunit PntAA (pntAA), PntAB (pntAB),and PntB (pntB) genes, complete cds.] |
| Contig154G | 25397658_f2_386 | 3925 | 8051 | 360 | 119 | | | NO-HIT |
| Contig154G | 25415906_f1_123 | 3926 | 8052 | 441 | 146 | 193 | 2.60E−15 | gp:[GI:g1224007] [LN:ACU48404] [AC:U48404] [OR:*Azotobacter chroococcum*] [DE:*Azotobacter chroococcum* ORF1, ORF2, ORF3, ORF4, and ORF5H2-dependent respiration genes, complete cds.] [NT:ORF4] |
| Contig154G | 25417957_f2_406 | 3927 | 8053 | 225 | 74 | | | NO-HIT |
| Contig154G | 25506962_f2_423 | 3928 | 8054 | 558 | 185 | 193 | 2.60E−15 | gp:[GI:g1072399] [LN:RMPHA] [AC:X93358] [GN:phaE] [OR:*Sinorhizobium meliloti*] [DE:*Rhizobium meliloti* pha[A,B,C,D,E,F,G] genes.] |
| Contig154G | 25554652_c2_1026 | 3929 | 8055 | 2364 | 787 | 2071 | 2.50E−214 | gp:[GI:g4206631] [LN:AF067954] [AC:AF067954] [PN:putative cation transporting P-type ATPase SilP] [GN:silP] [OR:*Salmonella typhimurium*] [DE:*Salmonella typhimurium* plasmid pMG101 silver binding proteinprecursor SilE (silE), silRS operon, silC(ORF96)BA(ORF105)P operon,complete sequence; and ORF191 gene, partial cds.] [NT:similar to heavy-metal resistance efflux P-type] |
| Contig154G | 25625627_c1_741 | 3930 | 8056 | 1008 | 335 | 727 | 6.70E−72 | sp:[LN:RLUC__ECOLI] [AC:P23851] [GN:RLUC] [OR:*ESCHERICHIA COLI*] [EC:4.2.1.70] [DE:(PSEUDOURIDYLATE SYNTHASE) (URACIL HYDROLYASE)] [SP:P23851] |
| Contig154G | 25641525_c1_745 | 3931 | 8057 | 879 | 292 | 436 | 4.60E−41 | gp:[GI:e1319245;g35599998] [LN:SC5C7] [AC:AL031515] [PN:hypothetical protein SC5C7.08] [GN:SC5C7.08] [OR:*Streptomyces coelicolor*] [DE:*Streptomyces coelicolor* cosmid 5C7.] [NT:SC5C7.08, unknown, len: 346; similar to] |
| Contig154G | 25665875_c2_873 | 3932 | 8058 | 1923 | 640 | 1766 | 5.30E−182 | sp:[LN:HTPG__ACTAC] [AC:P54649] [GN:HTPG] [OR:*ACTINOBACILLUS ACTINOMYCETEMCOMITANS*] [SR:,*HAEMOPHILUS ACTINOMYCETEMCOMITANS*] [DE:HEAT SHOCK PROTEIN HTPG (HIGH TEMPERATURE PROTEIN G)] [SP:P54649] |
| Contig154G | 25786532_c2_1015 | 3933 | 8059 | 849 | 282 | 345 | 2.00E−31 | sp:[LN:YJJV__ECOLI] [AC:P39408;P78143] [GN:YJJV] [OR:*ESCHERICHIA COLI*] [DE:HYPOTHETICAL 28.9 KD PROTEIN IN OSMY-DEOC INTERGENIC REGION] [SP:P39408;P78143] |
| Contig154G | 25804780_f2_352 | 3934 | 8060 | 861 | 286 | 948 | 2.50E−95 | gp:[GI:g2258280] [LN:NGU86637] [AC:U86637] [PN:thymidylate synthase] [GN:thyA] [OR:*Neisseria gonorhoeae*] [DE:*Neisseria gonorrhoeae* thymidylate synthase (thyA) gene, completecds.] |

TABLE 2-continued

| Query | Orf | NT ID | AA ID | NT Lgth | AA Lgth | Score | P-value | Subject |
|---|---|---|---|---|---|---|---|---|
| Contig154G | 2585933_f3_466 | 3935 | 8061 | 864 | 287 | 452 | 9.20E−43 | gp:[GI:d1033567:g3513356] [LN:AB017194] [AC:AB017194] [GN:ORG270] [OR:*Plectonema boryanum*] [SR:*Plectonema boryanum* (strain:dg5) DNA] [DE:*Plectonema boryanum* ORF270, proline iminopeptidase, ferredoxin andamidase enhancer genes, complete and partial cds.] [NT:hypothetical protein] |
| Contig154G | 26042258_c1_770 | 3936 | 8062 | 198 | 65 | | | NO-HIT |
| Contig154G | 26178752_f1_125 | 3937 | 8063 | 543 | 180 | 318 | 1.50E−28 | sp:[LN:DYR3_SALTY] [AC:P12833] [GN:DHRFIII] [OR:*SALMONELLA TYRHIMURIUM*] [EC:1.5.1.3] [DE:DIHYDROFOLATE REDUCTASE TYPE III,] [SP:P12833] |
| Contig154G | 26346886_c2_1030 | 3938 | 8064 | 3198 | 1065 | 3725 | 0 | sp:[LN:YBDE_ECOLI] [AC:P38054:P77767] [GN:YBDE] [OR:*ESCHERICHIA COLI*] [DE:HYPOTHETICAL 114.7 KD PROTEIN IN NFRB-PHEP INTERGENIC REGION] [SP:P38054:P77767] |
| Contig154G | 26369077_c2_1052 | 3939 | 8065 | 561 | 186 | 479 | 1.30E−45 | gp:[GI:e1310876:g3319721] [LN:SC6A9] [AC:AL031035] [PN:hypothetical protein SC6A9.02] [GN:SC6A9.02] [OR:*Streptomyces coelicolor*] [DR:*Streptomyces coelicolor* cosmid 6A9.] [NT:SC6A9.02, unknown, len: 213; som similarity to] |
| Contig154G | 26378393_f3_627 | 3940 | 8066 | 1311 | 436 | 383 | 1.90E−35 | pri:[LN:C70951] [AC:C70951] [PN:hypothetical protein Rv3197] [GN:Rv3197] [OR:*Mycobacterium tuberculosis*] |
| Contig154G | 26430302_c3_1145 | 3941 | 8067 | 342 | 113 | | | NO-HIT |
| Contig154G | 26572777_c1_810 | 3942 | 8068 | 1731 | 576 | 1900 | 3.30E−196 | sp:[LN:ILVI_ECOLI] [AC:P00893:P78045] [GN:ILVI] [OR:*ESCHERICHIA COLI*] [EC:4.1.3.18] [DE:III) (ACETOHYDROXY-ACID SYNTHASE III LARGE SUBUNIT) (ALS-III)] [SP:P00893:P78045] |
| Contig154G | 26577_c1_835 | 3943 | 8069 | 273 | 90 | | | NO-HIT |
| Contig154G | 26580400_c2_957 | 3944 | 8070 | 666 | 221 | 868 | 7.60E−87 | sp:[LN:LEUD_AZOVI] [AC:P96196] [GN:LEUD] [OR:*AZOTOBACTER VINELANDII*] [EC:4.2.1.33] [DE:(ISOPROPYLMALATE ISOMERASE) (ALPHA-IPM ISOMERASE)] [SP:P96196] |
| Contig154G | 26595793_c3_1176 | 3945 | 8071 | 798 | 265 | 125 | 1.60E−05 | sp:[LN:Y367_HAEIN] [AC:Q57065:O05019] [GN:H10367] [OR:*HAEMOPHILUS INFLUENZAE*] [DE:HYPOTHETICAL PROTEIN H10367] [SP:Q57065:O05019] |
| Contig154G | 26681512_c3_1091 | 3946 | 8072 | 2703 | 900 | 2182 | 4.40E−226 | gp:[GI:e1169780:g2597869] [LN:ECAJ2539] [AC:AJ002539] [PN:Initiation factor IF2-alpha] [GN:infB] [FN:Translation initiation factor] [OR:*Escherichia coli*] [DE:*Escherichia coli* (strain EcoAU9603) infB gene encodingtranslational initiation factor IF2.] [SP:P02995] |

TABLE 2-continued

| Query | Orf | NT ID | AA ID | NT Lgth | AA Lgth | Score | P-value | Subject |
|---|---|---|---|---|---|---|---|---|
| Contig154G | 26766250_f2_246 | 3947 | 8073 | 453 | 150 | 520 | 5.80E–50 | gp:[GI:e279977:g1657237] [LN:ACXCPR] [AC:Y09102] [PN:hypothetical protein] [OR:Acinetobacter sp. ADP1] [DE:Acinetobacter sp. xcpR gene and two unknown open reading frames.] [NT:orf1] |
| Contig154G | 27290_c2_915 | 3948 | 8074 | 1266 | 421 | 204 | 5.60E–14 | pir:[LN:B69348] [AC:B69348] [PN:magnesium and cobalt transporter (corA) homolog] [CL:magnesium and cobalt transport protein] [OR:*Archaeoglobus fulgidus*] |
| Contig154G | 273462_f3_623 | 3949 | 8075 | 1938 | 645 | 1059 | 4.40E–107 | pri:[LN:D70609] [PN:probable fadD6 protein] [GN:fadD6] [CL:*Mycobacterium tuberculosis* probable fadD6 protein] [OR:*Mycobacterium tuberculosis*] |
| Contig154G | 2741327_c3_1079 | 3950 | 8076 | 795 | 264 | 116 | 0.00022 | gp:[GI:e1314388:g3402249] [LN:SC2A11] [AC:AL031184] [PN:hypothetical protein SC2A11.16] [GN:SC2A11.16] [OR:*Streptomyces coelicolor*] [DE:*Streptomyces coelicolor* cosmid 2A11.] [NT:SC2A11.16, unknown, len: 340; some similarity to] |
| Contig154G | 2768758_f1_77 | 3951 | 8077 | 630 | 209 | 139 | 2.40E–09 | gp:[GI:g3293540] [LN:AF072709] [AC:AF072709] [PN:putative transcriptional regulator] [OR:*Streptomyces lividans*] [DE:*Streptomyces lividans* amplifiable element AUD4: putativetranscriptonal regulator, putative ferredoxin, putative cytochromeP450 oxidoreductase, and putative oxidoreductase genes, completecds and unknown genes.] [NT:ORF2; similar to transcriptional repressor] |
| Contig154G | 289067_f1_79 | 3952 | 8078 | 522 | 173 | | | NO-HIT |
| Contig154G | 29297163_f1_150 | 3953 | 8079 | 921 | 306 | 550 | 3.80E–53 | gp:[GI:d1017162:g1799946] [LN:D90883] [AC:D90883:AB001340] [PN:ALS OPERON REGULATORY PROTEIN.] [GN:ALSR] [OR:*Escherichia coli*] [SR:*Escherichia coli* (strain:K12) DNA, clone_lib:Kohara lambda minise] [DE:*E.coli* genomic DNA, Kohara clone #430(57.2–57.5 min.).] [NT:similar to [SwissProt Accession Number Q04778]] |
| Contig154G | 2931553_f2_313 | 3954 | 8080 | 993 | 330 | 268 | 2.90E–23 | sp:[LN:HOLA_ECOLI] [AC:P28630] [GN:HOLA] [OR:*ESCHERICHIA COLI*] [EC:2.7.7.7] [DE:DNA POLYMERASE III, DELTA SUBUNIT,] [SP:P28630] |
| Contig154G | 29328187_f1_205 | 3955 | 8081 | 618 | 205 | 461 | 1.00E–43 | gp:[GI:g3169573] [LN:AF062531] [AC:AF062531] [PN:unknown] [OR:*Pseudomonas putida* GB-1] [DE:*Pseudomonas putida* GB-1 signal peptidase (pilD) gene, partial cds;and unknown genes.] [NT:OrfX] |
| Contig154G | 29328763_c1_782 | 3956 | 8082 | 1335 | 444 | 1454 | 6.10E–149 | sp:[LN:CLPX_ECOLI] [AC:P33138] [GN:CLPX:LOPC] [OR:*ESCHERICHIA COLI*] [DE:ATP-DEPENDENT CLP PROTEASE ATP-BINDING SUBUNIT CLPX] [SP:P33138] |

TABLE 2-continued

| Query | Orf | NT ID | AA ID | NT Lgth | AA Lgth | Score | P-value | Subject |
|---|---|---|---|---|---|---|---|---|
| Contig154G | 29345937_f3_615 | 3957 | 8083 | 543 | 180 | 570 | 2.90E−55 | gp:[GI:g4545247] [LN:AF116285] [AC:AF116285] [PN:invasion protein homolog] [OR:*Pseudomonas aeruginosa*] [DE:*Pseudomonas aeruginosa* invasion protein homolog andphosphoenolpyruvate-protein phosphotransferase PtsP (ptsP) genes,complete cds.] [NT:Orf159; similar to *Escherichia coli* ygdD and] |
| Contig154G | 2939677_f1_64 | 3958 | 8084 | 1131 | 376 | | | NO-HIT |
| Contig154G | 29507877_f3_578 | 3959 | 8085 | 786 | 261 | 659 | 1.10E−64 | sp:[LN:YH25_AZOCH] [AC:P54085] [OR:*AZOTOBACTER CHROOCOCCUM* MCD 1] [DE:(ORF5)] [SP:P54085] |
| Contig154G | 29570292_c2_1013 | 3960 | 8086 | 630 | 209 | 106 | 0.00029 | pir:[LN:G70325] [AC:G70325] [PN:transcription regulator TetR/AcrR family] [GN:acrR3] [OR:*Aquifex aeolicus*] |
| Contig154G | 29770656_f2_366 | 3961 | 8087 | 786 | 261 | 116 | 0.00042 | sp:[LN:P60_LISWE] [AC:Q01839] [GN:IAP] [OR:*LISTERIA WELSHIMERI*] [DE:PROTEIN P60 PRECURSOR (INVASION-ASSOCIATED PROTEIN)] [SP:Q01839] |
| Contig154G | 29789752_c2_939 | 3962 | 8088 | 1170 | 389 | 949 | 2.00E−95 | sp:[LN:YGGW_HAEIN] [AC:P43899] [GN:H10463] [OR:*HAEMOPHILUS INFLUENZAE*] [DE:HYPOTHETICAL PROTEIN H10463] [SP:P43899] |
| Contig154G | 30125050_f3_524 | 3963 | 8089 | 1257 | 418 | | | NO-HIT |
| Contig154G | 30268927_c2_967 | 3964 | 8090 | 291 | 96 | 161 | 1.40E−11 | gp:[GI:e1318690:g3550467] [LN:HVH005286] [AC:AJ005286] [PN:cp31AHv protein] [FN:nucleic acid-binding protein] [OR:*Hordeum vulgare*] [DE:*Hordeum vulgare* cv. Haisa mRNA for cp31 AHv protein.] |
| Contig154G | 302_c1_700 | 3965 | 8091 | 186 | 61 | | | NO-HIT |
| Contig154G | 30472587_f1_84 | 3966 | 8092 | 246 | 81 | | | NO-HIT |
| Contig154G | 30503175_f2_248 | 3967 | 8093 | 384 | 127 | | | NO-HIT |
| Contig154G | 30572706_f3_535 | 3968 | 8094 | 2025 | 674 | 1768 | 3.30E−182 | sp:[LN:YBJZ_ECOLI] [AC:P75831] [GN:YBJZ] [OR:*ESCHERICHIA COLI*] [DE:HYPOTHETICAL ABC TRANSPORTER ATP-BINDING PROTEIN YBJZ] [SP:P75831] |
| Contig154G | 30578462_c1_795 | 3969 | 8095 | 1380 | 459 | 138 | 7.10E−07 | pir:[LN:A69463] [AC:A69463] [PN:2-hydroxy-6-oxo-6-phenylhexa-2,4-dienoic acid hydrolase (pcbD) homolog] [OR:*Archaeoglobus fulgidus*] |
| Contig154G | 30657953_c2_912 | 3970 | 8096 | 1764 | 587 | 617 | 3.00E−60 | gp:[GI:g42691] [LN:ECRECD] [AC:X04582] [OR:*Escherichia coli*] [DE:*E. coli* recD gene for exonuclease V alpha-subunit.] [NT:exonuclease V alpha subunit (AA 1-608)] [SP:P04993] |
| Contig154G | 31306311_f1_114 | 3971 | 8097 | 624 | 207 | | | NO-HIT |
| Contig154G | 31306881_c1_757 | 3972 | 8098 | 240 | 79 | | | NO-HIT |
| Contig154G | 3135878_c2_1020 | 3973 | 8099 | 189 | 62 | | | NO-HIT |
| Contig154G | 3157750_c1_852 | 3974 | 8100 | 435 | 144 | 210 | 4.10E−17 | sp:[LN:YQAA_ECOLI] [AC:P76631:P77028] [GN:YQAA] [OR:*ESCHERICHIA COLI*] [DE:HYPOTHETICAL 15.6 KD PROTEIN IN GSHA-CSRA INTERGENIC REGION] [SP:P76631:P77028] |
| Contig154G | 3164785_c3_1124 | 3975 | 8101 | 285 | 94 | | | NO-HIT |
| Contig154G | 31844563_f3_592 | 3976 | 8102 | 216 | 71 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig154G | 31931501_c2_899 | 3977 | 8103 | 1488 | 495 | 1302 | 7.80E−133 | sp:[LN:NUSA_ECOLI] [AC:P03003] [GN:NUSA] [OR:*ESCHERICHIA COLI*] [DE:N UTILIZATION SUBSTANCE PROTEIN A (NUSA PROTEIN) (L FACTOR)] [SP:P03003] |
| Contig154G | 32032207_f3_605 | 3978 | 8104 | 672 | 223 | | | NO-HIT |
| Contig154G | 32114636_f2_347 | 3979 | 8105 | 669 | 222 | 462 | 8.10E−44 | sp:[LN:YGGV_ECOLI] [AC:P52061] [GN:YGGV] [OR:*ESCHERICHIA COLI*] [DE:HYPOFHETICAL 21.0 KD PROTEIN IN GSHB-ANSB INTERGENIC REGION (O197)] [SP:P52061] |
| Contig154G | 32152012_f1_209 | 3980 | 8106 | 456 | 151 | 329 | 1.00E−29 | sp:[LN:YQGF_HAEIN] [AC:P43981] [GN:H10305] [OR:*HAEMOPHILUS INFLUENZAE*] [DE:HYPOTHETICAL PROTEIN H10305] [SP:P43981] |
| Contig154G | 3224000_f1_113 | 3981 | 8107 | 1569 | 522 | 543 | 2.10E−52 | pir:[LN:D70453] [AC:D70453] [PN:fumarate hydratase (fumarase)] [GN:fumB] [CL:iron-dependent tartrate dehydratase alpha chain:iron-dependent tartrate dehydratase alpha chain homology] [OR:*Aquifex acolicus*] |
| Contig154G | 32244126_f2_317 | 3982 | 8108 | 420 | 139 | 180 | 6.10E−14 | sp:[LN:YIBN_ECOLI] [AC:P37688] [GN:YIBN] [OR:*ESCHERICHIA COLI*] [DE:HYPOTHETICAL 15.6 KD PROTEIN IN SECB-TDH INTERGENIC REGION] [SP:P37688] |
| Contig154G | 32457777_c3_1207 | 3983 | 8109 | 936 | 311 | 267 | 3.70E−23 | pir:[LN:B36868] [AC:B36868] [PN:copB homolog:hypotheticalprotein 2] [OR:*Xanthomonas campestris*] |
| Contig154G | 3251257_f2_305 | 3984 | 8110 | 285 | 94 | | | NO-HIT |
| Contig154G | 33226386_f1_216 | 3985 | 8111 | 2193 | 730 | 2295 | 4.60E−238 | sp:[LN:FAOB_PSEFR] [AC:P28793] [GN:FAOA] [OR:*PSEUDOMONAS FRAGI*] [EC:4.2.1.17:5.3.3.8:1.1.1.35:5.1.2.3] [DE:HYDROXYBUTYRYL-COA EPIMERASE,]] [SP:P28793] |
| Contig154G | 33242137_c2_914 | 3986 | 8112 | 2118 | 705 | 2315 | 3.50E−240 | gp:[GI:e1325658:g36503641 [LN:PPY18132] [AC:Y18132] [PN:polyribonucleotide nucleotidyltransferase] [GN:pnp] [OR:*Pseudomonas putida*] [EC:2.7.7.8] [DE:*Pseudomonas putida* rpsO and pnp genes.] |
| Contig154G | 33359711_f1_76 | 3987 | 8113 | 219 | 72 | | | NO-HIT |
| Contig154G | 33476452_c3_1214 | 3988 | 8114 | 954 | 317 | 1127 | 2.70E−114 | sp:[LN:TRXB_ECOLI] [AC:P09625] [GN:TRXB] [OR:*ESCHERICHIA COLI*] [EC:1.6.4.5] [DE:THIOREDOXIN REDUCTASE,] [SP:P09625] |
| Contig154G | 33693802_f1_149 | 3989 | 8115 | 2181 | 726 | 2826 | 2.50E−294 | sp:[LN:CATA_ECOLI] [AC:P13029] [GN:KATG] [OR:*ESCHERICHIA COLI*] [EC:1.11.16] [DE:CATALASE HPI, (HYDROPEROXIDASE I)] [SP:P13029] |
| Contig154G | 3375887_c2_970 | 3990 | 8116 | 912 | 303 | 817 | 1.90E−81 | pir:[LN:C69857] [AC:C69857] [PN:formyltetrahydrofolate deformylase homolog ykkE] [GN:ykkE] [CL:phosphoribosylglycinamide formyltransferase:phosphoribosylglycinamide formyltransferase homology] [OR:*Bacillus subtilis*] |

TABLE 2-continued

| Query | Orf | NT ID | AA ID | NT Lgth | AA Lgth | Score | P-value | Subject |
|---|---|---|---|---|---|---|---|---|
| Contig154G | 33834375_c2_892 | 3991 | 8117 | 933 | 310 | 198 | 3.90E−14 | sp:[LN:YCAY_CLOKL] [AC:P38943] [OR:*CLOSTRIDIUM KLUYVERI*] [DE:HYPOTHETICAL 33.5 KD PROTEIN IN CATI 5'REGION (ORFY)] [SP:P38943] |
| Contig154G | 33869212_c2_897 | 3992 | 8118 | 807 | 268 | 880 | 4.10E−88 | sp:[LN:TPIS_RHIET] [AC:P96985] [GN:TPIA:TPI] [OR:*RHIZOBIUM ETLI*] [EC:5.3.1.1] [DE:TRIOSEPHOSPHATE ISOMERASE, (TIM) (FRAGMENT)] [SP:P96985] |
| Contig154G | 33879536_c1_748 | 3993 | 8119 | 1128 | 375 | 1316 | 2.60E−134 | gp:[GI:g3237310] [LN:PAU93274] [AC:U93274] [PN:LeuB] [GN:leuB] [OR:*Pseudomonas aeruginosa*] [DE:*Pseudomonas aeruginosa* YafE (yafE), LeuB (leuB), Asd (asd), FimV(fimV), and HisT (hisT) genes, complete cds; TrpF (trpF) gene,partial cds; and unknown gene.] |
| Contig154G | 33986525_f3_469 | 3994 | 8120 | 2793 | 930 | 2232 | 2.20E−231 | sp:[LN:DPO1_ECOLI] [AC:P00582] [GN:POLA:RESA] [OR:*ESCHERICHIA COLI*] [EC:2.7.7.7] [DE:DNA POLYMERASE I, (POL I)] [SP:P00582] |
| Contig154G | 33995708_c1_837 | 3995 | 8121 | 336 | 111 | 269 | 2.30E−23 | gp:[GI:g452573] [LN:RRU05294] [AC:U05294] [PN:proton-translocating nicotinamide nucleotide] [GN:pntAB] [OR:*Rhodospirillum rubrum*] [EC:1.6.1.1] [DE:*Rhodospirillum rubrum* S1 proton-translocating nicotinamidenucleotide transhydrogenase subunit PntAA (pntAA), PntAB (pntAB),and PntB (pntB) genes, complete cds.] |
| Contig154G | 34005312_c2_1022 | 3996 | 8122 | 303 | 100 | | | NO-HIT |
| Contig154G | 34022817_c1_742 | 3997 | 8123 | 717 | 238 | 210 | 6.70E−17 | gp:[GI:g567887] [LN:STMDNRN] [AC:L37338] [PN:putative repressor] [GN:dnrO] [OR:*Streptomyccs peucetius*] [SR:*Streptomyces peucetius* ATCC 29050 DNA] [DE:*Streptomyces peucetius* TDP-D-glucose-4,6-dehydratase (dnrM) gene,3' end, regulatory protein (dnrN) gene, complete cds, and repressorprotein (dnrO) gene, complete cds.] [NT:putative] |
| Contig154G | 34022885_f1_42 | 3998 | 8124 | 1332 | 443 | 193 | 1.40E−14 | gp:[GI:e258655:g1628369] [LN:DNINTREG] [AC:X98546] [GN:gepB] [OR:*Dichelobacter nodosus*] [DE:*D.nodosus* intB, regA, gepA, gepB, and gepC genes.] |
| Contig154G | 34089125_c1_847 | 3999 | 8125 | 513 | 170 | 396 | 7.90E−37 | sp:[LN:HPPK_HAEIN] [AC:P43777] [GN:FOLK:H10064] [OR:*HAEMOPHILUS INFLUENZAE*] [EC:2.7.6.3] [DE:(HPPK) (6-HYDROXYMETHYL-7,8-DIHYDROPTERIN PYROPHOSPHOKINASE) (PPPK)] [SP:P43777] |
| Contig154G | 34160876_f2_370 | 4000 | 8126 | 213 | 70 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig154G | 34180312_f3_637 | 4001 | 8127 | 411 | 136 | 91 | 0.00017 | sp:[LN:Y0FO_MYCTU] [AC:P71902] [GN:RV2310:MTCY3G12.24C] [OR:*MYCOBACTERIUM TUBERCULOSIS*] [DE:HYPOTHETICAL 12.8 KD PROTEIN CY3G12.24C] [SP:P71902] |
| Contig154G | 34238805_c1_729 | 4002 | 8128 | 216 | 71 | | | NO-HIT |
| Contig154G | 34244082_c2_1054 | 4003 | 8129 | 1407 | 468 | 468 | 1.90E−44 | sp:[LN:MESJ_ECOLI] [AC:P52097] [GN:MESJ] [OR:*ESCHERICHIA COLI*] [DE:CELL CYCLE PROTEIN MESJ] [SP:P52097] |
| Contig154G | 34276636_c3_1231 | 4004 | 8130 | 519 | 172 | 196 | 1.20E−15 | pir:[LN:B70006] [AC:B70006] [PN:hypothetical protein yuaI] [GN:yuaI] [OR:*Bacilltus subtilis*] |
| Contig154G | 34378318_f1_2 | 4005 | 8131 | 588 | 195 | 97 | 7.30E−05 | sp:[LN:SP21_BACME] [AC:P35147] [GN:SPOIIAA] [OR:*BACILLUS MEGATERIUM*] [DE:ANTI-SIGMA F FACTOR ANTAGONIST (STAGE II SPORULATION PROTEIN AA)] [SP:P35147] |
| Contig154G | 34390775_c2_868 | 4006 | 8132 | 4143 | 1380 | 5023 | 0 | sp:[LN:RPOB_PSEPU] [AC:P19175] [GN:RPOB] [OR:*PSEUDOMONAS PUTIDA*] [EC:2.7.7.6] [DE:BETA CHAIN) (RNA POLYMERASE BETA SUBUNIT)] [SP:P19175] |
| Contig154G | 34398333_c2_869 | 4007 | 8133 | 393 | 130 | 160 | 2.00E−11 | gp:[GI:g401789] [LN:PHTIPIB1A] [AC:L24206] [GN:ipiB1] [OR:*Phytophthora infestans*] [SR:*Phytophthora infestans* DNA] [DE:*Phytophthora infestans* ipiB1 gene, complete cds.] |
| Contig154G | 34406377_c3_1148 | 4008 | 8134 | 762 | 253 | 259 | 2.60E−22 | gp:[GI:g3916253] [LN:AF087669] [AC:AF087669] [PN:TonB] [GN:tonB] [OR:*Bordetella bronchiseptica*] [DE:*Bordetella bronchiseptica* TonB (tonB), ExbB (exbB), and ExbD (exbD)genes, complete cds.] |
| Contig154G | 34409650_c2_999 | 4009 | 8135 | 1299 | 432 | 1172 | 4.70E−119 | gp:[GI:g2896164] [LN:AF047040] [AC:AF047040] [PN:histidyl-tRNA synthetase] [GN:hisS] [OR:*Salmonella typhimurium*] [DE:*Salmonella typhimurium* histidyl-tRNA synthetase (hisS) gene,complete cds.] [NT:aminoacyl-tRNA synthetase] |
| Contig154G | 34410802_c1_800 | 4010 | 8136 | 1239 | 412 | 1201 | 3.90E−122 | sp:[LN:YFGB_PSEAE] [AC:Q51385:Q51525] [OR:*PSEUDOMONAS AERUGINOSA*] [DE:HYPOTHETICAL 41.7 KD PROTEIN IN PILF-NDK INTERGENIC REGION (ORFI)] [SP:QS1385:Q51525] |
| Contig154G | 34572182_c3_1130 | 4011 | 8137 | 594 | 197 | | | NO-HIT |
| Contig154G | 34625683_c3_1102 | 4012 | 8138 | 288 | 95 | 312 | 6.30E−28 | pir:[LN:538882] [AC:S38882] [PN:ribosomal protein S15] [GN:rpsO:rprA] [CL:*Escherichia coli* ribosomal protein S15:eubacterial ribosomal protein S15 homology] [OR:*Xenorhabdus luminescens*] |

TABLE 2-continued

| Query | Orf | NT ID | AA ID | NT Lgth | AA Lgth | Score | P-value | Subject |
|---|---|---|---|---|---|---|---|---|
| Contig154G | 35242187_f3_492 | 4013 | 8139 | 981 | 326 | 412 | 1.60E−38 | gp:[GI:d1035162:g3845577] [LN:AB015439] [AC:AB015439] (PN:D-threonine dehydrogenase] [GN:dtdS] [OR:*Pseudomonas cruciviae*] [SR:*Pseudomonas cruciviae* (strain:IFO12047) DNA] [DE:*Pseudomonas cruciviae* gene for D-threonine dehydrogenase, partialcds.] [RE: |
| Contig154G | 35323777_c3_1232 | 4014 | 8140 | 360 | 119 | 342 | 4.20E−31 | sp:[LN:IHFA_PSEAE] [AC:Q51472] [GN:HIMA] [OR:*PSEUDOMONAS AERUGINOSA*] [DE:INTEGRATION HOST FACTOR ALPHA-SUBUNIT (IHF-ALPHA)] [SP:Q51472] |
| Contig154G | 35348150_c2_884 | 4015 | 8141 | 585 | 194 | | | NO-HIT |
| Contig154G | 35703140_c3_1184 | 4016 | 8142 | 597 | 198 | 625 | 4.30E−61 | sp:[LN:ORN_HAEIN] [AC:P45340] [GN:ORN:H11715] [OR:*HAEMOPHILUS INFLUENZAE*] [EC:3.1.—.—] [DE:OLIGORIBONUCLEASE,] [SP:P45340] |
| Contig154G | 35819062_f2_274 | 4017 | 8143 | 807 | 268 | 330 | 7.80E−30 | pir:[LN:C69304] [AC:C69304] [PN:enoyl-CoA hydratase (fad-1) homolog] [CL:naphthoate synthase:enoyl-CoA hydratase homology] [OR:*Archaeoglobus fulgidus*] |
| Contig154G | 35941527_c3_1064 | 4018 | 8144 | 528 | 175 | 381 | 3.10E−35 | pir:[LN:E64083] [AC:E64083] [PN:ribosomal protein L10] [CL:*Escherichia coli* ribosomal protein L10] [OR:*Haemophilus influenzae*] |
| Contig154G | 35954002_c3_1234 | 4019 | 8145 | 1560 | 519 | 1138 | 1.90E−115 | gp:[GI:d1038193:g4200042] [LN:AB022715] [AC:AB022715] [PN:exopolyphosphatase] [GN:ppx] [OR:*Pseudomonas aeruginosa*] [SR:*Pseudomonas aeruginosa* (strain:PAO1) DNA] [DE:*Pseudomonas aeruginosa* ppx gene for exopolyphosphatase, completecds.] |
| Contig154G | 36125260_c3_1212 | 4020 | 8146 | 456 | 151 | 509 | 8.40E−49 | gp:[GI:g1545991] [LN:YEU58366] [AC:U58366] [PN:arsenate reductase] [GN:arsC] [OR:*Yersinia enterocolitica*] [DE:*Yersinia enterocolitica* Tn2502 transposon defective transposase(tnpA), resolvase (tnpR), arsenate reductase (arsC), transmembraneprotein of arsenite pump (arsB), arsenite inducible repressor(arsR), and ArsH (arsH) genes, complete cds.] [NT:ArsC] |
| Contig154G | 36132640_c3_1141 | 4021 | 8147 | 309 | 102 | 282 | 9.60E−25 | pir:[LN:B69779] [AC:B69779] [PN:conserved hypothetical protein ydeP] [GN:ydeP] [CL:conserved hypothetical protein MTH1285] [OR:*Bacillus subtilis*] |
| Contig154G | 36213566_c3_1155 | 4022 | 8148 | 894 | 297 | 114 | 0.00035 | pir:[LN:C70421] [AC:C70421] [PN:conserved hypothetical protein aq_1392] [GN:aq_1392] [OR:*Aquifex aeolicus*] |
| Contig154G | 36568750_c3_1143 | 4023 | 8149 | 777 | 258 | | | NO-HIT |
| Contig154G | 36601058_c2_886 | 4024 | 8150 | 630 | 209 | 132 | 1.00E−05 | pir:[LN:S77910] [AC:S77910] [PN:hypothetical protein 1] [CL:grapevine trichovirus B hypothetical protein] [OR:grapevine virus A] |
| Contig154G | 37812_f3_588 | 4025 | 8151 | 1077 | 358 | | | NO-HIT |
| Contig154G | 38577_c2_968 | 4026 | 8152 | 534 | 177 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig154G | 3906551_c2_985 | 4027 | 8153 | 1356 | 451 | 1043 | 2.20E−105 | sp:[LN:TIG_ECOLI] [AC:P22257:P15299:P77603] [GN:TIG] [OR:*Escherichia coli*] [DE:TRIGGER FACTOR (TF)] [SP:P22257:P15299:P77603] |
| Contig154G | 3906636_c2_876 | 4028 | 8154 | 681 | 226 | 277 | 3.20E−24 | pir:[LN:H69778] [AC:H69778] [PN:hypothetical protein ydeN] [GN:ydeN] [OR:*Bacillus subtilis*] |
| Contig154G | 3908593_f1_5 | 4029 | 8155 | 927 | 308 | 376 | 1.00E−34 | pir:[LN:H71275] [AC:H71275] [PN:conserved hypothetical protein TP0822] [GN:TP0822] [OR:*Treponema pallidum* subsp. pallidum] [SR:, syphilis spirochete] |
| Contig154G | 3916088_c3_1071 | 4030 | 8156 | 768 | 255 | | | NO-HIT |
| Contig154G | 3937577_c1_692 | 4031 | 8157 | 621 | 206 | 219 | 4.50E−18 | gp:[GI:e1309481:g3288111] [LN:CAAJ1918] [AC:AJ001918] [PN:outer membrane protein 21, Omp21] [GN:omp21] [OR:*Comamonas acidovorans*] [DE:*Comamonas acidovorans* omp21 gene.] |
| Contig154G | 3939392_f3_614 | 4032 | 8158 | 870 | 289 | 287 | 2.80E−25 | pir:[LN:S75955] [AC:S75955] [PN:hypothetical protein] [CL:transcription activator LysR-type] [OR:Synechocystis sp.] [SR:PCC 6803., PCC 6803] [SR:PCC 6803,] |
| Contig154G | 3947188_c3_1067 | 4033 | 8159 | 882 | 293 | 479 | 1.30E−45 | gp:[GI:e1355673:g3928730] [LN:SCD78] [AC:AL034355] [PN:putative oxidoreductase] [GN:SCD78.21c] [OR:*Streptomyces coelicolor*] [DE:*Streptomyces coelicolor* cosmid D78.] [NT:SCD78.21c, putative oxidoreductase, len: 584;] |
| Contig154G | 3957508_f2_362 | 4034 | 8160 | 1053 | 350 | 920 | 2.40E−92 | gp:[GI:g4321580] [LN:AF050114] [AC:AF050114] [PN:alginate lyase] [OR:Pseudomonas sp. W7] [DE:Pseudomonas sp. W7 alginate lyase gene, complete cds.] |
| Contig154G | 39707_c1_747 | 4035 | 8161 | 663 | 220 | 211 | 4.50E−20 | pir:[LN:F70788] [AC:F70788] [PN:hypothetical protein Rv3661] [GN:Rv3661] [OR:*Mycobacterium tuberculosis*] |
| Contig154G | 3994626_f1_80 | 4036 | 8162 | 2634 | 877 | 2494 | 3.80E−259 | sp:[LN:SYL_ECOLI] [AC:P07813:P78292:P77110] [GN:LEUS] [OR:*Escherichia coli*] [EC:6.1.1.4] [DE:LEUCYL-TRNA SYNTHETASE, (LEUCINE--TRNA LIGASE) (LEURS)] [SP:P07813:P78292:P77110] |
| Contig154G | 4062627_f3_602 | 4037 | 8163 | 951 | 316 | 536 | 1.20E−51 | sp:[LN:HTRB_ECOLI] [AC:P24187] [GN:HTRB] [OR:*Escherichia coli*] [EC:2.3.1.—] [DE:PROTEIN B)] [SP:P24187] |
| Contig154G | 40792_c3_1142 | 4038 | 8164 | 2679 | 892 | 2911 | 0 | sp:[LN:TOP1_ECOLI] [AC:P06612] [GN:TOPA:SUPX] [OR:*Escherichia coli*] [EC:5.99.1.2] [DE:(UNTWISTING ENZYME) (SWIVELASE)] [SP:P06612] |
| Contig154G | 4080092_c3_1241 | 4039 | 8165 | 2823 | 940 | 133 | 4.90E−05 | gp:[GI:g4378768] [LN:AF116775] [AC:AF116775] [PN:NADH dehydrogenase subunit 5] [GN:nad5] [OR:Mitochondrion Pedinomonas minor] [SR:Pedinomonas minor] [EC:1.6.5.3] [DE:Pedinomonas minor mitochondrion, complete genome.] |

TABLE 2-continued

| Query | Orf | NT ID | AA ID | NT Lgth | AA Lgth | Score | P-value | Subject |
|---|---|---|---|---|---|---|---|---|
| Contig154G | 4095342_c2_872 | 4040 | 8166 | 366 | 121 | 97 | 7.50E−05 | sp:[LN:Y040_MYCTU] [AC:Q10785] [GN:MTCY48.24] [OR:*MYCOBACTERIUM TUBERCULOSIS*] [DE:HYPOTHETICAL 21.6 KD PROTEIN CY48.24] [SP:Q10785] |
| Contig154G | 4095467_c3_1235 | 4041 | 8167 | 840 | 279 | 805 | 3.60E−80 | sp:[LN:ACCA_HAEIN] [AC:P43872] [GN:ACCA:H10406] [OR:*HAEMOPHILUS INFLUENZAE*] [EC:6.4.1.2] [DE:(EC 6.4.1.2)] [SP:P43872] |
| Contig154G | 4096928_c3_1078 | 4042 | 8168 | 1830 | 609 | 1522 | 3.80E−156 | sp:[LN:UVRC_PSEFL] [AC:P32966] [GN:UVRC] [OR:*PSEUDOMONAS FLUORESCENS*] [DE:EXCINUCLEASE ABC SUBUNIT C] [SP:P32966] |
| Contig154G | 4101467_c3_1197 | 4043 | 8169 | 954 | 317 | 161 | 4.60E−09 | pir:[LN:G69849] [AC:G69849] [PN:endo-1,4-beta-xytanase homolog yjeA] [GN:yjeA] [CL:nodB homology] [OR:*Bacillus subtilis*] |
| Contig154G | 4104202_c3_1237 | 4044 | 8170 | 846 | 281 | 627 | 2.60E−61 | sp:[LN:PROC_PSEAE] [AC:P22008] [GN:PROC] [OR:*PSEUDOMONAS AERUGINOSA*] [EC:1.5.12] [DE:PYRROLINE-5-CARBOXYLATE REDUCTASE, (P5CR) (P5C REDUCTASE)] [SP:P22008] |
| Contig154G | 4114375_c1_783 | 4045 | 8171 | 762 | 253 | | | NO-HIT |
| Contig154G | 4141893_c3_1180 | 4046 | 8172 | 1419 | 472 | 926 | 4.20E−143 | sp:[LN:YFGK_HAEIN] [AC:P44536] [GN:H10136] [OR:*HAEMOPHILUS INFLUENZAE*] [DE:HYPOTHETICAL GTP-BINDING PROTEIN H10136] [SP:P44536] |
| Contig154G | 4179688_c3_1213 | 4047 | 8173 | 735 | 244 | 780 | 1.60E−77 | gp:[GI:g1545994] [LN:YEU58366] [AC:U58366] [PN:ArsH] [GN:arsH] [FN:unknown] [OR:*Yersinia enterocolitica*] [DE:*Yersinia enterocotitica* Tn2502 transposon defective transposase(tnpA) resolvase (tnpR), arsenate reductase (arsC), transmembraneprotein of arsenite pump (arsB), arsenite inducible repressor(arsR), and ArsH (arsH) genes, complete cds.] [NT:required for arsenic resistance] |
| Contig154G | 4298203_c3_1195 | 4048 | 8174 | 1602 | 533 | 1862 | 3.60E−192 | sp:[LN:RF3_HAEIN] [AC:P43928] [GN:PRFC:H11735] [OR:*HAEMOPHILUS INFLUENZAE*] [DE:PEPTIDE CHAIN RELEASE FACTOR 3 (RF-3)] [SP:P43928] |
| Contig154G | 430327_f3_515 | 4049 | 8175 | 684 | 227 | 775 | 5.50E−77 | sp:[LN:IRLR_BURPS] [AC:O31395] [GN:IRLR] [OR:*BURKHOLDERIA PSEUDOMALLAI*] [SR:,*PSEUDOMONAS PSEUDOMALLAI*] [DE:TRANSCRIPTIONAL ACTIVATOR PROTEIN IRLR] [SP:O31395] |
| Contig154G | 4307888_c1_705 | 4050 | 8176 | 2109 | 702 | 261 | 4.50E−28 | pir:[LN:G6492I] [AC:G64921] [PN:probable membrane protein b1645] [OR:*Escherichia coli*] |
| Contig154G | 431400_f1_223 | 4051 | 8177 | 921 | 306 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig154G | 4322818_c2_1041 | 4052 | 8178 | 1137 | 378 | 807 | 2.20E−80 | gp:[GI:g452572] [LN:RRU05294] [AC:U05294] [PN:proton-translocating nicotinamide nucleotide] [GN:pntAA] [OR:*Rhodospirillum rubrum*] [EC:1.6.1.1] [DE:*Rhodospirillum rubrum* S1 proton-translocating nicotinamidenucleotide transhydrogenase subunit PntAA (pntAA), PntAB (pntAB),and PntB (pntB) genes, complete cds.] |
| Contig154G | 4337578_c3_1220 | 4053 | 8179 | 924 | 307 | 979 | 1.30E−98 | sp:[LN:CYSM_ECOLI] [AC:P16703] [GN:CYSM] [OR:*ESCHERICHIA COLI*] [EC:4.2.99.8] [DE:(O-ACETYLSERINE (THIOL)-LYASE B) (CSASE B)] [SP:P16703] |
| Contig154G | 4390688_f3_582 | 4054 | 8180 | 2343 | 780 | 125 | 7.60E−07 | pir:[LN:S64724] [AC:564724:547502] [PN:uxpB protein] [GN:uxpB] [OR:*Pseudomonas putida*] |
| Contig154G | 4391263_f2_451 | 4055 | 8181 | 714 | 237 | 380 | 3.90E−35 | gp:[GI:g3170570] [LN:AF058302] [AC:AF058302] [PN:FrnE] [GN:frnE] [OR:*Streptomyces roseofulvus*] [DE:*Streptomyces roseofulvus* frenolicin biosynthetic gene cluster,complete sequence.] |
| Contig154G | 4406537_c1_727 | 4056 | 8182 | 1215 | 404 | 989 | 1.20E−99 | gp:[GI:g3978480] [LN:AF092918] [AC:AF092918] [PN:outer membrane secretion protein S] [GN:xcpS] [OR:*Pseudomonas alcaligenes*] [DE:*Pseudomonas alcaligenes* outer membrane Xcp-secretion system genecluster.] [NT:XcpS] |
| Contig154G | 4429218_c3_1208 | 4057 | 8183 | 1503 | 500 | 737 | 5.80E−73 | gp:[GI:g4206629] [LN:AF067954] [AC:AF067954] [PN:putative membrane fusion protein SilB] [GN:silB] [OR:*Salmonella typhimurium*] [DE:*Salmonella typhimurium* plasmid pMG101 silver binding proteinprecursor SilE (silE), silRS operon, silC(ORF96)BA(ORF105)P operon,complete sequence; and ORF191 gene, partial cds.] [NT:similar to *Escherichia coli* ORF ylcD and] |
| Contig154G | 4456517_c2_960 | 4058 | 8184 | 1035 | 344 | 349 | 7.60E−32 | gp[GI:d103718:g4062962] [LN:AB014757] [AC:AB014757] [PN:PhbR] [GN:phbR] [OR:Pseudomonas sp. 61-3] [SR:Pseudomonas sp. 61-3 (strain:61-3) DNA] [DE:Pseudomonas sp. 61-3 genes for PhbR, acetoacetyl-CoA reductase,beta-ketothiolase and PHB synthase, complete cds.] |
| Contig154G | 4492061_f3_675 | 4059 | 8185 | 1161 | 386 | | | NO-HIT |
| Contig154G | 4531675_c2_1018 | 4060 | 8186 | 267 | 88 | | | NO-HIT |
| Contig154G | 4538217_c3_1086 | 4061 | 8187 | 759 | 252 | 596 | 5.10E−58 | sp:[LN:YJFH_HAEIN] [AC:P44906] [GN:H10860] [OR:*HAEMOPHILUS INFLUENZAE*] [EC:2.1.1.—] [DE:HYPOTHETICAL TRNA/RRNA METHYLTRANSFERASE H10860,] [SP:P44906] |
| Contig154G | 4539665_c1_731 | 4062 | 8188 | 186 | 61 | | | NO-HIT |
| Contig154G | 4558182_c2_993 | 4063 | 8189 | 699 | 232 | 470 | 1.10E−44 | pir:[LN:C64657] [AC:C64657] [PN:2-keto-3-deoxy-6-phosphogluconate aldolase] [CL:2-dehydro-3-deoxyphosphogluconate aldolase] [OR:*Helicobacter pylori*] |

TABLE 2-continued

| Query | Orf | NT ID | AA ID | NT Lgth | AA Lgth | Score | P-value | Subject |
|---|---|---|---|---|---|---|---|---|
| Contig154G | 4568755_c3_1172 | 4064 | 8190 | 1326 | 441 | 465 | 3.90E−44 | pir:[LN:S76126] [AC:S76126] [PN:hypothetical protein] [OR:Synechocystis sp.] [SR:PCC 6803,, PCC 6803] [SR:PCC 6803,] |
| Contig154G | 4687503_f2_256 | 4065 | 8191 | 300 | 99 | 145 | 3.10E−10 | sp:[LN:H82_NEIGO] [AC:P11910] [OR:*NEISSERIA GONORRHOEAE*] [DE:OUTER MEMBRANE PROTEIN H.8 PRECURSOR] [SP:P11910] |
| Contig154G | 4694136_f2_291 | 4066 | 8192 | 408 | 135 | 151 | 7.30E−11 | pir:[LN:A64946] [AC:A64946] [PN:hypothetical protein b1841] [CL:copper resistance protein pcoC] [OR:*Escherichia coli*] |
| Contig154G | 4695918_c3_1224 | 4067 | 8193 | 549 | 182 | 173 | 3.40E−13 | sp:[LN:YJGA_HAEIN] [AC:P45076] [GN:H11151] [OR:*HAEMOPHILUS INFLUENZAE*] [DE:HYPOTHETICAL PROTEIN H11151] [SP:P45076] |
| Contig154G | 4695962_c1_763 | 4068 | 8194 | 471 | 156 | | | NO-HIT |
| Contig154G | 4703178_c1_830 | 4069 | 8195 | 402 | 133 | 271 | 1.40E−23 | sp:[LN:ZNTR_HAEIN] [AC:P45277] [GN:ZNTR:H11623] [OR:*HAEMOPHILUS INFLUENZAE*] [DE:ZN(II)-RESPONSIVE REGULATOR HOMOLOG] [SP:P45277] |
| Contig154G | 4704202_f1_86 | 4070 | 8196 | 1059 | 352 | 652 | 5.90E−64 | sp:[LN:YJEQ_HAEIN] [AC:P45339] [GN:H11714] [OR:*HAEMOPHILUS INFLUENZAE*] [DE:HYPOTHETICAL PROTEIN H11714] [SP:P45339] |
| Contig154G | 4714380_c2_930 | 4071 | 8197 | 1056 | 351 | | | NO-HIT |
| Contig154G | 4728285_c2_966 | 4072 | 8198 | 597 | 198 | 152 | 5.70E−11 | pir:[LN:F70558] [AC:F70558] [PN:hypothetical protein Rv1624c] [GN:Rv1624c] [OR:*Mycobacterium tuberculosis*] |
| Contig154G | 4773467_c3_1205 | 4073 | 8199 | 1062 | 353 | | | NO-HIT |
| Contig154G | 4860687_f3_613 | 4074 | 8200 | 279 | 92 | | | NO-HIT |
| Contig154G | 4869086_c3_1080 | 4075 | 8201 | 858 | 285 | 372 | 2.80E−34 | sp:[LN:ADA_ECOLI] [AC:P06134:Q47032] [GN:ADA] [OR:*ESCHERICHIA COLI*] [EC:2.1.1.63] [DE:(EC 2.1.1.63) (O-6-METHYLGUANINE-DNA ALKYLTRANSFERASE)]] [SP:P06134:Q47032] |
| Contig154G | 4877203_c2_889 | 4076 | 8202 | 1011 | 336 | 340 | 6.80E−31 | sp:[LN:YJCR_ECOLI] [AC:P32716] [GN:YJCR] [OR:*ESCHERICHIA COLI*] [DE:HYPOTHETICAL 36.9 KD PROTEIN IN FDHF-PHNP INTERGENIC REGION (F343)] [SP:P32716] |
| Contig154G | 4882755_f1_148 | 4077 | 8203 | 2322 | 773 | 2004 | 3.20E−207 | gp:[GI:e1321548:g3641832] [LN:AVPTSP] [AC:Y14681] [PN:enzyme I] [GN:ptsP] [FN:energy coupling protein in phosphotransferase] [OR:*Azotobacter vinelandii*] [EC:2.7.3.9] [DE:*Azotobacter vinelandii* ptsP gene.] |
| Contig154G | 4882803_f3_673 | 4078 | 8204 | 210 | 69 | | | NO-HIT |
| Contig154G | 489001_c2_971 | 4079 | 8205 | 678 | 225 | 284 | 1.60E−32 | gp:[GI:g3916254] [LN:AF087669] [AC:AF087669] [PN:ExbB] [GN:exbB] [OR:*Bordetella bronchiseptica*] [DE:*Bordetella bronchiseptica* TonB (tonB), ExbB (exbB), and ExbD (exbD)genes, complete cds.] |

TABLE 2-continued

| Query | Orf | NT ID | AA ID | NT Lgth | AA Lgth | Score | P-value | Subject |
|---|---|---|---|---|---|---|---|---|
| Contig154G | 4892751_c1_851 | 4080 | 8206 | 606 | 201 | 558 | 5.40E−54 | gp:[GI:g290449] [LN:ECOHIMA] [AC:K02844] [PN:initiation factor 3] [GN:infC] [OR:*Escherichia coli*] [SR:*E.coli* DNA, clone lambda-himA] [DE:*E.coli* infC, rplT, pheS, pheT and himA genes encoding initiationfactor IF3, ribosomal protein L20, beta- and alpha-subunits ofphenylalanyl-tRNA synthetase and the alpha-subunit of integrationhost factor, complete cds.] |
| Contig154G | 4954688_c3_1228 | 4081 | 8207 | 630 | 209 | 586 | 5.80E−57 | pir:[LN:140179] [AC:140179] [PN:hypothetical protein 1] [CL:hypothetical protein b2302] [OR:*Pseudomonas cepacia*] |
| Contig154G | 5030_f2_372 | 4082 | 8208 | 489 | 162 | | | NO-HIT |
| Contig154G | 5126625_c1_732 | 4083 | 8209 | 645 | 214 | 134 | 5.10E−07 | pir:[LN:D70306] [AC:D70306] [PN:conserved hypothetical protein aq_065] [GN:aq_065] [OR:*Aquifex aeolicus*] |
| Contig154G | 519012_c2_871 | 4084 | 8210 | 1458 | 485 | 491 | 3.00E−89 | pir:[LN:F64614] [AC:F64614] [PN:conserved hypothetical integral membrane protein HP0758] [CL:conserved integral membrane protein HP0758] [OR:*Helicobacter pylori*] |
| Contig154G | 5211652_c1_804 | 4085 | 8211 | 912 | 303 | 954 | 5.90E−96 | gp:[GI:g4008034] [LN:AF104262] [AC:AF104262] [PN:enoyl-(acyl-carrier protein) reductase] [GN:fabI] [OR:*Pseudomonas aeruginosa*] [DE:*Pseudomonas aeruginosa* enoyl-(acyl-carrier protein) reductase(fabI) gene, complete cds.] |
| Contig154G | 5272928_c1_831 | 4086 | 8212 | 333 | 110 | 259 | 2.60E−22 | sp:[LN:ARSR_ECOLI] [AC:P37309] [GN:ARSR:ARSE] [OR:*ESCHERICHIA COLI*] [DE:ARSENICAL RESISTANCE OPERON REPRESSOR] [SP:P37309] |
| Contig154G | 5275437_f3_493 | 4087 | 8213 | 825 | 274 | 373 | 2.20E−34 | gp:[GI:e1370363:g4154042] [LN:MLCB1450] [AC:AL035159] [PN:putative oxidoreductase] [GN:MLCB1450.07] [OR:*Mycobacterium leprae*] [DE:*Mycobacterium leprae* cosmid B1450.] [NT:MLCB1450.07, probable oxidoreductase, len: 304;] |
| Contig154G | 5277135_f2_280 | 4088 | 8214 | 912 | 303 | 297 | 2.50E−26 | sp:[LN:YCBK_BACSU] [AC:P42243] [GN:YCBK] [OR:*BACILLUS SUBTILIS*] [DE:HYPOTHETICAL 34.0 KD PROTEIN IN PCP 5'REGION (ORF10)] [SP:P42243] |
| Contig154G | 5287943_c1_836 | 4089 | 8215 | 1140 | 379 | 116 | 0.00049 | sp:[LN:VBET_BPP4] [AC:P13057] [GN:BETA] [OR:BACTERIOPHAGE P4] [DE:BETA PROTEIN] [SP:P13057] |
| Contig154G | 54625_f3_665 | 4090 | 8216 | 183 | 60 | | | NO-HIT |
| Contig154G | 6025266_c2_986 | 4091 | 8217 | 609 | 202 | 780 | 1.60E−77 | sp:[LN:CLPP_ECOLI] [AC:P19245] [GN:CLPP:LOPP] [OR:*ESCHERICHIA COLI*] [EC:3.4.21.92] [DE:PROTEIN F21.5)] [SP:P19245] |
| Contig154G | 6053387_f2_348 | 4092 | 8218 | 288 | 95 | 167 | 1.50E−12 | pir:[LN:H64559] [AC:H64559] [PN:conserved hypothetical secreted protein HP0320] [CL:conserved hypothetical secreted protein HP0320] [OR:*Helicobacter pylori*] |

TABLE 2-continued

| Query | Orf | NT ID | AA ID | NT Lgth | AA Lgth | Score | P-value | Subject |
|---|---|---|---|---|---|---|---|---|
| Contig154G | 6064091_c1_772 | 4093 | 8219 | 837 | 278 | 250 | 2.40E−21 | sp:[LN:T10_MOUSE] [AC:P54797] [GN:T10] [OR:MUS MUSCULUS] [DE:SER/THR-RICH PROTEIN T10 IN DGCR REGION] [SP:P54797] |
| Contig154G | 6105380_f1_195 | 4094 | 8220 | 480 | 159 | 297 | 2.50E−26 | gp:[GI:g3128269] [LN:AF010496] [AC:AF010496] [PN:potential poly(3-hydroxyalkanoate) polymerase] [OR:*Rhodobacter capsulatus*] [EC:2.3.1.—] [DE:*Rhodobacter capsulatus* strain SB1003, partial genome.] |
| Contig154G | 6110452_c2_1051 | 4095 | 8221 | 360 | 119 | 483 | 4.80E−46 | pir:[LN:R5EC20] [AC:D64930:S08608:A02806:141 282] [PN:ribosomal protein L20] [GN:rplT:pdZA] [CL:*Escherichia coli* ribosomal protein L20] [OR:*Escherichia coli*] [MP:38 min] |
| Contig154G | 6262_c1_825 | 4096 | 8222 | 339 | 112 | 111 | 6.70E−06 | sp:[LN:COPB_PSESM] [AC:P12375] [GN:COPB] [OR:*PSEUDOMONAS SYRINGAE*] [DE:COPPER RESISTANCE PROTEIN B PRECURSOR] [SP:P12375] |
| Contig154G | 6292077_c2_888 | 4097 | 8223 | 240 | 79 | | | NO-HIT |
| Contig154G | 629393_f1_164 | 4098 | 8224 | 207 | 68 | 158 | 1.30E−11 | gp:[GI:g3169572] [LN:AF062531] [AC:AF062531] [PN:unknown] [OR:*Pseudomonas putida* GB-1] [DE:*Pseudomonas putida* GB-1 signal peptidase (pilD) gene, partial cds;and unknown genes.] [NT:OrfY] |
| Contig154G | 633427_f2_399 | 4099 | 8225 | 630 | 209 | 214 | 1.50E−17 | sp:[LN:YEAS_ECOLI] [AC:P76249:O07971:O07969] [GN:YEAS] [OR:*ESCHERICHIA COLI*] [DE:HYPOTHETICAL 23.2 KD PROTEIN IN GAPA-RND INTERGENIC REGION] [SP:P76249:O07971:O07969] |
| Contig154G | 6431250_c1_712 | 4100 | 8226 | 282 | 93 | | | NO-HIT |
| Contig154G | 6681530_c1_792 | 4101 | 8227 | 516 | 171 | 364 | 2.00E−33 | sp:[LN:GNTV_ECOLI] [AC:P39208] [GN:GNTV] [OR:*ESCHERICHIA COLI*] [EC:2.7.1.12] [DE:THERMOSENSITIVE GLUCONOKINASE, (GLUCONATE KINASE 1)] [SP:P39208] |
| Contig154G | 6723262_f1_190 | 4102 | 8228 | 1512 | 503 | 129 | 4.50E−08 | gp:[GI:g4155417] [LN:AE001513] [AC:AE001513:AE001439] [PN:putative ATP-DEPENDENT HELICASE] [GN:jhp0847] [OR:*Helicobacter pylori* J99] [DE:*Helicobacter pylori*, strain J99 section 74 of 132 of the completegenome.] [NT:similar to *H. pylori* 26695 gene HP0911] |
| Contig154G | 6828138_c3_1221 | 4103 | 8229 | 849 | 282 | 548 | 6.20E−53 | pir:[LN:E70330] [AC:E70330] [PN:conserved hypothetical protein aq_342] [GN:aq_342] [CL:beta-lactamase regulatory protein:beta-lactamase regulatory protein homology] [OR:*Aquifex aeolicus*] |
| Contig154G | 6837653_f3_571 | 4104 | 8230 | 2301 | 766 | 527 | 2.40E−92 | gp:[GI:g2981055] [LN:AF051693] [AC:AF051693] [PN:hydroxamate-type ferrisiderophore receptor] [GN:pfuA] [OR:*Pseudomonas aeruginosa*] [DE:*Pseudomonas aeruginosa* hydroxamate-type ferrisiderophore receptor(pfuA) gene, comptete cds.] [NT:PfuA] |
| Contig154G | 6855377_c1_819 | 4105 | 8231 | 1089 | 362 | | | NO-HIT |
| Contig154G | 6930277_f2_350 | 4106 | 8232 | 426 | 141 | | | NO-HIT |

TABLE 2-continued

| Query | Orf | NT ID | AA ID | NT Lgth | AA Lgth | Score | P-value | Subject |
|---|---|---|---|---|---|---|---|---|
| Contig154G | 7033128_f3_622 | 4107 | 8233 | 3378 | 1125 | 1531 | 3.00E−166 | sp:[LN:RNE_ECOLI] [AC:P21513:P77591] [GN:RNE:AMS:HMPI] [OR:*ESCHERICHIA COLI*] [EC:3.1.4.—] [DE:RIBONUCLEASE E, (RNASE E)] [SP:,P21513:P77591] |
| Contig154G | 7070918_c1_850 | 4108 | 8234 | 318 | 105 | 196 | 1.20E−15 | sp:[LN:PTHP_ALCEU] [AC:P23537] [GN:PHBH] [OR:*ALCALIGENES EUTROPHUS*] [DE:PHOSPHOCARRIER PROTEIN HPR (HISTIDINE-CONTAINING PROTEIN) (PROTEIN H)] [SP:P23537] |
| Contig154G | 7082907_f3_634 | 4109 | 8235 | 189 | 62 | | | NO-HIT |
| Contig154G | 7141087_c3_1144 | 4110 | 8236 | 405 | 134 | | | NO-HIT |
| Contig154G | 7156285_c2_962 | 4111 | 8237 | 1314 | 437 | 1605 | 6.10E−165 | sp:[LN:GLTP_ECOLI] [AC:P21345] [GN:GLTP] [OR:*ESCHERICHIA COLI*] [DE:PROTEIN)] [SP:P21345] |
| Contig154G | 7210207_f2_298 | 4112 | 8238 | 573 | 190 | | | NO-HIT |
| Contig154G | 7225057_c2_1040 | 4113 | 8239 | 1242 | 413 | | | NO-HIT |
| Contig154G | 782067_c2_994 | 4114 | 8240 | 1413 | 470 | 1160 | 8.70E−118 | gp:[Gt:g4103625] [LN:AF026470] [AC:AF026470] [PN:gluconate permease] [GN:gnuT] [OR:*Pseudomonas aeruginosa*] [DE:*Pseudomonas aeruginosa* gluconate repressor (gnuR), gluconate kinase(gnuk), and gluconate permease (gnuT) genes, complete cds.] |
| Contig154G | 785676_c1_696 | 4115 | 8241 | 3030 | 1009 | | | NO-HIT |
| Contig154G | 79503_c1_844 | 4116 | 8242 | 1401 | 466 | 690 | 5.60E−68 | sp:[LN:YGCA_HAEIN] [AC:P44643] [GN:H10333] [OR:*HAEMOPHILUS INFLUENZAE*] [EC:2.1.1.—] [DE:HYPOTHETICAL RNA METHYLTRANSFERASE H10333,] [SP:P44643] |
| Contig154G | 838925_f1_81 | 4117 | 8243 | 537 | 178 | | | NO-HIT |
| Contig154G | 865887_c3_1165 | 4118 | 8244 | 1914 | 637 | 1866 | 1.30E−192 | sp:[LN:EDD_PSEAE] [AC:P31961] [GN:EDD] [OR:*PSEUDOMONAS AERUGINOSA*] [EC:4.2.1.12] [DE:DEHYDRATASE)] [SP:P31961] |
| Contig154G | 865925_f2_342 | 4119 | 8245 | 198 | 65 | | | NO-HIT |
| Contig154G | 89207_c2_900 | 4120 | 8246 | 414 | 137 | 223 | 1.70E−18 | sp:[LN:RBFA_ECOLI] [AC:P09170] [GN:RBFA:P15B] [OR:*ESCHERICHIA COLI*] [DE:RIBOSOME-BINDING FACTOR A (P15B PROTEIN)] [SP:P09170] |
| Contig154G | 906937_f2_368 | 4121 | 8247 | 825 | 274 | 740 | 2.80E−73 | gp:[GI:g3237313] [LN:PAU93274] [AC:U93274] [PN:HisT] [GN:hisT] [OR:*Pseudomonas aeruginosa*] [DE:*Pseudomonas aeruginosa* YafE (yaFE), LeuB (leuB), Asd (asd), FimV(fimV), and HisT (hisT) genes, complete cds; TrpF (trpF) gene,partial cds; and unknown gene.] |
| Contig154G | 914077_c2_922 | 4122 | 8248 | 345 | 114 | 84 | 0.00092 | pir:[LN:573994] [AC:S73994] [PN:hypothetical protein VXpSPT7_orf112] [OR:*Mycoptasma pneumoniae*] [SR:ATCC 29342, ATCC 29342] [SR:ATCC 29342, ] |

TABLE 2-continued

| Query | Orf | NT ID | AA ID | NT Lgth | AA Lgth | Score | P-value | Subject |
|---|---|---|---|---|---|---|---|---|
| Contig154G | 9765888_f1_137 | 4123 | 8249 | 708 | 235 | 202 | 2.90E−16 | sp:[LN:YEAS_ECOLI] [AC:P76249:O07971:O07969] [GN:YEAS] [OR:*ESCHERICHIA COLI*] [DE:HYPOTHETICAL 23.2 KD PROTEIN IN GAPA-RND INTERGENIC REGION] [SP:P76249:O07971:O07969] |
| Contig154G | 978377_c1_832 | 4124 | 8250 | 477 | 158 | 403 | 1.40E−37 | gp:[GI:g3095052] [LN:AF010234] [AC:AF010234] [PN:ArsC] [GN:arsC] [OR:*Pseudomonas aeruginosa*] [DE:*Pseudomonas aeruginosa* ars operon, regulator (arsR), membrane pump(arsB) and arsenate reductase (arsC) genes, complete cds.] [NT:arsenate reductase] |
| Contig154G | 985681_c3_1147 | 4125 | 8251 | 720 | 239 | 228 | 4.70E−22 | pir:[LN:S29308] [AC:529308:S28380] [PN:hypothetical protein 3 (phaC2 3' region)] [OR:*Pseudomonas aeruginosa*] |
| Contig154G | 9860387_c2_1048 | 4126 | 8252 | 1965 | 654 | 2239 | 4.00E−232 | sp:[LN:SYT_HAEIN] [AC:P43014] [GN:THRS:H11367] [OR:*HAEMOPHILUS INFLUENZAE*] [EC:6.1.1.3] [DE:(THRRS)] [SP:P43014] |

SEQUENCE LISTING (8252 sequences)

SEQ ID NO: 1 - DNA, 372 bp, Acinetobacter baumannii
gagctcggatctcaggacgaaggtctccgcgaatgtccggtcgatccgcgcgacgtcccaggcgggcgttcccttggcggacatccacgccgcagcgtcgtgcatcagccgcacaacctcgtcgatatcacccgagcaggcgacccgaacgttcggaggctcctcgctgtccattcgctcccctggcgcggtatgaaccgccgcctcatagtgcagtttgatcctgacgagcccagcatgtctgcgcccaccttcgcggaacctgaccagggtccgctagcgggcggccggaaggtgaatgctaggcatgatctaaccctcggtctctggcgtcgcgactgcgaaatttcgcgagggtttccgagaaggtga

SEQ ID NO: 2 - DNA, 702 bp, Acinetobacter baumannii
gcttctgcgtcctcatccgacatcgctctgattgtcaccactccatcagagatcggcaaaactgcgaggaaatttcgatatgccgatccgctaagattatcgctttggtcgtccacttttgcttccggtgttgtttcgatgcttccgaggctgtcgatcgatttccaggggagcgacattgatagggcggctctcgtcatcatgcactatcaggtcgacgtgttcgacatcctcttcggtaaagagccatcgcccttgctggaccggtgtaacgctctgatccgaagctggcgcgccactggccggcccgtgctgttccccaacttttcgctcggcgaagagtatgaacatgcgccgccggcgacgaatcgccaaatctcaccgtatctcccgagcggacgatttcgcaccggtctgcccgtcgaagggcttgcgatcgaacggggcgaccttttctatgcatgtccgcgagccagcgtcttttatggcacggcgctcgacgccgaccttcggacgcgcggcgtaagcacgcttgtcatggccgggataagcaccaccggcgttgttctttcaagcgtcgcctgggctagtgatgcggactacgacgtgcgtttggtccaggactgctgctacgacccggatcgggatgcccacgaagctctgttgcgttccgggttcggcggacgtgtacaggtcgtgtaa

SEQ ID NO: 3 - DNA, 447 bp, Acinetobacter baumannii
catcaaggcccgatccttggagcccttgccctcccgcacgatgatcgtgccgtgatcgaaatccagatccttgacccgcagttgcaaaccctcactgatccgcatgcccgttccatacagaagctgggcgaacaaacgatgctcgccttccagaaaaccgaggatgcgaaccacttcatccggggtcagcaccaccggcaagcgccgcgacggccgaggtcttccgatctcctgaagccagggcagatccgtgcacagcaccttgccgtagaagaacagcaaggccgccaatgcctgacgatgcgtggagaccgaaaccttgcgctcgttcgccagccaggacagaaatgcctcgacttcgctgctgcccaaggttgccgggtgacgcacaccgtggaaacggatgaaggcacgaacccagttgacataagcctgttcggttcgtaa

SEQ ID NO: 4 - DNA, 1032 bp, Acinetobacter baumannii
ggacaggctttcattcggagaaccatcatggaaaacattgcgcttattggtatcgatctgggtaagaactctttccatattcattgtcaggatcatcgtgggaaggccgtttaccgtaaaaaattcacccgaccaaagctaatcgaatttctggcgacatgcccagcaacaaccatcgcgatggaagcctgtggcggttctcactttatggcacgcaagctggcagagttagggcattttccaaagctgatatcaccgcaatttgtccgcccattcgttaaaagcaacaaaaatgacttcgttgatgctgaagctatctgtgaagcagcatcacgtccatctatgcgtttcgtgcagcccagaaccgaatctcagcaggcaatgcgagctctgcatcgtgtccgtgaatccctggttcaggataaggtgaaaacaactaatcagatgcatgcttttctgctggaatttggtatcagcgttccgcgaggtgctgccgttattagtcgactgagtacccttcttgaggacagtagtttgcctctttatctcagccagttactgctgaaattacaacagcattatcactatcttgttgagcagattaaagatctggaatctcagttgaaacgaaagttggacgaagatgaggttggacagcgcttgctgagtattccctgcgttggaacgctgactgccagtactatttcaactgagattggcgacgggaagcagtacgccagcagccgtgactttgcggcggcaacagggctggtaccccgacagtacagcacgggaggtcggacgacattgttagggattagcaagcggggcaacaaaaagatccgaactttgttggttcagtgtgccagggtattcatacaaaaactggaacaccagtctggcaagttggccgactgggtcagggagttgttgtgtcggaaaagcaactttgtcgtcacctgtgctctggcaaacaagctggccagaatagcctgggcactgacggcgcgacagcaaacttacgaagcataa

SEQ ID NO: 5 - DNA, 1299 bp, Acinetobacter baumannii
cactttatcactgataaacataatatgtccaccaacttatcagtgataaagaatccgcgcgttcaatcggaccagcggaggctggtccggaggccagacgtgaaacccaacagacccctgatcgtaattctgagcactgtcgcgctcgacgctgtcggcatcggcctgattatgccggtgctgccgggcctcctgcgcgatctggttcactcgaacgacgtcaccgcccactatggcattctgctggcgctgtatgcgttggtgcaatttgcctgcgcacctgtgctgggcgcgctgtcggatcgtttcgggcggcggccaatcttgctcgtctcgctggccggcgccactgtcgactacgccatcatggcgacagcgcctttcctttgggttctctatatcgggcggatcgtggccggcatcaccggggcgactggggcggtagccggcgcttatattgccgatatcactgatggcgatgagcgcgcgcggctcttcggcttcatgagcgcctgtttcgggttcgggatggtcgcgggacctgtgctcggtgggctgatgggcggtttctccccccacgctccgttcttcgccgcggcagccttgaacggcctcaatttcctgacgggctgtttccttttgccggagtcgcacaaaggcgaacgccggccgttacgccgggaggctctcaacccgctcgcttcgttccggtgggcccggggcatgaccgtcgtcgccgccctgatggcggtcttcttcatcatgcaacttgtcggacaggtgccggccgcgctttgggtcattttcggcgaggatcgctttcactgggacgcgaccacgatcggcatttcgcttgccgcatttggcattctgcattcactcgcccaggcaatgatcaccggccctgtagccgcccggctcggcgaaaggcgggcactcatgctcggaatgattgccgacggcacaggctacatcctgcttgccttcgcgacacggggatggatggcgttcccgatcatggtcctgcttgcttcgggtggcatcggaatgccggcgctgcaagcaatgttgtccaggcaggtggatgaggaacgtcaggggcagctgcaaggctcactggcggcgctcaccagcctgacctcgatcgtcggacccctcctcttcacggcgatctatgcggcttctataacaacgtggaacgggtgggcatggattgcaggcgctgccctctacttgctctgcctgccggcgctgcgtcgcgggctttggagcggcgcagggcaacgagccgatcgctga

SEQ ID NO: 6 - DNA, 210 bp, Acinetobacter baumannii
ctcgtagtaacgccggtcgatgccgtcgtcggtcagaaccagctttgcccagcgcggcttgatgaatgcggttggcgcatcggcgggcaccttgcgcgcgctgtcgctgttcatgccgcgcagcatgtcgatggcatcgagcacacccttggcggcgggcgcagcccgcaatttgagcacgcccaggaactgcggcgcgtagcggcgtag

SEQ ID NO: 7 - DNA, 279 bp, Acinetobacter baumannii
caacgtggaacgggtgggcatggattgcaggcgctgccctctacttgctctgcctgccggcgctgcgtcgcgggctttggagcggcgcagggcaacgagccgatcgctgatcgtggaaacgataggcctatgccatgcgggtcaaggcgacttccggcaagctatacgcgccctaggagtgcggttggaacgttggcccagccagatactcccgatcacgagcaggacgccgatgatttgaagcgcactcagcgtctgatccaagaacaaccatcctag

SEQ ID NO: 8 - DNA, 663 bp, Acinetobacter baumannii
tgcatgatgacgagagccgccctatcaatgtcgctcccctggaaatcgatcgacagcctcggaagcatcgaaacaacaccggaagcaaaagtggacgaccaaagcgataatcttagcggatcggcatatcgaaatttcctcgcagttttgccgatctctgatggagtggtgacaatcagagcgatgtcggatgaggacgcagaagcctacgccgccggaacgggcgatgctctggtcaggcgcttcgctcacctgccgttggagaaatattcgccgcagattgttcgtgagctcatccacagcgtgattggagctggattgcgcgatggaactttggctgtcctgacgatcgccgattcaagctcggattcgttccttggaagcctagtgttctttgacatcaatcaggatgatgccgagattggctattgggtcgctcctgagcatcgcggccgaaaagtatcgggccgggcgctcgcgctggctttgcaaatttctcgcatcctgggtctgaaaaggcttcgtgctcgaacggttcaggacaatcctgcttccgagagggttcttctaaatgcaggatttaaacaggagggcgaagcgcggccggagattgttccctccggcaaaaccgaaatgagcgtgagctatctcattgaagtgtga

SEQ ID NO: 9 - DNA, 192 bp, Acinetobacter baumannii
aagaacaacgccggtggtgcttatcccggccatgacaagcgtgcttacgccgcgcgtccgaaggtcggcgtcgagcgccgtgccataaaagacgctggctcgcggacatgcatagaaaaggtcgccccgttcgatcgcaagcccttcgacgggcagaccggtgcgaaatcgtccgctcgggagatacggtga

SEQ ID NO: 10 - DNA, 375 bp, Acinetobacter baumannii
ggcttggacgctagggcagggcatgaaaaagcccgtagcgggctgctacgggcgtctgacgcggtggaaagggggaggggatgttgtctacatggctctgctgtagtgagtgggttgcgctccggcagcggtcctgatcaatcgtcaccctttctcggtccttcaacgttcctgacaacgagcctccttttcgccaatccatcgacaatcaccgcgagtccctgctcgaacgctgcgtccggaccggcttcgtcgaaggcgtctatcgcggcccgcaacagcggcgagagcggagcctgttcaacggtgccgccgcgctcgccggcatcgctgtcgccggcctgctcctcaagcacggccccaacagtgaagtag

SEQ ID NO: 11 - DNA, 216 bp, Acinetobacter baumannii
acgtcagaagccgactgcactatagcagcggaggggttggatccatcaggcaacgacgggctgctgccggccatcagcggacgcagggaggactttccgcaaccggccgttcgatgcggcaccgatggccttcgcgcaggggtagtgaatccgccaggattgacttgcgctgccctacctctcactagtgaggggcggcagcgcatcaagcggtga

SEQ ID NO: 12 - DNA, 615 bp, Acinetobacter baumannii
tgttatggagcagcaacgatgttacgcagcagcaacgatgttacgcagcagggcagtcgccctaaaacaaagttaggccgcatggacacaacgcaggtcacattgatacaccaaattctagctgcggcagatgagcgaaatctgccgctctggatcggtgggggctgggcgatcgatgcacggctagggcgtgtaacacgcaagcacgatgatattgatctgacgtttcccggcgagaggcgcggcgagctcgaggcaatggttgaaatgctcggcgggcgcgtcacggaggagttggactatggattcttagcggagatcggggatgagttacttgactgcgaacctgcttggtgggcagacgaagcgtatgaaatcgcggaagctccgcagggctcgtgcccagaggcggctgagggcgtcatcgctgggcggccagtccgttgtaacagctgggaggcgatcatctgggattacttttactatgccgatgaagtaccaccagtggactggcctacaaagcacatagagtcctacaggctcgcatgcacctcactcggggcggaaaaggttgaggtcttgcgtgccgctttcaggtcgcgatatgcggcctaa

SEQ ID NO: 13 - DNA, 183 bp, Acinetobacter baumannii
cttggactggccctgcctcgcaccaatccacctgcggctatggccgcgatcatgcgaggcccgaaaattacacgacctgtacacgtccgccgaacccggaacgcaacagagcttcgtgggcatcccgatccgggtcgtagcagcagtcctggaccaaacgcacgtcgtagtccgcatcactag

SEQ ID NO: 14 - DNA, 942 bp, Acinetobacter baumannii
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgcctttcggtcgaccatacgacgatctatcgctgggtccagtgctacgccccggagatggagaagcggctgcgctggttctggcggcgtggctttgatccgagctggcgcctggatgaaacctacgtcaaggtgcggggcaagtggacctacctgtaccgggcagtcgacaagcggggcgacacgatcgatttctacctgtcgccgacccgcagcgccaaggcagcgaagcggttcctgggcaaggccctgcgaggcctga

SEQ ID NO: 15 - DNA, 273 bp, Acinetobacter baumannii
aacctacgtcaaggtgcggggcaagtggacctacctgtaccgggcagtcgacaagcggggcgacacgatcgatttctacctgtcgccgacccgcagcgccaaggcagcgaagcggttcctgggcaaggccctgcgaggcctgaagcactgggaaaagcctgccacgctcaataccgacaaagcgccgagctatggtgcagcgatcaccgaattgaagcgcgaaggaaagctggaccgggagacggcccaccggcaggtgaagtatctcaataa

SEQ ID NO: 16 - DNA, 693 bp, Acinetobacter baumannii
gttggtggacatattatgtttatcagtgataaagtgtcaagcatgacaaagttgcagccgaatacagtgatccgtgccgccctggacctgttgaacgaggtcggcgtagacggtctgacgacacgcaaactggcggaacggttgggggttcagcagccggcgctttactggcacttcaggaacaagcgggcgctgctcgacgcactggccgaagccatgctggcggagaatcatacgcattcggtgccgagagccgacgacgactggcgctcatttctgatcgggaatgcccgcagcttcaggcaggcgctgctcgcctaccgcgatggcgcgcgcatccatgccggcacgcgaccgggcgcaccgcagatggaaacggccgacgcgcagcttcgcttcctctgcgaggcgggtttttcggccggggacgccgtcaatgcgctgatgacaatcagctacttcactgttggggccgtgcttgaggagcaggccggcgacagcgatgccggcgagcgcggcggcaccgttgaacaggctccgctctcgccgctgttgcgggccgcgatagacgccttcgacgaagccggtccggacgcagcgttcgagcagggactcgcggtgattgtcgatggattggcgaaaaggaggctcgttgtcaggaacgttgaaggaccgagaaagggtgacgattga

SEQ ID NO: 17 - DNA, 264 bp, Acinetobacter baumannii
caagcggggcaacaaaaagatccgaactttgttggttcagtgtgccagggtattcatacaaaaactggaacaccagtctggcaagttggccgactgggtcagggagttgttgtgtcggaaaagcaactttgtcgtcacctgtgctctggcaaacaagctggccagaatagcctgggcactgacggcgcgacagcaaacttacgaagcataaaggcagaaatacaccagtttaaacaatcattcatctggttttgcgaatactga

SEQ ID NO: 18 - DNA, 1020 bp, Acinetobacter baumannii
caagccatgaaaaccgccactgcgccgttaccaccgctgcgttcggtcaaggttctggaccagttgcgtgagcgcatacgctacttgcattacagtttacgaaccgaacaggcttatgtcaactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcagctgtcgcgtgcacgggcatggtggctgaaggaccaggccgagggccgcagcggcgttgcgcttcccgacgcccttgagcggaagtatccgcgcgccgggcattcctggccgtggttctgggtttttgcgcagcacacgcattcgaccgatccacggagcggtgtcgtgcgtcgccatcacatgtatgaccagacctttcagcgcgccttcaaacgtgccgtagaacaagcaggcatcacgaagcccgccacaccgcacaccctccgccactcgttcgcgacggccttgctccgcagcggttacgacattcgaaccgtgcaggatctgctcggccattccgacgtctctacgacgatgatttacacgcatgtgctgaaagttggcggtgccggagtgcgctcaccgcttgatgcgctgccgcccctcactagtgagaggtag

SEQ ID NO: 19 - DNA, 207 bp, Acinetobacter baumannii
cacttttgcctttggaggcatcttgcaaggtcaacgcatcggctatgtccgcgtcagcagcttcgaccagaacccggaacggcaattggagggtgttcaggtggcgcgggtgttcaccgacaaggcttctggcaaggacacccagcgtcccgagctggaaaggctgctggccttcgtccgcgagggcgacaccgtggtggtgcatag

SEQ ID NO: 20 - DNA, 903 bp, Acinetobacter baumannii
cggaggtcttgtaatcgcatgtcattacgcacgcccgatttattgttcacagcgatagcacctgccatttggggcagcacctacattgtcaccacccaatacctgccgaacttctcaccgatgacggtcgcgatgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccggggaccgccgtgttgctaggatggttgttcttggatcagacgctgagtgcgcttcaaatcatcggcgtcctgctcgtgatcgggagtatctggctgggccaacgttccaaccgcactcctagggcgcgtatagcttgccggaagtcgccttga

SEQ ID NO: 21 - DNA, 318 bp, Acinetobacter baumannii
cccgcctggtgccttggtgtccagataatccaccttatcggcaatgaagtcggtcccgtagaccgtctggccgtccttctcgtacttggtattccgaatcttgccctgcacgaataccagcgaccccttgcccaaatacttgccgtgggcctcggcctgagagccaaaacacttgatgcggaagaagtcggtgcgctcctgcttgtcgccggcatcgttgcgccactcttcattaaccgctatatcgaaaattgcttgcggcttgttagaattgccatgacgggctctgttgcaaagattggcggcagtcagaggtag

SEQ ID NO: 22 - DNA, 216 bp, Acinetobacter baumannii
ctttgcaacagtgccgaccgaaatgccgcgttccgccagcatttcctcaaggtcgcgatagctgatcggatagcgacaataccagcgcaccgcccacaggatcacatcaccctggaaatggcgccacttgaaatccgtcatcgttccgtccgtccaatctccgccaagcatgctcaagcttcacgatttttgcaacagagcccacacgagtattga

SEQ ID NO: 23 - DNA, 762 bp, Acinetobacter baumannii
tgcgtggggctttgtaggtatggggctcataattgctgcctttttgctcgcccgatccccatcgtggaagtcgctgcggaggccgacgccatggtgacggtgttcggcattctgaatctcaccgaggactccttcttcgatgagagccggcggctagaccccgccggcgctgtcaccgcggcgatcgaaatgctgcgagtcggatcagacgtcgtggatgtcggaccggccgccagccatccggacgcgaggcctgtatcgccggccgatgagatcagacgtattgcgccgctcttagacgccctgtccgatcagatgcaccgtgtttcaatcgacagcttccaaccggaaacccagcgctatgcgctcaagcgcggcgtgggctacctgaacgatatccaaggatttcctgaccctgcgctctatcccgatattgctgaggcggactgcaggctggtggttatgcactcagcgcagcgggatggcatcgccacccgcaccggtcaccttcgacccgaagacgcgctcgacgagattgtgcggttcttcgaggcgcgggtttccgccttgcgacggagcggggtcgctgccgaccggctcatcctcgatccggggatgggatttttcttgagccccgcaccggaaacatcgctgcacgtgctgtcgaaccttcaaaagctgaagtcggcgttggggcttccgctattggtctcggtgtcgcggaaatccttcttgggcgccaccgttggccttcctgtaaag

SEQ ID NO: 24 - DNA, 351 bp, Acinetobacter baumannii
tcggcgcagagcgacagcctacctctgactgccgccaatctttgcaacagagcccgtcatggcaattctaacaagccgcaagcaattttcgatatagcggttaatgaagagtggcgcaacgatgccggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcgggtcaaatcaggaataa

SEQ ID NO: 25 - DNA, 543 bp, Acinetobacter baumannii
caaagaatcggtcagcgccgcgtaaatgcgtcggttggcacgggtgatggcctcggcgcttgcgcgctcgatggcattcatggcgggcaggataatgctctgccgccgcagattctcgacaagtgcgctcgccagcacgatgcctttgtcggtctgcaaggccagctcggtcaatgtatgcacggcttgccgatagtggctcatggtgaagggcttgaacccaaaaaccgtttgcagctcgaccaagtgctcccgccgtgtctgttcgcgctggccgtactcgctccaactttccactggcatcttgagttgcgcggccaccatgcgcaacaggggcggaaacggaggctcatcgacgcccaaaaaggtgccagggaatcgcaagtagcaaagctgcacagcgaagcccaatcgattcgcggcgccgcgacgctgacggatcaccgacaggtcggtttcgttgaacgtgtagtgccgtatcagttcgtctttggcatctggcagtgccagcaggctttcgcgctcggtggcggacaggattga

SEQ ID NO: 26 - DNA, 435 bp, Acinetobacter baumannii
gcgcactccggcaccgccaactttcagcacatgcgtgtaaatcatcgtcgtagagacgtcggaatggccgagcagatcctgcacggttcgaatgtcgtaaccgctgcggagcaaggccgtcgcgaacgagtggcggagggtgtgcggtgtggcgggcttcgtgatgcctgcttgttctacggcacgtttgaaggcgcgctgaaaggtctggtcatacatgtgatggcgacgcacgacaccgctccgtggatcggtcgaatgcgtgtgctgcgcaaaaacccagaaccacggccaggaatgcccggcgcgcggatacttccgctcaagggcgtcgggaagcgcaacgccgctgcggccctcggcctggtccttcagccaccatgcccgtgcacgcgacagctgctcgcgcaggctgggtgccaagctctcgggtaa

SEQ ID NO: 27 - DNA, 552 bp, Acinetobacter baumannii
gtaatcgccggtcaggttgatgtgctcccaccccagcggcgacagatattgcaacaatgtgtcgtccagcgccgtgccgttgccacgcaaagcactggtggcacgctccagatataccgtgttccacaacacgatggccgccgtcaccagattgaggccgctggcccggtagcgctgctgctcaaaactgcggtcgcggatttcacccaatcggtagaagaagaccgccctggccagcgcgttgcgcgcctcgcccttattcagccccgcatggacgcggcggcgcagctccacgctttgcagccaatccaaaatgaacagcgtgcgctcgatgcgccccagctcgcgcaacgccacggccaagccgttctggcgcgggtagctgccgagtttgcgcagcatcagcgaagccgttaccgtgccttgcttgatggaggtggccagccgcagaatttcatcccaatgggcgcgtatttgcttgatgttcagcctgtcgctgctaatcatcggcttgagcgcgtcataggcggcatcgcccttggggatgaatag

SEQ ID NO: 28 - DNA, 330 bp, Acinetobacter baumannii
cgtgatcgaggccgatcacggaaagctcaagatactgatcaagccggtgcgcggtttcaaatcgatccccacggcctatgccacgatcaagggattcgaagtcatgcgagccctgcgcaaaggacaggctcgcccctggtgcctgcagcccggcatcaggggcgaggtgcgccttgtggagagagcttttggcattgggccctcggcgctgacggaggccatgggcatgctcaaccaccatttcgcagcagccgcctgatcggcgcagagcgacagcctacctctgactgccgccaatctttgcaacagagcccgtcatggcaattctaa

SEQ ID NO: 29 - DNA, 219 bp, Acinetobacter baumannii
tcgcatgtcattacgcacgcccgatttattgttcacagcgatagcacctgccatttggggcagcacctacattgtcaccacccaatacctgccgaacttctcaccgatgacggtcgcgatgctgcgggcgttgccggcgggtttattgctcgtgatgatcgtccgacagattccaacgggaatctggtggatgcgcatcttcatcctcggcgcacttaa

SEQ ID NO: 30 - DNA, 327 bp, Acinetobacter baumannii
agcttgagcatgcttggcggagattggacggacggaacgatgacggatttcaagtggcgccatttccagggtgatgtgatcctgtgggcggtgcgctggtattgtcgctatccgatcagctatcgcgaccttgaggaaatgctggcggaacgcggcatttcggtcggcactgttgcaaagttagcgatgaggcagccttttgtcttattcaaaggccttacgtttcaaaaactctgcttaccaggcgcatttcgcccaggggatcaccataataaaatgctgaggcctggcctttgcgtagtgcacgcatcacctcaatacctttga

SEQ ID NO: 31 - DNA, 387 bp, Acinetobacter baumannii
gcgtgcataataagccctacacaaattgggagatatatcatgaaaggctggctttttcttgttatcgcaatagttggcgaagtaatcgcaacatccgcattaaaatctagcgagggctttactaagcttgccccttccgccgttgtcataatcggttatggcatcgcattttattttctttctctggttctgaaatccatccctgtcggtgttgcttatgcagtctggtcgggactcggcgtcgtcataattacagccattgcctggttgcttcatgggcaaaagcttgatgcgtggggctttgtaggtatggggctcataattgctgcctttttgctcgcccgatccccatcgtggaagtcgctgcggaggccgacgccatggtga

SEQ ID NO: 32 - DNA, 246 bp, Acinetobacter baumannii
cccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttga

SEQ ID NO: 33 - DNA, 531 bp, Acinetobacter baumannii
cgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatga

SEQ ID NO: 34 - DNA, 390 bp, Acinetobacter baumannii
cgtggtgccgtcaccccagttgccggcgaagggttgccgaaactgcgcattcaccagctcggccagcgccgtcgaataggtttcatcgcggatgtgccaggcttgcagccaagacagcttggcgtaggtggtgccagggcaggactcggccattttggtcagacccaggttgatcgcgtcggccaggatcgtcgtcaacagcaaggttttgtccttggccgtgtcgctggtcttcaggtgtgtgaagtggcgggtgaagcccgtccattcatcgacctccatcagcaactcggtgattttgaggtgcggcagcagcatagctgtctggtcgatcatggcttgcgcggcgtctggtactgccgcgtccagcggcgtgatcttcaggcctga

SEQ ID NO: 35 - DNA, 234 bp, Acinetobacter baumannii
gccacgcaggttcgggtggcagtcgagccgcagcttggcgcacccctgcgttcgcgcggcatggcggcaagcctcgatcagcgcggagctgacaccccggcccgcatgtgtccgtcgcaccgcgagcttgtgcagatatgcggcctcccccttgagggcgtcgggccagaactcgggatcctcggccgacaaggtgcaacagccgacgatgccgtcgctgcaactcgcgactag

SEQ ID NO: 36 - DNA, 684 bp, Acinetobacter baumannii
cctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcggtgatagactatggccgcgagcatgtggagcagatcatgctgacggttgcggaagggaacgaagccgctataaacctctacgaaaagcatggcttcaagacttacggcgtcgaaccgcgcgctatgaagaacggctccgagtatcgcgacgaaattctgatggcattaatcctgcgctga

SEQ ID NO: 37 - DNA, 618 bp, Acinetobacter baumannii
ttgacatattccgtcaaaggtaatagatttcatcctgacacttttgcctttggaggcatcttgcaaggtcaacgcatcggctatgtccgcgtcagcagcttcgaccagaacccggaacggcaattggagggtgttcaggtggcgcgggtgttcaccgacaaggcttctggcaaggacacccagcgtcccgagctggaaaggctgctggccttcgtccgcgagggcgacaccgtggtggtgcatagcatggacaggctggcacgcaaccttgatgacctgcgccgcatcgtccaagggctgacacaacggggcgtgcgcatggagttcgtcaaagaagggctgaagttcaccggcgaggactcaccgatggccaatctgatgctgtcggtcatgggagccttcgctgagttcgagcgcgccctgatccgcgaacgtcagcgcgagggaatcgtgctggccaagcagcgcggtgcctaccggggacgaaagaaatcgctgaacagcgaacaaattgccgagttgaaacggcgagttgcggcaggcgaccaaaaaaccttggtggcccgtgacttcggcatcagccgcgaaaccttgtaccagtacctgcgggaagactga

SEQ ID NO: 38 - DNA, 339 bp, Acinetobacter baumannii
tcatgcaaatcaatgctgaacaatcagcgcagcttagcgaggtgctcgcaatgtttgatgatgttgagccaccacaaaaagctaagtctttggatgggtgatgttatgaattttaatattgagcagatcaaacctgacaccaaatatctattagttaaatacgactcaacaagatttgtctcatcacaccagcaggaatctttccataaagcattgcgcacattagcagataaaactggtttaaatgtggcagcaatagataagtcgatagccattgagcagctaagtgatgaagatttagcgaatgttggcttaatgaggattaataacaatgcctag

SEQ ID NO: 39 - DNA, 474 bp, Acinetobacter baumannii
aagagcagatctatggagtttgttgtagaaccttggcactggtttgtattgggtatcttacttattctttctgagctgattctccctgcctttgccgctctctggtttggtattgcagccataatggtttgctttctctattggttatttccagatatcagccttactactcaaatagtgctgtggattgtgttatcggtgctatgtacccttctctggtttaaatttattaagcctttatctattgataaaactaaagcaggtttacctcgagaagcgacgattgggcaaattggtatggtgattcagaccggacttgctcatgaccaaattattgttcgtttccctatgcctattttaggggccgatgaatggaactgtcgaagcaccacccctgttaaagtcggtgatcgggttcgagtcattgatatttcgggtaatgacttaattgttcagccccacagcacttcataa

SEQ ID NO: 40 - DNA, 189 bp, Acinetobacter baumannii
aaattccggtccaaaagaatcagcatttactttttggtttacagaacctttaccttaacttcatgttgtaacgaatcctacacaactctcttatcttatagaatgattaaatcattatttcattattcttttttagactttaggctaatatccaatctaaatgaatatttttttgccagtcttatttga

SEQ ID NO: 41 - DNA, 2856 bp, Acinetobacter baumannii
gaaatgggtccacaaatgcaagaagttgctgacgcattgcgtcttgacactgaactttccgctgatagtgcagcgtatattgaagaactttacgagcagtacctgacttccccaacctccgtcgctgaggactggcgccaatatttcgataaatatccaaagggtgaccaaccacacagcgctgtgcgtgagcaattcctattactaggacgtaatgctaatcgtgttcaacctgttgtacaaagtactgtaagtactgaacatgagcgtcgtcaaattggcgttttacaactcattgctgcttatcgcaatcgcggacatcaaaaagctaagttagatccgttaggtcttgctaagcgtgaagatattcctgatttagatctttcagcacacggtttaaccaaatcagatttagacacagtattcaacacaggcaatcttgagatcggtaaaagcgaagcaacgcttgctgagatgattgaagcaatggaagcaatctattgtggttcgatcggtgttgaatatatgcatatcgtggacacaaaagagaaacgttggattcaacaacgtcttgaaagtgcccgcggtaaattcaatttctcaaatgaacaaaagaaaggcttcttagagcgtttaaccgctgctgaaggcttagaaaaatatctcggtaataaatacgtcggcgctaaacgttttggtgttgagggcggcgaatcttttattcctatggtaaatgagattatccagcgtgctggtgccgtaggttgtaaagaagttgttatcggtatgccacaccgtggtcgtttgaaccttcttgttaatattatgggtaaaaaccctgcggacttatttggtgagttcgaaggtaaagcacttcataagaaaggttctggtgacgttaaataccaccaaggtttctcaagtaatgtaatgactccaggtggtgaagttcacttggcattggcatttaacccatctcacttagaaatcgttggtcctgtagtcgaaggttctgtacgtgcgcgtcaagtacgtcgtagagacatcggcggtgatgacgtattaccagttattgttcatggtgatgctgcatttgcaggtcagggcgtgaacatggaaaccttccagatgtcacaaactcgtggctatacggttggtggtacagttcatattattgtgaacaaccaagttggtttcacaacttctgatccacgtgatgcgcgttcgacagaatactgtacagacgttgctaaaatgattcaggctcctatcttccatgtaaatggtgatgatcctgaagctgttatctttgctactcaattagcacatgatttccgtcacgaattccgtaaagatgtagtcatcgatttgttctgttaccgtcgtcgcggccataacgaagcagatgagccatctggtacacaaccattgatgtatcaagtgattgctaagaaagcaactactcgtacactttatgctgatcaattggtacaagagaaagtacttgaccgtgctgaagctgaccaaatggttgaagattatcgtgctgatttagaagcaggtaatcatgtagcgaatgctttgattcttgaaccgaacactaaaatgtttgtagattggactccatatttgggccatgaatatacagacgattgggatacttcatttgacataaaccgccttaaagaattaggcgagggcatgagcaagcttcctgaagggtttgtaatgcagcgtcaggttcaaaaagtaattgaagaccgcgtgaaaatgcaaactggtgaaactccattgaactggggtgcagcagaaactttagcttatgcaactttattagatgaagactatctagttcgtattactggtgaagacgtgggtcgtggtaccttctcacaccgccatgcgaaattgcataaccaagttgatggttcaacttacattcctctttgccatgtgaaagagaaccaaccacgttttgcgatttatgactctcttttatcagaagaagcagttcttgcattcgaatatggttacgcaactacaattcctaagagcttaattatttgggaagcacaatttggtgacttcgtaaactgtgctcaggttgtgattgaccagtttattgcttctggtgagactaagtgggagcgtgtttgtggtttaacaatgttgttaccgcacggtttcgaaggtcaaggtccagagcactcttcagctcgtttagaacgtttcttacagttatgtgctgaagacaacatgcaagtgattactccaacgacacctgcacagattttccatgcattacgtcgtcaggctgtacgcccaattcgtaagccattaatcgtaatgtcaccgaaatctttacttcgtcataaacttgcgacttctactttagaagagctagcacatggttcattccaaactgtaattgacgaaatcgatcaaattaacaagtcagatgtaactcgtcttgtactttgtggcggtaaagtttattacgacttactcgaaaaacgtcgtgaacaaaacttaactaatgttgcaattgtacgtattgaacagttgtatccatacccagagcaacgtcttgcggaaatcttggctgcttatccaaatgtgaaagaactcgtttgggcgcaagaagagccgaagaaccaaggtgcttggttgtttatcgcaccgcgtttatatgacgatatcttaaaatctggcaaacaaatccgtatcagttttgcaggtcgtgaagcttctgctgcaccagcttgtggctcaccgtacttgcatgcaaaacaacaagctcagctaattaatgatgcattggcaatcgaagctgaacaatcaggagattctcaataa

SEQ ID NO: 42 - DNA, 1254 bp, Acinetobacter baumannii
gtatatatgttccgacagcaaaatctttatcttttgctcttttccttatattgggcacaaggtttgcctgtaggttttatgacgcatgccttacctgtcatattaagagctgaaggtgtgtctcttgcccatattggtggttttgggctgctcatgttgccttggtcaatcaaaatattttgggcgccgtgggtagatcgacatgccatctcgcatttaggtcactatcgtagctggattttacctgctcagtttttgacggtgggtgtactttgtattttatcttttttccctatacaagttttagatcagcctctttatctctttatattttttattacgctgttatttatgaacttaacaggcgcaactcaagatattgcgaccgatgctttagcggtcaatttattgcaacacgatcagcaacattggggaaatacttttcaagttgtaggttcacgacttggttttattgtaggcgggggagccgtgttatggtgcctagactggttgtcatggcaaccaacttttctattattagccgctttagtctttattaataccttacctattttactatttaaagagccatctcatacttctcattcacctcatcaatatagccaaccaagtctagttacaaagattaaagcttacttggggtacttctcgcaaaataaggaacttcgttcttggttaatcgtccttataacttttaaggttgcagatggtttagccgggccattacttaaacctttaatggtggatatgggtttaagttttactcaaattggtatttacatcaccatgcttggggctgttgctgctttattgggggcgcttattgctgggtggatgttaaaacatatttctaggtccacagcattaatgactttttcgatattaaaaattatgagtttagggggctatgcgtatttagcttatgcttatgaacaaaaggtaaagataaatgtatggcttatctatgctgtaaatgccctggaagatgcctttgctgccatgctactggttgtgatgttaactttggttatgcattacagtcgaaaaaactatgcgggtaccgattttacttttcaggtttcagtcatggcgacagtcagtggtggtctttacagctttagtggagtcattgcagatgcgcttggttatttccattatttgatagctattgtcagtattgcggtactctttttaattcctatttacctatggaaagttgccaaaactgtataa

SEQ ID NO: 43 - DNA, 357 bp, Acinetobacter baumannii
aaaacaatgttattaagtaatttagaaagtgttccaggccaccaaattttaaagcagctggatgtcgtttacggaagcactgtccgtagtaagcatgtgggtcgcgacttgatggcaagtttaaagaatattgtaggtggtgaacttactggttataccgaattattagaagaatctcgccaagaggctatgcaacgtatgattgtaaaagcccagcaacttggtgccaatgcaattgtgggtattcgtttttctacctcaaatattgcccaaggtgcttctgagttattcgtatatggcacagcagtggttgtgcagcctcaagcacctcatctgcccgatccatttaatgcatag

SEQ ID NO: 44 - DNA, 462 bp, Acinetobacter baumannii
tggaaaaacccgcatagaaggttcaccatggatcaagactaccatcgtattttagaggtcattacgcgttttcaattggtttttgaccagaaaaattgggatgcgtttgatgagttgttagccgatcaacttgaggtggactatttgcagtttagaggggagcctttatgtgtggtgtcttgtcatgaatataaaggttcacggcaacaagctttgtcacatttgcggctacagcacaatttaagcaatcctcttattcggattgaacaagatcaagcatggttagaatgtaattatcaaatttatcgtttttcggaaaatgattattttcattcttttggtcgctattattttactttggcaaaacaacagggcatatggaaaattaccggaatttgccaacacttaactaaaaatattggcaatccgcgtatacatttttctgctatggggcagtgttaa

SEQ ID NO: 45 - DNA, 249 bp, Acinetobacter baumannii
cggctagacccattcacattttttcattatgaggtagttttagtgtcttctacagattttgaactagatgataactacggcgatgatgatgatgtcggttttgatgagtcatcaggcaaaatcagtgcaaaagaatcgttggaaaaacgtagattaattgatgatctattggcacagcgccgtttagagcgtgagttaaaagatttcgattatgatttagacgatgatgatcttgatgacgaagactaa

SEQ ID NO: 46 - DNA, 834 bp, Acinetobacter baumannii
acttacgctttgtatagtggtaggagtgagtttacggggattaacatgcaactttacgataaaaaaattattttcattcttccaatgttagctgccatggttgcggtgagtggttgtcagccaaaatctacggctaaagatgaacaaccggcttctagtgcttcagtaaaagagcaaaagcaagctgaagtccctgtcattcaagcaaaagttgttccggtaaaactgccaaaacctaaagtttgtcttgaagacggctgcactgaatatgattttcagactgtacaaaccaatcaaaaatggattaatgattattttacgaaccgtataaagaaagcagacccgaatgcttttgcaaatttggctgataaacctgttgaggtaccggaaggggaaccgagctcaagtcagagtgcaatctatgtccgttatttagggcaaaattataaccttgcaacttttgcattccagacatattcatactctgcgggggcagcacatggtatgtcacatcaagagtttgtaaattttgacttgttaaataaaaaacacattaccgttgaagaacttattaagccagatgttgaaaaacagttggttgatgcactttttgatgcaaatactaattggcttcaagagcacaatattagccgcgaaaaactgcaattaagtgataatttctactatggtgcaaatgggattgtttttgtctatccaatttatgaattagcttcttatgcagaaggtatgtctgaattaaccttgccatattttgaagcagctaaatatattaaacctgagtatttaccgagtgtaccgaactataacttataa

SEQ ID NO: 47 - DNA, 582 bp, Acinetobacter baumannii
tgcctcaagccatcaataaatgcgtggaatacaaactcaggtaaaaaactaaatttttcacttagcacccaatcgggtgctttttttatgcctaaaggagcgctcttaatggctaacgttaaaacacaaggtacacagttatttactgtgattgacggacaagtggttcgctttgtctgcattaaaaaaattggctttggtcaagattcgtttagtaaattggacgttacttgtcttgaggctgaaagtagagagtatgagcgcggcatgcgtgatccgggtgagggtgcattcggtatcgattacaatgacacaaataccagtcacgacaagttagctgaaatcgcagactctggtgaaaagttagattggtatgtgggttctggtgactcaaaaaccccgcctacttatgatgcaactactggcatcgacctcccagatgaccgtacttggttgacatttaaagggtatttaaatgacgctgctcctaatgacattgaagttgatgcggtctgggggtatgaatacacccttgtgcggacttcaaaagtaactcgaactaaacgcgcggtgacaccataa

SEQ ID NO: 48 - DNA, 933 bp, Acinetobacter baumannii
ttaatcaggccatctacaaagaagagggaaattatgcgttggagagatcgtcgagtcagtaccaatgttgaagaccgtagaggcggaggcggtgttagggcaggtggtattagtattattggttgggttgtggcatttgttgcatggaaattttttggcgttgacccccaacaagcatatcaggcaacgcagcaggttactgcttcgcaacaatcaaatgcaactgcacccgaaagtttaacagccgagcaaaaggaagcttctgattttgttggaacagtattagccgatacagaggatacgtggacacctatttttaaacagttaggtaaaacttatacgccaccaacattagtattatttagtggaatagctcaatcaggatgtggcacagctcagtctgcaatgggtcccttttattgcccggcagatcagaaggtttatatagatacagaattcttcaaagatatgcgtgagcagatgggaatatctggcgaacaaaatcagacagaattatcgagacaagatcaggcaggggactttgcccaagcttatgtggttgcccatgaagtaggacatcatgtccaaactttgcttggtatctcatctcaagtacaacaggctcgtgcacaagtcagtcaaagagaaggtaatcagttatctgtacgtcaagaattacaagctgactgtttagcgggtatctgggccaatcataatcaacagcgtactcagtttttagagcagggggacgttgaggaagcaatggatgccgcgcaaaaaattggagatgactacttacaaaaacgagcaacaggacaagtcgttccggatagctttactcatggtagtagtgaacagcgaatgcactggttccaagtcggtttaaaaaccggtgatattaaccaatgcgatacttttaataattctatctaa

SEQ ID NO: 49 - DNA, 1215 bp, Acinetobacter baumannii
ctaagtcttacttcaagcggagcgcataacatggctaaaccatattacgaattcttttgtcctgtaaaagtcattgccggtaatgctgctttagaacatattccgtttgaacttgcgactttaggtgcaaaacgccctcttatcattaccgataaaggcgttcgtgcaaatggcttgttaaaccctattgaagctgcttttagcacaactgatgcagtcattggtcatgtttttgatgatgttccaccagactcaagtcttgaagttgttcgacttgccgcggaagcttatcgcacaaataaatgtgatgcgattattgctgtgggcggtggttctgttatcgatacctctaaagcaactaacattttagtatcagaaggtggagatgatcttcttcaatattctggtgcacacaacctaccaaaaccattaaaaccatttttcgtcatcccgactacatcaggtacgggatctgaagtgaccatggttgctgttgtgtctgatacacaaaagaatgttaaattggcatttgcttcatattacttaatgccacatgctgcgattttagatccacgcatgacattaactttaccacctcacttaactgcaatgacgggtatggatgcgttaacacattgtgttgaagcgtacacctgtatggcagctaacccgcttagtgatgcctatgcaagtgcgggtattaaaaagattagcgaaaatctatttaatgtcttagaaaatccaaatgactcacaaggtcgtttagaacttgcacaagcttctacaatggcaggcattgcattctctaactcgatggtaggccttgtacactcattaggacatgcattaggtgcagttgctcacctgccccacgggctgtgcatgaacttattcttaccttatgtgcttgagtacaataaacaagtcaatggtcagaaaattggcgagttgctattaccacttgcaggtgcggatatttatgcccagactcctgctactcagcgtgcagacagagcaatcgcaactattttagcaatgcgtgatcgtttatttagcttaaccaaattaccacgtaccttacgtgaaacaggtaaagttactgaagcacagcttgatgaagtggcagagaaagcactaaatgatggctcaattatttataatcctaaagaagcaagcttaaaagatctacgagagatcttacaaaaagcttggtaa

SEQ ID NO: 50 - DNA, 1719 bp, Acinetobacter baumannii
atggctgctacataccccaatgttgacgctgccaacagatgggctaaggcagttattgctggaaaaatccctgcatgtaagtgggtaaaattagcctgtcaacgtcacctagatgatttaaaaaaatcaaaaaaacgtgattttccttataaatttgagcctagacttgctgaaaaaaagatactttttgtcgaactattacctcacacaaaaggtgagtgggctttaaaaagactaaaaatttctttagaagattggcaaaaattcggtctggcagtcacattcggatgggtcagaaaaaaagacggttatcgccgctttcgtgaaagctattgggaaatacctcgtaagaatggcaaatcagccattgctgctggtgtggcgctcaatatgttttgcaatgatggtgagttcggatcggaagtgtattctggagccacaactgagaaacaggcgtgggaagtatttaagccagcaagattgatggcgagcagatctccagacttactagaggctacaggtattgttgtaaatgctgctagccttgaggtccctacagatggctccatttttgagccattaattggtgatcctcctgatggtcagtccccacattgtgcaattgttgatgaataccatgagcatattgactcacgtctctatgacaccatgcaaactggtatgggggcacgtaggcagcctctaattttcactatcactactgctggatttaacattgaaggcccatgctatgacttgcgtgagcgagttatacagatgctttctggtgttattgaggatgacgagttattcggctggatttggaccattgatgaggatgacgattggacaaatcccaaagtattgcagaaagctaacccaaattatgatgtttctgtatatggcgattacttggagtctcagcaaaaaaaggcagttcaacatccttctcgtcaaaatacatttaaaacaaagcatctaaatgtatgggtatctgcaagaactgcattttttaatattgagaaatggaaagcttgtgaaaacaaggatcttgatattgagcaatttaaagcggttccatgtttaattagtgccgacttggcttcaaaaatcgacttggctgcagcggtgaatttattttatcgccgtgaaagtgacgggaaaattcattactactgtgtagctcccaaattttatattcccgaagacacaatttttaatggtgaagaaaagcaggttatcaagctttatcagaaatggcacaacatgggcctaattgatgcgcatgatactgctgaaaatgaccttaataagattgcagacgatattactgacatggcccagcatgtggctttgactgaggtcccattggatgaatggggtggatttcaaatcgttagtaagattgaggaaaagggatacacagcagtcaagattccaaagacaactaagtcattctctccagcaatgcgagagttagaggcggctattgctgcaaagcgttttcaccacgatgggaacccaattctaacttggatgattagtaatgttgttgccaagcctgatgctaatgacaacgtttttccgcgtaaaccaaacaactccaaaaagattgatggggcaattgctctgttaatgggaattaatcgcgccatgttcttagctggcgaggcagatccaaacgacttttatgatgatccaattatggtgggtgtatga

SEQ ID NO: 51 - DNA, 489 bp, Acinetobacter baumannii
tttatggctactcaaatacatggcttggagcctgcattaagacgaatgcgggcaattggtagtgacaagactgtaaaacgtattgcccgtaaagcgatgcggcaggcaatgaacattgcaagagatgcagctcgtcaaaaagttaaacgcctagatgatccaaccactccagaaaaaatctggaaagaaattgtggttcaaaatggccggagtagaaataaaaacactttggttatgcgcgtgggggtgcgtggtggtgcacgtatcccatatacaaacaatgctcaaaatagacgtgctgggcgtgttggtcaaacttaccaagcggacggtcgagtcttttactggcgattccttgagttaggcacaagtaaacaacctgctactccatttttacgccctgctttatacgaaaacattgaacaagttaccgataaatttgttcaggtgtttaattttgaactcagcgtggttttaggtgcagcttaa

SEQ ID NO: 52 - DNA, 756 bp, Acinetobacter baumannii
tccaattccaccagcaccacgtacattctaatcgggagtataaagatgagtagaggtactcgtacattcgaaatctaccgctatgatcctgataaggataaagcgccgtacatgcaaactttcaagcttgaattgactgataagcaccgtatgttgcttgatgcattgcttgctttgaaggttcaagacgaaacattaacattccgtcgttcttgccgtgaaggtatttgtggttctgatggtgtgaatatcaatggtaaaaatggtttggcttgcttgcaaaaccttaacgatttaccagagaaaattgtaattcgtccattacctggtttgccggttgttaaagatttggttgttgatatgaaccaattctatgatcagtatgacaaaattcagccattcttgatcaataaccaacctgctccacctaaagagcgtttgcaatctcctgaagagcgtgaacacttaaatggtttgtatgagtgtattctttgtgcatgttgttcaacttcatgcccatcattctggtggaaccctgataaattcttgggtccttcagcgttgttgaatgcatatcgttttattatcgactctcgtgatactgcaactgcagaacgtttggctcgtcttgacgatccgttcagtttgttccgttgtaaaggtattatgaattgtgtgtcagtatgccctaaaggtttgaatccaacaaaagcaatcggtcatatccgtaatatgttgttagatcaagcgggttaa

SEQ ID NO: 53 - DNA, 678 bp, Acinetobacter baumannii
gtaccatgcacaggaaaatgtttaatgagccttgataaacccactttgattattcgtcagtggaacgatttacaagattatcaaagcaaattcgaatcgatgaagaacctgaccaatcaacgtgatgaaaatacagcagacgagctgtggttactccaacatcatgaagtactaactcaaggtcaggcaggaaaaccagaacatattctgattccatcaaacattcctgtagtacaaactgaccgtggtggacaagtgacatggcatggtcctggtcaactcgtcgcttactttatgtttgaccttaatcgactgaaatggaatgtacgcacattggtcagttttgctgaacaatttatgatagatgttttaaagaaatataacattgaagcatatgcaaaacctgatgcaccaggcgtttatgtggatggcagaaagattggttcattaggcttcaaaattcgccgtggacgtagttatcatggtttagccctaaacttggactgtgctttaactggttttcaaaccatcaacccttgtggttatgcagggctagaaatggtccgcatacaagatttagtgactccatatccatcatttaaacaactttgtcaggactttattgagtatattaaagctactgggtactttaatgacccagaagtcaaaattgaataa

SEQ ID NO: 54 - DNA, 543 bp, Acinetobacter baumannii
ggattaataacaatgcctagaatagtaagcatcattccaccagagagtaaaggaactgccactctttccactggtacaaaagttttacttgataatggtgaatatctccagcatgtaaacaaaataactttagtggcggagccggggcagccgtggaaggcaatcattgaggtgcatccaaccaatcaagagcaaatagatgcactgttaactgatcttgaagtggttaaacgcaatgaggcttttaatcgtctgcaagaaatacaagaggaaatgcaacaccttcaggatgaaaaactatttcttgagcataagtatctttcaggggttactggtgtttctattgatggtgttaaggatgtacccaaagaaggtacatggttattaaaagaagatgaaaagattttatctctacctaacatcatagatgccaaacaactcttaaagaatttttctttacatggctcgtgttgtgccacaccagatttaaaaggtaatgacaaatgtccagaccctgccgagaattcggatgcacaaacttag

SEQ ID NO: 55 - DNA, 1362 bp, Acinetobacter baumannii
agacctttgaccaacgaatcttctacacttcaacgaggactaaaaaatcgacatatccaattaattgctatgggtggagcaattggtaccggattatttttaggctcggcgcaagtgattcaatctgcgggaccatccattattttaggatatgccattggtggcttaattgcttttttaattatgcgccacctgggagaaatgattgttgaagaacctgttgcaggatcgttcagccattttgcgtataaatactgggggaaatttcccggatttttagctggatggaattattggatgctctatgttctggttgcgatgagtgaactcaccgcggtagccaaatatattaattactggtggcctcatattccagcatggacgtctgtcttatttttctttgtcgtgattacggcaattaacctaacaaacgtcaaattttatggtgagtccgaattctggctcgctattattaaagttgctgcggttatctctatgattgtttttggcctttatttgctatttacagcagatgtaggttcaagcatttcatttagtaacctttggtctcatggtggattttttccaaatggctttagtggcctcttctatatgttggctttcttgatgttcgcctttggtggtattgaactgattggtatggccgcggcagaagcaaaagatccgaaaaaaaccattccaaaagcaattaaccaagttgttttccgtatcttgattttctatatcggttcactagcgatcttactttcattagtgccgtggaaccaattagatctaggcggactcgataaaagtccatttgttatgatttttagtcaaatgggtattggttgggctgcacacttactgaactttattattttaaccgccgctctctctgtttataacagtgggatgtttgcaaatagccgtatgctttacggtttagctcaacaaggcaatgcaccaaaaattttcaagaaagtaaataaacaaggtgtacctgtaccagcagttttgctatcggcattactcatttttggctgtgttcttttaaattactttgtaccagaagatgctttaagccacttaatgtacattgttgttggagcactggtattgaactgggcgatgatcagtatgactcaccttaagtttaaatcagcaatgaaaaaactcggtcaaaaaactcactttcctgcactttgggcaccgtttagtaactatttggttttaggttttattgctgtagtactctacattatgtggagtcaaggctttaaagaatcagtgatgatgattcctatttggatcattctcatgtttattttgtttaaagtactcaatgccaaagaacagtaa

SEQ ID NO: 56 - DNA, 2886 bp, Acinetobacter baumannii
gctactatgactgacgctcaaaccgctcaaaatattgccaccacctacgatccaactgagatcgaaaagaagtggtacaaaacgtgggaagaacaaggttacttcaaaccttctggtcacggtgaatcattctgtatcatgatcccaccaccaaacgtcactggtagtttgcacatgggccatggctttaacaatgccattatggatgccctcacccgttataaccgtatgatgggtaaaaacactttgtggcaaccgggtactgaccatgctggtattgcaactcaaatggttgttgagcgtcaacttggcttacaagatatcactcgtcacgacttaggccgtgaaaagttcatcgaaaaagtttgggaatggaaagaacaatctggcggcacaattaccaaacaaattcgtcgtttaggttcgtctgtagactggtcacgtgaacgcttcacgatggatgaaggtttatcaaacgccgttaaagaagtattcgttcgattacacgaagacggtttaatttaccgcggtaagcgcctagtaaactgggaccctaaacttcaaactgcgctttctgaccttgaagtagaaagcaaagaagaaaaaggttcactttggcactttaaatatttctttgaagataaatcagttaaaactcaagatggcaaagactatctcgtagttgcaacgactcgtcctgaaactttacttggtgatactgctgttgctgttcaccctgaagatgagcgttatgcgcaccttgttggtaaaaatattgtattgccaattacaggtcgtttaattccgatcgttgctgacgactacgttgaaaaagacttcggtactggctgtgtaaaaatcacccctgctcacgactttaacgactatgagttaggtaaacgcaatagcttgccaatcatcaatatcttcaacaaaaacgccgaagttttaggtgagtttgaatatattgccaaagctggtgaacaaatttctaaaaccattactgcacctgcagattatgctggtttagagcgcttcgaagcacgtaaaaaattagttgctcaagcggaagctgaaggctggttagaccaaatccaaccgtatgacttaaaagcgccacgcggtgaccgttcaggcgtgattattgagccattattgactgaccaatggtacgtaaaaattgcgcctcttgcagagcctgcaattgaagcggttcaagatggtcgtattaagtttgttccagagcagtacagcaacatgtacatggcatggatgcgtgacattcaagactggtgtatttcacgtcagctttggtggggtcaccgtattccagcttggtacgatgcggatggcaacatctatgttggccgtagcgaagaagaagttcgcgcgaaaaataacatcgctgctgacgttgaacttaaacaagacgaagacgttcttgatacgtggttctcatctgcactttggacattctcaactttaggttggccagaacaaacacctgaactcaaaactttccacccgactgatgtgttggtgactggttttgacattatcttcttctgggttgcccgtatgatcatgatgaccatgcacttcatgaaaaatgaagatggttcatctcaaattccatttaagacggtttacgttcacggcttggtacgtgatggtgaaggtcagaaaatgtcgaagtctaaaggtaacgttcttgacccattagacttgattgacggtatcgatttagaaagcttagtcgcaaaacgtacgactggcctaatgaacccgaaagatgctgcgaagattgaaaaatcaacgcgtaaagaattcccagaaggcattaatgcttatggtactgacgcagttcgtttcacgttctgtgcccttgcaaacactggtcgtgacatcaagttcgacttaaaacgtgttgaaggttaccgtaacttctgtaacaaaatctggaatgcaacacgtttcgttctgatgaatgttgaaggccaaactgttggtcaacaagcccgtcctgatctttgggaacttccagaacaatggattatcagccgtctgcaaaaagctgaagctgctgtacaccaagcgtttgcaacttaccgtttagaccttgctgctcaagcgatttatgactttatctggaatgaatactgcgactggtacgttgagttaactaaaccagttctgaacgatgcagaagtttcagaagagcgtaaagctgaagtacgccgtgtattacttgctgtgatggaagcctctttacgtttggctcatccgttaatgccatatctgacagaagaaatctggcaaacacttgcaccaatgcttggtcaaggcggcccaaccattatgactgctcaataccctattcctgagcaagcaaaaatcaacgaacaagctgaagcagatatgcaatggcttcaaggtttgattggtgcggtacgtaacattcgcggtgaaatgggcttaggtaatgcgcgtttattgccagtattacttcaaaacacatctgacgctgaacgtgaacaaatcattcgtattgaagcattgttcaaagcattggctaaagttgaaagcattgagttcttgaatcaagaccaagagccacctttatcttgctctagcgttgttagccatgcatcggtatttgtaccaatgaaaggcttaattgaccctaaagctgagcttgctcgtttgcaaaaagacttggataaaatccaaaagcaacacgaccaaattgcaaataaacttgcaaatgaaggctttgtttctaaagcaccagcagcggtggttgaaggtgaaaaagcgaagcttgctgagtttgctgctcagttagagaaagttaaagcgaatatggagcaaattgctgcgctttaa

SEQ ID NO: 57 - DNA, 439 bp, Acinetobacter baumannii
cctcagcgcgtttccttgccgccccgtcggtgtaagactggcaacattacctgatgcaaaggcagaatcagtgcgcaaggctttaactgaagctctgaaatatttacctgcagaactgcgtaaaacgttgacctatgaccgtggacgtgagatgtcagaacataaaatactcgaagaagatttaggcatagatgtatatttctgtgacccacattcaccctggcaaaaaggcacatgcgaaaatatgaatggtttaattaggcaatatttacctaaagggattgatttaaatcaggcagatcagcattatttaaatcaagttgccatgtcactgaatactcgtcctagaaaggcgttagattggcttacaccattagagaaatttgctcagcttgttgattatcatatggcttttgaaactgtcgcacctcatgtttga

SEQ ID NO: 58 - DNA, 222 bp, Acinetobacter baumannii
gcccatgcagcttctaattcagcaaaacgaacttttgcaacttcagggtctggacctgaatcaccttcagaatcatcatcaccttcagactcttcttcttcatcgtcatcatcaagcttaacttctttcgttgactttgtagatgattcgtcttcttcctcaagctcttcaacatcttctaaaacttcaggaatatcttcatcagtttcagggtctaaataa

SEQ ID NO: 59 - DNA, 354 bp, Acinetobacter baumannii
ttaatgcaagctggtaaattaaaacatcgtattacgatacaaaggccaattaacacacaagacccggttactggaaaattaattcagacttgggaaaatttcaaaagtatttttgcggaagttaccgacttatcaacacgcgatgttattgctgccaaagctgccaatagctcaattcaggcacgagcaaaagttcgctacagcactacaaccaaacaaattaacagcactatgcgggtattatttggtggttactattacagaattgatggtaaccctatgcgagatccagactcacgccgtgagtatttaaccatcaacttatctacaggcgaaaaagcatggaatgggtga

SEQ ID NO: 60 - DNA, 276 bp, Acinetobacter baumannii
aaatataaagctattgatttaattatggtttctatgtgcgccctgcgggactcgaacccacgtcggtcgcttaggaggcaactgctctatccagttaagctaagggcgcataattttctgattataaacaaaaaagccattgccgaggcaatgactttttatagttttaagtacaagctgttagattactgttctttggcattgagtactttaaacaaaataaacatgagaatgatccaaataggaatcatcatcactgattctttaaagccttga

SEQ ID NO: 61 - DNA, 1275 bp, Acinetobacter baumannii
atgtctgaagcaactggcaaaaaagccgtattacatcttgatggcaaagaaattgaattaccaatttacagtggcacattaggtcccgatgtaatcgacgttaaagatgtattggcctcaggtcactttacttttgatcctggttttatggcgacagcttcatgcgagtctaaaatcacatttatcgatggtgacaaaggtattttattacaccgcggttacccgattgaccagttagcgactcaagcagactaccttgaaacttgttatttattattaaatggcgagttaccaactgctgaacaaaaagttgagttcgatgcgaaagttcgtgctcatactatggttcatgatcaagttagccgtttcttcaatggtttccgtcgtgatgctcaccctatggcaatcatggttggtgtagtaggcgcattatctgctttctatcacaacaaccttgacattgaagacatcaaccaccgcgaaattactgcgattcgtttgattgctaaaattccaacgcttgctgcttggagctacaaatatactgtaggtcagccattcatctatccacgtaatgacttaaattacgcggaaaacttcttacacatgatgtttgcaactcctgcagaccgtgactacaaagtaaaccctgttcttgctcgtgcaatggatcgtatctttacgcttcacgctgaccatgaacaaaacgcgtctacttctacagttcgtcttgctggttctactggtgcgaatccatatgcgtgtatctctgctggtatctctgctctttggggtcctgcacacggtggtgcgaacgaagcagttcttaaaatgcttgatgaaatcggtagcgttgaaaatgttgctgagttcatggaaaaagttaaacgcaaagaagttaaacttatgggcttcggtcaccgcgtttacaaaaacttcgatccacgtgctaaagtgatgaagcaaacttgtgacgaagttcttgaagcattaggtatcaatgatcctcaattagcgcttgctatggaacttgaacgtattgcattgaacgacccgtactttgttgaacgtaaactttaccctaacgtagacttctactctggtatcatccttaaagcgattggtatcccaacagaaatgtttaccgttatcttcgctcttgcacgtacagttggctggatcagtcactggttagaaatgcacagcggtccttacaaaattggtcgtcctcgtcagctttacactggtgaagtgcaacgtgacatcaagcgttaa

SEQ ID NO: 62 - DNA, 396 bp, Acinetobacter baumannii
tggctttcggcattaaccgaagcccaagtgagtgcacttatgacaacaagaacctttaaaacaattgatggtcgtaagcttgagtttactgttactcaagaacaatcttcatgtgctcatgactcaatcattccacatccaaatagattctatgatgagcacaagcatacatatcaatgtgctaaatgcgggtggttgttttctcatgatcagttattgctgcttaagtttggcggtaaggacaaagtgaatgatgcaactaataccaaagcaatggatgatgtttattgctgggagttgaagaagtggtttaatcacaagtattgggttgcgaagatgaaagacacccatacaggtgtgacactacgtgaattagtaatagcagcaaaactctaa

SEQ ID NO: 63 - DNA, 2109 bp, Acinetobacter baumannii
tttaactcggcttgcattacatcgaatacagtagatattattttgcctatgcatataaatttttcagaacatttttttaaaatccagaaacagcttgaaaaccctcaagctgttattgacgaaaatattctcattgacctggtcaatgctttacggccatccgatcctcaagatacggatgaaatagagcaaaaaatacaagcctttattgatagcctattacttactcctaccgctccagcccttttacaaacctttttattacgcctcattaatcaatataagcaagtcagcttatatgcagatagcggtattttgtctttagatggtttctggaaccagcttgggcaaagacttggcggccattttctgccacttattgaagatgcaagccagctaaaaattctgattggaaaaattttctatttagaaagtgattcaatctggttaaacaatgtcgatgacaagaattgggcaacgttgttcggacttattgggcaaagtaacagtaatgtcgatgaaaagcatgccattcagcgagaaatgattaaggcgattactgtcttatcttaccgtattagtggtattggtctttatcctgaatttattaacgctcaacctgagttaaccgaatatgaatcgccatttttggtacaaaaccgtgaaattattgagtttatagagaagtacaaaaaacaggatatttccagcaacgacattgctgtacttccaccacctgatgcctctcaagcatttgtaatgctagagcagtgtcgagacgtcgtcttaaaaatacgccgagcgaccaaaagaatcggtgtaagtttaagtttgacctatcttttgtctttacttgaacagtgtttagatcggattgaattattactctatctagttgtagatgatagcgagggacgctacgtttctttaggaaacttaatttcagacttaactaaagcacattatagtgaaaaaagtgtccgctctttactcagcacgaccagtgagcttattgcctttcaagtcacagagaatgcaagccgtactggcgaacactatgtaagtacagacaccaaaggcttttggggcatgtataaagccgctgctggtgcaggtgtgattattgcctgtatggcctcattaaaaattcttgctgcacgtatgacgatggctccgctcatgcaagcctttacgttcagtatgaactattcactgggctttattctaattcatgtattgcactttactgttgcaacaaaacaacccgcaatgacagctgccgcacttgcagccacagttcagcaacgtaaaggctctaaaactgcacaaattgcagaattagccgcacttattatcaatattattcgaactcagtttattgctattttgggtaatatctcgattgcaattcctactgctgctcttattacttttgcttggcagttctatcttgatgagcctttattaactcataccaaggcaacttatctattacatagcctaaacccttttacctcattagccgttccgcatgcagcgattgctggggtgtgtttgtttttatctggtctaattgcgggctacttcgacaacatggcagtttatagaaaagtaggaccccgtttaaaagcacatcgacgtttaagaaacttatttggacaagaacgcctgaaccgttttgcagaatatattgaacgtaatttaggggcgctcgcaggtaatttcctatttggcgtaatgttaggaagtatgggaacaattggctttattttgggcctacctctagatattcgtcacattgcttttgcgtcagcgaacttcattcaaggtttaatgactattaatggtagccctgatattggcttgattatagtttcatttttaggcgtactctgtattggtctcaccaacttatttgtgagtttcacactcactattattgtggcattacgtgcacgtcgagttcgctttgaacaatggaagccattagccaaactggtcatgacccattttcttacccgaccaagtgacttcttctggccaccgaaacagcctttagaattagaagaaaatgcgcaagccaatagtggaaaaaaagcagaacattaa

SEQ ID NO: 64 - DNA, 927 bp, Acinetobacter baumannii
ttttacgaggcgactgtgtcatcactctctcaagttaatgcggatgttttaaaacaagctcaacaacgtattcaacaagatttattgacgacactggctgcattctcaattcccgaacctttaaaaagcgctgtacaccatgcagttatgctcggtggaaaacgtgtgcgtccggctttgtgttacgctacagcttctttacaagataatccaaattttgcggctgctcgccgtgctgcggttgctgttgaactcatccattgttattccttagcacatgatgacctgccttgtatggacaatgatttgcttcgccgtggtcagccaacgtgtcatgttgcatttggtgaagataccgcgttacttgcgggtgacattttacaatcgatggcatttgaagttttaggtagtcgtttgtttgatgagcaagggcagggaacggatgctgcaattgtcttaaagcaaattcaaattttagctacagctagttctaaaatggtttgtggacaggtcttagacttacaagccgaagctaagcaaatttctcaagacgaactagaaaatatccaccgtaataaaacgggtgcgcttattcaggctgccattatgatgggggcagtgacaattttctcgggtacagatcaggcaattccaaaactacgtcaatatggtcaagcgattggactggcttttcaggtccaagatgatattttggatattacgtcgagcactgaaactttaggcaaaaccgctggtaaagacgaacaagtacaaaaatcgacttatcctgctctaatgggactagagcaagcacagatttatgctaaagaattgcatgatcaagctttcgaagctttagcgcatttcggtgaaaatgcaaaagaattagttgagatttcacaattcctgttagctcgtactaattaa

SEQ ID NO: 65 - DNA, 1467 bp, Acinetobacter baumannii
agtaatcctctatcctggtttatggagataaaaatgtctcaacaatttgatcttgttgtcattggcggtggtcctggtggttatgaagctgcgattcgcgctgctcaactaggcttcaaagtcgcttgtattgaaaaacgtattcacaacggtaagccttctttaggtggtacttgcttaaacgtaggttgtatcccttctaaagctttgcttgattcttctcatcgttatgaagatacagtgcatcatttagctgatcacggtattacaactggtgaagtgaatttcgatcttgcaaaacttcttgctcgtaaagacaaaattgttgaccaattaactggcggtattgatcaattgcttaaaggcaacggtatcgagtggttaaaaggtacaggtaaattacttgctggtaaaaaagttgagtttgttccacatgaaggtgaaactcaaattttagaacctaaatacgtaattcttgcgtctggttctgtgcctgtaaatattcctgtagctcctgtagatcaagatattattgttgattcaactggcgcattaaacttccctgaagtacctaagcgtttaggtgtaattggtgcgggtgtaatcggtttagaacttggttcagtatggcgtcgtcttggtgctgaagttgttgtatttgaagcaatggatgcattcttgccaatggctgataaagcactttctaaggaatatcaaaaaatcttgactaaacaaggtttagatatccgcattggtgcgaaagtatctggtactgaagtaaacggtcgtgaagtgactgttaaatacactcaagctggtgaagacaaagaacaaacgtttgataagttaatcgtttgtgttggccgtaaagcttatgctgaaggtttattggctgaagattcaggtattaaattaactgaacgtggtttagttgaagtaaatgatcactgtgcaacttctgtagaaggtgtatatgcgattggtgacttagtacgcggtccaatgcttgctcataaagcaatggaagagggcgtaatggctgttgaacgtattcatggtcatgcagctcaagtaaactatgacacaatcatttctgttatctatacacaccctgaagcggcgtgggttggtttaactgaagagcaagctaaagaaaaaggtcatgaagtaaaaactggtcaattcggttttgctgtaaatggtcgtgctttagctgctggtgaaggtgcaggttttgttaagtttgttgctgatgcaaaaactgaccgtttattaggtatgcatgtgattgggcctgcggcatctgatatcgttcaccaaggtatgatcgcacttgaatttgtatcttctgttgaagatcttcagttgatgacttttggtcacccaacattctctgaagttgttcatgaagctgcacttgctgtagatggtcgtgcaattcacgcgattcaacgtaagcgtaaataa

SEQ ID NO: 66 - DNA, 612 bp, Acinetobacter baumannii
tatctaaaatatatcattaaatggaatttaataaaacataggttttcttccatgtctaattctaatattgcggttgtatatttctcaggttatggccacactaaagtagtggctgaaacttttgctaatgaaattaatgctcaacttatccagattgatcaggaaggtaatatcactgagcaagattgggaaacattgaataatgcaaaaggtattgtgtttggtgcgccgacctatatgggtacagcaccatggcaatttaaaaaatttgctgatgccacttcaaaagtttggttcacacgtggttggcaagataaagtatttgcaggctttacgaatagtgcaagtttaaatggggataaacaagttacgcttatccagctgcaaactttagcatcacagcatggtggcatttgggtgagtctgggcttattgccagcgaatactaaagatgcaacacgtgaagatgtaaacaacttaggcggttcggtagggcttttagttcaatcaccttcggatgcaagtgtagatgaagtcccaacaggggatttggaaacagctaaagtttatgcaaaacgtgtacaagccattgtaaataaaatatatggttaa

SEQ ID NO: 67 - DNA, 909 bp, Acinetobacter baumannii
gtttttactcataataagtacaatatgacatttacccagcttgaaatttttgcactcattgctgaactaaaaagctttactgctacagcagaaaagctgggaatttcacagtcggcagtttcccatgcgcttaaatcattagaacaacaatggggcattaacctgatttcaagaactcaaagcgatattgagctgacgacgacaggtcagcagttattaacccatgtaaaagagctgttgagtatttccgataccttagaaaaagaagtggctgccatccacggtttaaatgaaggcacattacgtattggttcttttggagcttcatcctctatttatctattgcctgaaattttagaaacctttcggcaacgctaccctaaaatcgaaatttatatcgatgaaggtgaagataaagaagttgctcagtggttactagaaaggcgtatagaggttggttttttgattatgccagatgagcgattcgatacattccccttaattgaagatcgttttgtggccttaattccgagtggttacccgctcgcgcagcaactctatattgatccagcacatctagaaaactgcccttttattatgacaatggcgggtagtagacatcaggtcgaattaattttaaaaaactttaatgtgaaacccgacatcaaattttatgtttcacaaattctaagtattgtcagtatggtccataaccagttagggatttcgattgtctctgatatggtgctcaccaaagagttactctcactttatcccaacgtggttaaacgcccatttaaaccgaaccttaaacgttctattggtcttgcagtaaaaaataagaaacacatcagtccagccgtaaaagcatttattgaagttgctcaagaggtttggtccgatcattaa

SEQ ID NO: 68 - DNA, 1167 bp, Acinetobacter baumannii
atgaacttacatgagtatcaagctaaagcgttattgaaagaatatggtatgccggtacaagaaggtatcttggcaaccaatgcagacgaagcagttgctgcatttgaacagcttggtggtaaattcgctgtaatgaaggcgcaagttcatgctggtggtcgtggtaaggctggtggcgttaaagttgcaaaatctaaagaagatgttatcgaatttgcaaacaatatcattggtactcgtcttgtaacgtatcaaacagatgcaaatggtcaaccagtaaacagcatcattgttgctgaagacgtatatccagttgagcgtgagctttacttgggcgcggttgtagaccgttctagccgtcgtattactttcatggcttctacagaaggtggtgtagaaatcgagaaagttgcggaagaaactccagaaaaaattatcaaagttgaagttgatccattagttggtttacaaccattccaagcacgtgaagttgcgtttgctttaggtttgaaagacaagcaaatcggtcaattcgtgaaaatcatgacagctgcttaccaagcatttgttgaaaatgatttcgctttatttgaaattaacccactttcagttcgtgaaaatggcgaaattttatgtgtagacgcgaaagtaggtatcgactctaacgcgctttaccgtttacctaaagttgctgctttacgtgacaaatctcaagagaatgagcgtgaattaaaagcatctgaatttgatcttaactatgttgctttagaaggtaacattggctgtatggttaacggtgctggtcttgcaatggcaactatggacatcattaaactttatggtggtcagcctgcaaacttccttgacgttggtggcggtgcaactaaagagcgtgtaatcgaagcgttcaaaatcattcttgctgatacgtctgtacaaggtgttttaatcaacatcttcggtggtatcgtacgttgtgacatgattgctgaagcaattattgcagcggttcaagaagtaaacgtaactgttccagttgttgttcgtttagaaggtaacaacgctgagttaggtgcgaaattacttgatgaatctggtttgaaattaatttctgcgaacggtttgtctgatgccgcagaaaaagttgtagctgcagttaaagcgtaa

SEQ ID NO: 69 - DNA, 207 bp, Acinetobacter baumannii
cgtcgattacatcgggacctaatgtgccactgtaaattggtaattcaatttctttgccatcaagatgtaatacggcttttttgccagttgcttcagacattcaatagatctcctgtcctggtgaatgattatctgactcgaaatcctaattttctcatgtgcgaatcagacggtgtcaaaatttgctataagattagtgagtactga

SEQ ID NO: 70 - DNA, 2562 bp, Acinetobacter baumannii
cataaaaaacaacctaatttaattaccagtcctttagatccccgcatttgcggggattttttttggagaaaatttatggcaattcttactcctgaaaagtttgaaaacttgaatcgggatattgaggatacggggaaagcaattaatatcattgggattattacccctcgatatggtgaacctttcaaatctttgccgcttgtaagtaaagaagctgagaatcgaggtggatatatttcagcccctacattaacggcattgcaagcaattgttcctagttacaactatcaacttgcacgtgatgatagtaccggtaatgaatatcgctggaaccctgctgcaactcccacacctcaatgggaaccaacaggacgtaattatttaaaagatgcggtagattattcaaatcaatttagtgcattaacgaaaaatgcaacggtgttttatcctttttcgagcaccaagcgaaataatgtgaatgctagtagtgtttccgcatcacatgaagcttacttgaaaccgtatattttaaatattacggtgaatggtgctgatccaaataaatattatcgtattcagcagattagcactcccacaaatccgacggtgcctaatcgttgggtttttgaagttctaaatcgaacaaattttgattcctcagaaactgtagaaaaaactattccagttgttttcccaattgtgaaaaatatggggattcaaactttcaatgttgttgatggtgatgtcactatcattgtgacggtcgatacaagtaaagttccgactagtaatttttattctgttgcttcgactgatagttcatatacatacattattgatccgagtcgttatattttttcagcatttaaaaaatctgatgcggtcagttatgttgattcgtttagtacactgacaaagaactcaactgttttattcccgtttagtacattaaaacggaataacgtgaatgaaagcactgtaggttcacacgacaatattttacgtaacttcatccttgatgttcgagtgatgaatgctgatcccaataaatattatcgcttgcaacagatgagtagccccgatcaagcgacgaacccgaaccgctggatatttgaagaacttagccgctctaattttgatacaacagagacaaaaggtaaggcgattacagcagttttaccaattgtgaaaaatacggggattaagagcttttttgtaaaagatggtgatctcggtatttcagttacagtagatactaataaaacgccttctaatagcttttattcagttgcatcaacagataactcatacacatatatttttgatccaagtgtgtattcttatgctgccgtaactagctcagacattaatgcggtgaatgcacgtatcaatgcatttagtaagccgatgcagcttaaaaacttacttaatggtttacgtaatccaatccaagatgtgaatatcatatttgcacctgccgactctattacttatggagtgggtgcaacagataatggagcaggtcccaatcctccccatggacctgcaacaacagaaacttatgtgaacatttttcggaattatctaggcacagctttttgcaccagtgaacgttttgatgacactatcttggaaacaggtgaagcgtattttacaagcgaaggtacgagtgttttaagtgctgagcttgcgaactacacatttaagaatagtcttacaggtaaagtatttacactaactgaaatgcaggccttaattggtgtaaatccaagttcaccaacgggtactttccttgatattaaaagtccttcagtcgctggagcagtgacagatatggaatttaactttaatggaaatgcattcacaatcaattacgcaagactcggaaacggaagtgctactgaatcaaatattgatgtttttgtagatgatgttctgcactctagttttaatgtgtatacgacatcaccagcgtttgatggatctacaacaatcagtggattgccagatggttctaagaagattcgcattgccaatcgacttagtaattcaacaatctatgcgcgattggtttcaatcacagcgacacgtaaagtttcggtaatcaatgaagggatttcaggcacaaactctaagcaatggcttgataataactggattccagacaaaattagcaccaaagctaattatgttttcatgatgattggtactaacgatcggcacactacgcagaagatagggacatttaaaaatcaatatcttcagttgattgaccgtattactgcaaagaatccaaaagcacaaatcattatcatgtcaccgcctgccgtgactcaaaatgaagatcctaatacgacggtatataaatttaggattgcagatctgaattatgcattaagtcagatcgcagaacttcgcggactctcttttattagtctttttgaggcaacatcaaagctcaaagctaaaggtgaaaactatttgtttgatcaaatacatccaaatgattatggctatggagtgattgctgaatacatcattaatcaaattttgagtgcttaa

SEQ ID NO: 71 - DNA, 663 bp, Acinetobacter baumannii
  unsure (5): Identity of nucleotide sequences at the above locations are unknown.
agtcnattgcagagcaacgtgaatctctatggcagcaggcatactgacccaatgattttgattgatcaagactataaccgtcaaaaagcatcaatgggtttgcaggcacgcagtgaaacgcttggagggatggcagacttaatgggcggcttacttggtgaacaatcggcaggctataaagccatgtttgcaatgtccaaagcattcgccgttgctcaagcattaattaatgctccgcaaactttctctaacgtctacacctcggtttctgcaatcccgctaattggtccatatattgccccggcgcttgccgctgcagcagtaggtgtacagttagcacaggctgctcaaattaaacaaacctctcttacgggtatggcgcataacggtatcgataatgttcctagagaaggtacttggttgcttgatggtggtgagcgtgtattgaatcccaaccaaaacaaggaccttactaactatttgaataatcaaaaagatagcggacctcaagttgtggtttacaacaacagcaaagcaaatgttgaaacgaatgttggtgatgatgggaaggtgtatgtgaccattgatgatgtatacaacccaaacagcaagtacagccaagcaatgcaggaaagtttcaatatctcaagaaacagggggtaa

SEQ ID NO: 72 - DNA, 1461 bp, Acinetobacter baumannii
atcgtgatgcaaaaagtatggtctatttcaggtcgtagcattgcggtatctgcacttgcgcttgctttggcagcttgtcaaagcatgcgcggcccagaaccagtcgtgaaaaccgatataccacaaagctatgcatataacagcgcttctggtacgtctattgctgaacagggttataaacagttctttgctgacccgcgtttgcttgaagtgattgatttggctcttgccaataaccgtgacttacgtacagcaacgctcaatattgaacgtgctcaacagcaatatcagattacacagaacaaccagcttccaacaatcggtgcaagtggtagtgcaattcgtcaggtttctcaaagccgtgatccgaataacccctactctacttatcaagtaggtttgggtgtaactgcttatgagctagatttctggggtcgtgttcgtagcctcaaagatgctgctttagatagttatcttgcaacacaaagtgctcgtgattcgactcaaatcagtctgattagccaagttgctcaagcatggttaaattattcgtttgcaacagcaaacttaagactggcagagcaaacgcttaaagcacagttagattcttacaatctcaacaaaaaacgttttgatgtaggtatcgacagtgaagttccattacgtcaagcacagatttctgtagaaactgcgcgtaatgatgtagcgaactacaaaactcaaattgctcaagcacaaaacttgttgaacttgcttgtaggccaacctgttccacaaaacttgttacctacacaacctgtaaaacgcattgctcaacaaaatgtgtttactgccggtttaccaagtgacttgttaaataaccgtccagatgtaaaagctgctgaatacaacttaagcgctgcgggtgcgaatatcggtgcagcaaaagcacgtttattcccaaccattagcttaacgggttcggctggttatgcatcaactgacttaagtgatctatttaagtctggtggttttgtctggtcagttggtccaagcttagatttaccaatctttgactggggtacacgccgtgccaatgtaaaaatttctgaaaccgatcagaaaattgcattgtctgattatgaaaaatcagttcagtcggctttccgtgaagttaatgatgcacttgcaactcgtgccaatattggcgagcgtttaaccgctcagcaacgtctagtagaagcaactaaccgcaactacacactttcaaatgcccgcttccgtgccggtattgatagttacttgacagttcttgatgcacagcgttcttcatatgcggctgaacaaggtttgttattgcttcaacaggcaaacttaaacaaccaaatcgagttatacaaaactctaggtggcggtttaaaagcaaatacttcagatacagtggtacatcaaccatctagtgctgaacttaaaaagcaataa

SEQ ID NO: 73 - DNA, 1275 bp, Acinetobacter baumannii
attttatctaaacgaggtggaacaatgatgtcggctaagctttgggcaccagcccttactgcttgcgcattagcaacaagtatcgcgcttgttggttgtagcaaaggctccgatgagaaacagcaagctgctgctgctcagaaaatgccgcctgcagaagtaggtgttattgttgctcaaccacaaagtgttgaacaaagcgttgagctttcaggccgtacttcagcatatcaaatttctgaagttcgtcctcaaacaagtggcgtgattttaaaacgtttatttgctgaaggaagctatgttcgtgaaggtcaggcgctttatgagctcgactctagaacgaaccgtgcaacgttagaaaatgcaaaagcatcactcctacaacaacaggcaaatctagcttcactacgtaccaagttaaatcgttataaacaacttgtttctagtaatgctgtgtctaaacaggaatatgatgacttacttggtcaagtcaatgttgcagaagcacaagttgcagcagctaaggctcaagtaacaaatgcaaatgtagatcttggttattctacaattcgctctcctatttctggccaatctggtcgttcttcagtaacggctggtgctttggttactgcaaaccagactgacccgttggtaacgattcaacagttagatcctatctatgttgatattaatcagtctagtgctgagttattgcgtttacgtcaacaactaagtaaaggcagtttaaataacagtaacaacacgaaagtaaaattaaagcttgaagatggttctacctatccaatcgaagggcaacttgctttctctgacgcttctgtaaaccaagatacaggaacaattacattacgtgccgtattctctaacccgaatcatttattgcttccgggtatgtataccactgcgcaaattgttcagggcgttgttccaaatgcttacctgattcctcaagctgccattactcgtttacctacaggacaagctgtagcgatgcttgttaatgctaaaggggttgttgagagccgtcctgttgaaacctctggtgttcaaggacaaaactggattgtgactaacggcttaaaagccggcgataaagtcattgttgatggtgttgccaaagttaaagaagggcaagaagtatcagcaaaaccttatcaagctcaaccagcaaactctcaaggtgcagcaccaaatgctgcgaaaccggctcaatcaggtaaacctcaagcagaacagaaagcagcttcaaatgcataa

SEQ ID NO: 74 - DNA, 477 bp, Acinetobacter baumannii
aaattggataagttcatgctctgcccgttgttaaaggggtatgactttacaccgggcaacaatttgcgagagcaagaaacagaaggggggcctccaagacaggttcctttttttgtaggagcttggcacacggtaaacgtttctatctctctaaataacgaggatgaaaaggagtacttctgggctttttggcgtgacaagcagtacaaacctagtaattggctttggaagctagcattagacaatgcaaggctagaggaatgcgagtgcaggtttgttgcagattcgcgcccaaaagaagtagagcgagatggaaaaatccttcaactcagttttcagctaagaatcaagcctattcaccgtgatcatgaaaatgacagggacattattgaggcttggcaaaatggaggcccggcagttataggcacaattgaaaaagtaccaaatgaatggttctcgaacgctacaggagtttag

SEQ ID NO: 75 - DNA, 1017 bp, Acinetobacter baumannii
ataatgagtaatgttgatcagcgtccaattattttgacaggcgaccgcccaaccggacaacttcacctcgggcattttgtcggttctttgcgttctcgtgtaggtctacaggatagccatcatcaacatctcttattagcagatgcacaagcgttaacagacaatgccgataacccagataaagtgcgccgtaacattttagaagttgctctagactatttagcggtaggcattgatccaactaaaaccacaatttgtgtacagtcatgcttgcctgcactgaatgagcttacaatgttatatcttaactttgtaactgtagctcgattggaacgtaacccaaccatcaaatctgaaattcaaatgcgtggttttgaacgtgatattcctgccggtttcctttgctaccctgtagcacaggcagctgatattacggcttttaaagcgactgtagtaccagtaggtgaagatcaaattccaatgattgagcaaactaacgaaatcgtgcgtcgtgtaaaccgacaaattggtcaagaccttttacctgaatgtaaagctttgctttctaatatggctcgtttacctggttttgatggtaaagcgaaaatgtctaagtcattaggcaataccattgttttaaatgcttctgacaaagacatcaaaaaagctgtaaatgcgatgtataccgatccaaatcatcttcgcatcgaagatccgggccaagttgaaggaaacattgtatttacttatttagatgcatttgatccaaataaagaagaagttgaagagctaaaagcacactaccgccgtggtggtcttggtgatggtacagttaaaaaacgtcttgaaggtgtactaaaagaattaattacacctatacgtgaacgtcgtgaagaacttgctaaagatcctgactatattatggatgttttacgccaaggtactgataaatgtcgaatcattacccagcagactttggacgaagttaaagatggtttaggcttatttaagttctaa

SEQ ID NO: 76 - DNA, 339 bp, Acinetobacter baumannii
cattacgtcctagtaataggaattgctcacgcacagcgctgtgtggttggtcaccctttggatatttatcgaaatattggcgccagtcctcagcgacggaggttggggaagtcaggtactgctcgtaaagttcttcaatatacgctgcactatcagcggaaagttcagtgtcaagacgcaatgcgtcagcaacttcttgcatttgtggacccatttcctattgcaaaaaatattacaggctgccttttaagcatacccatgatgcataatgtcaaattggtaaaaatgacactacttacccaacaggtcttcaagaccatggggcgtcatactacctag

SEQ ID NO: 77 - DNA, 504 bp, Acinetobacter baumannii
agggttgacaaaatgggtggaattgcgtccgtgccggggcggggtagaaagcccaagccagtcgaaacaaaacgagcatccggcaacgttggaaaacggccattaaacaacaatgcgcctgaatttacagaagtcacaaatattgatgttccctcttatatggaaaatttagagttcgcatcaatgatttggaagtctattgttcccgaactccttaaaaacaaagtccttcgcataacagacatgcataacgtagagggtttttgtttggcttatgaaaactggagaaagtcacagcgcgaagttcaatgtcacggaatagttgttgagggtgcgcaaggtgggccagttaaaaaccctgcacttacagcagcaaatgaagcagccagacaaatgactatgtttggcgctttgcttgggctagatcctgcatcccggaacagaattaccggaatcgggcaaaagaaaaaaggcaatgcatttgcaggagtcttagaaatgtga

SEQ ID NO: 78 - DNA, 438 bp, Acinetobacter baumannii
aaaatggacaatcttatttttcagcttgttatttttctcattcttttcagtattggttgggcttttggccgccatattgaacaaaaacatttaaatgaacttctagaaaaagagcaacaatttgcccatatcagaattgataccaatcgttttgccacaagtgatcagttaggccattttattagcagtaatgtagttatttcgcatgactactttaaatatgtactggcctctataaaaaatattttaggcggtcggctgaccagctatgaaagtattgttgaacgtgctcgccgcgaggcgattgtacgactaaaacaacaagctcaaagtgtcggtgccaatcacattatgggagttcggctgagtacaaccgaactgggtatgcaaggtggaatggtagaggtatttgcctacggaacagcagtcaaagattaa

SEQ ID NO: 79 - DNA, 225 bp, Acinetobacter baumannii
gctgcactaaaaaatcatacttatatttttagccaatcttttaaaaatgtatatttttggctatttaaatggcttattaattgtgccatcttgtttggaaagcaaaaggaagctgcaaggagaaaagtggatgcaaataacaagaaaaatcatgtgaatcaaataagactggcaaaaaaatattcatttagattggatattagcctaaagtctaaaaaagaataa

SEQ ID NO: 80 - DNA, 660 bp, Acinetobacter baumannii
gataaaacaaaggatgatttaaaacttaaaaatatggaacaacatttccctaatctaccgtctcaggttccccaacgtggtaatgctttaagtcgagcattatttaaaaaactctttttggcacaaggctggactatagaaggtgaagttcccaactttcctaaagctgtagccattatttctccccacacctccaatattgatggctggtatggttttcttgccatttttggactcggtattcaaattacggtgctaggtaaagacagtttatttaagccaccttttaaacgggttttagattgggcgggcgttattcctgtaaaacgtgactcggccaatggtctgactgaacaagtcgttgcgactattcaacagtatgacaagatttggattggaatggcgccagaaggcacacgtaagaaagcaaaaaaaatgaagagtggtttttaccatattgctgcaaaagccaatattcctattgtgatgttttcttttgattatgaccgtaagactattcactgcttaggctatttaactccaagcggaaattatgatgaagatctcgccaagatttttgaacgttatgaaggaaaaatatcaccgaaaaatcgtaattggcttgcagagcctttacaaaatcttgtgaaaaaaacctag

SEQ ID NO: 81 - DNA, 678 bp, Acinetobacter baumannii
aacatgacaaaaatcttgatgattgaagatgattttatgattgcagaatcaacgatcacgttgctgcaatatcatcaatttgaggtggaatgggtcaataacggtttagatggtttggctcaattggcgaagactaaatttgatcttattcttttggatttaggattgcctatgatggatggtatgcaagttttaaagcagatccgtcaaagagcagcaacaccagtattaattatttctgcccgagatcaattacaaaaccgtgtcgatggtttaaatttgggtgcagatgattatttaattaaaccttatgagtttgatgagttgcttgcccgtattcatgcattactacgccgtactggagtagaagctcaacttgcgagtcaagatcaactattagaaagtggtgatctggttttaaatgttgaacagcatattgcgacgtttaaaggccaacgcattgatttatcaaatcgtgaatgggcaatcttaattccacttatgactcacccaaataaaatcttttctaaagccaacttagaagataagttatatgattttgatagtgatgtgaccagtaatactattgaagtatatgttcaccatttaagagcgaagctgggtaaagattttattcgaaccatccgaggactgggctaccgtttggggcaatcataa

SEQ ID NO: 82 - DNA, 456 bp, Acinetobacter baumannii
agaactgcaaagcggtcgtattgcagcgacaatttcattgatcttatctgtggtagccattatcgcagcctttgtatggattatgttctaatgaaaagtgctacaggtttaacaggttcaggttctcgtgattggtttatccagcgtgtaagtgctgtggtattggcagcttatactgttgttctttttggttggatcctctgcaaaggcggatttgactatcaacaatgggctggcttcatgatgacattaccaatgaagattttctctttattggcaattttgtcgcttatcgcacacgcatggattggtatgtggcaggtttttactgactatgtcactactcgtcaaatgggtccttcagcgaaaggtttacgccttgtactgactacggctgtcattattgcagtgtttgtgtacgcaatctggggtatccagattttctgggcgaattga

SEQ ID NO: 83 - DNA, 384 bp, Acinetobacter baumannii
atacaggagaaaagaatgaatggtgaacagcttcatcaactcgcaatagaggcggcgcgtaatctcccttttagtgagcaaacttatccatttggtccagagtatgaagtttttaaaattttagaaaaaatatttatgctgacagtggaagtgtctggcgtaaaaatgattaatgtcaaatgtgacccttataaaagtcaggaatatcaggaactctatccatttattattcccggctatcacatgaataaaaaacactggatttcgattaaaccgcataaaaatttaacaagcgattttctccgagatttaattggcgactcttatgacttggtcgtaaaaaagcttcctttgaaagatcagaaaagattaaacaaccaataa

SEQ ID NO: 84 - DNA, 321 bp, Acinetobacter baumannii
ctttatgggaaagtcacggaagaagaacttgacgaatacgaattctggtgtgagcttgccctcggaatcggaaccaccatcgaagaagccaagcaaaaaatcagcttaaaagagcttagtatttggaaagcttaccggatgagacgcggctctctttttcttggtcgccgtattgagcaagcaattggtaatttggcagcagtttatatcaggagtcactcaaaaaatcctgagcaaatagatgcactcaattttatgcctcatgaatacaaacaagagcttagtttggccgactatctagaacaattggtagacgaataa

SEQ ID NO: 85 - DNA, 204 bp, Acinetobacter baumannii
gttcaccacctacaatattctttaaacttgccatcaagtcgcgacccacatgcttactacggacagtgcttccgtaaacgacatccagctgctttaaaatttggtggcctggaacactttctaaattacttaataacattgttttttataaaactaaatttcttaagctttcaagataaaaaatattcagatgagttgcaataa

SEQ ID NO: 86 - DNA, 300 bp, Acinetobacter baumannii
gtgaaatttgatcaaacgacaagtgctttatctttaactaagcaacagaagccatcattcttacataataaaaatagcttcaatttgattttagtacttttcattgattctgaatggaatttaaaatacagttccaaacacaacttgcaacaagaacaagctgtattcatgttgacgttattaaaatttattgttttgtcggaaacacatcgttttgccgaaataaagaacaaagaactcttcatgaacatacaaatgattaatatcaattgcttgtttccctgtttaatgcacttttaa

SEQ ID NO: 87 - DNA, 183 bp, Acinetobacter baumannii
aaagaaattgacgatagcatagcacttaagctgacgatgccctatttagttttgattagtcttcgtcatcaagatcatcatcgtctaaatcataatcgaaatcttttaactcacgctctaaacggcgctgtgccaatagatcatcaattaatctacgtttttccaacgattcttttgcactga

SEQ ID NO: 88 - DNA, 312 bp, Acinetobacter baumannii
ttcatgactgaggatgtaaccagattaactccatacttagagtattggagcagtgggatgtatttatttaaatgcccgggctgcaaatacttacatccatttcatgtcgattcacaccctaacggcagcaaatggaattttaatggtgatgttaataaccctactttcacaccgtcattacttgtaaatgatcatcatccagcaagtcgatgtcatttatttttgactaatgggaaaattcaatttttatcagattgtcatcatgagcttgcaggtcaaacggttgatatggtgcctataggagatctttaa

SEQ ID NO: 89 - DNA, 708 bp, Acinetobacter baumannii
aaaggtgatgacatgaatatgcttcgtaaaaccatgtgtgctattacactcagcgcctcagtgcttgctcctgtaatgagtactacagcgttcgctgcacccgtagcagcaccggagcaacaggcaattgggaacctggtaaatcagttatcaggcttacagcgtttgactgccgattttgaacagacaacgaaagcgaatacaaaaactgtagcacagaaaaaaggcttaagtgctcagcatatgaaccagacatttaaaggttcaatgaaagttgaacgtccggggaaattttattgggaaacggtaagtccgtctaagcaaactattgtaacaagtggaaaaacagtctggatttatgaccctgatctacaacaggctgtgcgccaaagcttagatgatcaggtcgctgatacaccggctttattgctctctggtaatactaaccaaatcatgaagtcttaccgagtaactcagccagataaatctaagttatatttcacattattccctaaaaaagaagatggagctttccaaagcttaacgattagttttggtgccaacaaagcacctacactcatggtattgcaagattctttaggtcaaacgacttatgttcgtttcaagaatgttaaagtaaatgcctcaattccagcttcaactttcaattttacgcctccgaaaggtaccgatatcattgatcaataa

SEQ ID NO: 90 - DNA, 549 bp, Acinetobacter baumannii
acgcgcggtgacaccataatgactaaagtaaatattaaagcatttaaaaaggtcactaaaattggtgcgccagttgaaagaacagtcaaatgggttgtggaagtaacagaagataatattgattttcttacctctcaacttaaacgcgaactgactcttggtgaaaaagcagaagtggaagggcaagtttttattaaaaagctagcctttaatgatcttcatgaaatttctaaagcgtatgactgggaaattaatgaagacaatattgctgattcgaaacttaagtcggtaagtgttaagcgtatgcaagcaggtcatttgcttggatcagtttgtgaagatgcaaaaggcacaccgttctttagctctgttcaagacgtacttgattctgaaatcccttttattgagtcgctttatgctgtggccgatgaagtgaataactttatgggaaagtcacggaagaagaacttgacgaatacgaattctggtgtgagcttgccctcggaatcggaaccaccatcgaagaagccaagcaaaaaatcagcttaa

SEQ ID NO: 91 - DNA, 1296 bp, Acinetobacter baumannii
gtttgtttcgacaaacttaggtttttagattccttaaatctattttggtgcaatttacagacccagatttgttccaaaatggaatttagcacttttttcgagcatgctatgcaaaatgtagatctgtttttcttattacttggtgcagttttggttcttgccatgcacgcaggttttgcattcttggaacttggtacagttcgccacaaaaatcaggtgaacgcgcttagtaaaattctgactgactttgccctctccgcaatcgcatatttctttgttggctactacatttcgtatggccagcacttcttccatgaaggtacggttttatccaatgaccatggctataacctcatgcgttgctttttcttactcacttttgctgcggccattcctgccatcatttctggcggtattgcagaacgcgcaaaaatgcgttcacaagcgattgccacactcgcattggttgcactggtttatccgttctttgagggaatggtctggaatggcaactacggtctgcaaaagtggttagaaacaacttttggcgcagcttttcatgactttgcgggttcagtcgtagttcatgccatgggcggttggatagcacttgctgctgtcattttattgggcgcacgttctggccgttataagaaagatggtcgtgtaagtgctcacccaccttcttctattccatttttggcgcttggttcatggattttgattgtaggctggtttggctttaatgtgatgagtgctcagcgtgttgatgcaatctctggtctcgttgcgattaactcacttatggcaatggttggcggtacaattacagcaaatgcgattgggaaaaatgaccctggtttcttacacaacggtccacttgcgggtttagtcgctatttgcgcaggttctgacattgttcatccagtcagtgcacttgtgattggtggtgcagcgggtgccatgttcgtgtatctattcacctatactcaaaacaaactcaaagttgatgacgttcttggtgtctggccgctacatggtgtatgcggtgcatttggtggaattgccgtaggtatttttggtcaaaaatggctaggtggtttaggcggcgtatcattcatctctcagctcatcggtacagcactcgcgattgctattgcactggctggcggtttcattgtttatggcatccttaaagcgaccataggcattcgcctatctcaagaagatgagttccgtggtgcagacttatctattcataagatctcagcaaactctgaagaaggtatgttttaa

SEQ ID NO: 92 - DNA, 540 bp, Acinetobacter baumannii
atggttctcgaacgctacaggagtttagtgatgattattactgatgaaatgctagcagttttagaccagtcatctgggccagtcggcttgcttgaatgtatcgaagtatcacaccctaattggccgcgtgtacttcgatatatcgtgaatggtagtgatccgatggatctaacacatgaggatgggcagacttttacctattcttttgctcccctcaatattacacggagtaatgaagaggagaatttggatcagaaaattacggcagctatcggtgatgtaggatctgaaatccccgacttggttgatcttgttttaaaagactcggttcgaataccccctatattgaattatagagcatatgttatcggcaaatatgacctgccgtgtacatatgctaaagggcttgaagttattgtaattacaagggattggaaaggcactagctttgaggcgcaagctcccggtttgaatgattcaggaaatggggaaatttattcggcaagtacagatcctagtttagagggattttactcatga

SEQ ID NO: 93 - DNA, 726 bp, Acinetobacter baumannii
ttgaacttagaattgaataaaattttaaagagactttttatgggaataagtgctggtggtttagctgtaccatttaatgggacaatggaaaatgcaatagagttagtttcaggttggaagaatagaactattaatgttgttagtttgagtgagcgaacggattttgatacgcgatatgataattgtataagtttaaagatttttaataatgtattgataatttatcatgcagattttttattttctgcaatggatgatcactcattatgggcaaagcgatttaaagaaagtaatttaacagaatgggtattattttttgctgcttatgatagtggtggtacatatggatattcattttttcagtatgggaagtttgtacgctcggtttttcagatggtcgatgattttaaaatagaaggtaggttatctgaattagagcaaaaaattataaactcacctgtattttttgaatattttaatgaggaagatgaatcagaatatttagatcttgaaggacttaaagctaatgatttattagatgcgaacggtgatattcaagaatgggcagattgttataaatgttattattttgaggatgaatatgttgctgagcatgacttagcttctagatttttatccgaaatggtaaccgaatatgtaggatgtgattttttttacgatactgagtacgaccaaatctatttagaagttattcaagattattaa

SEQ ID NO: 94 - DNA, 195 bp, Acinetobacter baumannii
atgagtagagaagaattaatttattgtatcgaaaaatttatagataaaaatgatatctctatcaagaatacacaaagaatagaagttcttcttgatgacttaaattcagaggaagagataatagagagtatgtttctaattctagcgttatatgtcctaaaggtgatgagtacttgtatggtgaagatgaagtga

SEQ ID NO: 95 - DNA, 321 bp, Acinetobacter baumannii
ccccttatttggggctttttattgcctaaattctggagaaataaaatgtctgaaactcagtctgcattcggggttggtgcagcaacaataacgcaaaaagtaacagcaactactggtgtggggtcatttatcggatttatagccaaaattgatgttattgcatggggtggtttggtaattgctgcacttggtttggctgtacagctttattttgcttgggcgcgtaatcgccgtgagaaggtagagcataagctaagaaaggcagagtacgagttacgtattcaaaagttaaaaggtgactgtaatgtcaaacaagactaa

SEQ ID NO: 96 - DNA, 264 bp, Acinetobacter baumannii
ttgctcatttgtactttttttcacccaaaaaattgtgtatttataaaacagaacaatcttttgataagcgaagatttctacaaatttttctatgatttaaccttgaaaaaaatgattttagcccaatattcaaaaaatagtcgtgaattcaaagatattttttatttaacggtcaccgatcaaagcccaaacatttcaagcaaattgtgctatcatgcacggtttttcactgccacagattcaacaaagagtaagcaaagatga

SEQ ID NO: 97 - DNA, 1428 bp, Acinetobacter baumannii
gagcgaagctgggtaaagattttattcgaaccatccgaggactgggctaccgtttggggcaatcataatttaaaatttcgggacttcataaaagtgcattattcattaaaaaaacgactgatttggggcacctcaattttcagtgtcatcttaggttgtattttaatttttagtgcttacaaggttgcacttcaagaagtcgatgaaattctagatactcaaatgaagtatttagcggaaagaacagctgagcaccctttaaaaactgtaagcagtaagttcgattttcataaaacttaccacgaagaagatctgtttatcgatatttgggcttataaggatcaggctcatttgtctcatcatttacatttgctggttccacctgttgagcaagcgggattttattctcataaaaccgctcaaggtatagtcagaacttatgttttacctttgaaggattaccagattcaggtcagccagcaagagagggttcgtgaagctttcgcttgggagcttgcgggcagtatgtttattccgtatttaattattttaccttttgcaatatttgctttagcagccattattcgtcgtggtttaaaaccaatagatgattttaaaaatgagttaaaagaacgcgattccgaagaactcaccccaattgaagtacatgattatcctcaagagcttttacctactattgacgaaatgaaccgtctttttgagcgaatttctaaagctcaaaatgaacagaagcaatttattgccgatgctgctcatgaactacgaacacctgtgactgcattgaacttacaaaccaagattttgctaagtcagttccctgagcatgaatcattgcaaaacttaagcaaaggtttggcacgtattcagcatttggtgactcagcttttagcattggcaaagcaagatgtaactttaagtatggtcgagcctactggatattttcaactcaatgatgtggcattaaattgtgtggagcagttggttaacttggctatgcaaaaagaaatcgatttaggttttgttagaaatgaacccatcgaaatgcatagtattgaacctactgtacattcgattatttttaatttaattgataatgcaattaagtacaccccgcatcagggtgttattaatatttcagtttataccgatcaagatcactacgcatgtattcaaattgaagatagcggtgcaggaatagaccctgaaaattacgataaagtccttaagcgtttttatcgcgtgcatcaccatcttgaggtgggaagtggtctaggtttatctattgtagatcgtgcaactcaaaggcttggtgggactttaactctcgataagagcttagagcttggcggtctttctgtattagtgaaattacctaaagtcttacatttacatgaaacaagagcgtga

SEQ ID NO: 98 - DNA, 381 bp, Acinetobacter baumannii
atgaatgaatgtctaaaatataatatttttcaacaacattgccctgctcgactgttttttgaaaaaattgcagacaaatgggttttactcatcttaaatattcttgagcatgaaactcagcacttcaacttacttaaaaaaaatattgaagggatttcacctaaagtcttgtctcagaagttaaaaatgttagagagagacggttttatcgaacgaaaaattcaggatacttcccctattcgtgtcgattattccctcacgccacttgggcaaaatgtagctgctatggcgtatcagttaaaagagtgggctgaaactaatattgagcaagttttagcagcccaaatcatctatgacgaaaaaatactagatcaagcttaa

SEQ ID NO: 99 - DNA, 1086 bp, Acinetobacter baumannii
cttaaagaatgctggctaccttcctcatataattattgctacacttttttctttttcgggtggatgagtatgtcctttgatctcaaagtgagcttgcagcaaaggtctgaaccatctgcacagcagaaaaaactgaatcgcctgattgataaaatagaacagcaaaaagttagcttgagcacatggcaaaatgcacaagctgagattcaacagcacatacgacaaaaactgatgcctgtgtataacgatttacatatagtgctatttcagcagttagagcaactttggaatatattgcatagccatgagttttctaaagcggatatacaacaattcgatgaaaaaattgctcagcttgcacaaatgttgaagcgctccaaaatgctatctgctgaacagttggagctagtgaagcagatcgatactttttatcagcagcatgcaggggaatcggtaaaaaagaataaaaaagctcagccaatagaatttgaatatgaagaaaatgctgataaaggttcagagtttgaagaagaatttgaaaagtacgctgctgagcaacaacaagcgcgggaacaagccaaacagcaaagacagcaacagaaacgtgaacaagccgagcaaatggcagcgcagtcacttaaaacagtctatttaaaaattgccgcgatgattcacccagaccgtgagcaagatgaaaccaaaaaagaagaaaaaactgagttgttccaacaagcaagtcaggcctacgaaaagcaggatttgttttacttactcaaactccagttacagcttgaacagaataaagggctaggcgctaaagaattatctgccgaacagttgcgattttataaacttgctttggatgcacaaagtcagcagcttgaaagccaaattactgagattttggattcttttcagttagccaaaaatgtaaaagcagagcatgtacatattagtgatgtctataaagctgtagatgctgactgtgctgagttaaagcagcaggtgaagtgggaaaaggaacgcttaaagcatatgaaaaaagagagtggggtagagatgttgttgggacatggggttctataa

SEQ ID NO: 100 - DNA, 1062 bp, Acinetobacter baumannii
tatcaattgcttgtttccctgtttaatgcacttttaattgatacactaacgccacttatctaccaatacggggtttttcttcatatggtcatcgattttaagcaagacattctcgctcctgttgctacagactttgctgcgatggatcacttgattaatgaaggaattagctcaaaagtcggcttggtcatgtcagtgagtaaacatgtagttgaagctggcggcaaacgtatgcgcccaatcatgtgtttacttgcagcacgcgcttgcggcctcgacaatatgcaaaatgcacagcgtctggcagctattattgaaatgcttcataccgcaactttagtgcatgatgatgtagttgatgaatctggacttcgccgtggtcgtcctactgcaaatgcaacatggaacaatcaaacggccgtattggttggtgacttccttattgcccgcgcttttgaccttttggttgatttaaacaacatgaccttattaaaagacttctcaacagggacatgtgaaattgctgaaggtgaggtattacagctccaatctcagcatcaaccggatacaaccgaagaaacatatttaaaaattattcatgggaaaacttctcgtttatttgaacttgcaaccgaaggtgcggctattttggctgggcaagaagcttaccgcgaacctttaagattatttgcaggccatttcggaaatgcattccagattattgacgatattttagactatacttcagatgctgaaacattaggtaaaaatattggtgatgatttaatggaaggtaaaccgactttaccgttaatttcagcattagcacattcaatcggtgaagagcatgccattatcagacgcagtattgcgactggtggtgttgaccaattacctaaagtgattgaaattgtgcaaaagtctggtgctttagactattgccagcgccgtgcccaagaagaaacagaagcagcactgcaagccttatcaatcttgcctgatacaccttatcgtcaagcgttgattaatttaactcggcttgcattacatcgaatacagtag

SEQ ID NO: 101 - DNA, 1242 bp, Acinetobacter baumannii
acaagtctgcttgttttgagatataaaaacacaatagtaaggataacagttgatatgagcttcgtaccgcaaattaaaattccagcaacttacatgcgtggtggaaccagtaaaggtgtattctttaaacttgatgatttgccggaaaaagctcaagttgcaggtcaagcaagagatcaactcttgctacgtgtcattggtagcccagacccttatggaaaacaaattgatggaatgggtggagcgacctcgagtaccagtaaaaccgttattctcgctaaaagtacacagccagatcatgatgtcgactatttgtttgggcaggtttcaattgatcaagcttttgtagattggagtggtaactgcggtaatttgacagctgcggttggttcatttgcgatttcaaatggtttggttgatgccgatcgtattcctgaaaatggcctctgtactgttcgaatttggcaaaaaaatattcaaaaaactattattgcgcatgtacctatcaccaatggccaggttcaagaaaccggagactttgaactagatggggtaactttccctgctgctgaagttcaaattgagtttttagaccctgccgatgatggtgaagagggcggtgatatgttcccgacagggaatgttgttgaccaattagatgttccagagattggtagttttcaagccacatttattaatgctggtattccaaccattttcttaaatgcagaagatttaggctacgaaggtactgaattacaagatcatattaatggtgatgcagcagcattagcacgttttgaaaaaattcgtgcctatggtgcagttcagatgggcttaattaaagatatttcagaagcagccgcacgtcagcacacaccaaaaattgcttttgtctctaaaccaaaaaattacacagcttcaagcggtaaaaacgtttcagagaacgatgtcgacttactcgttcgagctttgtcgatgggcaaacttcaccatgccatgatgggaacagcagcggtagcaattggtacagcggctgcgattccaggcactttagtaaatttagcggctggtggtggagaacgtgaagcagtacgttttggacatccatctggaacattacgtgttggtgcccaagctgaacttacaaatggccaatgggtggtgaaaaaagccattatgagtcgtagtgcgcgtgtgttaatggaaggttgggtacgcgttccgggtgacagtttctaa

SEQ ID NO: 102 - DNA, 189 bp, Acinetobacter baumannii
tttgcggtacgaagctcatatcaactgttatccttactattgtgtttttatatctcaaaacaagcagacttgtttagtcattcgcttcatcttaaatcgttttatgatcaagagatagcactctacttttatacatcaatcgtattgacgcgggtttattttggaaatttcaattcatgcctgcaatga

SEQ ID NO: 103 - DNA, 840 bp, Acinetobacter baumannii
tggggtaaacgaaatgtattacctagagccgactttaaatcagaaaagcacgggttttcattgccccttgcgctggatcgctggaatccagcaataaaagctgcagacgaaagtgataatacaattagcatcatggatcccattggttatgactggtggactgaaacaggcgttactgcaaaacgaattagtgcggctctccggtccttgaatggtgctgatgttgttgtgaatatcaactcccccggcggtgatgtttttgagggtttaacaatttataacctgcttcgcgaatatgaaggacatgtcacggttcgagttcttgggcttgctgcttctgctgcctcgtttattgctatggctgcagatgagattcagatcgcacgagcgggcttttttatgattcacaatgcgtggacaggggtttggggcaatcgcaacgatatgcgcgaaacagccgactttcttgagcaaattgacgagactattgcggacatttacagcattcgcacaggtttatctattgatgagttaaaagctcaaatggataaggaatcttggattaatggcaagaattctgtagagcaaggatttgcagatagttaccttgactctgatgttgttgaggaaagcactacaaactctacaaaagaccgcattgcggctcacaagatcgacttaattatggcgaaggctggaataagtcgaagtgaacgccgtgacctaatgaaagattttaagggcacgccaagcgctgccaaagagcagactacgccaagcgctagtcttgatttatctggcttaataaaagacatgcaagacgctgctcgaaaattctaa

SEQ ID NO: 104 - DNA, 693 bp, Acinetobacter baumannii
aaagggatgcgacacatgagctacaaagtttttttaaagatttccgattcaacctatacccaatttgcttcaattcgagagaaattacatgctggggtaagagaaagccagtcgaaagtattgggggatgttctttccgatttgtcttgtgaaattattgagcaagttttctctgtattgttaaaggatgagcaagacaactctactatgactcaaaaacagcgatatgagtccgagaaagttcttcagcaaattttagatactttccgaaaatatatgccttggtcagtctcttttttcggtaatgaaagacttttacctttagttgattatatgacctcactcatgaaagaacgtgagcaagatgtttatattacatacccgatcacccctcaacttgtacaacaggcccaaacactgacggaacaaatacgtgagggcaatatgcaaagcgtagaaaaagcttttcagaccttaattcaaattgtggatttaggtgtaacaagcctagtacgtgaacctaaaaaacgtttaaaatttaatttggttgtcgataaaaccctaaatggggtcattaatatgacaacgcatttgggctataaacgtttggaaaaattggggacgcaggttgatcaaacgaccgcaactcactatatcaaccactttttggccttcatgcatcaagcagcataa

SEQ ID NO: 105 - DNA, 462 bp, Acinetobacter baumannii
caatgccagctttccttggaattaattcaacaaactccggtcggagtttctacctacaggatgcccgctgtgaaaagcaacagacctgtcaatttgtccatgggtcaggtgttagcggtaaatttacgctcacccgtggctattgcatcaattttacaccgtttatcaggtgtcatcgttttcttattagtaccagttctcttatggattctagataaatcattatcttcaccagaaggatttgactacgttaaaaatgtcgtttttggaaatatcctcgtacgttttgttgtgtgggtatttgtagccggcttgattttccactttattgctggggttaagcatttgcttgcagatctaggttttgctgaagaactgcaaagcggtcgtattgcagcgacaatttcattgatcttatctgtggtagccattatcgcagcctttgtatggattatgttctaa

SEQ ID NO: 106 - DNA, 711 bp, Acinetobacter baumannii
tattgcatcagaatgactaatcaaaaactttttttccaaattaatattctctttctttttttctgttttattattcttctatttgtatttccagtcggtgggaaaattgatatgtacctcatccaaccttggattgattcaacaggtcattttttcaatcgggacaattggtatcttgaaaggcttaatcatgaaattgtaaaacaaatcatcaccgccgtttatgttatcttttttggtttatggcttgcgtcatttaaattaaaaaaattaaaaccttatcgctggcaatatggctatatgttttttgtcagtatgctcggtagcagtatagttggcctaataaagtcacaatctgctcacgcctgcccttggaatatggttcaccctaatactttaggaagctatatttgggactttagcgctaaacatggccattgttttccaggcggtcatgcaagtgcaggttttattttaatgacaggttattttgtttatcgtcttgaacaacctaaacgtgcttacttttatttattctccggtattttattaggtttcatgatgggttgggcgcaaatgatgcgaggagcacatttcctaagccataacttatggacaggctgggtcgtttgggcaataaatattttattttatgcgatttgtattcatcgttttgagttcgaaaaacaagtgaaacaagagcttacgtaa

SEQ ID NO: 107 - DNA, 354 bp, Acinetobacter baumannii
caaatgtccagaccctgccgagaattcggatgcacaaacttagttaagtccgctagtcagaaaggctattgtgatgatcatgcacataagcgaagtggttggggtaaacagcaagaccgaacaggatcaacaaccgagcgtggttatggtcatgcatggcgtaagttacgcgaaagtatattagagcgtgacggctatctatgcgtgcactgccgcgccgttggtcgtgtatcaccagcaacagacgttgaccatatcaaggctaaagcttttggtggtactgatgatccagacaacctacaaagcctttgtggtacttgtcataaagagaagacagcaaaggagagtggctaa

SEQ ID NO: 108 - DNA, 225 bp, Acinetobacter baumannii
agcatgaggctacccatagttgaagctattattatgttagtgatagtcctatgttttatatttcttggttttcaaatctggaaagaatttacgagtcaaaaaattgaattaaataaagacgaatggatctgctcaaaaagcgaggtatctgttcagaatattatgattggtggaaagttaatgcctcaagccatcaataaatgcgtggaatacaaactcaggtaa

SEQ ID NO: 109 - DNA, 927 bp, Acinetobacter baumannii
gaaatggcaagtggcttacttttactactagatgatattgcaacaattttagatgacgtcgccttaatgagcaaaatggcagcaaaaaaaactgctggtgttttaggtgatgatttggctttaaatgcacaacaggttacaggtgtccgtgctgatcgcgaattaccgattgtgtggaaagttgctaaaggctcctttgttaataagctcattttagttcctctagctttattaatcagtgtgattgctccttggttgattaatcctttattaatgcttggcgggttattcttatgttatgagggtgttgaaaaagttcttcataccattacacataaaaaagcctcaacctcagaagaagcacaaaaagagtttgatagtgaagagttagacttggcaacttttgaaaaagataaagtgaaaggagctattcgtacagactttattttgtcagctgaaattgtggttatttctttaggtactgtggcaactgcaactttaatgactaaagttagtgtcctcagcattattgcagttgtgatgacgatcggcgtttatggtttggtcggcatgattgttaagattgatgacttgggtctatatttaacaaaacaggctgcttcttttaaacaaactattggtcgagggctgcttgcatttgcgccacttttaatgaagttattgtctatcgtcggcactattgcgatgtttttggtaggtggagggattattaatcatacgattcctttactccatcatgtcactgaaaatacagttgaccatgtggaaactatacctgctgtaggcaacatcattggtgctttaaccccaacgcttattaactttgcaataggaattgttgctggtgcaatagtattgcttgttgttagcttgatacaaaaaatgtggccaaaagcttctagttaa

SEQ ID NO: 110 - DNA, 1296 bp, Acinetobacter baumannii
cccagaagaagggtgttcatgggtaattttttcttattacaagcatttacggttgtatttgccttatcaattgcgaccaccatatttaataagcgtattttgggctttcctcaggctatcggtgtacctcttgtttctgcgatttttgtcttcattttgcaatggggagccagtcttttaaatggtaatcaattcattactatcaatattcataatattgaggaagcagtacgtcatatcgatttctatgattttttaattaatggtgttatttgctttattctgacgtcttcagcacttaaatttaaaatttcagatctaagaagctattggaaacagattagtattttggccactattgccttggtaatctgcgctgtattgtttggtagcttactttacggtttccaattgttagttgggcatcatgtaccaattttggttcttctattattaggtgcggcattgggtgcaacagacccgatcggtattaaaggtgttttaagttcaattcgtgctcctcatcatctcattgttaaattagaaggagaatctttatttaacgatgcgatgtgtattgccttatttatgacattactgaatgttttacagggtgaacatttttcattggttgcgacattagaagctttgctttatgaaattgtggtagctgttggtattgggtgggcatttgggataggtaccttacgcttattgcgtggtaaacacgaaatggaatccctgattttaacaactgccttacttgcaagcggagcatatttggtggctctattcgcccatgcttccgcaccgattgcctgtgtaattggtggtttaatcgtcggtaataaatggaaagaaattcgtgaagagcgtgagatcagagaggttaaccatttttggcatacagtagaagggattatcaattcattcttatttaccttaattggccttgagttatttattcttgatttaaactttagcctgattttaggtggaatagttgctttctttattctgcatatttctcgttttgcagcaaactttatgtcttttgctttcttcccaacaatgcgtaagaccaaaagttacaatggtagtttaactattttatcttggggtggtgttcgaggagggatttcactcgctttaatattggcggtcgcgaatattcggccgctgagtctttatagtagtattctgattgaatataccttatttagcgtattgttatctggtttagtgtgtggacttggccttccatgcggtaatgaatgcgttttattacaatcctaa

SEQ ID NO: 111 - DNA, 531 bp, Acinetobacter baumannii
cacacaatgagtgcattagatttagaccaattaagtgaatatctagatggagaccacaatgagtatggtctagactttgctgcaactcatggatttttgtgtgcaattgcagtaggccctcagtttgaccgttggttagatgaattgttcgaaggtaaccagaaaaaggttccggctgaaattattcaacaaatcaaggtttggctagagtcgattcgtcaagatttagcaaatgaaaatgggattgaatttccatttgaagttgaagaagctgacgttgaatcaagcctaggcgattggagtgtagggtttgttgatgcaatgttcttaaacgaagaggcgtggtttgctcctgagtacgaagaacaattggttgatttaactttaccgattatggtttttagtggaattgatgaagaagatccacagatggaatctttccgtcgcaatggacagttaatggatgaactggcagaagaaatcccagataatttgaatgagttatatttgatgtaccatactccaaattaa

SEQ ID NO: 112 - DNA, 1893 bp, Acinetobacter baumannii
gcaaagatgagcgatatgcattcccctacttctcaagtagcggctctgattagccgaggcaaagaacaaggttacttaacttacgctgaggttaacgatcatctgccggactcgattactgaaagcgaacagattgaagacatcatccagatgcttcaagacgttggtattcctgtacacgagcgtgcacctgaatctgacgataccatgttcggcgaatcagctgatgcaactgatgaagttgctgaagaagaagctgctgccgtacttgcatctgttgaaaatgagcctggacgtacgacagaccctgtacgtatgtacatgcgtgaaatgggtacagtagaactgttaacccgtgaaggtgaaatcagcattgctaaacgtattgaagaaggcattcgtgatgtcttgaactcaatcgcttactggccaaatgctgttgaagttgtattaaaagaatataatgattttttaactggcgaacgccgtcttgccgatatcttatctggttatttagaccctgaaactgatgaagatattcctgaagttttagaagatgttgaagagcttgaggaagaagacgaatcatctacaaagtcaacgaaagaagttaagcttgatgatgacgatgaagaagaagagtctgaaggtgatgatgattctgaaggtgattcaggtccagaccctgaagttgcaaaagttcgttttgctgaattagaagctgcatgggctcaaactaaagctgtcatcgaaaaacatggccgtaatagccctgaagcaaatgaagctcttgagtctttagcaactgtatttatgatgtttaaatttactccacgtttatttgacatcatttcagaaatgattcgcggaactcatgaacaaattcgtgccaatgaacgtgaaattatgcgttatgcagtacgtcgtggtcgtatggatcgtaaccagttccgtacatctttcccgaaacaggaatctaatcctgcttggttagatgaacaaattgctaaagctccagctgaaatcaaggctcacttggaaaaagttcgtcctgatgttttagccttccagcaaaaaattgcagatatcgaaaaagagcttggcctaaacgttagtgaaattaaagatatttctaaacgtatggcaattggtgaagccaaagctcgtcgtgcgaaaaaagaaatggtagaggccaaccttcgtttggtaatttcgattgcgaaaaaatataccaaccgtggtttacagttccttgacttgattcaagaagggaacattggtttgatgaaagccgtagacaagtttgaatatcgtcgtggttataaattctcgacttatgcgacttggtggattcgtcaggcaattacccgttctattgccgatcaggcccgtacaattcgtattcctgtacacatgattgaaacgattaacaaaattaaccgtgtatcgcgtcaattattacaggaaatgggccgtgaacctactcctgaagagttaggcgaacgcttagaaatggatgaggttaaagttcgtaaagttcttaaaattgcgaaagagccaatttcaatggaaactccaatcggtgatgatgaagattcgcatcttggcgatttcattgaagaccagaacatcacttctccaattgatgctgcgacttcagaaggcttaaaagaagcaactcgtgaagttttagaaaacttaactgaacgtgaagcaaaagtattgaagatgcgttttggtattgatatgccaaccgatcatactttagaagaagtaggtaagcagtttgatgtaacacgtgagcgtattcgtcagattgaagcgaaagcattgcgtaaattacgtcacccttctcgttctgaacacttgcgttctttcctagagaatgactaa

SEQ ID NO: 113 - DNA, 1218 bp, Acinetobacter baumannii
acaatcaggagattctcaataatggcaaccgaaattaaagcaccggtattcccagagtctgttgcagatggaaccatcgcaacttggcataaaaaggtgggtgaacctgtatcacgtgatgaagtaatctgtgatattgaaaccgacaaagttgttttagaagttgttgctcctgcagatggtagcttggttgcaatcattaaaggtgaaggcgatacagttctttctgacgaagttattgctcaattcgaagctggtgctggcgcagcggctgctgctcctgcggctgtagaacaagcagttgctcagactcaagctggtgctgctcctgttgttgagcgtaatgaagctgtatctgatcaagctcctgcggtacgtaaagcgttaactgaatctggtattgctgcttctgacgtacaaggtactggtcgtggtggtcgtatcactaaagaagatgttgcgaaccatcaagctaaaccagctgctaacgttactccattaagcgttgctgttggcgagcgtatcgaaaaacgcgttccaatgactcgtttacgtaaacgtgtagctgagcgtcttcttgcggctactcaagaaacagcaatgttaactacatttaacgaagttaacatgaagccaatcatggaattacgtaagcaatataaagatgctttcgaaaaacgtcatggtgctcgtttaggcttcatgtcattcttcgttaaagcagcaactgaagcgcttaaacgctacccagctgtaaatgcttcaattgatggcgatgatatcgtttatcacggttactatgacatcggtgttgcagtatcttctgatcgtggtcttgttgtaccagtattacgtgatactgaccgtatgagctatgcagaagttgaagcaggtattgctgcttacgctgctaaagcacgtgatggtaaattatctatcgaagaaatgactggcggtactttcacaatcactaacggtggtactttcggttcattactttcaactccaattttgaaccagccgcaaactggtatcttgggtatgcataaaatccaagaacgtcctatggcggtaaatggtcaagttgaaatcttgccaatgatgtacttagcgctttcttatgaccaccgtatgatcgatggtaaagaagctgtaggtttcttagtagcaatcaaagaattgttagaagaaccagctaaactcattcttgatctttaa

SEQ ID NO: 114 - DNA, 222 bp, Acinetobacter baumannii
aaggtgaggagcctaagagtggaagataacaaaacattagcagaagtggctctggaacttattaagcaaaatactgagttagttaagcagacaaacaagctgatagagcaaaacacaataatcatgcaaatcaatgctgaacaatcagcgcagcttagcgaggtgctcgcaatgtttgatgatgttgagccaccacaaaaagctaagtctttggatgggtga

SEQ ID NO: 115 - DNA, 2280 bp, Acinetobacter baumannii
  unsure (2238): Identity of nucleotide sequences at the above locations are unknown.
atggctgctggttcattaggtcgtttaacacttgatctggttgcgaaagttggttcatttgttgagggaatgagtcaggcagaaagaaaggcaaaagaagcttctgacaacataaagaagtcttttaaaagctttggtgatcagatacaagatgcaattggtggtactcaaattggttccgcaattgagggtattactggcaaattaggtgctttgcgtggtggtgtcttggtagctggtgctgcattagctggtatggcagtaggtggtacagttttggcagctggtgcactaggtcaaatggcgattgagctagcaaaagccgatgctcaacttaaccagttatcacgtagagcggtaacttctgccgaaaacttccagattgtggcgggggcagcaagtgcatttggtgttgagcaggaaaagctaagtgatattttagccgatacctcagaaaagcttggcgaatacacatcaacaaaaggtggtggcgcaaaggacttttttgaaatgctggccaacaacaccaagatgtcagcaaaagaaattgatgagtttgctaaaaaactatcaacaatggacacggtagatgcattaggccaaatcaccacaaagcttgatgacatgggagcaactgcagctgaaaagcgctttgtgctagagtcattagcgagtgatttgggtgatttagccccattatttgcaaacaactctgaattaattaaagagtatggcgatcagttgcacgaggctggcgttgttcgcacgcaagagagtattgataagtcacttgttttaaatgctcaaactcaagccttaggcacacaatttcagggattcaaaaaccagctagcgagtcagatgactcctgtcttgagtaatttgattcaatattttgtagatggcgctgtaaaaagcggaagctttggaactgttttaagtgctgttggtacggttgctaaagtggtgggcattgctattgttggagttgcaagtgcggtttcagtggtcattcagtcaattagtggttttgcaagtctaattgaccatgtgggcaatgttgcagcaaggttagatgctgctacttcgataaaggagcaaattaacgtccttaagactggttttagcgaagggaaggccatttgggttgatactgcctctgggattgacaagacaatcaccagcacgattaaccttgtaagcaatattaaaacaggagctatgcctgctttaacaggcttatctgctgcacagttaaaagtcaatcaagcaaatttggccaattcaaaaagtaccattacagacacagaaacagctaaagaaaatgccaaagccaaagaggagcaagcaaaggcagcagctaaggctgctaaagcgcagcaagatcttaacaaaatggttggggcatctgctttaagtggtttacggatcaaaggtgcagaatctattgctggtggtcaggttagagcatacacagcaagctttgctcaactaacacaatccgcattaggcaagggtctgaacagatttactgcattcaatgacctttatcacaaagggacaaatagcaagcacgcaacaggtaatgcatttgacttcacgctagatgatgcgaaaaagtctggtgaggctgttacacaacttgagcaaatggctaaaagatacggctttgtcattcgcgttcttgatgagtacaagaagaagtctgctcgtgcaaccggggggcatattcatgtatctgtgcttggctacaaaggcacagcagatgcattaaaagatgcaaatgcagagcttgatattgttcagaaagcaaatgatgaagctacaaaaattcaggaagagcgacaaaaacagcagcttgctatcactgctaaatacgcaacccctgaacaaaaacttgcattggacaatgctgaagcaattaaacaaatcaagttggcatatgctaatgatccagttgctgccgaagtttttttaaatcttcaagcgaaggcttatcaaaaagatttagaggaatatcgtacagcacagaatcagaagctcataagtgctactgaaactgcagctcaggcggctgaaaagtggaatagcaactttgcagatatggctgggttttcgcctttatatggattgcagcaagagaaaagcagcagatacgaagaatcatttgcagtttttgattcacaatcagctatgcttgatcaacaagagcaagaaccaaatgctgacttagagtcnattgcagagcaacgtgaatctctatggcagcaggcatactga

SEQ ID NO: 116 - DNA, 1362 bp, Acinetobacter baumannii
tccaattatggtgggtgtatgaataagaaaccaaaccgcttagccagagcggctaaggcggctttgcggtttctggggctaaatggtcaatttagcttaacccctgatgtgctccagaatttacagagcacagcaagcggaaagtttgtcacggtagattcggcgcttcaattgagcgccgtttttgcatgtgtaagacttgtatcggaaaccgtctcaactttgcccttaaaactttataaggcaaatcctgatggcagcagtacattagcaaaagaacatccgctgtataacgtgttatgtagttcaccaaactatgaaatgacacaaagccggttcctactttttatcgtagcaagcattgttttatggggtaattcctatactgaaattatccgaagtgcaaatggtagaaggattgtttcattagatccattattgcctcaaaacatgcaggttataagaaataaagtaagtggcgctttagagtatttttataccgttgatggtgttcgccgtcagataaatgaaaaagacattatgcacattagaagcttcggcattgatggtgtaatggggatttttaccatttccaaaggtcgcgagacatttgggacggcaatgtcagccgagcaaacagcggccaagttttttgaaaatgggctacaaacttctggctttttgagcaccgataaaaccaatactccagaacaaagacagcaactcaagaaaaacattgaaagctttatgggttctaaaaatgccggaaaggtcatggttcttgaaaatggctattcatataacggcattactatgaatccagaagcggctcagatgctagaaactcgcagttttgagattgaggagatttgtcgctggttccgtgttccacctttcatgattggtcatctcgacaagcaaagctcttgggcggcctctgctgaggctcaagatttacagttcttaaaatattcattacgtccgctgctggtgaatattgaacaagaaatttctcgttgcttaattggccgcctagagagtgaggtttactttgttagcttcaatattgaaggcttattgagagcggatagtaaaacgcgttctgagtattacgcctcagccgcagatcatggctggatgaatcgaaatgaaattcgtgcaaaagagaatttgccaccaattccgggtggggatatctacacaatccaatctgcattaataccacttgaccaagtgggaacaaattataaaaaagggatgactgatggggtaaacgaaatgtattacctagagccgactttaaatcagaaaagcacgggttttcattgccccttgcgctggatcgctggaatccagcaataa

SEQ ID NO: 117 - DNA, 516 bp, Acinetobacter baumannii
aaagtatatggtttatttaaggagtctgttttgagtagtgatcatcgaatgctctctctcaccccatgtgcagggcgttgttcaacagtttttggtgatcaggtatgtcgtggttgtcgccgctttaaccatgaagtaattcaatggaatacctatacggcagagcagcgtttagctgtctggaagcgtttagatgatcaattggatcagattttggtacctatgttgccgcaggcgaatctacagcatgtagaaggatttatattaggtaaacgtgtcaggttaatggaaggggcgagtaaagggcgtaaactctaccatgccttaaaaatatgtgaaaagaataagcatttagctcatgagagtggtttggggatttcagaagcgcaagttaaagaagtatggactgagtttgaaagacgtattttagctttggctaaagcgagttatgagttggcttggctaagagctgatgggattagtcatcacttattaaatatgtttgaagaagaataa

SEQ ID NO: 118 - DNA, 402 bp, Acinetobacter baumannii
actcagcgtggttttaggtgcagcttaatgattgatattccaatatttaaaatagctaaagctgacccagccgtgagatctcttcttgaaagtgacaatattttgcgggtttggcgttttgggaaggctccagagcagccagaaacaccctatgtcacatggcagatcataacaggtgaaccaaataacaatcttgattcaagaccggactctgacaatgcagtgattcaaatagatgtttatgcaactgatgaggatgttgtggagcaggtcgcagaatctcttcaattcgcaattgagctagattgctacattgttcgttatggggaggttgataatgaccctataacaaatatgcctcattactcatttgatgttagttgggttgtgaataggagttga

SEQ ID NO: 119 - DNA, 960 bp, Acinetobacter baumannii
gtaagccaaggtagttcccaaactagcaagcctcaacaacactcgagtaaagaaatgaatagcattgttttatctctttttcctttagttgcactaattgcatcgggatacttatttaaaaaatatcatttttttagcgatgagttttgggctggggcagagaagttgaattactatattctatttcctgctttgcttttcagtacgctatcgaccgcgaaaattgacttacaaagcttgagtgcagccattattgtgatgttgattgtggttttggcagtcaccgcctttttatacatcctccgaatgttttggcagatagcgcctgcacgttttggtgtgcatgtacaaagtatggttcgctttaatacctatattggtttggctttagtgacttcgctttttaaaagtgaaggaatggcaatactggcaattttattggcgctttgcattccgcttgtgaatgttatttcggtgctcgctctcacctctaaagaacacatggcaattaaacctgttttgattgcacttcttaaaaacccgttgattgcatcatgtgtggtcggggcagcagttaatgcgcttcatatccctatttgggaaggctttactcagtttattaagcttttttcagtgtcgagtttgccactagggttgttatgtgttggcgcagctttacagtttttgcaaattaaaaaagacattgtggtattggcagcagacacgtttgcacgacttttagcagtgcctgctttggcttatatggtttgcatgtggtttagtttaccaagcttgcaaactcaaattttagtcattttctttgcgctaccgactgcttccgcttcctacattttaaccaaggttctgggtggcgatagtcagctcatggcagccgtaattagctttcaaaccttatgtgctgccgtgactttaccattagtgatttggtggctttcttaa

SEQ ID NO: 120 - DNA, 645 bp, Acinetobacter baumannii
ataagcaaaggtgtgtttatgccctatctattgctttgtattggttgcgtttttttaggattaggtgttcttggtctttttgtaccaagtcttcaatctttggacttgctcaccgttcaaacattgagtcaccatcgtttagattatcttaatagtataaccacctttcttgcacgcgtaggcggcatgccttttgtatgttttttatcctttctagtatgtatatatttagcatggtataaaaaatatattactgttattttcattagcttgggagttattggcagtatcaccatgggttggctgctcaagtggtgtgttaaccggcctagacctcctgaggcatatcatattgttgaaagttacggtgcatcgttcccaagtgcacatagtgtttatgcatcaacactggcttgtctggcaatgattatgttatgccataagcacaacattaactctccttatattgttttgatctcctgtctttggtttgtgtgtatggggctttcaagaatatatgcaggagttcatttcccaacagacgtactcgctggttggggcattggttttatttggattgcactgctttggctctggttattacaaacacaaagtaggttaagtagaaaacaaatatatttttag

SEQ ID NO: 121 - DNA, 405 bp, Acinetobacter baumannii
gcaagagaggggaaaccctctcttttttggagtagtaaacgcatgaaagttaaatttcttgatgtaatccagatgggtactcacctttataaatctggtgaggttggtgagttctcaagtcaaacggccgaagagcttattaaaaaaggtttagctgttttagatgatggcattgaaactgccggaaccacaccagatcaaaagccaaaaactggtaagggtggcaaaggtagtaaaggtaaaaatgcagagccaccaaaaaatgaaaacggtgctgatggtgaagaaaacaaaggttcgggtgttgaggccaatgattcaactaaagaaaccaatggttcagaagataaaaataaatctgatgaaaacacccaaacaccaagcgaagacacgaaaccagaataa

SEQ ID NO: 122 - DNA, 912 bp, Acinetobacter baumannii
agcgtaaggggagtatcaatcatgagcgtattaattaataaagacactaaagtattggtacaaggttttactggtaaaaacggtactttccactctgcacaagctttagactacggtacaaaagttgttggtggtgttactccaggtaaaggtggtacaactcaccttgacttaccagtattcaacacaatgaaagaagctgtacgtgaaacaaatgcagatgcatctgtaatctatgtaccagctccattcgttttagactcaatcgttgaagcggttgattcaggagttggcctaatcgttgtgatcactgaaggtgttccaacaatcgacatgcttaaagcaaaacgttatttagaaactaacggtaacggtactcgtttagttggtcctaactgcccaggcgtgatcactccaggtgaatgtaagatcggtattatgcctggtcacatccaccaaccaggtcgtattggtatcatttcacgttcaggtacattgacttatgaagctgttgctcaaacaactaagcttggtttaggtcagtctacttgtatcggtatcggtggtgacccaatcccaggtatgaaccaaattgaagctcttcaattgttccaagacgatccagatactgatgcaatcatcatgatcggtgagatcggtggtacagcggaagaagaggctgctgaattcatcaaatctaacgtgactaaacctgtagtaggttacatcgctggtgtaaccgcgcctaaaggtaagcgtatgggtcacgctggtgcgatcatttctggtggtcaaggtactgctgaagagaaattcgctgcatttgaaaaagcaggtatggcttacactcgtagcccagctgagcttggttcaactatgttgcaagtattaaaagagaaaggtttagcgtaa

SEQ ID NO: 123 - DNA, 1230 bp, Acinetobacter baumannii
gtaaaatttatgtctgaacgtacaaatgaccaagcagcagaacaacttaagcaagttaatgcgacccttaaagatttaacagaaaaagttcagccaatggctgagaaagctttgaaagaagctaaagatgctggtgacttatcaaccaaaactaaagaagcggttgaccaagcactaacagatctgaacttgcttcgccaaacacaaaatgaattgcaaacgcaattgggtgaagcggagcaaatgtttgcacgcatcggcaaaggtggtaacaataataatggtgtgtcagatcgcgctggtgatcttgttattaaagatgagtctttaatcaacttcacaaaggatgttcgtggtggaactcgcttaaacgtgaatgtgccacgtaatgcattgatctcttttgctgtaaatccagttgatggtactaccccgattattgccaagccgaaccagcgcttaacaattcgcgacttacttgcaccgggtcgcactggttcaaatgcaattgcatatttgcgtgaaactggctttacaaataatgctgctctggttccagaaaacacagcaaaaccttactctgaaatcacattcgaagaagtgatggaaagtgtaaaaaccattgctcacatgttgaaagcatctaagcaaattttagatgacttgccacaacttcaaagcttcatcaataaccgcatgttaaacggattgaagcgcgcagaagatacacagcttttgttcggctcaggcgttggaaacaacctaaacgggatctacacccaagcaaccccttatagtgcaccaatcactattgcgaacccgactaaggtggacatcattcgtttagcaatgcttcaagcggcattagctgattactatgctactggtacagttttacactcaaaagactggaccgaaattcagttgctaaaagacaccacaggcgcttacttgtttacaagcccatttgggaccatgactccttcactgtggggcctaccagttgccgaaacgaaccaagctggtttggatggcaaattcttaacaggtgcttttgcagaaggcgctcaaatctttgatcgtgaagatgccaatgtggtgatttctacagaaaaccaagacgactttgaaaagaacatgatttcagttcgttgtgaagagcgtcttgcacttgctgtgtatcgtccagaagcattcgttaaaggcacattcccagtacctgcaccttaa

SEQ ID NO: 124 - DNA, 1410 bp, Acinetobacter baumannii
tcaacgattatgaggataacgccgttgacaaacttatctgggactaaaccaacagctaaacttcaaaagaatcttgtgctttggcacatcattattattggtttagcttatattcagccattaactttatttgatacttttggtttagtatcagaacgaagtggtggacatgtacctacttcttatatctttgccttagttgcaattttattgacgtcgatcagttatggacacatgatcaaacgctatccttcttcaggatcagcatatacctacgcccaaaagtcaattcaccctaatgttggttttatggtgggttggtcatcttggctagactatctactttcaccactcgtcaatatcattttggccgatatttatttaagagctttgtttccagaagtaaataattggctatgggttattggcttaactgcattaatgactgtgattaacttatttggcgcacgctttgtcgcgcgttttaacagtacaattgtagttattcaacttggtgttattttttactttgtttatcaagtatatattctccttacccaaggcgtatatgctgatggtacgcttaatcctgataaagccgaattatggtcattaactcctttttggaatgatatgacttctattagtgctttgattggtggtgcaacagtactgtgcttttcttttacaggttttgatgctttatcttcacttgcagaagaaactaaagatgctgaaaaaacgcttccaaaagcgattttctcaacagcattgcttgcaggtattatttttatcgtaagcacttactttatccagttgtatttccctagcaacccgaacatctattttaaaccgttagatgaatcacaacctgttatggttgcggcaattggcagcattgcatttaaaacattagttttatattttgctgtagttgcagtaatggcatccggtatttcagcacatgctggtgtatctcgcttaatgtatgtaatgggtcgtgatggggttattaataaaaagttgtttggtcatattagcccaagattgcatactccgacttacaacattcttattgttggtgtggttgcattatctgctggctttttagaccttgaacatattgttaacttaattagtttcggggccttaactgcttttagttttgtaaacttctcggtgatttcgcgctacgcgctgagagatggtaaaaacaaatctatcaaagatattattaattacattattgtaccaacgcttggctttgctagtgtgttcttaatgtggttagaaattgacaagcttgctttgcaaattggcttagcttgggcagtgtttggggtaggttatcttgcctataaaaccaaaggctttaaatataatgctcctcaacataatgagcatgaataa

SEQ ID NO: 125 - DNA, 234 bp, Acinetobacter baumannii
atactagttattggcggggcttttcttttttggagtgtgtctatggctgacaaatcagaagttaaaaaggatctggatttttgttcgtgtgagcttgagaaatatcagaacctttcacgcactggtttatctcgtgacgagctaatcactatcgattcaataattgttcggctgaaaggacgtatacgtaatttgcgtgagctgaaaggtgaggagcctaagagtggaagataa

SEQ ID NO: 126 - DNA, 870 bp, Acinetobacter baumannii
agagaggttattttcatgccagttggtactattattgttttagcctttttggcttttgttgctgttaccatttttaaaggggtacgtattgttcctcaaggctataaatggattgttcagcgtttaggaaaatatcattctacgcttaatcctgggcttaacttcgttattccttatattgatgatgtagcctataaagtcaccactaaagatattgtgcttgatattccatcacaagaagtcattacccgtgacaatgctgtattactcatgaatgccgttgcgtatatcaatctgactacacctgaaaaagcggtgtacggtattgaaaactatacatgggccattcagaaccttgtacagacttcactacgttcaattgtcggtgaaatggatctagatgatgccctatcttcacgagatcacattaaagctaaactaaaagctgcgatttctgatgatatttcagattggggtatcactttaaaaacagtagaaattcaagatattcagccatcttcaaccatgcaagctgccatggaagctcaagccgctgctgaacgtcaacgtcgtgctacagttaccaaagctgatggtgagaaacaagctgcaattttagaagcagatggtcgtttagaagcatctcgccgtgatgccgaagctcaggttgttttagcagaagcttctcaaaaagcgattgaaatggtaacaagtgccgtaggtgataaagaaattcctgttgcttacctgttaggtgaacaatacgtcaaagcaatgcaagagatggcgaaatcaagcaatgctaaaactgttgtgttacctgccgatgttttaaataccatacgtggcattatgggaaagcataattaa

SEQ ID NO: 127 - DNA, 777 bp, Acinetobacter baumannii
actagttgtatctttacaaaaatatcaatgacaaaggcaatcgtcatgtatgcgaaaatatctagcgtgattctcttctgcattttaatttcggggtgtgccacaaatccagaaaagttacagacaccagttgaacttacttgtatcttccttaaagagcctctttcaactacagggctttatggtccactcaatgtggagtggaccacccgtctagaacggggaccatattggtcagaaaagatagatgaaaagggcacgttctttcgaggggcacctggtagtatttcaattcgaagtccagactatccatcaattccaggacaacctgcagcaactgatggtggcttttacttaccaaaagaccctaaggagccagtcaaaatttatcgctacttcacaacaaaggcagtacctgttgaagttccatctgacaatgtgacgtgtaatactctagcttatactaaagaacccgcatcccataaagttagtctagtatcctttgccacagctggcacagtaggaggtgttactggtgccataattggtaagaacttttcctcaggaaatatgagctacggtcaagctacaggagctggcgctgcagggggagcaattggtggattgattgttgctgctatcatcaacgctgaagtagggaaaatcattggtggtctaccaataaaggaatctagttttatggaaaagcttcgcgaacttggggcaaaacgcgagcctcttaaacaaatttctttactaccaccttctagtccataa

SEQ ID NO: 128 - DNA, 963 bp, Acinetobacter baumannii
atttctatcttaatacatttggagttttccatgaacgctactgtagaacagcttgcacctgtagaacagcaagcgaccgcgggttgggttgttgcagcactatatcaatttaaagaagttcaagatccagctgatcttcaacaacgtcttttagacttagtgaaaacaattaacctttgcggaactctgattgtagcaggtgaaggaattaatggtactgttgctggggaccgtgaagcaattgatacgattcatcaatttttgttaaacgaaggttttaacgctatggaatataaagaatcccatagttctgacaaacctttccgcaaaatgaaaatcaagcttaaaaaagaaatcgtgactttaggcgttgaagtaaaacctcgtgatttagtgggtcattatcttgatcctaaagaatggaatgagcttattgcacgtgatgatgtgattctaatcgacacacgtaatgattatgaatataaagccggaactttcaaaggtgcgattgatccaaaaacagaaactttccgcgaatttcctgaatatgtaaaaaaagagttagaacaacataaagataagaaaatcgcgatgttctgtacgggtggtattcgctgcgaaaaatcaacttctttacttcttcaagagggctttaaagaggtttaccaccttaaaggcggtattcttaaatatttagaagaaactcctcctgatgaaagcctttgggaaggtgaatgtttcgtatttgatggacgtactgctgtaactcatggtgttgaagaaggtgcaaacattaaatgtcatgcttgtggctggcctttaactcctgaagagtctgcgctaccaagctatgaacatggtgtttcttgcttgtattgtattgataaaaccactgaaaaacaaaaagctggtttccgtatgcgccaatcacaaattgctgccgctaaacgtaaacgtctataa

SEQ ID NO: 129 - DNA, 960 bp, Acinetobacter baumannii
tgggccatcttaatttatcttgccatagattgtttttcaaagatgaaaattgctcaatttgccagtatcggatttatctctttagccctattcggctgtgataggttcagcaaaacaccaacaccgaccacttcagttaaagcgcgcgaaccagtgatcgcacttgcattgggtggcggtggagcaaaaggattttcacatattggtgttatcaaggttttagaatcacatggtattaaaccgaaaattgttacgggtacaagtgccggtagctttgtaggcagtatctatgccagtggacaaacaccttatcaactccaaaatcttgcgcttaaattgcaagagtctgatattcgcgatttaaccctgaatcgccaaggtattattcttgggcaaaagctacaggactatgttaaccgtaacgtgggtaacaagcctattgagaaattcccaattcgttttgcagcggtagcaactcgtcttgataatggccaaaaagcagactttattaaaggtaatgcaggacaagctgttcgtgcatcatgcagtattcccaatgtatttgtaccagcaaccattggtaagcagaaatatgtagatggcggactggttagcccaattccggtcaaaacagcacgtgatatgggtgctgatattgtgattgcagttgatatttctgcacgtccggcaggaaaccgacctgcgaatatgtggggattgcttgatcaaaccattaatattatgggtcaacaaagtattaatgaagagttaaagcaagctaacgtggtgattcagcctaaagttgggcatttaggtacactcgatttaaaatcaagtaatgaagctattttagaaggcgaaaaagctgctcaaggtcaaattcgccaaattgaaactgcaattgcaaatttcaaaaaatctccagccgcatttaagcctgcgccacgtcctaaattttaa

SEQ ID NO: 130 - DNA, 1845 bp, Acinetobacter baumannii
gaagatatcatgggcgcgataaaccctaaagaagattattcaaatattcaaaacctcactttcgatgctgttatcgttggtggtggcggttctggtatgcgtgcatcttaccaacttgctcaagcaggtttgaaagttgcagtacttactaaagttttcccaacacgttcacatacagttgctgctcagggcggtattggtgcgtcgttaggtaacatgcaagaagataactggcatttccacttttacgatacagtaaaaggttctgactggttaggtgaccaagacgcaatcgaatttatgtgtcgtgaggcgccaaaagttgtttatgaacttgaacacttaggtatgccgttcgaccgtaacgctgatggtacaatttaccaacgtccgttcggtggtcactctgcaaactatggtgataagccagttccacgtgcttgtgctgctgccgaccgtactggtcacgctttattgcacacgctttatcaaagcaacgtgaaaatgggtactcaattcttcgttgagtggatcgctcttgatttgatccgtaacgaagcgggtgatgtactcggtgtaactgcaattgaccaagaaactggtaacattgcagtattccaagcaaaagcaacattatttgcaactggtggtgctggtcgtgtttaccgtgcatcaacaaatgcttatatcaacactggtgacggtcttggtatggctgctcgtgctggtattccattacaagatatggaattctggcaattccaccctacaggtgttgcgggcgcaggcgtattgttgactgaaggttgtcgtggtgaaggtgcgatccttcgtaacaaagacggcgaaccattcatggaacgttatgcaccaactttaaaagacttggctccgcgtgacttcgtatcacgttctatggaccaagaaattaaagaaggtcgtggttgtggtccaaaaggtgattatatcttgcttgatatgactcacttgggtgctgacacaattatgaagcgtttaccatctgtatttgagattggtaaaaaattcgcaaacgttgacatcactaaagaaccaattccagtagtaccaacaatccattatcaaatgggtggtattcctacgaatatgcatggtcaagtgtgcttaccagagcctggtacagacaactacactaaacctgtaaaaggtttctatgcaatcggtgagtgttcatgcgtatcagtacatggtgcgaaccgtttaggtacgaactcacttcttgacttggttgtatttggtaaggctgctggtgagcacattatcgattacgtaactaagcatcatggtgatgaatatgcaccgcttccaacaaatgtattagagcaaactttagctcgtgtacgtaaattggatgaatcaacttctggcgaaaatgctcaagaagttgctgatgcaattcgtgatatcgttcaagaccacgcaggtgtattccgtactcaagcattgcttgataaaggtgttaaagagattcttgctctcgaaccacgcgtgcgtaacatccacttgaaagataaatctaaagtatttaacactgcacgtgttgaagcgcttgaagttgaaaacttatatgaagttgcaaaagctacattaatttcagctgctgcgcgtaaagaatgtcgtggtgcgcatacggtagttgattatgaattaccagctgatcacccaacttattcatacggtcgccgtgatgatgagtggatgaaacatactttatggtattcatcagataaccgcttggaatataagccagtgcgcttcaagccgttaactgttgatccaattccaccagcaccacgtacattctaa

SEQ ID NO: 131 - DNA, 483 bp, Acinetobacter baumannii
ggcaatgtcatgtcagtgatttcaataaataaggctatggcgcacttgcgtgtcgatgaggacattgacaatgacattgcaagtaaacttgagtctgctgagcgcatagctaaagagtatctaaataggaatttttatttagataaggccgcgcttgatttagctaaagaagaaatacctttgatactttctgaggcaaaagttcagtacgaccatgatgtggattttgctagaacactcgaaggcgatttgattgataaattcatccacacagcttcactgaattacgatacagcaattcggaaggccaaaatgattagtcttggcattgtggtaaatgaagcaattgaaatcggcgttttattgattcttggcaatctttatgagaatcgcgaagacctaacaacagcaaacgtttacgaattgcctagaggtgcagagtggcatttacacccatttagaacagatctgggggttagttaa

SEQ ID NO: 132 - DNA, 399 bp, Acinetobacter baumannii
ttcgaggtaattatgaaaacaaaaatgctatgtgtaggtcttgctgctgccctaatgtttgttggatgttcgcgtgatgcacaagtagcttctaagaatctttcttatgctgctgacaacttccagctagaccgaagaattgttttttataacggcattactggtgactacattcttacaatcgaaggtaaatgctcttttgatgcagtaagtgaaaagaaagtcgatgtaacttgtaagacaggtgattctgaatttaaaaaacattcattgggtatttctgacaatgttacttatttctctgagcagctaaccagtaagggtgtgagtacgtatcattacaaagtagcgtttaaacctcaatcaatcatccctgatattgatttgaaagttaattaa

SEQ ID NO: 133 - DNA, 816 bp, Acinetobacter baumannii
gaagttaaaatggccaaacttgatactttgcaaaataaagtggtgtggattacgggagcatcttccggtttaggtaaagctttagctggtgagtttgctttgcaaggtgctcaagtgattttaacttcgcgtcgctttgaagagttagaagaagttcgcgttggtttactccatccggatcagcacttgtcggtagttgcagacattaccaatcaagagcaagttcaagaggcttatgagcagattttaaaagcaaaaggacgaattgactggcttattaataatgcgggtttaagtcaacgtgctcttattcaagacaccacaatggcaacagaacgcgccattatggaagtcgattatttttcacaagtcgcgttaactaaaaccgtattaccgaccatgcttaaacaaaagtctggccgagttgtatttgtgtcgagtgtagcagggcttttaggtacgcagtaccgtgcgagttattcggctgctaaagctgctattcatatgtgggccaacagtttacgtgctgaagttgccgatcagggtgttgaagtttcggttattttcccgggctttgtaaaaactaatgtttcgtttaatgcactaaatggtgcagggcaacctcaaggccaccaagatgaagcaatcgaaaatggactagaggccgatgtttttgcagaacagtcagttaaggctttaatgcaaggacaggaatatattgtagtgggaggtactaaagaaaaattaggcgtgatggtttcccgtatgtcaccgaaactactctataaaatgatccggaaaacaaaagtgaaataa

SEQ ID NO: 134 - DNA, 2871 bp, Acinetobacter baumannii
agcaggcgaatagtatttttagtcggattcgatattatgagccaaatttatctttaccagaactctctcaacaagaacgaagttgatgtaatcgatacagataacattctgtttgaatttcttaaagtaaaaaaacaatttcctcaagcaaaaatttatctgggtaatccttgccctgaaaatgaaataacaccatcaataaaagataaggcatcaattgcgcgcttaaccgaaattgcagatgactgcagtattgtttgtcatccgggtgaattaagctcatttgtgacatgggttgcaacaaagattctgggttctgctgtttctgctttggttaaggttcctaagccaaacatgagtaataacggctcaatgtctggttcaagtaacaataacttatcagatccagagaaccgccagcgtttaaaacaacgtatacctttcattttggggcgtgttaaggctattccagatctttttgctccagtcatcaaatactttaaagatggggtcgaagttgaagaatctttgatgtgtatttgtgaaaaccccattcaagtttctaacttcaagtcgggcgatacaccaatacaagagatacccggcacaagcctctcagcttatggtcacaaccaatctttaattgggaatgaaactatattcaagtggggcgatacatttgatcagccaccagttattgcccgtcaaaatgcttctattaacggacaaactcttttgccgccaaatagcacccgtattgaagccagtgatatttatttccaatatccaaatttgatcaaagcgaatgatcaaggcactgctgataaatttaatgcgtttgatattaatgactctttaattattagtggggcgaattttggtattaatgacttagctattactggacaagttgaagtagacaataccaataatacgttctcaattgcttcaaaccaaaccgttgttgattttcaaaattaccgaaaaatcaatgtgacttctttgcttgtcactgatcctgtgcgtggtcaactagatcttgcaggtttatatgatattgattctattgcatatgaatcgggtatttatacgattcatttaaagaatcctgtatcaactaattcaaattttgcaaatcttacagaagtattgactgctaatatttcagcaaatcttacagctaattcagcaaatattttccttgatggaaattatgttgtaactggtgtggatatagccaacaagcaaatttctttagctaccccgagtgctgtgaatgatgactggaacaagcttgcagacttaacggatcagaaaaccagtactggtacaattaagctgagaggtagtcaagaaaattatatcgggtggtttacgattgagtcagcaaaagctactgggttgctactcaactttcaggcgcttaatggtatttatcagggatccgatgctaagtttgtagatatttatgttgaatatcagcaagtattaaacggaaacccaacaggcaatgtttataaccaaacaatacgcctgaatggtaaagcgaataaccgcgatagtgtcggcggctcaatgtggattacattgccatttactggtgcagtgcgctttcgagcgcgccgtacaaatgacaatggtgacgctgtagatctatcagacgaaactaagttttataccgcatacgcatatcattacttatccaagcttgtatatgacaaccgagttttaattcgtcaacgtacacaagcaacacgtgcagcaacggccattgatagccgaatgacaaactgtatagcagaaagtctggtttactcataccgtgatggtgttaagtcggatacccgcataccttcaagatttattcctgatctagtaattgaattagctttgcataagttgattggacgaagaacattgaatgaagtaaatgtcgaaaaactgtattcagtttttgatgaggttgtcgattatttcggctcagaaaagatggctgagtttaattacacaattgatgatgctaatcaatcatttgaagagattctaagaatgttggcgggcgtctcttgctgtaatgatcgccgtctaaatcgtcagatttactttgagcttgagcgggcgggtcgagagccttatttattattcaatcatcgaaataaaaaggcccgtacagaagttaggacaatccgaacaaaaccagaaaacaattatgacggtgttgagatgacatacgttgatagtgaagctggatggattgaaaaaaccttgaaaattcctaatgaccaaatcactaacccgaaaaaaattgaaggctatggaattgtttataagcagcaagcgcatattgttgcgtggcgtgcttggaacaaaattcaatttcaagcaattaattgccgtttttcatgttttgccgaaggtgagttggttggtagtggcgatccagtagcagtggttgatgatactcgattagcaccaacattttttggtgatccttcgcaagcgattttatcgggagaggtgctcgcttggaatggcttaaacatcacaggctcgcagccttgcaagctatctaccgagcattcatttgtaatccatttacagctcaagagcggttacatagatattatcccggtaacgcaaggtcaaactgattttgattttattctttctcgtccaccagttgaagcactggtgacagaaggcgaagttaaaaccgtttattcactctctactgatgatcggcaagatgatgatctattcctcataacaacaaagagaagggcaggtatttttgaaaatgaattaacactcgtaaaccttgatgaacgttactatcaaaatgatagtgacataaaaaacaacctaatttaa

SEQ ID NO: 135 - DNA, 1305 bp, Acinetobacter baumannii
gagtctttgatggatctattccttaatcgtaaatcgtttgttgttaaaagtttagctattacagtaacagctttaatgatgagtggggcaaatgcggcaacttctgataaagaagaaattcgaaagcttcgtcaagaagttgaagcattaaaagcattagttcaagaacaacgtcaagtacagcaacaacagcaacaagtacagcagcaacagcaagtacagttagctgaagtaaaagcgcaacctcaacctgcggcagcacctgcttctccattagcatcactaaaatctaaaactggtgctgatgtaaacctatatggttttgttcgtggcgatgctaactatattatcgaaggtgcagacaatgactttgctgatgtaagtaagtcaaatggtaaaacacaagataaattacgtgcgaccgcgaaaacgacacgcctaggtttagattttactgctcctgtaagtggagcaaaagtaggcggtaaaattgaattagatttcgcaagtagtgacaatgataaatctgaaaatgtacgtattcgtcatgcttatttaacgtataacaactggttgttcggtcaaacaacttcaaacttcttatctagccatgcgcctgaaatgatcgacttctcgacaaacattggtggtggtacaacacgtattccacaggtgcgttataactataaactagctcctgctactcagttatttgtttcagcagaagagggtaatagttcagcaacaggtgactcagttaaatacagattacctgtgttaacagctaaagtaactcaaggctacgcagatggtaatggtaatgcttctgctcgagcttttgttgaaaattacaagtctggagctggtgacgataagacagggtggggtattgcagccggtaccgactttaaagtatctgatcctttaaaactctttgctgatgcatcgtatgttgtaggtaatagtaactatctatatggtagtaattctgcttatactttagttaatgacaatattgaacaaaatgaatttgtagcagtacaagtaggtggaacttataagattttacctaatttacgttctactctagcgtatggtgcgcagtttgcagatgacggtactgactatgcgaaaaataatgtaactgcaaatgaaaaagttcaacaagcgtggatcaactttatctatacgccagttaaaccaattgatttaggcgttgagtatgtaaacggtaagcgtgatacatttgaaggtaagtcttacaaagataaccgtgttggtttaatggctaaatatagcttctaa

SEQ ID NO: 136 - DNA, 1278 bp, Acinetobacter baumannii
ttgattatgatcgaccctaagttactcagaaataatattgaagtcgttaatgcaggtttggcaaaacgtggtgttcagttagatgttcaagaatgggcatctttagagactcgccgtaaagacttgcaatcaaaaactgaaaagttacaggcagagcgaaatgccggtgctaaacaagtgggtcagattaaaaaatccggtggtgatgcttctgaaatcatggcacgtatgcaagccattggtgatgaaattaaagctgccgaagttgctttatcagagctacaaaacgagattgagcaaaaagcgcttagcattcctaacttgccggacgaatctgtaccagctggtaaagatgaaaatgataacgttgaaatctcaaaatggggtacacctcgtcagttcgattttgaaatcaaagatcatactgatttaggtgagtggatgggcggactggagtttgaaactgccactaaactcacaggctcacgttttagtgtgttgaagggacctttagcgcgtctacaacgtgctttaactcagttcatgctcgatacccatactttaaagaatggttataccgaagcgtatgtgccttatctggtaaatgctgattcattacgtgggacaggtcagttaccaaaatttgaagaagatttatttaaacttcaaggcgaaaaagaatactacctcatccctacagcagaagttccagtcactaactttgtccgtgatgaaattattgatgcagaccgtttaccattaaaatatgcggctcatacaccatgtttccgtagtgaagcgggttcttatggtcgtgatacacgtggtttaattcgtcagcaccaatttgataaagttgaaatggtgcaaatcgttaagcctgaaacatctatgcaggcacttgaagagcttactgcacatgctgagggcattttacaggcgcttggtttgccttaccgcaaaattttgctctgtggtggtgatatgggcttcggtgcgactaaaacttatgatttagaagtttgggttccaagtcaaaatacttaccgtgaaatttcaagctgctctaatatgggtgatttccaggcacgtcgtatgaaagcacgctaccgtatggatcagaagaagaccgaattggtgcacactctaaatggttcaggccttgctgtagggcgtactttacttgcagtgatggaaaactaccaacgcgaagacggttcaattgagattccagaagtattacgcccatatatgggtggtgcaacgtttattgattaa

SEQ ID NO: 137 - DNA, 1659 bp, Acinetobacter baumannii
tcactcacgatgctgaattttttttcaacattaagaaataaacagatttctctgtttatgtttaatctcattatagccatttggctaggtgcaattttaaatattggtttttatcatcaagttcatactttaactccatattttggagtaaaggctattttgtttttagctgctactctcgtaattcttgttgctacctattatgcggttttacaaatcttaaattggaaatggactgccaaaatctttgcaattttattgatatttattggtggccttagctcttattttgtaaacacattgggtgtcattatttcacccgaccaaattcaaaatatggtgcagaccgatgtttcggaagttaccgatctaatctctttacgctttgttttatggacaattttttttgttattttacccatttttttaattactcaagttaaatttaaacaagaaaaagtatcacggttgttattgaagaaagtattctcactggtagcttcatttgcagtggtcggtgttttactttttacctactatgtcgatttcgctgcaatatttcgtgaacatcgtgatttaaaagggatgatttcaccgcaaaatagtatttcatcgcttatgtcttactatcataagaaggctccgaagaaaaatctgcctcttgtgatatatggacaagatgctcatcaagttcagcgcgtacaaaagaacctccctaagttaatgatacttgttgtcggtgaaacggcacgtgccgaaagtttctctctaaatgggtatgcaaaaaatacgaatccggagctttctaaacaagatattttcaacttttcgcaagtgagctcatgcggtacggcgacagctgtttctgtgccatgtatgttctcgggtatgccacgtgtagattatgatgagcaattagctagtcaccgcgaaggtttactagatattgcaaaacgtgcgggttaccaagtgacttggattgataataactcgggttgtaaaggtgcatgtgatcgtgttgaacaataccaaattccagaaaacttaaagaaaaaatggtgtaaagatggcgaatgttatgatgacattctcattgacagcttaaagcagtatttggctactattgccaaagatgatgatcgcccacgtttgattgttttgcatcaggtgggtagtcatggacctgcatattacaagcgtgcgcctgaggcatatcaaccctttaaaccgacttgtgatacgaatgcgatacagggctgttcgcaaaccgaattgctaaatagttatgataatacaatcgtatatacagaccatgtattaagccaaatgattaatactctaaaagaaatatcaaaatatcagacaggtttatggtatttatctgatcatggcgaatcaaccggagaacatggtttatatttacatggttcaccttatgcaatcgcaccgagccaacaaacacatgtaccaatgattatgtggttctctgaaagttggaaacaacataatcttgctcaagtgaattgtttaagccaacaaactaaacaaaagttaagtcaggataatttattcccaagtttgttaagtttgctggatgtaaaaactcaggtcatcaaccctcaactggacatgttgcactcttgtgcccatgtaaactaa

SEQ ID NO: 138 - DNA, 330 bp, Acinetobacter baumannii
acgcctgcgatgatgcaggcgtttcacatgatgaggttacttatgttagaccgcactccatctcgcgaactccgtgaagacctttgggtatttccaatggactatccaattaaactcattggcgatgcgggtgaagaattacgtatagctgtcgttgatattctagtgaaacattttcctgactttgaccaaacaacgttaaaagtacaagaatcacgtacaggcaaataccattcattaaccgcgcaattacgctttgatgaattggaacaagtgcatgctttgtatgcagacttggctgcttgtccgcaaataagaactgcgctttaa

SEQ ID NO: 139 - DNA, 414 bp, Acinetobacter baumannii
tttagagggattttactcatgaatattcgtcagcttttttattgtgtctatgatccagaaaatttccattgcgtgcatttcgtcatcttggccgcaaaggtcatctttgggaaagattacacgccgtgttttttggggcttactggaccattacaggaatcaataaaaacatcacgtactacagttcacagaaacaagcacatcaaaaagccggaagacggctgcattgtcttaatgacttacctagatcaaagctcccacgtggggcttttttttcagggtcgaatttttcatttgatcgaacgcgggccgcagagaatcactgtagagcaggcgaatagtatttttagtcggattcgatattatgagccaaatttatctttaccagaactctctcaacaagaacgaagttga

SEQ ID NO: 140 - DNA, 369 bp, Acinetobacter baumannii
atgtgggttgttgtagcagctaaattttggcgagaaatcattattggttttctcgcttttttattggtcatttgtttggccgtacttaatcacaagactggtcagttgaaagaagctgatcaaaagtgtcaatcgcagatccaagagattgaacgcaagaatttgaaagcacttgccgaaaagcaaaatcagatcaataaagtgagcgcagaatatgaacaagccaaagcagagcaaagcactaaagtcgaaaccattacacgtgaagtgcaaaagatcgtggagcgtcctgtttataagtctagctgtattgatgatgatggggtgcagcaactcaacgaccttatcaaagccggcaataccagctaa

SEQ ID NO: 141 - DNA, 561 bp, Acinetobacter baumannii
aaggtgactgtaatgtcaaacaagactaagttattcgttgtttgttcaacattagccgccgcttttggcggcttagttatttatgggcctagtgatcaacaagttcaagcaacggccataaaagaggggtatacagcgaagcctacgattccggtaaaaggtgaccgaccaacgattggtaatggtacaactttttacccggatggccgcgccgtaaaaatgacggatccagcaattacacgaaagcaagcttttgaatatctcaagttcacaatgaataaggatgcaaaagcatttaataaaacgttgctgaacattcccatatctcaaactgaatacgacctttaccttgatttttcttatcagtacggtgtgccaacatttgcaaaatcttcaatgcttaagcatttaaaagctgggcagtacaaagcagcttgtgactcattacttaaatataagtacgttgcaaaacgtgattgttcgattcgtaaaaatggctgctatggggtttggaccagacagcttgaacgacatgccaaatgtatgggagctaattcatga

SEQ ID NO: 142 - DNA, 396 bp, Acinetobacter baumannii
attgtctatgtcgaaaaaacaaatggtgataatgtgagaaaagcaatatttttaatttctgcgcttttttcagtaggtttacacgctaaccctgtaaattgtgaagatattacgaaaaaaattgatgaaaaaacaaaatcaattgcctttgaaaaggtttttgaagttgaacgagctaagtcggttgatgggatgatgtttgttaagtccagaaagattccgcagtatcaaaatgaaataagcttgttcatgcaacaaagccgcgatatgggttgtcctgcctacacaggtgatatcacgggggcgccgtattttaagcacgctcagaagtgtattgattcaaaattaagggatagagaggcgtgtgacaaacgcaactgggaaaacaccccttaa

SEQ ID NO: 143 - DNA, 474 bp, Acinetobacter baumannii
gtgattcatgttgttctatacgagcctgagattcctgctaacacaggtaatattattcgtctatgcgcgaatacaggcgctcaattgcatttagttaagcctttaggctttgaacttgatgataaaaagcttaaacgtgcagggcttgattatcatgaatgggcaagaatgcaaatttgggacaacatagagctttgtcttgcggacttaaaagcaaaaggtgttgagcatatttttcctttaactacgaaaggttctgctacgcctcatacagttgatttaaatagacctgtggctttattgatgggtccagaaacacgcggcttgcctgaacatgttcgtctgatgttccctcaagaacaatggattcgtttaccaatggcagaaaactcaagaagtttaaacttatctaatgcaactgccgtaattgtatatgaagcatggcgtcagcaaggctttaaaaaattaggttaa

SEQ ID NO: 144 - DNA, 279 bp, Acinetobacter baumannii
tgtgtggacttggccttccatgcggtaatgaatgcgttttattacaatcctaatgaagaaacggaagggcttaaaggcttttatcaaaagctatgccataaaatgaatcgccgtggctttcaatatatagttggagaagatgcattaggaagagaaacaattactatctttaacccagatgttattgttgatcaaaaaacagaagacgggattgcaaccatgcatgatccaaataagttacaagaagtaacacgtttcgaaagtcccgataatttctaa

SEQ ID NO: 145 - DNA, 324 bp, Acinetobacter baumannii
ttggagtacgttatgtacgcagtaatccaaagcggtggtaaacagcaccgtgtagttgagggtgaaacccttaaagttgaattattgaaggctgaatctggcgcaactattacatttgatgatgtattaatggttgtaaacggtgacaacattcaaatcggtgctccagttgtagctggcgctaaagtaactgcagaagtgattggtcatggtcgtcacgacaaaatccgcatcatcaaaatgcgtcgtcgtaaacactaccgtaaacaacaaggtcaccgtcaatggtttactgagttgaaaattactggtatttcaggctaa

SEQ ID NO: 146 - DNA, 186 bp, Acinetobacter baumannii
agccctgtagttgaaagaggctctttaaggaagatacaagtaagttcaactggtgtctgtaacttttctggatttgtggcacaccccgaaattaaaatgcagaagagaatcacgctagatattttcgcatacatgacgattgcctttgtcattgatatttttgtaaagatacaactagtctactag

SEQ ID NO: 147 - DNA, 276 bp, Acinetobacter baumannii
tcacgaggagtaagagacatggcaactaaaaaagccggtggatcgacgaagaacggtcgtgattcaaacccaaaaatgttaggtgttaaagtttacggtggtcaaactgtaactgctggtaacatcatcgttcgtcaacgtggtacagaatttcacgctggtgcaaatgttggtatgggccgtgaccatactttatttgctactgctgacggcgtagtaaaattcgaagtgaaaggtcaatttggccgtcgctacgtaaaagttgaaactgtttaa

SEQ ID NO: 148 - DNA, 1383 bp, Acinetobacter baumannii
aggtttaaggtggatatttttccaatctctttgaagttgcagcagcaacgttgtctgattgtgggcggagggcatattgctttacgcaaggcaaccttattagctaaggcaggagcaataattgatgttgttgctcctgcaattgaagatcagcttctgcaattaattaaaacaacaggcggcgagccgtttattgaagcttttgctgaaaaatttttaagtacaccctatcgtttagttattgcagcgaccaatgatgcagaagtaaataaaacagtttttgagcagtgtgaagcgcgcaatttacttgtaaatagcgtcgatgatattccacattgccgttttatggtgcctgcgattattgatcgatctccattaattgtttctgtggcttcaaatggaacatctcctgttctatctcgtcaaatccgtacgcagttagaaacctctattccgcacggcatgggcaagttagctgagttttcaggaaaatggcgcaatcaggttaaagaaaaaatttctaatccagatgagcgccgtattttttgggaaaacttgtatgcaagccccttaaaggaacaagtttttaatgacaatctagatgttgccgatagcatgcttgaacaagcactgcaggagtggaaagcacctaaaggcgaggtttatttggtgggtgcaggtccaggtgatcctgaactcattactttaaaagctttacgtttaatgcagcaagctgatgtggtcatttatgaccgtcttgtttctgcacctattttagaattgtgccgtcgagacgcaacaaaaatatatgttggtaaagcgcgttctaaccatagtgttcctcaagaaggtattaatgcattattggttgactacgcgaaaaaaggtaaacgtgtttgtcgtttaaaagggggagacccttttatttttggccgtggtggcgaagagatccaagagttattccaagctggcgtcccatttcaagttgttcccggtattactgctgcgtcaggttgttcagcttatgcaggtattccgcttacccatcgtgattatgcccagagtgtccgctttcttacaggccatctaaaagaaggttctcctgagttaccgtggaacgaactggtatacgaaaaccagacattagtactgtatatggggttggtgggattagagcgtatttgtgagcagctgattgcgcatggacaacgtccagatatgccagttgcattaatttcaaagggtacgacacctgaacagaaggttgtggtggggtcacttgctgatattgcatctaaagtgacagaacatcaaattcatgcgccgacactcacaattattggtgaggttgtacgtttgcgtgaacagttacagtggaattag

SEQ ID NO: 149 - DNA, 234 bp, Acinetobacter baumannii
gcaaaattattctcaactgtattctctcgaggtttcatcatgcagcaattaatgattatggtcacagaagttggaaagcttgagcacacatgtaatttgcttgctgaggtaaacaaaggtggtaaagtcataaaggttttcgactacaacggtaatcaattaccaataagcattgatggaaccgtgacatttaatagacgccgttgggagcttcctgtcaaggttgacctttaa

SEQ ID NO: 150 - DNA, 3177 bp, Acinetobacter baumannii
atggcacaattttttattcatcgccccatatttgcgtgggtgattgcattagtcattatgttggcgggtattcttacgctaacaaaaatgcctattgcacaatatccaacgattgcaccaccaaccgtaacgattgctgcgacttatcctggtgcatcggctgaaacagttgaaaatactgtaacccagatcattgaacaacaaatgaatggtcttgatggcttacgttatatttcatctaacagtgctggtaatggtcaggcatctattcaattaaactttgaacaaggtgttgaccctgatattgcacaggttcaagttcaaaacaaattgcaatctgcaactgcgcttttacctgaagatgtacaacgtcaaggtgtaacagttactaaatctggtgcgagcttcttgcaagttattgcattctattcaccagataacaacctgtcagactctgatattaaagactatgtaaactcgtcaattaaagaaccgcttagccgtgttgccggtgttggtgaggtacaggtcttcggtggctcatacgcaatgcgtatctggcttgatccagctaaattaacaagctatcaacttacgcctagtgatattgcaactgccttacaagcgcagaactcgcaagttgccgtaggtcagttaggtggtgctccggctgtacaaggtcaagttcttaacgcaacagtaaatgcacaaagcttattgcagactcctgaacagtttaaaaatatcttcttaaagaacacagcatcaggtgctgaggttcgattaaaagatgttgctcgcgtagaattaggttcggataactatcaattcgactcgaagtttaacggtaaaccggcagctggtcttgcaattaaaattgcaacaggtgctaacgcactcgacacagccgaagcagttgaacaacgtttatctgaactacgtaagaactatccaacaggtcttgcagataaactggcttatgacacgactccatttatccgtctttcaattgaaagtgtagtacacacattaattgaagccgtgattttggtattcattgtcatgttcctattcttacaaaactggcgtgcaacgattattccaacgcttgcagttccagtagttgtattaggtacatttgcggtcattaatatctttggcttctcaattaacaccttaaccatgttcgctatggtattggcaatcggtcttctggtcgacgacgccattgttgtagtcgaaaatgttgaacgtgtgatgagtgaagaccataccgatccggttaccgccacttctcgctcaatgcagcagatttctggtgcgttagtaggtattaccagcgtattgacagcggtattcgtaccaatggctttctttggtggtacaacaggtgtaatttaccgccagttctcgattacccttgtaactgcaatggttctgtcgttaattgtagcgttgacgttcacaccggcactttgtgcaactatcttgaaacagcatgatcctaataaagaaccaagcaataatatctttgcgcgtttctttagaagctttaacaatggttttgaccgcatgtcgcatagctaccaaaatggtgttagccgcatgcttaaaggcaaaatcttctctggcgtgctctatgctgttgtagttgcccttttagtcttcttgttccaaaaactcccgtcttcattcttaccagaagaagatcagggtgtggtcatgacacttgtacaattaccaccaaatgcaacacttgaccgtaccggtaaagtgattgataccatgactaacttctttatgaatgaaaaagataccgtggaatctattttcactgtttctggtttctcattcacaggtgttggtcaaaacgcgggtattggcttcgttaagttgaaagactggagcaaacgtacgacaccagaaactcaaattggttcattgattcagcgtggtatggcattaaatatgatcattaaagatgcatcatacgttatgccgttacagcttccagcaatgcctgaacttggtgtaactgccggatttaacttgcagcttaaagattcaagtggtcaaggccatgagaaactgattgcagctcgtaacacgattttaggtttggcatcacaagataaacgtcttgtaggtgtgcgtccaaatggtcaggaagatactcctcagtatcaaattaatgtagatcaggctcaagctggtgctatgggcgttagtattgccgaaatcaacaatacaatgcgtattgcatggggtggctcatacattaacgatttcgttgaccgtggtcgtgtgaaaaaagtttatgttcaaggtgatgcgggcagccgtatgatgcctgaagacttaaacaaatggtatgtacgtaataacaaaggtgagatggttccattctcggcatttgctacaggtgaatggacgtatggttctccacgtctcgaacgttataacggcgtgtcatcggttaacattcaaggtacacctgcacctggcgttagctctggtgatgccatgaaagcaatggaagaaattattggtaagttaccatctatgggcttacaaggtttcgactatgaatggacaggcttatcacttgaagaacgtgagtctggtgctcaagcgccgttcttatacgcactttcattgttaatcgtattcctttgcttggctgcactatatgaaagctggtcaattccgttctcggttttacttgtggtaccacttggtgtcattggtgcaatcgtattgacctacttgggcatgattattaaaggagatccaaatctctcaaataacatttacttccaggtagcgattattgcggttatcggtctttctgcaaaaaatgcgatcttgattgttgaattcgcaaaagaattgcaggaaaaaggtgaagatctacttgatgcaaccttacatgctgcaaaaatgcgtttacgtccaattatcatgaccaccctagccttcggtttcggtgtacttccacttgcactttcaacaggtgccggtgcaggaagtcagcactctgtaggctttggtgtacttggtggcgtactcagcgcgacgttcttaggtatcttctttatccctgtattctatgtgtggattcgtagtatctttaagtacaaaccaaaaaccataaacactcaggagcataaatcgtga

SEQ ID NO: 151 - DNA, 537 bp, Acinetobacter baumannii
caagtgatttcgacaaaagctgtaaagcccactctgcaacttgcctacgttaagctcatgatggacgttgttggtcgaggcttagtcatggcgagtcaagtagatagtgaaatacaagaggaagtgtctaaatttcctgttcactttgtactttcaatgaatgtcttcccaaatggaccagcattttttgcacgagtgacagaagataaacaattagaactactgaaaagagcggaaaaaaagcctgatttaaccattacgtttaagcatgtaactcatgcctttttggttttctcttttcaggaaagtactgctcaagcctttgcaaatgaccgtatgattgctgatggtgatgtatccgcagcaattcgtttagttcgctgcctcaataaaatggagtctctcattttaccgaaattggtggcttcactcgctgttaaagaatacccaactgaacttaccctaaaagaaaaattcaaccaagctgcaaatatttatttaaaagtagctaagtcttacttcaagcggagcgcataa

SEQ ID NO: 152 - DNA, 186 bp, Acinetobacter baumannii
attgttgaattactaagtcgattggcaatgcgaatcttcttagaaccatctggcaatccactgattgttgtagatccatcaaacgctggtgatgtcgtatacacattaaaactagagtgcagaacatcatctacaaaaacatcaatatttgattcagtagcacttccgtttccgagtcttgcgtaa

SEQ ID NO: 153 - DNA, 264 bp, Acinetobacter baumannii
tggcctccttcgggaggttttttattgccaccaacaaaggtaaataaaatgacttcaaaacttattcatgcgcatgatgttgataaaggttctgatgtttactttgatccaattggggttgaaggcgctctaattgaatggacaggaaagaaggactatagccaatacatttatagcgtgaagctttacatgagaagcgggaacataatcagttgtgttgttaatgaagatggtaagaagaagattcttgagcatgttcactga

SEQ ID NO: 154 - DNA, 942 bp, Acinetobacter baumannii
agccgaagctctggtatccagatttttgcgctcttccatttagcacctttatttatagcgaaaaatctgactatagaactgtcttatttaaatgatatagtgaaaaacagacaagacataagtaatttcaggcaattttcaaagatgaaaaaatcagctcaacgtgtgcaggattttcaggaaattccggctcataacgcaattcctgatttgctttggttccgtgttcgtaatgcacccgcagaaacggtttatcctcaacatgcgcatgcatggggtgagtttatttatgcgtttagtggtgtactcgaagttaatattgatcaaattaattatttaaccccgccaccttatggtatttggcttcctccttataccaaacacagtggtattaaccgcaacgaagtgactcatgcaactttatatgtacatgaaagtctgtgccaaaagttaccgcaggaaagctggtatattattaacgtccccacttgtacctgctttactcgatcacttgaggccaaaacccacaagatgaaacccaagttcgaatatatacgcctactccaagttttattagatcaactcatacaggctgaattagtgggtagttatttacctacaacagatcatccagctttagcaaaaattttaaatgatttacatcaatgccctgccgataacagcaccttgcaagaattagctgaacgaataaatatgactgaaagaacattggcacgttacagtcaaaaagagctgggaatgtttttacatgaatggaggcaacgattaaaagtaatgaaagcaatgaccatgcttaatcaaggaaaaaccatagaaagtatcgcttttgatttgggctatgccagcgcatcggcatttatttatatgtttaaacgttggatgggttttaccccagaccagttccgaaagctctatcaataa

SEQ ID NO: 155 - DNA, 1209 bp, Acinetobacter baumannii
ctcataacatccagcccaaaccaaggaagaaatacaatgcaatctggtgctattcgtcccattccaaatatgttacctcgccatttatttaatgaagaacatgaagcttttcgggaaacggtacgtaaattctatgagaaagaagttgtacctaatattgaaaaatatgaaaaacaacaacatgttgaccgagatctttggaataaagctggttcattaggtttactctgtaccaccatgccagaacaatatggtggttcaggtgtcgatcgcctatacagcatgattcttattgaagaacaagcctatgcgatggactcaagtacaggtttctcactgcattccgacattgtagccaactatattaataacttcggtaatgaagagcaaaaacagaaatggctccctaaaatggctactggtgagacggttaccgcaattgccatgaccgagccgggaacaggttcagacttgcaagcggttcgtacaacagccgttcttgatggcgatgaatatgtcattaatggttcaaaaatatttattaccaatggctatttatgcgatatggcgattgtcgtttgtaaaacggggaatagcgataaaggatctgccaatttatcactcattattgtcgaagctgaccgtgctggttttactaagggcaaaccacttaacaaaattggtatgaaaggccaagatacctgtgaactcttctttgataacgttcgtgttcctaaagaaaatcttttaggtatggaaggtatgggctttatcatgctcatgaaagaattagcgtgggagcgtatgctagttgctattatctgccaagccggggcaaaagcggcatttgcacatactgttcaatatacaaaagatcgtaaagcattcggcaaaccaattggagcattccaaaatactcgttttaaacttgctgaacttagaacagagatagatttctgccgtacctatttagatcgttgtatggaattacaactcgatgaaaaattgagtgttgaagctgcagcggctgcaaaatataaaatttcagatatgttttcaaaagttgtagatgaatgtcttcaattacatggtggttatggctatatgatggaatatccaattgcacgcgcttatatcgatcaccgagcaaaccgtatttatgcaggcaccaatgaaattatgaaagaattaatctctagaactctttaa

SEQ ID NO: 156 - DNA, 1473 bp, Acinetobacter baumannii
atcgatctgttaggagcctgcatgacggttcaaaccttcattcccaatggtgccaaagctgcctcagaaaacactgttacccagccaacgcacaccactgacgtttcaataaagaaactatatattgaaactcaagggtgtcagatgaatgagtatgacagtcaccgtatggcagaccttttgggggattctcatggttatgtgttaacgaataaccctaatgaagcagacattctgctcatgaatacttgctctatccgtgaaaaagcacaagagaaagtatttagtgaattaggccgttggcgtaaactaaaagaacaaaatcctgatcttgttattggcgtgggtggatgtgttgcttctcaagaaggtgacaatattcaaaaacgtgcaccttatgtcgacatgatttttggtccacaaaccttacaccgtttaccgcaaatgcttgatcaacaccacgcacaagtggaaaagccaaaaaaagaaaagattaagctcgttgatatttcattccctgatattgaaaaattcgacttcttacctgaaccacgcgtagaaggttttaaagcattcgtttctattatggaaggttgctctaaatactgttctttctgtgttgttccatacactcgtggtgaagaagtttcacgtccacttgacgatgtacttgcagaaatcgcaggtcttgctgaaaaaggtgtccgtgaaattagcttacttggtcaaaatgtgaacggatatcgtggcgaaacattcgaaggtggcatttgtaccttccctgaattgttacgactcgttgcagaaattccaggtattggccgtttacgttatacaacttcgcatccgcttgagttctctgatgaacttattcagtgttatgaagatttacctcaaatggtttcacacttacatttgccagtacaaagtggatctaatgatgtactcaaagcaatgaagcgaaatcacacgattgatgtatacatcgataagattgccaagttacgcaaaatacgccctgatatgcatttatcgagcgattttatcattggtttccctggtgaaacagatgaaaattttgcagaaacattgcagtttatcaaagacttagactttgatcattcttatagctttgtttattcaaaacgcccgggtaccccagcatctgacttaccagatacaacccctgaacacgttaaaaaagaacgtttagcacaagttcaacaagtcattaagcaatctagcattgaaaaaactgacgcaatgcttggcaaaattgaacgtgtacttattgaaaaagtatctgatcaagaccctaatattttagtaggtacagcagacaatacacgtttagtgacttttgtaggcgatgcatcgtgggttggtcgttttgcagagattgagattactgaaattaaaactttaaatttagtttacggtgaactcttgaatcttgagcctgacgtggcgtaa

SEQ ID NO: 157 - DNA, 2373 bp, Acinetobacter baumannii
accaccatgttcttactgaaaaatctcgtctcttcaatatcaaaagttactcaggacctgggtaatattgtatcaataacccctgtagtaaacacaggttcctctgttaatgtaaatgtttctgatatcaacattgctaatgtttcaacaacaggcttactttctaatgtgatttcaactgtaaccgatacagtttcaaatacaaccacagacttagtttctaatgtagttggtaccgtaacaggtactgtagggtctacaaacccaattgatactgtaaccaatattattggcggcgtaacgggtggcgttacaggcaaccctcttgaagttgttactgatattatcggcggagtaacgggtggtgttgtcggcggaacttctccaatctctccagtaatcgatgttgttcaaggcggcattgatattcttcaaggcgttgaaagcttaaaaactgaaattattaatacaggcattgaaactgtagctgatgcagttattggtgtattacctcaagctgagcatccagtttctgaaattgcagaccttggcacattaacttttgaaacttctcgtgacacagtcaatggtgctcttgaagttgtttctgatttagtcggtggtgatattcaaggcgctactgaatcagcgaccggtattctcgatacgcttattacaaatggcacaactgctacaggtattgttactggtgtggctggaagtgttactgatgttattggtggcgtaactggcggtgttgatggcaacccacttgaagtgattacagatattattggcggtgtaactggtggtgttgggggtgataaccctcttggcgtagtaactgatattatcggcggcgtaaccggtggcattattggtggcggtacatctcctatttcgccagttattgatgttgttcaaggtggcatcgatattcttcaaggcgttgaaagcctaaaaactgaaattattaacactggtattgatacagtagccgacactattattggtgtattacctcaagctgagcatccagtttctgaaattgcagaccttggcacattaactttcgaaacgtctcgtgacacggtcaacggcgctcttgaagttgtttctgatttagtcggtggtgatattcaaggcgctactgaaaatgcaactggtattttaggaacacttattcagaatggttcaacagcgactggtattgtgactgatatccttggtggcgtgacaggtactatcggcggcgtaactggtggtatcggtggtgacaatccgcttggtgtagtaactgacatcatcggtggtattactggtggtatcggcggtgataaccctcttggcgtagtaactgacattatcggcggcgttactggtggtattggcggtgacaatcctcttggcgtagtaactgacatcatcggtggtgttactggcggtatcggcggtgataatccgcttggtgtagtgactgacattatcggtggtgttactggcggtattggcggtgacaatcctcttggtgtagtaactgacatcatcggtggcgttactggtggcattattggtggtggaacatctcctatttctccagtaatcgatgttgttcaaggcggcatcgatattcttcaaggcgttgaaagcctaaaaaccgaaattattaacactggtattgatacagttgcggatacaattatcggtatccttccacaagcagaacatccagtttctgaaattgcagaccttggcacattaactttcgaaacgtctcgtgacacagtcaacggcgctcttgaagttgtttctgatttagtcggcggtgatattcaaggcgctactgaatcggctaccggtattctcgatacgcttattacaaatggtacaactgcaactggtttagtaactgaaatcattggcggagtaacaggaactattggtggcgtaactggcggagatagcccactaggattagtaactgatttacttggtggtttaactggtagcgtaggcggcgacagtccgcttggcgtagtcactgaccttctcggcggtttaactggtagcgtaggcggcgacagtccgcttggcgtagtcactgatctactcggcggtttaactggtggtgttactggcggtacagacaaccctatcggtatcgtaacggatatcgttggaagcttaacgggtggtgttactggtgaaggcagtttagatgttatttctaatttgctaggcggattaactggtggtagcttactcggtggtgtaacttctacagtatctagcgtaacaaatacaacgcatacgatcgtaccgacatcattacttactgataacttcctagaaaactcattcaatactgtttaa

SEQ ID NO: 158 - DNA, 2448 bp, Acinetobacter baumannii
acctatctgccaagcatgaaaccaaacgacatgacaaaaaactgggttgaccccgaagcaaaagccgaagctgaacgttatgacaatcctattccaagccgtactcttattttagatacgttggaacaattgcaaacaccgcaatctcatgcagaacttgttgaccattttcatattcaagatcagaaaagtatcgaagccttaagtcatcgcttaagtgctatggttcgtgatggccaacttatgaaggatggttttaagtttcagttggtggcagaccaacctacctatgaagcaactgtctatattaatagtaaaggtttgggtacagcacatattgatggtcaagatgatttgttattacctgagcgtgagttacgtttagtctttaatggtgatcgggtccgtgttcggcagacatcggtagatcgcaaaggtaaaccgtggggtttcattaccgaagttatacagcatcgtgtaaaacagttaattggtaaattgtcggtacatgacggcgaatattttattcagcccaacaatccaaatcagcatcaacctatcccactagaaaaagaattggttgaacatgctaaagcaaatgtcggcgatatgcttcgtgttgctatagacacttacccaacccgggaagaatttgcaacggcacatattattcagtctatggcagataaagccgatactgaaattattatcccgcagaccattttagagtttggtttgccttacgaatttccagatgaagttataaaagaagctgaaagtttcaaagaacctgctgaaaaagatcgcgaaggtcgagttgatttaagagacttggcacttgtcacaatcgatggtgaagatgcgcgagatttcgatgatgcagtatatgcggaaaaacgtcctggtggtggttaccgagttgtcgttgcaattgccgatgtgagccattatgtacgtttagattcggcattaaatgaagaagctgaagagcgcggcacttcggtttatttcccacattttgttttaccaatgctaccagaagcattatcaaatggattgtgctcacttaacccacacgtagatcgtctatgcatggtctgtgacctaaaactttctcgtacgggtcgtgttacaggttatgaattttatccggcagtcatgcattcaaaagcacgtttgacctatacacaagtaggacaatattttgaaggtgcaactgatgcaattccaaaagatcgtgatattcataaatcgctaaatacacttttccagctttaccagattttgaaaaacttacgtgttgatcgtcatgcaatggagtttgaaaccattgaaacttatatgacctttgacgagttaggtggaattaaagaaattttacctcgtacacgtaatgatgctcataagcttattgaagagtgtatgttgcttgccaatgtagcagcagcagaatatgccttagaacatgatattccgatgttgtatcgtgtacatgaggcacctgaattctcacgtattcaaaaagtaaaagattttgtaaaactattgggtttacctttccctgaccaaccaactcaggcagattatcaaaaagttattgaggcaactaaagaccgtattgatgcgccaagcattcacgccgtgttattacgctcaatgatgcaagcttactatggtgccaaaaatgcaggtcactatggtctagcttatgaagcttatacacatttcacttcaccaattcgccgctacccggacttattgttacatcgtgcaattaaagctcatctaaaacaaaagccttacccactttccggtgcagctttagatgatgcaggtgaacatttctctcaaacagaacgccgtgccgatgaagcatcccgcagcgtaacgacttggttgaaatgtcactatatgcaacaacatttaggtgatgagttcattggtattgtgagtgcggtaactgaatttggcctatttgttactcttaaagatctttatgttgatggcatgattcacattagccaacttggcgatgatttctttatttacgatcaagccagtcaaaacctcattggacaaaatcgtggccaagtcttcggtttaggtgatgaagttaaaattcaagttgctggtgtaaatctagaagagcgtaaaatcgatttccaactcattaaacaagttactcatgctggacgtgtagttcgtagtcgtgctccacgcacaaccaaaacaagcacccaaacaacagaagaagtttttggtaaaccatctgtatcaactgatggtgaaaaacctgtccgtaaaaagaaggaaaaaggtaaaccaagctcatatagtaaaaagtctggtaagaaaacctctacaaaagcagaggctaaaccagaaaaagtaaagaaaaaagcgaaacctaaaaagaaaaagtcaaacgccaagtctaaggctgactaa

SEQ ID NO: 159 - DNA, 840 bp, Acinetobacter baumannii
aaaataatgacaaatgcgcctaaaccagagcaagatttaactcataatgaacattcttttgatgggattacgttcgaagtggttgaagaagaagataatccggaaggacaaaaagtgaagcgcagaggtatttacctttggcctaacttaatcacgacagccgctttgttgtctggtttctattccattattgcaagtttgaatggcgaatttgctcaagcgatttatgccatttttcttgcagcattatttgatgggttagatggacgcgttgccagagctattggtgcccaaagtgcttttggtgagcaatatgactctttatcagatttgttagcatttggtgtagcgccagcaatgctaatgtatagctggagtctacatgacttaggccgtatcggtttggcatgctgttttgtttataccgcttgtgccgcgttccgtttagcacgatttaatgttcagattggagtggttgataagcgctattttattggtattgctagtccactcgccgcgattatcattatttcactcgtatgggtagctcgtgattatccgttcatttttgatttacgcgatattgctattcaaaccattaacgcggtcatcatggtggttgtaggactacttatgatttctaatattaaatattattcatttaagcaaatggatcgtaagcgtgttccttttgtagttatgttgccagtagtactgatttttgcagcaatcacttataatattccaatgggtattttgattgtatcaatcatctatgctctatcaggttttgttaccacacttttagctaaaaaaaataacgagaccatcaaaacataa

SEQ ID NO: 160 - DNA, 396 bp, Acinetobacter baumannii
ttaagtaggactatcaccatgcgtcatcgtaatagtggtgtgaaattaggccgtacaagcagccatcgtaaagcgatgttccaaaacttggctaattctttatttgaacatgagttgatcaaaacaactttgcctaaagctaaagaattacgtcgtgttgctgagcctttaatcactctagcaaaaaacgatactgtagcaaatcgtcgtttagcatttgctcgtactcgtaatgctgcaactgttggtaaattatttaccgtactcggccctcgttacaaagaacgtaacggcggttatctacgtgttcttaaagcgggcttccgtgctggtgatgcagcaccgatggcttacgttgagcttgtagatcgtgaagtgaacacttcagctgaataa

SEQ ID NO: 161 - DNA, 579 bp, Acinetobacter baumannii
aaggagtgtgctatgaaagatcatgtactcaataaaaaagtgcttttggtcgcagggtgcatttctgtttctgcatgtttacaggtgtttccggattattttatctattggcgtgaaagcttactcggcgagttctggcgtttatggacagcgcactgggtacatgtcggatggattcactttcttttaaatatgatggcatttgcatgtttgcctttcatatttccccataccaaagtgtggcacattttaagtcttctttttcttttgccaccttttattagtttggtgttctatttttatttgcccaatatcgatgcatatgcaggcctttctggggtactccatgggttatataccgcagttgctttggtttacttgcaataccgtaaagaaaggaattttgcatttctggtcttaggtttaattgttgcaaagttgatttgggaaaatacatttgggcaaacaggaacagcccagctcattggtagtccagttttaactgaagctcatctatatggggcgattggtggtgcaatctttggaggatgctattggctcatacaaagattcaaatag

SEQ ID NO: 162 - DNA, 456 bp, Acinetobacter baumannii
gctttcaacgccttgaagaatatcgatgccgccttgaacaacatcgattactggagaaataggagatgttccaccaccaataatgccaccagtaacgccaccgatgatgtcagttactacaccaagaggattgtcaccgccaataccgccagtaacaccaccgataatgtcagtcactacaccaagcggattatcaccgccgataccgccagtaacaccaccgatgatgtcagttactacgccaagaggattgtcaccgccaataccaccagtaacgccgccgataatgtcagttactacgccaagagggttatcaccgccgataccaccagtaataccaccgatgatgtcagttactacaccaagcggattgtcaccaccgataccaccagttacgccgccgatagtacctgtcacgccaccaaggatatcagtcacaataccagtcgctgttga

SEQ ID NO: 163 - DNA, 648 bp, Acinetobacter baumannii
agcttgcattttttcggatgctttttaaaatacgcatttgctttaaaaagcatccgtctagaggattctcccgtgcacgcactagaacagaaaatcttaacagaaggtatcgttctatctgatcaagtgttgaaagtcgacgctttcttaaatcaccaaattgaccctgtactcatgcagcagattggtaaagaatttgccgctcgctttaaagatgcagggattaccaagattattaccattgaagcttcaggtattgcgccagcaatcatggcaggtttagaacttggtgtacctgtgatttttgctcgcaaatatcaatcgcttactttaaaagacgatttataccgcgctaaagtgtttagtttcactaaacagacagaaagtaccattgccatttcaaataagcacatcaactcaagcgacaaagccttagtaattgatgacttcttagcaaatggtcaagctgcgcttggtttgattgacttaattcatcaagcaaatgcagaagttgtaggtgtgggtattgtgattgaaaaatcattccaaccaggccgtgatttattacttgaaaaaggttaccgcgttgagtcattagcgcgcgttcaatcacttgctgatggcacagtaacttttgtaaaagaataa

SEQ ID NO: 164 - DNA, 948 bp, Acinetobacter baumannii
atatcagtttatgttttattcggtaataccgtggggaaaaggcatctatatgcttttaagattatgttgaaaaaaagaagtctatccatagagcctttttattattggtggcaagaccgagtctttatcgctgcaataatattagcaatcttactgcatatttttgtgttgctcatccattttgcgatgcctgcgccatcagaacaatcgactaaagaaattgcaatatcgattcgtcctactgaagatgtaatcaagcatgcagactttttagctcaagccgatcaacaaggttcaggagcttttcgggaagctcatcggatgtcgagtaactctccaatgcctatgccaagtgatgcttcaacaggagaagctcagctagaaactttagaaaaagtgcagcaacaaagagaacttaaatttgaagaaaaagtactcatgactgtattgagttggcagaaacaagcagaggagagccaaagaaaaaaagcacttgaacaattacaaagtcagtttcaggcaaaagctgccatggtagcgagtcttgaagctcagtatttacaacgtcagcaagattttagtcgccaacaaaaaataaaaacagtagatggtattcaagccaagaaagatgcgtcggcagcttatctagataaatttcgtgaaaaagtagagctttatggcaaccgttattatccagaagaagcgaaacagcaacagttaaaaggtgaagttcgccttatggtaattttgaatgctcaagggggaattcgtgcaattcgtttgcttgaaagctcaggtcatccagttctagatgaagcagcaaaggcatcggtacggcgtggagcgccgtttggccgttttgatgcaaatatgaaagatatttcagagcttcgtattattcgtacatggcgttttgatccagctgaaactgaatttgaagttcattaa

SEQ ID NO: 165 - DNA, 1524 bp, Acinetobacter baumannii
agttatattctcaacaatgggtataaaaataaaatggaaaagcaagttgatgtattaatcattggtgcaggcatatcaggaataggagttgctgcccacttatctaaaaactctccacaacgtcagtttgaaattttggagcgtcgtgaatcgtttggtggaacttgggatcttttccgctatcctggtatccgttctgattcagatatgtctacttttggttttaactttaaaccatggcgcaaagccaatgttctcgctgatggtgcctctattaaaggatatctaggggaagtgattgatgagtttaagttaaaagaaaaaattcatttcggccatcgtgtcctttctgcgaattatgattctgcttcgaaaaagtggcatgttattgttgaggacaataagaaaaaacagcagacttgggttgctaacttcgttgtaggttgtactggttattataattatgaccaaggttacgcgccaactttcccaaatcaagaagctttcaaaggtcaactcattcatccacaacattggccggaaaatttggattataagggtaaaaaagtagtaattattggtagtggagctacagcaattacactggtgcctgcaatgtcaaaaggtggagcaggtcatgtaacgatgttgcaacgttcaccaacttatattgcttctgttccgtctattgatttcatctatgaaaaaactcgtagatttatgtctgaagaagcagcctataaatttacgcgtgctcgtaatattggtatgcaacgagcaatttatgcattgtctcaaaagcatcctaaaacagttcgtcgtttactcttaaaagcaattgaaatgcaacttaagggtaaagttgatatgaaacattttacaccttcatataacccttgggatcagcgtctttgcgtagttcctgatggtgatttattcaaaattcttcgtgaaggtaaggcgagtgttgagactgatcaaattgaaaaatttactgagactggtattcaattaaaatcaggcaagcatcttgatgccgatattatcgtatctgcaacaggtttgcaggttcaaatcatgggcggtgtgcaggcaactattgatggggagccagttaaatcatctgaacacatgctttataacggcgtgatgctcagcgatgtaccaaacatggcgatgattattggctatgtaaatgcttcatggacattaaaagttgatattgcagcagattatatctgccgtttattaaactacatggataagaataattatgatgaagtcattccatctggtgataagagtgtgatggaagaggacacagtcatgggtagcttatcatctggttatattagtcgtgctgccgacgtgattcctaaacaaggtaaacaagcaccatggcaggtaaccaataattatcttgaagaccgaaaatcattaaaaaatgcaaaatttgatgatggtgttctacgttttcataagcattcagaagttaccacacgtaaaccaaaattagtgtcttga

SEQ ID NO: 166 - DNA, 321 bp, Acinetobacter baumannii
tccataaaatatgatcacttcggatcgtactcaccacaccattttgaatccccgcttctcgaaactcatcaaagtggtggctacactctttggcaacttgagtatgatattcagcagaataagcttggttcacaattgcgaaaccatgagcatttaagtcatctaaaatctggttcagattccagcagtcaggaagcggttgagagtgcatataacctcatatcgatcgtaagaaaatcaagcagccttattttagatgatcacaaccttacgaaagaatatttttttcatgttaaactaatcgttgaattgaggaattaa

SEQ ID NO: 167 - DNA, 612 bp, Acinetobacter baumannii
ggttatatgcactctcaaccgcttcctgactgctggaatctgaaccagattttagatgacttaaatgctcatggtttcgcaattgtgaaccaagcttattctgctgaatatcatactcaagttgccaaagagtgtagccaccactttgatgagtttcgagaagcggggattcaaaatggtgtggtgagtacgatccgaagtgatcatattttatggattaacgaatctcttcctgttgctgagcagcatgtagaaacattaacttcattttgccagcatctaaatcaagctttctttttaggtattaaagaagtagaagcacattttgcctgttataacccgggtgaattctacgcattacatcgagataatcctcagcaaaaaaatgatcgtattatgtctaccgtttattatttacaccctcaatggcaagatgactggggtggacaattacgcttacaagataaaaacaatatttggcacattatcacaccagagcctaatcgcttagttatattccagagcaatttgcttcatgaggttttagtttctaaacagcagcgcctctctattactgcttggcttcgtagcggaaactcaatttgggtttaa

SEQ ID NO: 168 - DNA, 2004 bp, Acinetobacter baumannii
tcaggatttaacgcatttatgagaccgggtaaaaagagctcatcaaacaagagtcgtgtgatgaaaaataaatatgcacatcgtagctggttaggagctgtgtgtttacttggttgttcattatcttatgccgcggaagaacaatttaacgatgcactaaatgccgccaatagtggtaatactgcattgttagatcaatatcagcttgcaatgcaaaatgatgtgttgggctactatcctgaatattggaaattaaacacgaatttaggctttcaatctccgacatcaattgtaagcttcgcacagcgctatccacagtctgctatggcagaaaagctggccgcggattatgttgaagaaaaagttaaacaagctgactttgcatctgcacaaccaatcttgccttatgtttcgaatcctgaccaggccgaaaattgtgctttagcgcaggtgagagctaaaagtggtgatgcattagtttttgctgaatataaagatgtatggttagccactgaatcgcaaccagaatcatgtattggactcggccgtatgatgctgtctagtccattaatgagtacacaagacaagcagcagcgcctgtgggtacagttacgtgcaggtttatctggacaggcgcttgctacagcacagactttgggtttgaatttgtctttggctcagctcaatcagattcaggcgaatccactgaattacttgtggtcagcaccaaaaaccaatgacgtagattacgcctatttaatttttgcactaggccgtttagcaaataatgatttaggaaatgcttttgcaaatgtacagcgagtagcgcaaggcactccagagagcgtgcaaaagtatctctatcgaaccgtagcctatattggtggaactacggtaatgaaaaacaactttaaccgtgaagtccttcaatattttgacgcaagttatggctatccgttaagtcctgaagaagctgaaatttatgcacgacaagctattcgttttagtgcctgggaaagtttaattcgtgcaattgatagtatgtcagtttcacaaaaacaagaagatcgctggcaatattggttagcgcgtgcaacagagcaacgtggcgatagtaattctaaaaacacggcacaacgtatttataaaaaattagctgaaagtggggatgattatcacaaccttcttgcaaaagaccgcttaggcgtacgatataatcatcagccgtataatgatgagccaactgcaagtgatttacgccgtttagatcaaaatattcactttaatcgtgcatttactttaagacggattaatgccaacccaacctatactaaccgagagtggaactgggctgttcgtcaagcatatctacagcatgatgatggattactattagcggcggcaaaacgtgctcatgatatgggatggtatgaccgcgcgatttatgcggcagatcgtacaacgaataaacataatgatacgtatcgttatgtgaccccgcataagaccaatgtcgtaagccatagttacaatgctggaattgatcctgcttgggcttatggtttaatgcgtcaagaaagccgatttgttacctcggcacgctctcatgtaggtgctggtggacttatgcaaattatgccggatacggcaaagttgattgctcgccagatgggagaaacatataatccggcagcgttaagtgaaatgaacaccaatattcgttatgggacattttatttatcgatgattcaagggcagttaagtaataaccctgttttagcaacggcaggttataatgctgggccgaatcgggcaagacgttggcaacctgattaccaaccgattgaggctgatcaatatacagaaaccattccattgcttgagaccagagattatgtcaagcatgtcatgacgaatgcgacgcattatggagtgatattaggtcaaggtgctcaatcattaatacaacgtatgaaagtcattccaacgcgatcatcaccttag

SEQ ID NO: 169 - DNA, 390 bp, Acinetobacter baumannii
aagatggctaaagatactcgcacacgcaagaaggtcactcgtaccgtctctgaaggtgttgcacacattcacgcgtcttttaataacaccattgttacgattaccgatcgtcaaggtaatgcattggcttgggccacctcaggtggacaaggcttccgtggttcacgtaaatcaactccgtttgctgctcaggtagctgctgaagttgctggtaaagcagctttagattacggtttgaaaaaccttgacgtccttgtaaaaggtcctggtccaggtcgtgagtctgcggttcgtgcattaggcgcagtgggttataagattaacagcattaccgatgtgactccaattcctcacaacggttgccgtccacctaaaaaacgtcgcgtgtaa

SEQ ID NO: 170 - DNA, 537 bp, Acinetobacter baumannii
acagtattgaatgagttttctaggaagttatcagtaagtaatgatgtcggtacgatcgtatgcgttgtatttgttacgctagatactgtagaagttacaccaccgagtaagctaccaccagttaatccgcctagcaaattagaaataacatctaaactgccttcaccagtaacaccacccgttaagcttccaacgatatccgttacgataccgatagggttgtctgtaccgccagtaacaccaccagttaaaccgccgagtagatcagtgactacgccaagcggactgtcgccgcctacgctaccagttaaaccgccgagaaggtcagtgactacgccaagcggactgtcgccgcctacgctaccagttaaaccaccaagtaaatcagttactaatcctagtgggctatctccgccagttacgccaccaatagttcctgttactccgccaatgatttcagttactaaaccagttgcagttgtaccatttgtaataagcgtatcgagaataccggtagccgattcagtagcgccttga

SEQ ID NO: 171 - DNA, 1110 bp, Acinetobacter baumannii
agtctactgaaaggttttctcttgactgcagcgattcgacgtaccgtaacatttcctgaaatttcaatggaacgtttaaagagcatcttgggtgcctataatgggcaccttaagcaaattgaacagcgtttagatgtcaaaattactcatcgtggagatgttttttacatagatggtgagatagatgctgttgggagagccgaagcgttattgcaacgactctacgaagaaacagaggcgtcccaacaaatcagtgctgacctgttacacctcttgattcaatcttcgcaaactgaacgaaacttcgaactagttggcgaagaaatggatgagcatgatgcgcccatggatgtctatttccagactcgaaaaggtcgcattaatccacgtggtgccaatcaaaaacgctatgtacaacgtattttacaaagcgatatttcttttggtgtaggccctgctggtacaggtaaaacttatttagcagttgctgccgcagtggacatgttagaacgtaatgaaatccagcgtattttacttgtccgccctgcggtagaagcaggagaaaagctcggtttcttacctggtgatttaacccagaaaatcgacccatatctacgtcctctttacgatgccctttacgaaatgctgggctttgaaaaagtagccaagttaatcgaacgtcaagtgattgaagttgcaccacttgcttatatgcgtggtcgtactcttaaccattcatttgtgattttggatgaagctcaaaacactacaccagaacaaatgaaaatgttcttgacccgtttaggttttggctctcgtgcagtgattacaggtgacattacccaagtagatttacctcgaggccaacaatctggtttggcacacgctcttcgcgtacttgagaacattaaagaaattcatattacccgtttccattcccgcgatgtagtacgccatcaacttgttcaaaaaattgttgaagcttatgagggatgggatggtgaacaacagcgtcttaatgctgaagcacgtgctgaacgtaaagcacgccaagaagcattaattgctgaaaacgatacagcagcagacttgcaacatcaggatgcttaa

SEQ ID NO: 172 - DNA, 1029 bp, Acinetobacter baumannii
ataatccttgaggtagcaataatgacgcgtactgcaaacgagtttctaactccgcaagcgatcaaggtcgaagcggtaagcgggacctcggcaaaagtgattctggaacctttagagcgtggttttggccatactctaggtaatgctttacgtcgcattctattgtcttctttgccaggcgctgctgtggttgaagtaaagatagaaggtgtcgagcacgagtacagtactttagaaggcttgcagcaggacatcgtcgagctcttgctgaacctaaaaggattgtctattaagctgttcgatcaaaatgaagcttatttaacattagaaaaacaaggtcctggtgacattactgctgccgaccttcgtttacctcataatgttgaagtggttaacccagaacatttaattggtactttgagtgctacaggctcattaaaaatgcgcttgaaagtttctcaaggtcgtggttatgaaacatctgactctcgtttccctgaaggcgaaacacgtcctgtaggtcgtttacagttagatgcttcttatagcccaattaagcgtgtttcttacaccgtagaaaatgcgcgtgtagaacaacgtaccgatttagataaactggtaatcgatcttgagaccaacggtacggttgatcctgaagaagcaatccgcaaagcggcaacaatcttgcaacaacaaattgcaatttttgttgatcttcagaaagaccaaactcctgttgctcaagaacctcgtgaagaaattgacccaatcttgcttcgcccagtagatgatctagagcttactgttcgttctgctaactgtttgaaagcagaaaatatttactacattggtgatcttgttcaacgtactgaagttgagttgttaaaaactcctaaccttggtaaaaaatcgttaacagagatcaaagatgttttggcatcgaaaggtttacaactcggtatgcgtcttgagaactggccaccagctagtcttcgtatggacgaccgttttgcctatcgtagccgttaa

SEQ ID NO: 173 - DNA, 1131 bp, Acinetobacter baumannii
tgtacatctgaaaaggaaaaaacaaattacatcgaggacaggaagatgtctaaagtccaaaaaatatgccaaggtttggcggtaagttttcttgcagcttcagttttatcaggttgttcatacgtcgtgaaaagcggagcaaatgttgctttgggttttacggaaaagcacgtcgttccacctattttggcaatgcaagatgctgaaatggtttgtaatactggtagtgccttaactcctgcaatcatgtcgactaaaggtatgggtgcagatcctactcgtgttgctgtcttaatgtatgctgcttcaggtgtatgcgcggaaaaccaagcattagaacaggaattacgttatttgcgtgcttcaaaagcagggcaggtaacagaagctcaagatgcacgtattgcacagaagcgttgggctgcaattgctgctgagcgacaatacgcaggctataagctctttgctgatcgttgggaatctaaatataaatatcatttaggtgattcttgtccaacaatgcgtagtgatattgaccaaactgtatatttacttgggatgattagtggtcttcaagctgtgaccaacgatattaactctggcggttctgtcaatgttccgaaagatattgctgctattgtagagcgcggtatggtctgccttgataaccaaaaattctggggcgcaccaaatgcaacccgtgcagtgatctggactttattaccaggcgctaatgaagggaagcctgatccatatgagactttaaaacagtccgtgcaaattggtgaacaaaaaggtgtgcgtttatctcatgcattatatgccgtagctgctcaagcgagtggtgacgatgccaaaatccgtgatgcattaaaaacttatgccgcatctcaagcagatgacaaacctgtcaatccgaactttaaattaatcgatagtatggctggtttaattgtgcgcggtatttctgaccgttactggactgagcatactggtgttcgtactggtgatgacggtatgtctcatttctgggatgagaaaaacgaaggctcagctgaattggatgagttgtttgatggtggagctgcatcggaagccccagctgacacaaaaactgcacctgcacagtaa

SEQ ID NO: 174 - DNA, 1251 bp, Acinetobacter baumannii
cgcatgttagaacgttttttgaagaagcttcctttttataacaagacctggtttcaatttattttattcgtaattaagcgttttgaagcggatcgttgccgtgaacaagccggctccctcacctatacgactctttttgccgttgtacctatgttaacggtatttttagttatgatttcttcaattaaggcattggaacctgccagacaacagttacagcacttaatctacagtaattttttacctaaaagtacgattgcttttgataaagctcttaatgcttttaccgaaaagtccagtaatttaactgtaattggtgtgctattcctctttgtcacaacagttttaatgcttacttcaattgaaaccgtttttaaccgaatatggcgagtaaaagaaacccgtagcggtattgtaggctttatgcgttactggaccattatttcgcttggtccaattattttaggcagtgcatatgttatttcatcaactgttgcttccatgaatttattgagcaataacttcacaggttatcaacttgatggtgcctttttactctggcttatttcttttgttctcacaattttaggtttttttattttatattggactattcccaaccgcacagttcccctgtatgcagcagcaattgctgcatgcttaagtgctgcattatttgagacactcaaaaatttatttagctttgttatgtcaaatttcaccagttatgaaatcatatatggtgcgtttgcagcagtacctattttcctattatgggtcttcttatcttggaatattgtattgcttggtgtcgaggtaagttttgctcttaccgcttttcattcaggcaaagagcaaaaaagacatccggttttaatgctgctcgatatcttggaattgttctataaaaagcaaaaacttggtgaaagcgtaagtgataaagaagcattagaaattttaggtcgtggtgaagttggtcgttggcctgcttatgttctcttactagaagagcaaaatctggttaaacgtaccgataaggatgaatatgttttggtccgcaatttatctcaagtcgacttttggagcttcttcactgcactgccttatccattacctttacgtcaggatgtatcaaatgtgcatgatgatgacgaatggatggaaaaaattggcccagctttagtagagtctaatgattatttagctgcaaagctctctattccactttcaacaatttttgaagagaaataa

SEQ ID NO: 175 - DNA, 258 bp, Acinetobacter baumannii
atgtctgaagaaatgaccttggaagaacgtaaagtaatctatcgcgcacgtcgtggtttaaaggaaattgatgtctattttgacccttatgtgaaaaattattatttaaaggcagacccggcagaaaaagcgttgtttgctgagttggtagaacaggaagaccctgatttactagattggtttatggaagtatcagaaccaccacgtaccgaattacgtgactttatctataaattaaaacactatgttcatggttaa

SEQ ID NO: 176 - DNA, 186 bp, Acinetobacter baumannii
actcaatattgccaacccatatcaggaataatcaaattctctcacacgattaagaacacagtcagcttcttaatacattttaaaaatgtggatatcctaaaagttatccacattttttcattaatgaacttcaaattcagtttcagctggatcaaaacgccatgtacgaataatacgaagctctga

SEQ ID NO: 177 - DNA, 2061 bp, Acinetobacter baumannii
aaaataatgtggctattagcaatgactttacagcaagcgactctacctactccccgctttgatcaaattacattagataatttaaaacaagatattcaacaagcgattcaagcaggacaagagtttttaaacacccttacggctgcaccatccgagacagaccagcaacttgccgtacttgaacaaattgatgcacttgaaaataacctcagtgaatcgtggggagtgttgtcacatttaaatgctgtgatgaacaatgctgaaaccagagaagtctatcaatcactattacccgctttaagtgaatattacactcagcttggacaacacacggcgttatatcagacctatcaactcattcatgatggtcagagctattcaaagctaagccctgcgcaacaaagtgccatccgtctcgctttacgtgattttaaactttctggtgttgctttagagggtgaagaaaaaaaacgttacgctgaaatttctgcacgtctttcacagctttcttctgacttctcaaaccatgtacttgatgcgacacaggcttattttaaaccactgacagaagaccaattaaaaggtcttccggaaagtaatgttgagttattaaaacaatacggcaaacagcgtgagcttgatcaagcggtcgcaactttagattttccagcttattttgccatcatgacctatgccgatgatcgtgccttgcgagaagagctttataaagcttatgtcacacgtgcatcagatcagtctgagcaaacagaatttgacaacagcaaaattatggaagaaatcctgagtcttcgccaagagatggcaaaactactcggttttaataactatgctgaatattctcttgccagcaaaatggcgcctgatgtcaaaacagttcatgactttttggtcgacctagctgagcatgcacgtacccctgcacttcaggaagttgccgaactccaagctattgccaaacaagatggtattgatgagcttaaaccttgggataccacttactattctgaaaagcttaaacaacaacagttcaacttatcacaggaagctttaaaaccttacttccctgcaccaaaagtgattcagggattattccagatcgtacagcgtttatatggtattaacatcgttgaacgtgaagctccggtttggcatccagatgcacgttattttgagttagaagaccaaggtgaagtcattggtggcttcttctttgatttatatgcgcgtacaggtaaacgtggtggagcatggatgagtggtttccgctcacgtatgcaaactgttcatggtttacaaaaaccaatttgctatatggtgtgtaacttcactccacctgtaggtaaccaaccagccttactcacccatgatgaagtcattaccttattccacgagtttggtcatggcttacaccatatgcttactgaagtagataatatctcagttgcaggtactcacggcgttgcctgggatgcagtcgagttaccaagtcagtttatggaattctggtcatgggataaagaaagtcttgatgttttaagtgagcatattgagagcaagcagaccttacctcaagagttacttgatgctttattaaatgcacgtttcttccagtctggtatgcaaactttacgtcagcttgaatttgccttatttgatttaactattcacaccaaaactcctgcgttgaagagtgaacaaattcagcagaccttaaatgatattcgcaaacaatatgcagtagttccaaccgtggactacaaccgtttccagcatagctttagtcatatttttgcaggcggctatgcagcaggttactactcttacaaatgggcagaagttttagcaagtgatgcttttgaccgttttgaaaatgaaggtattttcaatactcaaacgggtaaagaattccgtcaggcaattttagcggtgggcgggaaagatactgctcttgaagcatttgtgaatttccgcggtcgtgagccaaaaattgatgcattgttacgtcatcaaggttggacgaacgataacaaaaccgcttaa

SEQ ID NO: 178 - DNA, 660 bp, Acinetobacter baumannii
aattggctacgccaaaaaaacaaaaaataccgtatagtgttctttttaacaaaattcgtgaaaccgatgcaaccttacattcttgtgctttattacagtaaatatggttcaactaaagaaatggcgcaccttattgcgaatggtgttgaatcggcaggtgtgaatgtaaaaattcgcacagtacctaatattgcaacagtggtaacagaagctgagccaagtattcctgaagaaggtgatatttattgtactttagaggaactggccaattgtgcaggcttagcgctagggtctccaactcgctttggtaatatggcaagcgaaatgaaatatttttgggatcagactacaagcctgtggttaaatggtgctttacataataagccagcatgcgtttttacttcttctggttcaatgcatggtgggcaagaaagtacgttattaacgatgttacctccattatttcatcatggtatggtgattttaggattaccaaactctattccggctttgtcgaatactaaaacaggtgggactccctatggcgcaagccacgtgagcggtccaagacatgatcaaagtttaagccaagatgaaaaaattttatgtgaagctcaagggaagcgtttaggcgaaatcgtaaaaaaactttattcttaa

SEQ ID NO: 179 - DNA, 915 bp, Acinetobacter baumannii
atggaagagcgcaaaaatctggataccagagcttcggctttaatggtgcttttatgtatggtcttagggctgcaacaggtggttctgaaaatagcagcaccagatatttcgccgattatgcaaatcgctttacgttccggcttatctgttgttctagttttacctttattgtggcgagatcattcgattcatctattttcttatagacaatgcaaagctggcgctcttgttgctttatttttttcattagaattttatttcgtcacccaagccttaaagtttacctctacctctcatacagtagttttactgtataccgctccaatttttgttgcattagggcttcattggaaatttcctactgaacgtctgaatcgagcgcaatggggtggcattactctggcttttatggggatcattcttacattttacccaacaaccacagctacaaatgcgccagctctagcacaagttttgttaggcgatttatatgcacttatggctgggcttgcatgggcactcagtacaattattgttcgtttatctcctttagctcaagcaccagcaactcaaacattgttttatcaactgtttggctgttttgttctactcctattaatcgcttttttaacaaatcaaacaacaattcatttcaccactttaacgatcttaagcttaagctttcaaactttaatcgtatcttttgcaagtttactattatggttttggttattaagaaattatcttgcatcacgattaggggtattttcttttttaactccgttatttggtgtgttatttagtattttgttattagaggaaaaattagaaattaaatttatttttggaagtattttagtgctgtcaggaatagtcatcatgagcctaaagcagggcaaagctaacagcagctaa

SEQ ID NO: 180 - DNA, 546 bp, Acinetobacter baumannii
ttaaaaaggcgaaggcgtatgtctattgaaacaaaagcgattgtgtccagaattggtgaaacagaccaactctatttaactgagaatacgcccgagcttgctttggagcgtgcagaattacgtatgcagctcgttacgttaagccgtgttcgccaagaacaaattcacttcttgcaagaagccattgttttgctggaacaagctcgtatggaatatgaagaaatgccaatgagtttgtatttaaacctatcgctgcatttagctaaagcttatatgctttattttgagttaaataaggaaaaacgctttgcgctgattgctcaacaaattttgaaacctctagctcatcatcaacatggcgatatatattttttcttggcttatgcgtcagcagcacagcaagagtctgcactaactcgtcattggctcacaaaatatttatcaactgctcaatgtgatcttgagttgcttcatgaacatcctatattcaatccggtacgtcatgaaacatggtataaaaatttaatcaagttaagaactcactaa

SEQ ID NO: 181 - DNA, 663 bp, Acinetobacter baumannii
atgaaatatagagacctaggacttcaatcaatatcgcaacttgcatggtggatcatctgtgcaagcgttggtttgttgagttctgttttacatgcggaacctgttaacgtgcaaggttatgttatgcatgtacagatgacgcctgctgtttgtgcgctagatccttctaaacaaaagcagcgtaaatgtcttgaaggatattcgcttacgattactggtttaatgcctgaaaccaccagaactgactgttcaacacaaagctcagctacactgtcaccactgcaagctaaggtggtcgctcgggtgatgccagataataatgctcgtgtgcaactctggagaagtgtgggtggctgtgtgcctatgaatgcaagtcaatatttccgtacgattattaactttgctgaacgtttaaaaatacctgctaatctaaccagctctactaatgtggaaatgcaacaatctacattacgtcaacaatttaccaagcttaatccgagcttacctcaaaatggtattcgcttcacttgtcagctctcacgctctgatgtcgtactaacagaagttaaagtctgttacacggtaaatggtcaatataagcaatgctcaaatcacgttgtctctaattgcccaagcgaaattactattaaaggcagttattaa

SEQ ID NO: 182 - DNA, 351 bp, Acinetobacter baumannii
aatttaataagaacacacaaaaaacaacaagaaaatataggcatagatatgcaactcacatctattgttgttagattattgaaaagaagccatgggagaataacaatgtttgaacaacaaccgacattacaacttttatttgagcaattgggtttagattctgatgatgcaagtattgaaaattttatcagaacgcatcaattgccggctgaacagaagttacatgaggcctctttctggtcccaaggccaaagtgattttttaaaaagtcattgggaaaaagatgatgagtggattgtagttattgatgagctgaatgagcaattacatgaagatagtgtaaaaaaataa

SEQ ID NO: 183 - DNA, 486 bp, Acinetobacter baumannii
ggattcattttgaaaatcagtttaagtttacaacaagactttcaatcccctgagttagagctcaaacgagctcaactcaaaaaaattattgagacaactttacgccacgttggctataaagaagattgcgaaattggtatcgcatgtgttgatttggaagaaagccatcaacttaacttccaatatcgagagaaagataagccaactaacgttctatcttttccaagtgatattcctgaagaagttttaccaatgctcgacgcattaccgttgggtgatttagtaatttgtattccagtggtattacaagaggctctggaacaaaagaaaaccccacaaaatcattttgcgcatcttttagtccatggggttctacatttacttggttatgaccatgaaacaagtgatgaagatgctgaagaaatggagggtttagagatcgaaatcttagctaaactcaatattgccaacccatatcaggaataa

SEQ ID NO: 184 - DNA, 717 bp, Acinetobacter baumannii
agattgtgtggattctttagtaaatcatcttctggaagttcttttatgcaaacgctattttcctcattagtcaaacgtcttcataaagtctaccgaaaagctgaagccttcattgaggaagaaagagattttacattatcgcaaacttttctaaatgcgaccttagaacgctacgtgactaataatgtcgagtttttagatgatctacatgcagatctttatcatgactggttaagactctatgccacaatgcatgttaaaggtttagagaccactttgtcggtcgacttaaaacttatccagatggaatttaataaagaacaacaacttattgtttttgagcaaattagtaacacacaaattgtagaagctaaatataaaaatttctggcaaaaaattgctgtaaaagcggctattttttactatcacaaaattctaaaaaaagatccattaggcatgattctggagcgatttgatgtagcccaagaaaaagatgacctgatcttcttagaccttaaccgttggtttgctaaaaaggccagtattattgaaactttaggcaaggttcatatcaactatgcacgagtacgtgaagcagaattagttgtttttggtaatgttaatctggctgctttacttttccgtgatcaagatgatgattctgaagatgaacttgaagacactgaaattacgccaatacagcaaaaagatgtataa

SEQ ID NO: 185 - DNA, 1080 bp, Acinetobacter baumannii
atgaggttcggtatgcctaagttgataagtgaaaaaaatcaattacagcaactgagcctcaactcaaatgggggagttgtctatcagcccgctagaggtttttttaaagttgtctatcaaggtttaattcttcctaacctgcctgcaccacttcgttactttaattacattagtctgatcggtcagcctagaatccctctttgctataacgcaaatagtattgtgacttctgcagttgatacagcaactgtactggttagcaatagcttacatagtgtagggcacttaaaaacttattccattcgacgccaatgtcagcttaatcctagtcggtatcaattcgataaaactgatcttattgagtggcaaatcccaagagttcagcttagacgaatcgattttgaaatgagttgtgatttaatcgtccaaactccttccgatatttcgaattcatcagcattgcagtggggaatatctgactattggtctattttgtgccattgtgaaggtgagattttatataaaggtcagaaatatgaggtcaatggattaggccgatttaaacatgctcgagccttacatttaccttttttatctttatgtttttatacctgtcaaattattaatttgaatgaaaccactcaagtcacactttctcaaataagaaatcagtggaatatcattctattttcacgtttagatattcaagaactaggaaagcaacccctcacgtttaccgaagatgttaatttccacattcaccgggtttatccaaaagttgaaacaccgcatgggcgagaaatgtatttaccacgagagttttcttggcaatgtaaaaaaaatggaaaagttatttttgaactctatggtgaaagtcgtggtgattacaaatttgggttagctgctggatacataggaagttttcgttatcaattaagttggaatgatcaatgtcttcaaggagaaggtggatattgtgaatacattgattgtcgacctttaagatggcaagaaaagaatcaaaacgaaaaaatgctcgataagttgctgcttttacaaccgtgtttgtataaaaaatga

SEQ ID NO: 186 - DNA, 447 bp, Acinetobacter baumannii
ctaaaggtcttagacatgccactacaaagaaaacaaaactcaaaactattgtggattttaattgggggcttaagcattctcgtcgtgctttttttcgcagcacaatggtttttcaaaaaaactgaaacgtcagcgccaatggttgatccacaaccagcctcggtaccagctcctgaaaaaactacaaaaccttctgaaagctcggaacccgtagttcaaacacaaaccgctaactcacagcaacttgtgaatgaagatgtgctcaagcagccaatccctgctcaagaatctttagctaaagaagaagtatctaaactcaatgacattcatcgtcaattgcaagatcaggaagcgacactaaaagctcaacatgctgatgcagatcaacttattaagctaaaagaagagcaagtgaagcttcttgaggcccaagttaaacaacaatag

SEQ ID NO: 187 - DNA, 291 bp, Acinetobacter baumannii
acaacatcaataactggcgaaataggagatgtaccgccaccaataatgccaccggttacgccgccgataatatcagttactacgccaagagggttatcacccccaacaccaccagttacaccgccaataatatctgtaatcacttcaagtgggttgccatcaacaccgccagttacgccaccaataacatcagtaacacttccagccacaccagtaacaatacctgtagcagttgtgccatttgtaataagcgtatcgagaataccggtcgctgattcagtagcgccttga

SEQ ID NO: 188 - DNA, 510 bp, Acinetobacter baumannii
aaaactcaaatattaggtggcatccgtcttgcaccttatatagcgggttataagcttgggtgggtaacggataaaacgatccgtactaagctctgccaagtgggatatatcggctatgatgcagcttctttgatatacaaaggacaagagtttgctaaaaaagtaattccttcctgtattcgtgaaaatgctttagaacgcattctctggcataaacaacagggagatcaggttgttgttgtatctgcttcattaagtgtttacttggaaagttggtgtaaatctttagatctggatgttatctgtaatcaacttgaaatagataatggtattttgacaggttgttttattgatggtgattgtggttatttagaaaaagtaaatagaataaaaaataaatatgacttaactcaatattctataatctatgcttatggtgatacacctaatgattatgaaatgttggagttagctcatagaaaatattataaatggcaagagattaattaa

SEQ ID NO: 189 - DNA, 2217 bp, Acinetobacter baumannii
gagaacaaaattggaatatttatgcaagaatatcaagaaaaaagatctggattaggtctgctgggttatatctggaatgaatggatctcaacattcattatcctcattttactattgatgacgctcataattggtaccggggaaatgatccacggtcaattattacgtatcggggaacgtctttatggtgaccctgctacaggcatgcaatattcattcttgcgtgctgaacctgaaaagccgacttgtgatcgacatccgaatattgatgctcaagtaaaagagcagatgaaagcaaatgcatctgatgattttgcgagcttctttggtgctgcatcggaaagtgatgtccgtgcatccttactggcagcacagcagcaatgtgaagaaaaatatcaggcttacgacaaaactattaaatatatcgaagcaaacccgggagtacgtacttatcgtacgatcgaaacaggtttctttggtatttttaaattcggtacagagaaccgtgccattttactggtctttatggtactgatttcagcgattactgcatcattgaaatatcaccatattggcttgcgtaatccagcaacaaaaatagattacaaagtgtattctctatttatgttgattggtaatgcgctactaagcttctcggtcattagccagtatcgttcagtcattaattccggggtaacacctacttatgaaacagtaacgatttactggatatggatgattctgtttgttgttctgaccttaattagtctgtatcaactatttgtttcacctccaccaaaacgtgaaggcggtaatataggtttagccttactttctgtacctttatatgcctatatggcactaattacaggtattgtattcacgttctttatggattatccaatggggcaagggatttaccttggtttattggttgagttctcgggtatcttcttaaatcttgccttatttatttgggcgggtatgttactcacgcaaacccgtgttatggacttgttcttaaatgtacttcgtccatggaacttggcgccagaaaccttaacttggttaattctgattgctgctgctgtaccgactgcttataccggtgcttcggggattttcgttatcgcggctggtgcgattatttataaggaagtttggaacgcaggcgctcgccgtcaatatgcattagctgtatctgcaatgtccggctccctaggggtggttgtacgtccatgtctattggtcgttctaattgcgatgttggatagtcgtcatgttacatctgacgaattattcggacatggtatttatgtcttctggctaacagcatttattttcttgggtgtatctcttttattggccgaagaaaagttccgtgtgaactcgccaaaagtggcactaccaggtatggcacgagctttcgtaccggttattccatatatcttaattactgtagttgtccttgcattttataaatatgcattagatacaggaatgaatgaatttaccgcaccagtgattctgccactcgtgcttattgcgatgattctgtacgataaaatggttatgcctaaagaggcaccagctttaaatattcatgaggcgattgttcgtgagcatgaaaagaaatcaccgttcttacagactcatgatccgcatagttcacagttccgtcttggttttggtggtgcattacgttttgcgacatcagaaacagtgggacatatcggggccttaattattttgatggcattgtctgcaagtgtaggtggtttaattgaacgctctgaagtggtcgaattattaccaactcatttaggcagtatctatatatcactggcatgtattgcactgttacttgcaattattggtatgtgtacagatccatttggtgccgtaattttagtggcagcaactattgctcctgtagcttacgaaaatggtattcatccaattcacttctggatgattgtattggtcgcattcgaatttggttatgtaacgccgccagttgccttgaaccatctattaacgcggttatccgttggtgatgatgaggtgaatgctgccgatgcagaagctaaagagaagtacacaagtttctactatcgatatgaacgttggttattaccaattattgtcttgttctcatcattggtattggtaacttatgcaccactaatactgaaactatttggttggtacaagtaa

SEQ ID NO: 190 - DNA, 735 bp, Acinetobacter baumannii
atttatagaatgcttctattgtctcttttcgtggaattcgtcatgtctttctttgcaaaactatttggcttcaaacaaaaaacaacagctcaagaagatgtggctttgaaagctgctaaagagctagaaccttcaaatgaaacctcttttatagaacttattaaaaaccgccgctctatttatgcaattggcaataacttaagccaatcaaatgatgagattgaaaagttaattcaagaagcaataagacacagcccttcagcttttaactctcaatcatctcgcgctgtgatcttatttgaacaatctcatcataaattctggaatacagttctagaagttttaaaaaccattatcccaactgaagcggtatctggaacacaacaaaaaattcaaagctttgcagcaggcgcaggtacagttctgttttatgaagaccagagcgttattaaaagcttacaagagcaatttgaactttatgctgataattttccgatctggtcagaacattcaacagccattgctcaatttgcagtttggaatgtattagctgaacaaaatattggtgcttcattgcaacactacaatccaattattgatgagaaaattaatacctcatttaatatcccagcagaatggaaactaagagctcagctagtttttggttctattgaaggcgcagcaggcgaaaaagcttttattgatgatgaaagccgcttcaaaacattcggctaa

SEQ ID NO: 191 - DNA, 681 bp, Acinetobacter baumannii
gttattggaattattagccgcaacaataaaggaagcttcatgaaaacacgtccttcaaaaatcgtttgtgtgggcagaagttatgctgatcatgtaaaagaactgaacaatgcaatgccaggacgtccggtgttatttatcaaaccaccaagtagtttgattggtttagatgaaggcatttcatggaatcctgcgtggggtagttgtcatttcgaatgcgaatttgttttacgcattgatcagccactaaaaggagaaactgatccgcaaaaagtattgcaggctattggtgcagtgactttagggttggatttaacattacgtgacttacaaaatgagttaaaagataaaggccaaccttgggaaagagcaaaggcttttgatggttcatgtgtgcttgcagactgggtagatgtaagtgaaattacgaactgggaagagactagatttactttccatattaatgatgaattacgtcaagacggtaatactgctttgctcatgtttaatattgcttatcttttagtagatattaatcaggtgttctcacttgagccaggcgatgtcattatgacgggtacacccgcaggtgtagggccattaaatgctggcgatcagctaaaaatgactttgaaaggggctactcaagattttgtttgggaaacttttgttaaagcataa

SEQ ID NO: 192 - DNA, 396 bp, Acinetobacter baumannii
tttattttgatcaaccatttgaattttaagctgaaatatagccgtttttcgattatatttcagttttttattggcttaagcttagcagttctattttatcaattaatgccgttactatggtggttagttgtaatcagcttactatttatcagctttattttctttttaaagcgtccgcagcttgcacaaattgcttatttagataaaaaactatggtcgcttgcttatcactcacagaacaccatttctcgcgtcaaaattttaaaagtaattgattatcagattttcatagtgatctattttgaaggtaataaaacactaacttctatcatttggtttgatcaaatgtcattagcagagtggaaaaagcttaaaactttagaaaaactctattaa

SEQ ID NO: 193 - DNA, 507 bp, Acinetobacter baumannii
tacattgtgatgaccgagcaaaaaagcgctttatctttacgttattatttaaatttagaagagtctcaagacggatttggcttggtgacattcggaaagaagcaattcacacggtttttgacacctgttattagtattgcaattattatttggggcttatatttaggcttttcaggtgttggccgctactatgttgctttaggcgttttcttcttggttatgcaaggtctaatgcgctactggcttttacctatgatgtttaaacgtcaatttgtacgttatcaatttggtaagagcgagcaaggaatcgatttatatcaagattattttgagctctatgctgctgggcgtaaacaagctgtacagtatagtgaagtgcagacttttgctaaaggcaagctgacttatatgcttgagcttaaaaataaaacggtcatcattgtaccgaaacgtgcatttgctcaggcttcagatcaaactatatttgaaaatacatttaagaaataa

SEQ ID NO: 194 - DNA, 429 bp, Acinetobacter baumannii
acaacatcgattactggagaaataggagatgttccaccaccaataatgccaccagtaacgccaccgatgatgtcagttactacaccaagaggattgtcaccgccaataccgccagtaacaccaccgataatgtcagtcactacaccaagcggattatcaccgccgataccgccagtaacaccaccgatgatgtcagttactacgccaagaggattgtcaccgccaataccaccagtaacgccgccgataatgtcagttactacgccaagagggttatcaccgccgataccaccagtaataccaccgatgatgtcagttactacaccaagcggattgtcaccaccgataccaccagttacgccgccgatagtacctgtcacgccaccaaggatatcagtcacaataccagtcgctgttgaaccattctga

SEQ ID NO: 195 - DNA, 1032 bp, Acinetobacter baumannii
aatcgctacttaacccgattaaggacactcattggagacaattacatgaagcaacccgttcgtgttgccgtgactggcgctgcaggtcaaattggttacagcttattattccgtatcgcaagcggtgaaatgctaggtaaagatcaacctgttattttacaattgcttgaagttccagttgaaaaagcacaacaagcgcttaaaggcgtaatgatggaacttgatgactgtgctttccctttattggctggcatgatcgggactgatgatcctaaagttgcatttaaagatgctgactatgcgttattggtaggttctcgtccacgtggtcctggtatggaacgtgctgacttgttaaaagttaacggcgaaatcttcattggccaaggtcaagcattaaacgaagttgctagccgtgacgttaaagtattagttgtaggtaaccctgcaaacacgaatgcttacatcgcgatgaaatctgctccagatcttccagcgaaaaacttcacagcaatgttgcgtcttgaccacaaccgtgcgttgactcaagttgctcaaaaagctggtgttgctgtagctgacatcgaaaaattaacagtttggggtaaccactctccaactatgtatgctgactaccgttttgcaactgcaaatggtgaaagcttaaaagacaagatcaacgatccagcttggaacaaagacgtattccttccaactgttggtaaacgtggtgctgcgattatcgaagcgcgtggtttgtcttctgctgcttctgctgctaacgctgcaatcgaccatatgcgtgattgggcacttggtacgaacggcaagtgggtaactatgggtgttccttctgacggttcttatggtattcctgaaggcgttatgttcggtttccctgtaacaactgaaaacggtgaatacaaaatcgttcaaggtttagaaatcgatgaattcagccgtgagcgtatcaacttcactctaaacgagcttgaagaagaacgtgcagcaattgctgacatggtaaaataa

SEQ ID NO: 196 - DNA, 237 bp, Acinetobacter baumannii
attgatcgtgtggttagggtgataaagatgaagaaacgtttcattgctggggctaaatgtccaaaatgtgaagccatagatcggattgtcatgctaaccaccgctgaagacgaatggattgaatgtattgaatgcggctatagcgaaaatcgtccgactcatattgatgagcctgaaacgcctgctatacctgatgaaattggggtaatacagttcaagtctcgtcgttctgactaa

SEQ ID NO: 197 - DNA, 873 bp, Acinetobacter baumannii
ggaattaaagtcaacatgaattaccgtcaccatttccatgcgggcaactttgcagatgttatgaagcatgtgcttttgctacagcttctcaaccgtttaaatgctaaagataaaccttatcgttatatcgatacgcatggaggtgcaggaaaatatgatctatctcaggcacctgcacaaaagtcaggagaattcctaacaggtattcatcgtcttgtacagctttctgacatggaaaagcgccaagctcctgaagccatccagcaatacctaaaacttgtagaagaattacgtgctcaagaaggtaagggaagttatccgggctctccgtggtttgctttgcaaggtatgcgtgaaattgataaggctacaatatttgaaatgcagcgtgatgtatttcagcaattacgccataacattcatgataaacgtgcgggcttgcatgagcgtgatgcatatgaaggcttgcttgccgtaattccaccaaaggaaaagcgcggtttagtgatgattgatccgccttacgaattagagcgtaaggatttcccgcaattggttgaacttttacaaagcgcttataaaaaatggccaacaggtgtcttcgcggtttggtatccaattaaagatcgcgcaatgattgaacgttttgaaaagaaaatgtttaaaactggaattcgccgtcaattaatctgtgaaatttgtgtttggccagatgacacacctgtaggtttgaatggttgtggattattagtaattaatccaccttggcagttctccgaacaagcagatcaagccctacaatggttattccctcacttacgtatgcaagaaacaggtggtcatgccgctgtacgctggttagtgggtgagtaa

SEQ ID NO: 198 - DNA, 774 bp, Acinetobacter baumannii
tatgcaaaagtcatagatgcatcagcactgacctatcagtctgtacaaggatatttacttatggcaacaaaatttctgaaatcattcagcatcgcaactggtatttcgacaactttgcttattgcaagtttctctagccatgcacttgccatgagcccatttcaggcaaattatcagtttagctacaataataaaggtatgggttcagcgacacgtgcattgagtcaacaaggcaataattggacttatcaattcacagcaaaagcaggtggaatcgcttctgcaagtgaaacaagtaaatttagttttgcaaatggtaaaattggttcacaaagctttagtcgtaccagtaaaattttgattcataacaacacaatgagtattaattttaatcctggcaataagactattagcacgaaaaaagacgataaagcgcgctcattcgcttggcaggcaggtgtacttgatgagctaaatgcagaattacagattcgtgaagatttaaaaaatggttcacttaaatcgtcttaccctctagccgatgcaaaagaagttgaaaatcgtcgttttgttaaacaaggcaacgagaaaattaaaacttcttatggcacattcgataccgtaaaagttgttttacaacataagaaacctgaacgcagcacaattttctggctagcaccgaaattagactaccttccagtcaaggtaagtcatattgatggcaaaacatcttatggtttgttattaacaagttatacaggtaaaacgaattaa

SEQ ID NO: 199 - DNA, 639 bp, Acinetobacter baumannii
ggagaaacattcatggctcgttatattggtccaaaatgcaaactctctcgccgcgaagggacagacctgcaacttaaatctggcgttaaaccatttgacgtcaaaactaaaaaagctaacaaagcacctggtcagcatggtcaggctcgcggtggtaagcaatctgagtattcactacaattacgtgaaaaacaaaaagtccgtcgtatttacggtgtgttagagcgtcaatttagtaactactataaagaagcagctcgtgttaaaggcgcaactggtgagaacttgttgaaattgcttgaaagccgtcttgataacgttgtttatcgcatgggttttggttctacacgtgcagaagctcgtcagttagtaagtcaccgtagcattactttgaatggtcgtcgtgtaaacatcgcatctattcaagttaaagctggtgatgtaattgcggttcacgaaggtgctaaacaacaattgcgtattaaaaacgcgattgaattggctgctcaacgtggtattccagcttggatcgaagttgatcactctaagcttgaaggtacgtttaaagctgcaccagatcgttctgatttacctgctgaaatcaacgaaagcttgattgtagaattgtattctaaataa

SEQ ID NO: 200 - DNA, 792 bp, Acinetobacter baumannii
tcgagacctttaatggctgcttttaacgttgaacgcattactcatgtgcaccactggaatgacacccttttcagttttaaaactacacgcgacgctagcttacgttttaaaaatggtcagttcgtgatgatcggacttgaagtgaatggcaaaccgttaatgcgtgcatattcgattgcaagtgcgaactacgaagaagagttagaattcttctcgattaaagtacaagacggtcctttaacttcgattttgcaaaaagtacaagttggcgacgaaattttagtttctaaaaaaccaacaggtacattggttcatgatgaccttttacctggtaaaaacttgtacctattatcttctggtactggtcttgctccattcttgtcaattattcgtgacccagaaacttacgaacgctttgaaaaagtaatcgtagttcacggtacgcgttatatttctgaattagcttatcaagacctaatcttgaacgaattaccaaacaatgagttctttgaagaattaggtattaaagacaaacttgtttactaccctaccgttactcgtgaacctttccatactcaaggccgtgtaacaaccgcaattgaaactggtgctttatttgaaaaaattggtttaccacgtttcaaccgtgaaactgaccgcgcaatgctttgtggtagccctgcattcttgaaagatgttgctgcgttacttgaccaacacggtttagttgaatcacctcgtatgggtgaaatgggcgactatgtcattgaacgtgcgttcgtagaaaaataa

SEQ ID NO: 201 - DNA, 222 bp, Acinetobacter baumannii
tcgcattactcagaaattcaaaaaattattcaccatcgggtgagcatgattattcagcttcaacatattcaccacaccaccatatttacgataacagtcaccatagttctcattcatcaaatgattgctcatcattttccgactcaggcggatgtgatgggggcggtagcagtgactaaaaagccctttcatataaaagggcttttaagcagtttaaggtaa

SEQ ID NO: 202 - DNA, 618 bp, Acinetobacter baumannii
atgcagttatcgctgaaatacattcttgcactgacggctagtttaagcatggccccactgcacgctgaaatgatgcaatcatcatcattaaatagcgatgtagatggtccaaatgcaaatttagctgctcgtgtgttgagtaaagatactcaaaactttaattctcgtttctctaacattaacagtctttcaatcactgaacgttctggcgatcaaatccgtcgtcaagctatcgcagctaaaattgaaatccctgaagatgagccttcagtgattgaaaaacttaacacagtagcttcaaatactgttcgtaagtttagccaaactggcatggcatcgtggtatggtcgtcaatttcatggccgtaaaactgcaagtggtgaaacattcgatatgaatgcacttactgctgctcaccgtagcttaccgcttaactgttatatccgtgtcaccaacaaagacaatggcaaaagcgtagtggtaaaagtaaacgatcgtggtcctttccatggtaatcgtgtgcttgatttatcatacggtgcagctaaacgccttggtattaccaatgctggtactgctaaagtaagtattgagcgtgtagacggtcctacttcataa

SEQ ID NO: 203 - DNA, 201 bp, Acinetobacter baumannii
tcatcatcatcgtcattacacgctgtaagaaataatgctgaaattgataatgttatagctaaagcaatttttgaccgtttcatagaatatcctttttatgtgttatttattccgcatatttttcatgcacaaatattaagacataaaaaaagtgctctgcatagaacacttttcaacctcacggtcatttttactatatga

SEQ ID NO: 204 - DNA, 255 bp, Acinetobacter baumannii
tactttacatcacttgcattggtcttatgcccatctgtttttaatgggcggcattgttttgttatttgcattgagccttttaattcctatccgttcttccatgccgaacactctcggagaaaccgaatcgtgaaaactttattctttcctctctttttgattattttcgtactcattattcaggctttagaccaaagctatcaaaagaaaattggtatctctaaaccccagaagcatccggaatttatgcaataa

SEQ ID NO: 205 - DNA, 231 bp, Acinetobacter baumannii
tctagaggattttacatgccacaagttaagttgaaagaaggcgaaccagttgacgtagctatccgtcgtttcaaacgttcatgcgaaaaagctggtgttttagctgacgttcgtaaacgcgaattctacgaaaaaccaactcaagaacgtaagcgcaaaaaagctgctgcagttaaacgctaccaaaagaaattggctcgcgaatctgtacgtactactcgcctttactaa

SEQ ID NO: 206 - DNA, 558 bp, Acinetobacter baumannii
tttattcaatcagctcacacaacggtcatatctctggtcaatgtgacacagcgaattgcgtcaactggatggaatgaaatgaataaaccaattctcgacccttgctctggttcacgcatgttttggttcaatcgccaaaatccacatgtggtttatggggatattcgccaggaaaaacacattttatgtgatggacgttcactaattattgaacccgacattgttatggattttagagatatgccattcaaagacggacaatttaatttagtggtttttgacccacctcacttaataaaagctggagagaaaagctggctagcattgaagtatggaaagctaaatcaagattggcgtgaagatattcgaaagggtttccaggaatgtttccgggtattggccaaaggtggagttctcattttcaagtggaatgaaacccaaattaagacaaatgaaattttagcattaaccaagcatgcccccctattcggtcactcaagcggcaagcgtagtaatacgcattggttcggttttatgaaatttgaggacgaaatttaa

SEQ ID NO: 207 - DNA, 1167 bp, Acinetobacter baumannii
agagtggaatcttttgcattaaaactggatgaagaaactggggcgcaagagtggaagtttgataatagttcgccttacttcgatgccgagctcatttcttatcgttacactttactgaaaagatatcgtcagcaacatcgcactttagatttgatttatcttttaaaagaagggttgacctacgatattgcaaatattggccaccctatgttgtttgctgccacacatgtaggcacaaaaaaattaattgaagattatattgaagaagtcagtcaaagcttagcttacattgcatctagtgaatgtattacattccaaagaaaagaaaaaatcgaattttttgaaaactgtgaaaaagcatatggacaacctgctcttatgttttcggggggagcaaccttaggtcttttccatactggtgtatgtaaagctttaattgaacaagatttaatgcctaaagtcctgtctggttcaagtgcgggtgccattatgacgggtatgttgggaatttctgccagtgaagatatccaaaacttgctaaatggtgagcaattttttagtgatgcttttcactttagaaaacttcgtgaacttataaaagggaatggtgggattgccgatgttcactatttaaaaaaattcttaattgaaaatttaggtgatcttacttttgaagaagcattcaaaaaatcaggtttgaatattaatgtcgctgttgcgccgtacgatgcaactgaaaaccctcgaattatgaatgcgattatgactccaaatgttttggtttggagtgcggtattggcttcttgtgctgtgccagttttatttccacctgtgcgtttaaccagtaagcgttatgatggtgaacatactccatatatggcaaatactaaatgggtggacggcagtgtacgtagcgatttcccacaagaaagaatggcaagactttataatttaaactacaccattgccagtcaagtgaatccgcatgttgtaccgtttatgcaagatgatgcgcgccgtttccgtaaagacgttttaagttggcctgaacgaattttaagacgccaaggtaaagtactctcaatggggttgatggactttacacgtcaaagattaggcgcaatttcacccgtaagaagactgttcgatcatgggtacggcgtagtt

SEQ ID NO: 208 - DNA, 318 bp, Acinetobacter baumannii
attttaagatctatttacttgattaaaattagttttaaaaagagtctctttatagaggctctttttgttatattgttacgcattctgaaatcgatattatttgagtttgaagaacttatgagccagcaatctgttgaaaaaaaatctgttccttggttattaatgggattaggtttacttattccttttctgattattggaatactttttttggctgcaaaaagtgatgctcagaataagaaacaatatgaacagcagcgtttagaaatggaaaaaagaatagctgagaaagaagctgccaattctgacaagaaataa

SEQ ID NO: 209 - DNA, 1149 bp, Acinetobacter baumannii
agccgcatgtctcctagtccacaatataaatttttacgccaagctcctcgagatggccttagtactgccatgcaaccttcacgctggcagcagcttcatattgacccttggttatgcctatttttattcctaaatgcattgttaggtttaacggtactttatagtgcatctgcacaagatgtgggactcgtcagtaaacaggccatgagctttggtatcggctttctggtcatgattagcctagctcaaattccacccaaggtttatcaagctttttcaccttatttttatttatttggcctgttttccttaattggcgttatggtttttggcgaagttcgcatgggtgcgcagcgctggatcgatattccagggttcgggagtgttcaacccagcgaatttatgaaaattggcatgccaatgatggttgcatggtttttagctcgaaaacctcttcctcctagtttctcccaggttattttgtctttaatgttaattggtgttccatttttacttattgcagaacagcctgacctaggaacatctctattagtattagcaagtggtatttttgtactgttcttaagtgggctatcttggcgcatgatcggtgcagcagcagcttgtgcagctattgtgattccaattgcatgggaattccttttacacgactatcaacgtcaacgagtattaacgttgcttgacccagaagcggatgctttaggaacaggctggaacattattcagtccaaaacagcaatcggttctggtgggttctcaggtaaaggtttcctcgaaggtactcaatcacatttacacttcttaccagaaggccatactgactttattattgctgcttactcagaagaattcggtttaattggtgtacttatattagtaattctttattcggccattatttttagaacatttcaaatcggtttacaaagctttcataattatggccgattagtggctggcgcgtttggtttgtctttttttgtttatgtatttgtaaacgcaggaatggtcagtggtattttacctgtagtgggtgttcccttaccttttatgagttatggcggtaccgctattattactttaatggccacttttggtttagtcatgtctattcatacacatcgataa

SEQ ID NO: 210 - DNA, 225 bp, Acinetobacter baumannii
aaccactcgtcacttcatagttatgagtttcttggtcatgcttatcgtaaatttgctggtacttcagatgtatttcgccctgagctagtttttgtcttaattgctggagcaaagaggactgaggcgtatggtcaaaatgttcaattgttaaatcaagaggaacagcttcaatgctcggtgaaaccgttttgtctacggttggcattacttcaagttgaggtgtaa

SEQ ID NO: 211 - DNA, 225 bp, Acinetobacter baumannii
tcttctaagtctgctaacttattccaatcggaatttacaccgctaggtgttgctaaagtaagctgcttattggcagtatcaataccagttactacatactcaccatctaaaaagatgtttgctgtgtttgcagttagatttgccgatattgtggaagttaatacctcagttacttttgaaaaattggtgttagttgctacaggatttctcaaatggattgtatag

SEQ ID NO: 212 - DNA, 807 bp, Acinetobacter baumannii
aagaagaagtcattttttatgaaaatcgtcattctcaacaaaccatatgacgttctctcccagtttcgtaaagacgaagcacacatgacggtctctgactttgtagatgacccgactttgcgcatagcaggccgtcttgatatggactctgagggtttagttttcttaactgatcatggtggtttgaatcagttcattaccaaccctgcgaataaaaaatacaaaacgtatttagttcaagttgatggcgatgtaaccgaagaagcactcgagcagcttcgtaagggtgtagagcttaatgatggtatgactttaccagctaaagcaattaaggtaagtgagcctgaatggttatgggaccgcgatcctcctgtacgttaccgtgccagcattccaacatcttggattgaaatctctatttgtgaaggtcgtaaccgccaagttcgtcgcatgacctctgcggtaggttttccgactttacgtctcattcgtacaaaaattggtacgattgacttagttcaattgggattacaaccgggcgaaaccaaagaaattgagcctctactctacccagactttaaagatgttccggctgaacaaccttatcgttcacgttcatatgtgaaaaaaccgggtggcactggcggtaagccaatggttcgcaagaacaaagatggttctgcgaaaaaatctggtacaaagcgtatttggcaaatggatgaaagtgaaaaaccgcgtcgtaagactaacggtacaacgcgtccaaataccaaagcaccacgtggtcgtagccgcaatagccgataa

SEQ ID NO: 213 - DNA, 1026 bp, Acinetobacter baumannii
acaaattttccctcgctttggtttgatgggattaaatttgcaatttgcatcggctttattacgctcaagtggggcacgccactgatgcgatttggcttattctgtatttttatcattttatgtatttgttcgttattactcggggctgagcaaatacagtggtctaccttattttctttttctcatgagagttggctcactcttacagccagccgtattcctcgtttgattaccattgtactcaccggtatcggtttggcggtatgtggtgtcatcttgcagcatattgtgcgtaacaagtttgttgaaccggaaacgtcgggcggtttagatgctgccaaactgggaattttagtgtcgttaactttagttccggtaaccagcacgctgagtaaaatgatatttgcgatcattttttgttttattgctagcttaatttatatcgcaattattcggcggatccgttttagaaatacggttttagttccggttattggcttgatgtacggcagtgtactgagtgccttagctgagttttatgcctatcgctttaatattttacaaagtatgcaagggtggcttttaggagatttttcaaaaattgtccaaggccactatgaagttatttacattatttttccgattgttgtcctgacttatcttttcgcacaccgctttaccgtgattggtatgggggaagagatggcttctagtttgggactcagttatgcagctatagccgccattggtttgatactggttgccattacagtttcgaccacagtaattacggttggtgctattccttttgtcgggctcgtggtccccaatttagtcgcactgaaatacggagaaaacttagctaaaaccttgccgattgtggctttgggtggggcatctctattactgatttgtgacattcttggtcgttcaattatttatccatttgaagtgccgatcggacttaccgcaggtggtgtggggggaattattttcctcatcctcattttgagggagttcagataa

SEQ ID NO: 214 - DNA, 1122 bp, Acinetobacter baumannii
ggctgccttccaatgatcaacgatgatcaaaacaaaacgacttctcttagtttagaacaaattcgcgaagatattgatagcgtagatcaacagattcaagagttattaaatcgccgcgcaagccttgctgaagctgttgcgaaagctaaatttgcttctgaagagaatcctttgttttatcgtcctgaacgtgaagcacaagttttacgtaaagttatggagcgcaatcaagggcctttatctgacgtaacaatggcccgtttgttccgtgaaattatgtctgcttgccttgctttagaagctccgcaaagtattgcatttttaggcccagaaggtacttttactcaatctgccgtacttaaacattttggtaaagatgcggttgtccgtccgctaccaactattgatgaagtattccgtgaagtggaagcgggtagtgcgcattatggtgtagttccggttgaaaactcatctgaaggtatcgtaaaccatactttagattgttttaaaacttcgaatttaaatgtgattggtgaagttgaattgcgtattcatcatcaattccttgtttctgaaaatacacgtaaagacagtattaagcagatttatgcgcatcagcaaactttggctcaatgtcgtcagtggttagacgcacattatccgggtgttgagcgtgttgccttaaactcaaatgcagaagctgcacgccgtattcgcaatgaatggcattcagcggcgattgcgtccgatattgcagcaggtatgtataaccttgaaatcttgcatagtaatattgaagataatccagaaaataccactcgcttcttagtgattggccgtgaaaaaattccacaaagtggcaatgacaaaacttcattattaatttcagcgcatgaccgtgcaggcgctttattagaaattttagcgccgtttgcaaaacataatattagcttaacgagcattgagacccgtccagcattacctgaaaaatgggcatatgtattctttattgacttagaaggtcatatcgatcaggaaaatgtggctgcggcaatcaatgagattcgtccaatggtaaaagaacttcgtattttaggttcttatcctgctgctgttctttaa

SEQ ID NO: 215 - DNA, 189 bp, Acinetobacter baumannii
aaagacgctccccatgtatataaatcagctttgtataaaacggctggtcttttatccaagcttcaaatttctcatgcatgggttaaacccccatttttcggtaaggaaacatcaaccgctcacacgcaatatttacatataaagccgcatcggtctgtgctgctctgttttggtacatatcaccaatga

SEQ ID NO: 216 - DNA, 192 bp, Acinetobacter baumannii
aaattgctgttatttcagcagatgagtaagttcgaaatactcaagtttttatcaccttatttgtgttttaaggagaagcttcaagatggcaagctttatgaaaaaaatattcgtttcaacaaccttagttctggctgctgttgcgacgaatgtacaagcaaaggattggaaggtgattcgttttggtactga

SEQ ID NO: 217 - DNA, 969 bp, Acinetobacter baumannii
aattttatgttattccatttgcctaaactccctgcggaaatacgtgtcagtcatttaaatgcacgtgtaaatgaacagagaaaaaaaattgcacaaaccacagcaagccgtttagagcttttacaattggctcaacaacttgcaaaagaagctaaaattcgccgtaagaacaaccagaaaatttttgttttagattttaaaggtgacattcaggcatctgcggttgaaaatcttcgtgaagaaatcacccttattttagcaacggctaaagctggacgtgaccgtgttgtggtacgtcttgaaagccctggtggtatggttcatggatatggattggcggcagctcaattggttcgtttgcgtgatgcaggttttcatttaacgatttgtgtcgataaggtcgcggcaagtggcggctacatgatggcttgtattgcaaatgaaattatttctgcaccgtttgctgtcgtgggttcgattggtgttgtggctcaggtaccaaatttcaatcgtcttttaaaagaacataacgtggacttcgaactttacacagcagggcaatataaacgtactgtcaccatgtttggtgagaatactcctgaaggtaaggcgaagtttgaagaagagctacaacaaacgcatgtattgtttaagcactttgtagagaaatatcgtccacagcttaatgtagacaaggttgctacaggtgaacattggtatggtcaagatgcacttgatttaaaccttgtagataaactacaaacttccgatgagtatctattagcgttgttacctcagcatgacgtatatgtaattaatacccgtaaaaaagcaactttgggtgaaaaattaggtttgcaagcagctcaaatgacagatagcctgattccggctgtaatgaataaagtggctgatactttagcaaaagcgaattcaactttagttcaaatgcgcgatactaaattttaa

SEQ ID NO: 218 - DNA, 711 bp, Acinetobacter baumannii
agaacaatgttttatcccttacctcgaaaaatccagttagccgcaagtacttcaaattggccaattgaatctacgcaaagcatattgctcctagtcgggctcgatgatcttgaaaatatatctgattggacgcatcagccattagccgatcatttagaaatgctaagtaaaagagcacaagccctcgaaattccagtcatgatgattcagtcatctcaacttcaacagaccatgttacagcttgggcagcacttgtcatcaaacactcaggcacaggtgattatggcggggaatttatcaccgctatttaagcaggtcatgcagcttgttttatccattaccgattatgtagctgttgtaaatgatgcaatcttggcaagtagtttagagcagcatatacaatggattgaaaaaatcagttttgaccatattcaacatataaacacgcagactttaatgcgcttatggtctttaagtgcaccgtcgtcacaggtgttgtccgataaaggaattttattggcagttgctgaacaggtagggcgacatccaatggaaattcatcccgaaatagatttaagaaactatggtctagacgcttcgggagtcaattatttggtggaattatggcgtgctaatggtgcgagcctaactgttgatgagttgatgcaaactcctacattgcaacatattatgcagttattgaagcgctaa

SEQ ID NO: 219 - DNA, 543 bp, Acinetobacter baumannii
ccaaaaacccctaaatttcgtatcatacgacttttaaattcatggtgcttttttatggccgcatggactcctcatgtcactgtcgctacagtcgtagaaaaagatggacgctatctttttgtcgaagaacatagcgaaggttttgtacacacagtgtttaatcaacctgctggtcatgtggaatgtggtgaaacactaacagaagcagcgatccgtgaaacgcttgaagaaacaggacatcatatagatattgatgccctacttggtatttatacttataccccccctatgtttccggaccgtacttattatcgcttctgctttttagcgcatgtgacccacgtcgaaagcgacccaaaacttgatacaggtattgtttctgctgtctggatgactctagatgaacttaaagaatctgcccgtgcacgtagccctcttgtcattaaagccattgaagacgccatgaaaggacaacattatcctttagctcttatttatgagcaccctttctctccctcattaacttctcatttggatgcctag

SEQ ID NO: 220 - DNA, 660 bp, Acinetobacter baumannii
ttgtataacccagcaaatgcaaggaataggaacatgacaaccattactttacctgcacttccatatggctatgatgatttagcgccacatatcagtaaagaaactttagaataccatcacgataaacaccacaatacctatgttgttaacttaaacaacttaatcaaaggtactgaccttgaaggtaaaactttagaagaaatcattaaagcaactgctggtgatgcatctaaagctggtattttcaacaatgctgctcaagtttggaaccacactttctactggaacagcatgaagccaaacggtggtggtaagcctactggcgcaatcgctgctaaaattgacgaagcttttggtagctacgaaaaatttgcagaagaatttactgctgctgcaacaactcaattcggttcaggttgggcttggttagttgctgatgaagtaaacggtaaactttctattactaaaacttctaatgcagacactccacttgcacatggtcaaattgctgtattaacaattgacgtatgggaacacgcttactacatcgatttccgcaacttacgtcctaaatacatcgcaactttcttagaaaaccttgtgaactgggactatgcaaatgcaaaacttgcaggccaaccagctggtgtagagaaataa

SEQ ID NO: 221 - DNA, 798 bp, Acinetobacter baumannii
gcgggggtgttattcaccatacaaacgcccctacaccaaattttatttaagggaatgaatggcatggtggagttaccctttcaacaatcacaagccttgaatgttcgccaaaaccgtgcccttgccttggctggggtatttcaagcgacccagcttacgcatatgaccgccatgacaggtcagcaaagtattggtgaaagtggtaacttttattttgagttattaataaaggcgagcttaaatattcgccctacaacaaataataatgctgttcagacgttggattttttcaatcaattggctgatatttcgttgggtcttaaaactcttgaaaattgtatcactcagccttttaccaatgcgcctaaatctcgtttgcctaaaatgcgcagtgcaaaacttcctatgtcttatgcgatgtcacttttgcagttagagaaaaaggtctatagcaatcctgaatatgtggcgattattgaaaaagcgcagcagaagattttaaaacagctttctttttttgataataactatttacacccaagtattttagccaatttggcgcaaacctatgttgatactgctggacagattaatccacgcattcttgttcgtggtaatgctgaggcatttaaagataccaaccatactaaccgtattcgtgcttgtctgtttacggggctacaaatggcccatttatggcgacaactcggcggtagttcatggaacatgatttttagcaaacgtaaattgctacaggatattcaagcacttgctcgtttacagtaccaagttatctaa

SEQ ID NO: 222 - DNA, 1272 bp, Acinetobacter baumannii
tttataggacccccgctaatgtttgccaatatttccatttctgaatttgatccagaattagctcaagcaattgcttctgaagatgagcgtcaagaagcacatatcgagttaattgcatctgaaaactattgctctcctgcggtaatggaagcgcaaggatcaaaacttacgaacaaatatgcagaaggttatccaggcaaacgctattatggcggttgcgaatttgtagatgttattgagcaaatggcgattgaccgtgctaaagaactttttggtgcagattacgcaaacgttcaaccacacgctggctcacaagctaactctgctgtttatttagcacttcttaacccaggcgatacagttttaggtatgagcttggctcacggtggtcacttgactcacggtgcaaaagttagcttctctggtaaaacgtataacgctgttcagtatggtctaaatgctgaaactggtgagattgattacgaagaagttgaacgtttagcattggaacacaagccacgtatgatcgttgctggtttctctgcttatagccgtgttgtagattggcaacgtttccgtgacatcgcggacaaagttggtgcttacctttttgttgatatggctcacgttgctggtcttgttgctgctggtgtatatccaaacccagttcaaattgctgacgtaacaacaacgacgactcacaaaacacttcgtggtccacgttctggtttaatccttgcgaaagcaaatgaagaaatcgagaaaaaacttcaatcagctgtattcccaggtaaccaaggcggtccattaatgcatgcgattgctgctaaagcaatctgcttcaaagaagcaatgtctgacgactttaaagcttaccaacaacaagttgtgaaaaatgctcaagcaatggctgaagtattcatcgcacgtggttatgatgttgtttctggtggtacagacaaccacttattcttgttatctttaatcaaacaagacgtaactggtaaagatgcagacgcttggttaggtgctgctcacattactgtgaacaaaaactcagttccaaatgacccacgttctccatttgtgacttctggtatccgtatcggtactccggcagtaacaactcgtggttttggtgaagctgaagttcgtgaacttgctggttggatcgctgacgtgattgatagcaaaggtgacgaaaaagttattgctgatgtgaaagcaaaagttgaagctgtttgtgcaaaattccctgtatatgcaaaataa

SEQ ID NO: 223 - DNA, 1218 bp, Acinetobacter baumannii
aagtcggctttgctttatcctaaaatgctaggctcttctgcttcatacaagatattggaattacctagaatgactcgaaaaagcgctattgctgcactcctcctcttaccaagtttttcttatgcagcaactgtcttatcagctccgccagaattaaataataagtcttatgtattaatggattacgagacaggacaaattctcgcttctaaaaatgaaaatgaaaagcttgctcctgcttctatgactaaaatgatgacaagctacatcattgaacaaaaattattaaaaggtgagcttaccgaaaatgaacaggttcgtatgaacgaatctgcttggtgtaaaggcagtagttctgaatcatgtatgtatgttccattaaatggtacagcaactgttttagaaatgcttcgcggtattattattcagtcaggtaatgatgcatcaaaagcaatggctgaacatattgctggaaatgaaggtacttttgctcacatgatgaaccaagaagcaaaacgtatcggaatgaccaatacccagtttattaactcaactggtatgccagctgaaggtcattactcaactgcaaaagatatggctgttttagcacaacatattattaaagacagctcaaaatactacccgatttattctgaaaaagaattcacatttaacggtatcaaacaaggtaaccgtaatgctttactttacactgacccaagtgttgatggcttaaaaacaggccatactgatgaagctggttactgcttaacgacttcaagtaaacgcggtccaatgcgtttaatctcagttatttttggtacaccaagcatgtctgaacgtgctgaccaaactcgtgcattattggcatggggttttgcaaactttgaaactgcaaatgtacaacctgcaaaccaagttcttgcaaaagctaaagtttggtttggtaaagaaaatgaagttcaggttggtttagctgaaaactttaatgtgactatgcctaaaggcaaagcggatggcattaaaactcaattggttgttcaaccgaacctaaatgcaccacttcaaaaaggtcaagtcgttggtaagcttgttgctagtttagatggtaaagttattgctgaaaaaccattggttgctttaaaacctgttgaagaagctggtttcttcgcacgtttaattgaccatatcaaacaattcttcagcaacttattctaa

SEQ ID NO: 224 - DNA, 726 bp, Acinetobacter baumannii
tccagacagtttaagaatatattgaaaaacatgacccaaacctcactttctcagagcccaaatgacacaacctcatcacaagatgtcattgaaataaaaacagtaacgcgttctgttggaagaaaagcgacgattacgaaagaagaactttttcaggcagctcttaacctgattggtccacaaaaaagtattgcctcactcagtttacgtgaagttgcaagagaagctggtattgccccaaacagtttttatcgtcactttaaagacattgatgagttagctatttcactcattgaccgtgccggtatcgttttacgtaaaattattcgtcaagcacgccttcgtgcatctttgcaagacagcattattcgcagttctgtagaaatttttctgcaacagctggatgctgatgaaggcaatttaagtttattgttgcgagaaggttttacaggttccgcctcttataaagctgctgtagatcgacagctcaacttctttcagcaagaactacaagaagatttaattcgcttagaacgcctcaataacaatcatctatatcaccctgaacttgttgcaaaagcaattacacaacttgtgtttcatatgggtgccaaagtgattgatcttcctattgatcagcgtgcggaagtcgcagaacaaacaatgatcatgatccgaatgattttagaaggtgcccgtcatctagacgaagcaaaaataagatag

SEQ ID NO: 225 - DNA, 633 bp, Acinetobacter baumannii
gtatttaagttattttgtattcacaacaaagagttgagggcaacaatggcatttcgaaataatgttccgcaagccagttggcgcttggcaaaaattgcattgggcggtattgttctgactggcttagctgtcggaacatatgcctatgcccagcagaagcctctacctacagtcgataaggttgaattagaccgttatttaggtgtgtggtatgaagtcgcgcgtaaacctgcttttttccaaaaaaaatgtgcttacaatgtatctgcaacctataccttaaatgaaaatggaaacatagttgtagataaccgctgctacgataatcaaaagcaattacagcaatctatcggtgaggcttttgtagttaatccgccgtataacacgaaattaaaggtaagctttttacccgaagctgtaagatggattccgataattcgtggagactactggattttaaagctcgatgaagattaccaaacggttttggtaggcgaaccttcccgaaaatatctttgggttttatctagaaccccacatccacacaaagaagtggttgatgaatatctaaattatgcaaaaacattaggatttgatattcgagatattattcataccgagcataaagaataa

SEQ ID NO: 226 - DNA, 246 bp, Acinetobacter baumannii
agaactaagttctgcttttcacggttcggttttggaggtttgagcatgaattggttcgatgcggttttaaaagtacgccaggtaattaccgataagcatggagtagaacgccctgctcaaaccattaacggcacattagattgcccgatctgcaatgaaggtgaagtgatttattcaatcagctcacacaacggtcatatctctggtcaatgtgacacagcgaattgcgtcaactggatggaatga

SEQ ID NO: 227 - DNA, 885 bp, Acinetobacter baumannii
atatcttttacgaagaattttgatagatggagtaaaaatccgcacatatatcgtcacattactctgggtgcccgtaaaaaggtggagaatgcggatatatggaggcctaacccaacttttaaggtaaagaaaatggcagattacaacgtaagcatgcgcgaccttcttcaagcaggtgcgcactttggtcaccaaactcgtttctggaacccaaaaatgcgtcaatacatttttggcgcgcgtaacaaaattcacatcatcaaccttgagcacactgttcctgcgttaaatgatgctttgaacttcgctaaccaattagcaagcaaaaagaacaaagttttgttcgttggtacaaaacgtgctgcttctaacatcatccgtgaacaagctcaacgcgctggtcaaccatacgtagatcaccgttggttaggtggtatgttgacgaactggaaaacacttcgccaatctatcaaccgtttaaaagatcttcaaactcaatctcaagacggtacttttgctaagcttactaaacgtgaagctttagaacgtactcgtgagatggaaaaacttgagcgctctttaggcggcgttaaaaacatgggtggtttacctgacgcattatttgtaatcgacgttgatcacgaagcgattgcaatcaaagaagcgaagaacttaggtattcctgttatcggtatcgttgatacaaactctaacccagacaacgtagattacgttattcctggtaacgacgatgcgatccgtgcagtaactttatatgcttcagctatggctgatgcaattcttgctggtaaagaatacgctcaatctcaagcgaacgctcaagcaaaaggcgatgacgctgcgaaagacgcttctgaggcttaa

SEQ ID NO: 228 - DNA, 831 bp, Acinetobacter baumannii
aaaatatctactgttatagttggcattaataataattttttcaggttgtctatgcttgctttaatttctcctgcaaaaactttagattatgaaacagcgttacctacagatgagtttactcagccgcgcttgttagaacactccgcacaattaattgatgtttgccgcaaactttctgcgtcggaaattgcgagtctaatgagtgtcagtgaaaaaattgccacacttaatgctgatcgttttagggactggaagccagaatttgatttttcaaatgctcgtcaggcaatttatgcatttaaaggggatgtttacaccggtttagatgcttatcatttaaaagacaaagatattgattttgcccagcagcatttacgtatgctctctggtttatatggtttattgcgtcctttagatttaatgatgccttatcgtttagagatgggcactaaattaaaaaatacgcgcggtcacaatttgtatgaattttgggatgacattatcactaaccagattaatgaagatttagcggcaattaaatcagaattgctggtaaatttggcttcagatgaatattacaaatctgtcaatgaaaagaaaattaaggctgaaattgtgaagcctgttttccttgaccagaaaaatggcaaatataaagtcattagtttctatgcgaaaaaagcacgtggtttaatggctcgttttattattgaaaaccaattaaataaagctgaggatcttaaagcttttaatactgaaggttactactttgatgctgataactcatcggcaaaagagttggtgtttaagcgtgatgaacaacaggcttaa

SEQ ID NO: 229 - DNA, 246 bp, Acinetobacter baumannii
atgagcactacttcttccgctacgacgcctattgaaattaatgcccttggccaaccttgtccaatgccattattaatgttgaaacgtgaacttaaaaaattatcgggaaaacaactattcttattaaaatcatctgacccgcatagtgaaattgatgtaacacgttattgccaattacatcattttacgtgtcaaaccatgcagatttcagaaagagaatttcactatttaattgaaactcaataa

SEQ ID NO: 230 - DNA, 906 bp, Acinetobacter baumannii
atcatgaatactattgatattacgaattccttagaaaaggataagttagtgaatactgaacaatctcaacttacagatacacaactgcatcatggcacttcgtatgtttcgcattttgaaccacatgcttcaaaaaagccaaactcaaccgaaatcaagatcagtgcacaagatgcccatgtttattatggtgactttgaagcgattaaaggcatcgatttagatatttatcaaaatgaagtaattgcgtttattgggccatcaggctgcggtaaatcgactttcctgcgtactttaaaccgtatgaacgacacgattgatggctgtcgtgtgacaggtaagatcactctagataacaaaaatatctatgatccaaatctggatgttgtattactgcgtgcacaggttggtatggtgttccaaaagccaaatccatttcctaaatctatttttgataacgtggcatatggtccgaagctacacggtttagcacgtgacaaatatgacctagaagaaattgttgaaaatagcttgcgtaaagcaggtctatgggaagaagtgaaggatcgcttaaaccaaccgggtactggcttatctggtggtcagcaacaacgtttatgtattgcgcgtacaattgcagtaagtccagaagtgatcttgatggatgaaccttgttctgcacttgacccaatcgcaacggcaaaagtggaagagctgatttctgaactgtctgatcaatacacaatcgttattgtaacgcactcgatgcaacaagcagcgcgtgtttcagaccgtacagcttacttccatttaggtgatttgattgaagtaaactctacagagaaagtatttactcagcctgaccaccaattgacagaagcgtacattactggccgtttcggttaa

SEQ ID NO: 231 - DNA, 225 bp, Acinetobacter baumannii
ttttttgatacggtaagcctgatgcggattcatatcacttcgtattttttcaaacatatttcgtcctcatcttcacagatgattttactgaatagacatgacaacactatgcgcggtctgaacatttcaatcaattgcaaaaccgataaactgcatggatcgtatcttttttgtcagcttgcaaatttcggtgttagtatcctagtaaattactgtttaacatga

SEQ ID NO: 232 - DNA, 672 bp, Acinetobacter baumannii
attagaggtactgatttagacatgattgggcagcaaagaaatatactggcaactttaggaatagacgtatggattcctagaacacaagtgtgccaaaaaaataatgcccatactttgtggcgagatcaggttgttgaacctcatgagtcaattaccgtacctaccatagatgttcctgcttttgagcaaaagaacactcagacacaggtgcttgaaattcctaaagtggtggaagagccatcaatagtggttgcagaagtctcgcagccagagaaacttgtagaaaaacctaaagtcattgagcaagagacaattgctccatttgagttacaggcttattgtcttgaaaaatgtgtaatttttgttgatgtaacggctttggaaacagaagagaaacaactttgggcaaatatacaaaaggcgaaggtaggacaatattctgaattaagatggccatttcctctggcagcctatcaagatcaacgaggggtaggttcttatattcaaggtttcttagatgctgtagcggcagagaaaaagattttatgtttgggtaaatgtacctatattcaacatgcaaatattattcatttagctagtttaaaagaaatgttagataagcctcttcttaagaaaagattgtggcaacttatgcaagataacaatgagtag

SEQ ID NO: 233 - DNA, 1071 bp, Acinetobacter baumannii
tgtgtttgcactagaaaatgcattaataggagtgtgcgtgtggatctatttcatgccatgagagtattcaacaaagttgttgaaacaaatagtttcagtttagcagctgatagtttgggtttaccgcgtgcttctgtgactacaaccattcaggctttagagaagcatttacaagttcgattgcttaatcggacaacacgaaaaattagtctcacaccggatggcgccgtatattatgatcggacagcccgtattttagcggatgttgccgatattgaatcttcttttcatgatgcagagcgggggccaagaggtcagcttcgtattgatgtgcctgtatcgattggacgtttaattttaattccaaggctccgcgattttcatgcacgctatcctgatattgatttagtgattggtctgaatgaccgacctgtagatttggttggagaagctgttgattgtgcaattcgggtgggtgaattaaaagattcaagcttaattgcgcgtcgtatcggaactttccagtgtgcaaccgctgcttcaccgatttatttagaaaaatatggcgaacctacctcaattgaagatttgcaaaaaaatcataaagcgattcacttcttttcaagccgtaccggacgcaacttcgattgggactttgtggttgatgatttaattaaaagtgtgtcagtacgtggacgtgtttcggtaaatgacggtgatgcttatatcgacttggctttgcaaggttttggtataattcaaggcccacgttatatgctcaccaaccatttagaatcaggtttgttaaaagaggtattgcctcggtggacgccagcaccgatgccgatttcagcagtttatcttcaaaatcgtcatttatcgcttaaagtaaaagtgtttgtagattgggtcgctgaactttttgcaggctgtccattacttggcggtacagctttacctttcgaccagaaatgtgaatttgcctgtgataaagaaactggtcatgaatatacaattcgtactttggtcgagcagcataatattgctgaagcttatacgctcaaaacttaa

SEQ ID NO: 234 - DNA, 1200 bp, Acinetobacter baumannii
ttagcatgcacagcaatgagattcgataaaacaataaagccgaaggaaaatattatgttggcatatgatgcagatttagaattattccgtgataattttaaacgttttatgaatgagcatattgctccacattatgaccaatgggaacgtgaaggaattatgccacgttcagtttggtctcaactgggcgaaaatggttttttatgtgtggatgtcccagaagaatatggtggttatggcgtcccaacgtattattcattaatgttagttgaagaatcggctcgtgctggattttgcgcattatcaactgctatttcttgtcactctgagattgcagcgccttatattttacatattgggactgaagaacaaaaacaatactggttaccgaaaatggtaacaggtgaagtagtcggagcaattggtatgacagaaccgggtgccggttcagacttacagtcaatgcgtaccagtgccattttgcaagatgaccattatttgctaaatggttctaaaacgtttatttcaaatggacaacatgctgaccttgtagtgcttgccgtaaaaaccgatccgcaagcgcgtgcgaaaggtgtatctttattattggtggatactcacttagaaggtttcaaaaaaggaactaacctcgacaaaatcggattgcattctcaagacacatctgagctattttttgacaatgttaaggttcctaaaaaccagttactcggccaagctggacaaggttttgcttatttaatgcaagaattaccgcgcgaacgtacggctatcgcatcgacagcggttggcgctattcgtggtgcaattgatttggcaaccgcttatgtaaaagaacgtcatgcatttggtcaacctatttcacagttccaaaatactcgttttgttttagcacaagcaaaaattgatgagcttgcgacaacagctttctatgagcgaaatgttgctttatatcaagaaggtaaacttgatgttgagacggctgcagcactgaaaagttttagtacagatatgcaaatgaaggtggcggataacctattacaactatttggtggttatggttatatgactgaatatccaatttcacgcttctttgtagatgcccgtattcaacgtatttacggcggtacaaatgaaattatgaaagaaatcgtagcacgtggattaatcggcaaagcttaa

SEQ ID NO: 235 - DNA, 1440 bp, Acinetobacter baumannii
ttcagtaggttgaatcaaaaatatagagttaataaaataaaaccatacattttttatgccttttattttatgaaaactgagcttctctctcccgcaggttcacttaaaaacatgcgctatgcttttgcctatggtgcagatgccgtatatgcaggacaaccacgttatagcttacgtgttcgtaataatgcttttgatcatgacaacttaaaaatcggaattgatgaagcccatgctctgggtaaaaagttttatgttgtagtgaatattcagccacataacagcaaattaaaaaactttattcgtgatcttgaaccgattgtagctatgcaaccaaatgctctgattatgtctgatcccggcttaattatgatggtacgtgagcattttccagaaatgcaaattcatctatcggttcaagccaacgctattaactgggccactgttaaattttggaaagactacggcctaagtcgtgtgattttatctcgtgaattatctttagaagaaatagaagaaatccagcaacatgtgccagatattgaactcgaagtttttgtacatggcgctctatgcatggcctactcaggccgctgtttactttctggatatatgaacaagcgtgatgccaaccaaggtgcttgtactaatgcttgccgttgggactataaactgcatgaagcccaagaagatgtgaacggcgatgtgattccagtcactcagctaaatacaccagaaaagccttgctgctcatcaggacaatcagaaacaacctcggttcaaactttgctcgtacaacgtaatgatgaggaaatgtttgctgccgaagaagatgaacacggcacctattttatgaactccaaagatttacgtgcggtacaacatgtagatcgtttaacaaaaatggggatcgcctcactcaagattgaaggccgtactaaatcctatttttactgtgcccgtactgctcaaatttatcgaaaagccattgatgatgctttagcaggtaaaccttttgacccaagcttaatgacccaactcgaagggttggcaaatcgcggttataccgaaggctttttaagacggcatgtgcatagcgaatatcaaaactatgctgatggatcatcacatttcgactaccaacaattttgtggagaggttgtagaacgtcgcgataattatattcggattgaagttaaaaaccgttttgtggtgggtgactcacttgagctgatgacgcctcaaggcaatatcacctttaacttaaccgaaatgcgcgatttaaaaggcaacccaattacagatgctaaaggttcgggacattttgttgagattccactttcacaagatgttgatatcagttatgccctactcatacgtaatttgccgcatgcaaaagaaagtattactgcatctacattggcttattcagcgagttaa

SEQ ID NO: 236 - DNA, 234 bp, Acinetobacter baumannii
tgcaagtcaacggatgattcgggagaatttttaatgttagtcaagattaattcaaatatatacgttcttgcatctgatgttatctcgattaaaaaaaaccagagaacaggctcagatagttacgggaaatggttcgcatacgttaagacggatcaaaacattactggttttgaagttcctgaagatgaagtaaaaattctcgttcaagatatcaatcgatttttagaaaaatag

SEQ ID NO: 237 - DNA, 1470 bp, Acinetobacter baumannii
ataccagcaactaacacgcactcaacaagtgcaacaaaatttcattggagcaaaatgagcatggcgaacaaggtccttcaactcatacaagaaagtggcgcaaaatgggtcgattttcgctttactgatactaagggtaaagaacagcacgtaacttacccagctgattctattgatgaagatacttttgaagacggtaaaatgttcgatggttcttcaatcgctggttggaaaggtattgaagcatctgacatgattttacgtccggatgcagaaactggtttcatcgacccgttctttgctgagccaacagtagttgtgacttgtgacgttattgaaccttcaactggtcaaggttatgaacgtgacccacgttcgattgctcgccgtgcagaagaatacttaaaatctacaggtatcggtgatactgcattctttggtccagagccagaattctttgtatttgacgaagtgaaatgggacatcgatatgtctggcgctcgtcatacattaatcgctgaagaagctgcttggtctactggtaaagattacgagtctggtaactcaggtcaccgtccacgtgttaaaggtggttacttcccagttcctccagttgactctgcacaagatatgcgtgcagaaatgtgtgcaaaaattgaagacatcatgggcccaggtcgtgtagaagtacaccaccacgaagttgcttcttgccaattagaaattggtgtgagcttcaatactcttgtacgtaaagctgacgaagttcaacagttcaaatatgctgtttggaacgttgcacatcaatatgcaaaaacagctacgtttatgcctaaaccaatggtaggtgataacggttctggtatgcacgttcacatgtctatctctaaagatggcaagaacttgtttgctggtgatgaatatgcaggcctttcagaaatggcgttgtacttcatcggtggtatcatcaagcacgctcgtgcattgaatgcaatcacaaacccatctacaaactcatacaagcgtttggttcctcacttcgaagcaccaattatgcttgcttactcagcgcgtaaccgttctgcatctatccgtattccttacgtttctaaccctaaaggtaaacgtatcgaagctcgtttcccagacccaatgatgaacccgtacttaggtttcgctgcgttgttaatggctggtatcgatggtattcaaaacaagatccatccgggcgaagctgctgataagaacttgtacgatcttcctccagaagaagaagcaaaaatcccaacagttgctcatagcctagatatggctcttgaagcacttcaagcagatcacgaattcttgttaaaaggcggcgtgttcactaaagaaatgcttgatgcatacatcgaacttaaaactgaagatgtacgtcgtcttaacacgactactcacccagttgaattcgatatgtactacagcctgtaa

SEQ ID NO: 238 - DNA, 240 bp, Acinetobacter baumannii
acgtttgaaacgacggatagctacgtcaactggttcgccttctttcaacttaacttgtggcatgtaaaatcctctagattatggataagatcaggcacaccattgcgccagatcacaagtgaaggtcagtattttactcatttacaactcatatcacaagtctataatagcgattgcaatattttgactcatataaaaggcagttttgatgattgttttaggcttggaaacttcttgtga

SEQ ID NO: 239 - DNA, 2034 bp, Acinetobacter baumannii
agagagagaactgtgaacgaaaatcaacctttcgatttggtcactcattaccagccagcgggtgatcagccacaggcaattgaaaagctggtgaatggtatcgaaaagggttttcgtaatcagttactgctaggcgtgaccggttcaggtaagacctataccatggcaaatgtgattgcccaaactcagcgcccgacgattgtgatggcgcataataagaccttggcagcccagctctatggtgagtttaaagctttcttcccaaacaatgcagttgagtatttcgtaagttattacgactactatcaacccgaggcttatgttccgtcatcagatacatttattgaaaaagacgcggcaattaatgaccatattgaccagatgcgattatcggcaacgcgtgctttgttagaacgtcgtgatgcgattattgttgcttctgtttcggccatttatggtttgggtgacccaaatgcttatatgcaaatgttattgcatgtggtccaaggtgatcgagtaagtcgagacgaaattattcgccgtttggttgaaatgcaatatacccgtaatgagcttgaattcttacgtggtacgtatcgtatccgtggtgaaattattgatattttcccggcagaatccgaccaacatgcgattcgtattgaactctttgatgacgaagtagactcaattcgatggtttgatccgcttaccggtaaaatggtccgcaaagtaccacgtgtcacgatttacccgaaaagccattatgtgacgccaaaagacaacctaacacgagctatcgataccattaaggatgaattgcaagaccagcttaagttcttccgtgaacatgacaagttactcgaagcgcagcgtatcgagcaacgtactcgttatgatttggaaatgatgcagcagttaggctacaccaatggtatcgaaaactactcacgtcatttatcgggacgaccggcaggggaagcaccaccgactttatttgactatgtaccagaagatgccttacttattattgatgagtcgcatgtaacggttcctcaaattggcgcaatgtataaaggtgaccgttcgcgtaaagaaaacttggtgaattacggtttccgtttaccaagtgcgcttgataaccgcccaatgaaatttgaagagtgggagcgtattgttccgacgactatttttgtgagtgccacaccagctagatatgaactggaaaaatcagaacaagtggttgagcaggttgttcgaccaacgggcttgattgatcctgaaattgaagttcgtccggtacttacccaagtcgatgatgttttgtctgaaattaatattcgtaagaacttaaatgagcgtgtattggtaacgactttaaccaagcgtatggcggaagatttaacttcttatttaaaagaatatggcgttaaggttgcatacctgcactcggatattgatacagttgaacgtgtcaaaattattcatgagttacgtacaggcgtatttgatgtactagtgggtattaacttgctgcgagaaggcctagatatgccggaagtttctttagttgctattttagatgcagataaagaaggtttcttacgttctgagcgttcgcttattcagacgattggtcgtgctgcgcgaaatgtgaaaggtaaagcaattttatatgctgatacaatcactgattctatgcgaaaggcaattgatgagacagagcgccgacgtgcaaaacaaatcgagtttaatgagcagcatggtattacgccacgtagtgcagttcgtcaggctgtgaaagaaattgatacgggtgaagtactttctgatgatcagattgatgagaaagtactagagcaggcacaagcacttagcgcagatgaacgacatattctttctgaccctaaattgtttagtaagcacattactaagctagagaaagaaatgttaaaggcgtcgaaggatttacaattcgagcaagcggcgcgtattcgtgatgaaattgttcgtttaaaagcgcaaatgttgcaataa

SEQ ID NO: 240 - DNA, 471 bp, Acinetobacter baumannii
acaaggagaacaaggtctatgaaatctatcggtgaatggtttgatgaatatagtgaaagtcatcaaaacccgataaataagaaaattcactgggtatgtgttccagctattttattttcgattattggaattattgctcactttagtgccctactcaccgctttactcgtagtactgaccctgattttttatgctcggcttgatcttgtacttgcagtagcaatggctgctctacttgttgtgatggcatggcttatttatgttctgccagtaggtgtaggattttatattgctctttttgtgtttgcctggattggacaattttatggacataaagttgaaggaaaaaaaccttctttctttaaagatttgcaatttctcttgattggtccggtctggtgtatggatgcttatcttgcaaagatattacctcattggaaaagccgtcagaagaaactgattgctcaataa

SEQ ID NO: 241 - DNA, 1095 bp, Acinetobacter baumannii
aaaagagcgacagagccctcagttatgcaagcaatcgaaaagagaaattctctattcaattcattaacacaagctgtatttgacaaaaatatggcgaacttctggctacaaaaaataaatcctttatggtctgtgcagcatggactagttcaaattgtaaaaaaagaattcgtagctcatgacactgtgagcctgacattaaaatgcaaccgcttggtgaaaatgggtgcggcaggtcaacatcatccagtgattgttgaaattgcgggccgtcgttatgaacgtacttatagcttgacgcaaattgatgcagagcacttacgtttaacagttaaaaaagttgctgatggtattgtcagtaactggtttattgcagaaagcaaaattggtgatgtttttgagcttgggcagccttatggtgacatgcaagaaaacattcagacaccgaaattaattatgttagctgctggtagtggtattacaccaatgttgagcttaatcacagcaattaagcaaagccaacagttagaaaaaacgcaggttcagcttttatattgggtcaaacagcgttctgatgctgcttttacagagtactttgaacaagtggctgaacaaaacccaaactttagctatcaggtgttttacacacaagaaacaccaaatgatgaacgtttaaatgccgaacatcttgcactggttgatggtattgaaaacagcacagtttatgcatgtggtccatcgggctttgtttcaactgttgaacagctttttgaaaaagcaccaacagtacttactgaagcatttagtttaactaatgaaagttctgcggatgacattggttatgtgaatgtcacattaacccagtctaataaagtgattgcaattcctaaaggccaatccattttggtcagccttgagcatgaaggccttaagccgacacatggctgtcgtatgggaatttgtaataaatgtgtttgtagtaaaacgcaaggttctacacgtaatttactaaacggtagccaaaatacggaaccaagccaattacttaaaatttgtgtgaactcagcacaatccgatctagttattgatctttaa

SEQ ID NO: 242 - DNA, 1320 bp, Acinetobacter baumannii
atatttaagacgagcatttccatgagtttatctccaaagcaagaacagttatttaaacaagccagcaaacacattccaggtggtgttaactctccggtacgtgcctttaatggcgttggaggcacaccggttttcattgagaaagccaaaggtgcatatttgtgggatgtagatggtaagcgctatgtagattatgttggctcttggggaccaatgattttgggccatgctcatccggatattattaaggctgtgcaaacagcagcagaagatggcttaagttttggcgcaccaaccgtacatgaaacaacattggcagatatcatttgtgaaatcatgccatcaattgaattggtacgtatgaccaattctggtacagaagcgactatgactgctattcgtttagcgcgtggttatactggccgtgacaagatcgtgaagtttgaaggttgttaccacgggcactctgactcattgttagtaaaagcaggttctggtttattaactaaaggtgagggcgaaccaacatcaaaaggtgtaccagctgactttgctaaacacactttaacgttgccatataatgatattccagcattaaaagaatgctttgctaaatttggtcatgaaattgcgggcgtcattattgaacctgtcgcaggtaacatgaatatggtgaaaccaatcgacggtttcttacaagccattcgtgatgtgtgtgatgaatataaatctgtatttattattgatgaagtaatgacaggtttccgtgttgcattgggcggtgctcagtcagtttataacgtaaaacctgacttaacgactttgggtaaaattattggtgcgggcttacctgttggtgcatttggcggtaagcgtgaaatcatggaatgtatcgcgcctttaggtggtgtataccaagcgggaactttatctggtaacccacttgctatgcgtgctggtattgaaatgtttaaacatttacgtcaaccggacttttacagtaagttatctgctcaacttgaaaagttacttgcaggcttacaagcagcagcagatgaagcgggtattccatttaaaactcagcaagctggcgcaatgtttgggctttactttaccgatcaggaagacatcacaagctttgactctatgttggcatgtgatattgaagctttcaaaaagttcttccatggcatgttaaaacgtggcgtaaacttggcgccgtctgcatttgaagcaggctttatttcatctgctcattctgatgaagatatcgagtttaccattcaggctgcaaaagaaaccttcgccgaaatgaagtaa

SEQ ID NO: 243 - DNA, 1845 bp, Acinetobacter baumannii
atgaaaaagacttttgatctttaccaaacagctcaagtgctccttgccagcaccagttttttgcttgccatgtctactcatgcttatacatggaaactcgacgatattagtacctcgactaaatatacagtcgagcctcactttttctatattggaaaaggtgctgaatggcaaaacattcagttttcgagtgactactcaactgaaaatgacacaacagtactcgtcaaatatgacgataagctcatttataacactacgcttaatggtgatggccaattcaaatttaatattcctgccagccagagcggttttcaccgtttagattttattattcaacaatatgcaaaaccaacgacgcttaaccaaacaaaagaaacattctgtacagaagatattgatcacttaacttatttgagtaattctcaactcgactttacgcctattcgaaatgagtaccgtttaaaagatctaccggacgctttatttaaccctcaggctagacgacctacaccttttgtcgggatcttaaaatataaccgtaaagaaattaccgaagcctctatgttgggccgattagtaagttcgtggagctccgtaacgccaattgaatgggttgattcaggccaaaccaatctaaatcctgaaacgaactttattattgaagtgattcgttcggcaagcccactcaaaggaggagccttagtacaaattgctaaaccggctgaaggtgtaccgacgctatctattacttatcacactccacaagagcttaccgctgccattaacgggctaattaatccaacttatgtgcaacagcttgatacgggtagcgctatttttccaactacaatctcagcaccagcttgggcgcaatttaaaaaaattgatacgcttgcagatctaggtattcaggattttcgactaaatcatgccgaaaagaatttatttcttgattttccggcagtatggcaacctactgatattctgcaagggcaaatcgcacttcgtattcaaagtggactattacaaggttcaaatattacagcatggattgatggaggacttgcaggaagtatgaaaacggcggatctcgcatccgaccctgtaaaccgacagttcaacatctttgccaaggaaatttcaaatacaaccaactttagcttgaaacttgaaaactcggttattgccaattctcaatgtttacccaatgctcacggctcactttgggttgataccgccaaatcaacggtaaaacttccccataaacttaaaaatggtgttgctgctctttcaatgaccttagccaccaagccaacgattgcaattgatgaccaatcaggggcattaaatattgccattattttaggacaagtcgctaaaaacatgctgctgacacaggcaccaatgccagtgaacctagtacgcttctctccgacttccccacaagcagtgaatgtgagagtgaacaaagagatttatcagcaacaagtcttaatgcatcaaaatattatttatgcacccgcagcagcgaatggctttatcgtaagttataacaataaccgcttcgatgtaattacagactctgaaaacggtgcacaaacctttatgcatttatggggaaaaatacagcataaaatcccaaataatgtgactaaaatgctggtttctgaaaacggcaatatttatgttcttcaaaaattaattgtgggtaatcaaaaagcgccattagttcagcaatcatcattctttttattagttgtgattatctctgcaattatgataatagtgatcttcttgtggtattggttacgacgtaataatgaaaaaacagataccaattaa

SEQ ID NO: 244 - DNA, 660 bp, Acinetobacter baumannii
aacatgtatgcaacgagcgaaacgaataagactataaaaaatctcgccctgttcgattttgatggaaccttgtgcagtaaagacagttttacagggttcatcttttatgcgttgtctaaacgtcatattgtgaagcaaggcttgaaaatcctgccatggattcaagcctattatcttaacttttatccagcccatgctatgcgtgccaagctatttcgtagcatgttcagagatactcctgcaattgaattgcaaagactaggtgaagaatatgcacaagaactcgtctctgcactttcacctgaaatttttgcacaattacaacagcaccagctattaggtgatcaggtggtattagtttctgcttccattgatatctatctcgctccactttgcaaattactagatatcgaattaatttgtacagagactcaaattaaaaatggcatgatgacaggttactactcaactccggattgtagtagtgagcaaaagaagttaagaatacatgagcaatattctttaaagcattatcagcgaatctatgcgtatggaaatagctcagaagatttagacatgcttagtcttgctacacatccttttatggtcggtgaagatcgaatcttgccctcattaaccccacaaaaaaagctcgcatga

SEQ ID NO: 245 - DNA, 2772 bp, Acinetobacter baumannii
tgtatggatgcagcgaagtggtacagcatttgctgcatctttttatttaaaactacagaggataaaacccttatgctggtcaagccttcatttaaaaaaagattgctacttacaacattattatctttatcggcgacacagatttttgcatctaataacagtgaacaaatcccgattggtaaattacccgagtgggtcgtacccgaatcttatgatttagattttaagattgatcccgcacaaaaaggctataccggtaaaactacgattcatttaaagctggctcaagccacagatcacatctggattcatggtaaatctttgacggtgaaagatgtgaatatcatatcggctgagggtgctaaaaccaaagcaaaatatgagcaagcctctgaggtagatggggtaagtaaaattaaatttgccaagaccttgccagcaggccagtatcaactcgttctagattttaatgcggcgtatgaccagcaacttgacggtatttataaaatcgagtttgagggtaaaccttatgtgatgactcaaatggaagcaattagtgcacgccagtcatttccgtcatttgatgagccacgttttaaaacgccgtttaatattcgtttgacgattccaagcaaatattcagggtttgccaatacccaacaaacttctgagcaagcagagaagtcgggttggaaaacactcagttttgcacaaactaaaccactaccaacgtatttacttgcactggctgttggaccgtggcaattacaaaaagggcctgatattggtgcaacttcatggcgtaagcagccgattcagttacgtggtattgcgcctgatgctaaagctgaaaaaatgcagcatgccttatctgaaacgccagccattttaaaaattttagaagattattttgcctttggttatccatttgacaagctcgatttactggcagcaccagacttcgccgctggtgcaatggaaaacccggggctgattacttttagagactatctaatgttgctagataaggactcgccagtctcttttgtacagaattcatttaacgtcaatgcacatgagctggcgcatcaatggttcggtgatgtggtcacgatgccgtggtgggatgatttatggctcaatgaatcttttgctacatggatgcaaagtaaaatcactcaaaaattacatcccgaatttaatgctgacctagaacgtattgcagataccgccgatgcgatgaaaagtgatagcttggtgagtgtgcgccgtattcgccaacctattttaagcaatgccgatattcaaaccgcttttgatggtattacttaccaaaaaggtgctgctgttttaaatatgtttgaaagctacttaggcgaagaaaaattcaaacaaggggtacgcaattatattaataagcaccaatatggtaatgcgacagccaatgatttaattagcgctttagcagagcagtctggacaaggtgagcgttttgccagagggatgaaaagttttcttgatcaaccaggtgtacctttaatcaatacttcattacagcaagaaggcaataaagtctttttaaatgtgaagcaaagccgttatttacctgtgggttcaaaaggtgatgcaagaagtctgtggggtgtaccattatgcgtacgttatgaagttccaaatgcagccagtaaggtccagtgtgagctggtagaccaagcagaatccaagattgaactcaaaggtgctagccttggcagttggtatattccaaatgcaaatgcggcagggtattaccaatttagtttgccacaaaaagaatttactcgtttgactgccgctacagaaaagctttctaacactgaacagttggcttatgcctatgcaatttcagctgcatttaaccacggtgatattaatttgttggctgtcgtagatgctgcgaagaaatttgccaattcggatagccgacaaattagtacagcgttgttttcccagttaagtacgattcatcgtcatgtattgaaaacagaagctgaacgtgaatattttagaaaagttttggccaatttatatttaccaaaattaaatcagttgggttatgtcagcaaaacaggtgaatcagctgaggacagtttgtggcgtagtgaattggttagatttcttgctttagatattcaagtttcagaagttcgtacacaactgttaaaacagtcagatgctctctttgctcaaaagcagcttaattttgctcaagtaacacctgaattattgccaactattttagctgtacgtgtacaagaaaaaggccaacctgcttttgatcgtttatctggagagctacaacgcgtgactcaacctacacaacgtcttgcaattcttacggctctaggttcagcaaatcaagaagcaacacgccaacaagcacgtcagttgattttgaaccctcgtgttaaagtcggtgaagtccgtaccgtggtcaactccatcaataattatggagatgaacaaggggggctatggtcgtggtttaaagtaaatcatgacgccgtgtttgatcgtttaggtaaatcttcggctgggcgtttccctgcaatgttcagtggagcagcatgtagccaacaacaagcggcacagttaaatgacttttttgcaccacgaactaaagaattggtcggggttgaaagaggattgaaacagaccaaagagcgaattcaactctgcgaatctttggtggcaaaacaagatggatcaattgtgcaacagttaaagttgtaa

SEQ ID NO: 246 - DNA, 1158 bp, Acinetobacter baumannii
aaaggttatttagcccacatgctgtacatatggatgcctgaaaccaatggagtttggcattggtctaacggagaaaactggttgcaggctgcaagtctcgatcaattaatacaagacttgcaaatacatcaaggaaaagaagctacggtcttttttccgagtcgtcatgctcaaatgcttcagcaaacgatggcaaagtcccattacaaacagcttggcgctgatggggttaaatatctacttgaagagtttgtgactttaccgattgatcacatgaaagtggttcaccattttcatgcggatcagttaactgttttgggtgttgctcaggggatggtagagacatggcaacattctttagctttgttaccaaccaaacttgtggctttgttgccagattttctagttttacctgaaccacaagctcagcaagttattctgtgtaatattgatcatcagcttttggtgcgtgagaataagtggttaggtaattctattgatgacttggggctttttttagagttccagtcagccgagacacattatcaatatagcggtttaacagcagagcaactagagagcttagaagctgcctcaagcgcagagcaacgttctgagtttgtttatcaatttcagcccttagataaaactaagcagcatccttttaatgttttgccaaaatcaaaagggcaagagcgtactttttctaattattggaaagcttgtgccgccgttgttctagcaattattgtcgtgcagtttagctatgatttattgcgttgggtaaaattgaaaaaggtggcagatcagactgctgaacaggcaattgagcaatataaatattggtttggtccatctagtcgtgtgactgaacaaaatattaaaggacaattcgaaagtcatttaagaatgagccagcaaggtgatacccaggcactttctttgttaagccgggttgggcctattttaatgcaaagacagattttagctcagcaactcaattatgatgcttcaatcttaacaatggcattaaaagcaaaatcagcagatgatttgcaagctttaacccaacaacttaatcaacaaggttttaaagctgagttaggtaatgttcaagctgatggtagtggtgcgattggggtggtgaaaatacaataa

SEQ ID NO: 247 - DNA, 2445 bp, Acinetobacter baumannii
caagctatcgcatcattaacgcattgtttagggttttatctcatttatatgaagtttgaacgtggtatcggtttcttcgcgctaattttttccattttggtgattggtgcttttattgctcttagtatctatctgattcgtttagataatattatacgtgaaaaatttgaaggacagcgctgggacattccggccaaggtgtttgctcgacctttggaaatttataataatgcgccaattactcaagcaaatttcacccaagaattaaaattactaggttacaaaacttcaagtaattatgacaagtctggaacctatgttgctcaaggcagcaacatgtatgtccatacacgtggtttcgactatggcgacagcgtagagcctgaacaggttttagaactgagttttgcaaacgaccaagttgtagaagttcgcagtacaaaaccgtcatcaactggggttgcccgtttagaacctttattaattgggggtatttatcctcaacataatgaagaccgcgttttgattaagcttaatagtgttcctaaaccacttattgaagctttaatttctacagaagaccgtaacttttatcatcaccacggtatttcaattcgtggtacagcacgtgctttggtaagtaacgtaactggaggacgtcgccaaggtggttcgaccctcacccaacagttagtcaaaaacttctatctaacccctgaacgcacacttaaacgtaaagttaatgaagcattaatggctttacttattgagttgcattacagcaaagatgaaattttagaagcatatttaaatgaagtgaatttaggccaaaacggtaactattcaatcaatggttatggattggcctctcagttttatttcggtttaccactacgtgagcttaatgttgcacaacaagcttatttagtcggtttggttcaaggtccatctttatataacccttggaaaaaccctgaaggggcaaaaaatcgccgcgatacagtattaaataacatgcgtgtcatggggtatttaactcaagcagagtatgaaactgaaattgcgcgtcctttaaatgttctaagcaaaccaagcctaggtccagcaaaattccctgactttttagatattgtgcgtcgtcaattacgtaccgaatatcaggaaagtgatttaaccaatcaaggattacgtatttttacgaccttggacccaattgctcaaacacaagttcaaaacgcctttaaagcttctgtagagcgtttagctaatagcaaccctgctcgcttgaaaaacctgcaaggggctgtactgattgcccatcctgaaaatggcgaattaattgcagctgtcgggtcaacacaagactttaccggctttaaccgtgccttagatgcaaaacgccaagtcggttctttattgaaacctgtcatttatttgagcgcaattgaatctggacgttataactgggcaagccagattgaagacgctccaattagcgttccagtagacggcggtaaaagctggacaccgaagaactatagcggcggtggacatggaattgtgagtttaagtgaagccttagcaaattcttataacctttctgctgtgcgcttaggtcaagagttcgggttatctacatttaccaacaacttaagaaaatttggtgttgaatcgacaatcccggcctacccttctattttccttggtgcagttaatatgtcaccaatggaagtactgggtatttatgaaaactttgctacaggcggtttcaaatatccgactcgtgcaattcgttctgttgtagatgcaaatggacgtttacttgatcgttatggtctaaacgtacaacaaaccattgatccatctgtcggttatatcatgaactatggtttacaacaggtcatgtcatcaggtacaggacgtgcagcgtataacagcttatctccagctttaaaattagcgggtaaatcaggtacgactaacgatacacgtgactcatggtttgccggctattcaggtaatcatgttgcagtagtatggttaggtttagatgacaataaagtaactggtttaacaggttcatctggtgcattaccagtatggattaatgtgatgaaacaattacgccagacaccagtaaacttacgtcaaccagactctgtacagtggcaatggattgaccgtgcatcgggtgacttatcggcacaagcttgtgatggtgccatgtatattccaatgctagcgcatacagtcccacatcgtgctacgccatgtggagcaccgtattatcaagttgatccaacatatacgccacaaagtgataacacaattcctgagtctcaggatgataataccgacagttatattcgtgaaagtgaaaaccagatggaacaagatctgtcgaataacacacgaatcatttcaagtggtagttataacaactaa

SEQ ID NO: 248 - DNA, 1068 bp, Acinetobacter baumannii
ataattctagcaatacatatcaatacttccccacgttattcagggattcacatgcaaagtttgagtaatcgtcaaagcctgattgcaagctatattctgatgggcatttttttgctttcggttatcccattgcatctcttagcaagtttttttgcaggctttctcatttatgaaattattattagtttaagctctattgttgaacgttatattgatggtcaaagagcccgtatttttattagtattttattaagtattattactatttctcttcttgcctttttcattacaagtttaattagctttgtagtttatgatttaaaaggagttggtttacatagtattaacggtaaagtcgaccaaacactactgcacttacaagcggagattgggaaatatttaccgggctatattccagatagcgttacagaactaaaagatgaaatattcgcgtttatgaaagataacgtgactacattaaaaaatgccagttccgatattttacataatctagtgactatggtgatgggtcttattatcggtatattggttgctattcacggctttcaccgacgtacaccccaacctgtttttaaatccttactgatccaacgtattcaaaaattatcaatttcttttagaaatgtagtttttgcacaaattaaaatttcagcgattaatacgctactctttatattatttgctttcgtactattgccgatctggggtgttcacttacctttcgccaaaaccttaaccattcttacctttatgtttggcttaattccaattttagggaatttaatttcaaatactttaacttttattgcggctcttacaatttcactcggtctagcaggtgttgctctactctacctcgtattagttcacaagttggaatactttattaatgccaaaatcattggtcataaaattaatgccaatgcatgggaaattttattggccatgttaattttcgagtcaatctttggcttaagtggcttaattgcagcaccgattttctatgcttatttaaaactagaattaaaagatgccagattgatttaa

SEQ ID NO: 249 - DNA, 348 bp, Acinetobacter baumannii
attaagatagctattgcgacatcgacaatcggtttgggcatttttctactcactaaaatttttcacaagtgtaagcaaattttatcaatttataaaatctttaaaatctcattgacagatctattcgataatgattatcatttaaatcgttcaagaatataccacggagcacaacaaatgaacgcaccttttagcttatttacacgcaatacagattcagctcatgccttaccaatgctgcattctaacaacctattcgccttaggtcgtgaaattcgaattatgcatgctggcgaggaatatcgtttacgccttactcgcaataaccgtctcattttaactaaataa

SEQ ID NO: 250 - DNA, 216 bp, Acinetobacter baumannii
cttatgacagctcgtgaacaaggcgtagtaaagtggtttaatgacactaaaggctttggttttattcaacgtaacggcggcgacgatgtattcgttcacttccgtgcaatcgtaggtgacggtcaccgttctctacgtgacggtcaacgtgtagaatttagcgttgtacaaggtcaaaaaggttttcaagctgaaaacgttcagcctttagactaa

SEQ ID NO: 251 - DNA, 1275 bp, Acinetobacter baumannii
aaaactaaagcacaacaaaaatggaatttaagggaagatataccaatgaaaatgaaactattaatgacgagcgttcttagtacgagtttatttttagtcgcttgtggaggagggagtagtgatgatggcccagctcctactaatccatccggaactccaaccaataatattcaaaatccagttgttaaagttgaagcctatacaagtactaacttaggatcagttgccgcagaaagtagtattttaacttataaaatgttaggtcaaagtggacaagaagtgcaggcaacaagtctagtgtttacaccaaacactccaccaccagtcggcggttggcctattgtagtctgggcgcatggcactacgggggtggcagatgcttgtgcaccaagtaaagcagctttagcagacagtacaaaagatttaattagtaaattactagtagcaggctatgttgttgtcgcacctgattatgaaggtttaggtaccccaggcatacatcctttcttaaatgttaaaagtgaggctttttcaattaccgatgcagtggttgcagcgcgtaactatttatcgcaacgtaatttattaacttcgaaaaaatgggtcactgtgggccattctcaaggtgggcatgctgcattaggggcggcacagtatgcgagccgtgcacaactagactataaaggtacagtagccgtagcgcctgcttctaatttaagaagtattttagtagatggagaggcacaagttgcgaatgcacctatagacattaaaattggaacctatgcacagcttgatacatatacagctttggttacagctggtattcgcaacacacagccgagctttgattatggacaagtatttacttcacaaatttcaagtattgcccaacaagcggaaacaatttgttctggaccattgggacaggcctttggagcgggtatgactaagtatgctacagaacataatggaacacttgacggttatacccgaacacagcctaattttatggctgtaccgttagttaaaacatttttagataaagattcgcagccgttacaagtaaaagttactactccaatcatcatttatcaagggatagctgattctacagtacctaaattggcaactgatctattgatatctaatgccactgctgtaggcactaaaattaatagttatgtgacaggtaactgggatcatgggacggcgatgagtagtaatgtagataatattgttggaaatgttcagactttactatcagctcaatag

SEQ ID NO: 252 - DNA, 888 bp, Acinetobacter baumannii
ttaaccatggctaccattgatttacccgacaatttagttcaaaccttatcacttgtattaaatcagttacagcaggtcttacctgaaccgaaacaagagaccgattttactgcccctgcttttagatgggaaaaccagcagcttaaagctatttatacacctaaaaatatttatcttgatgacttaaaaggcatcgaaagacaaaaagaaaagatcattcaaaatactttgcagtttttaaatggcttaccggcaaatgatgtacttttaacgggttcacgtggtacgggtaaatcctctattgttcgtgctttactcacggagtatgcacctcaaggattacgtttgattgaaattgaacgtgatgatttagcagacttaccgaaaattcaaaaaattattcaaaaccgacctgaaaaatacatcgtctattgtgatgatctagcatttaatgctgaagatgaaaattaccgtagtttaaaaagcgtattagatggttccttacagtcaggttcaacaaattttattatttatgcgaccagtaaccgtcgtcacttattacctgagttcatgcatgaaaacacccctgtaaccaaagtagatgtgcctcaatatactgagcttcatccgcaagaagcgattgaagaaaagatctctttgtctgaccgttttggtttgtggttatctttttatccaatggatcaaaacttatatttagaaatcgtagagcattatctagataaagcaaacatgccttttaatgatgaagttcgtgctgaaagcttgcgttggtgccaaatgcggggtcagcgctctggtcgagctgcttatcagttttctaagcattggattggtttaaacgccttaaaagatttgtctaacaattaa

SEQ ID NO: 253 - DNA, 252 bp, Acinetobacter baumannii
ctggtaatggctacatatattgaaaaattacaggaccctaaaaccgttcaaaagctggagtccttgctaggtgggcacatcatgagcgtgtacagaaatgcaggctttaatccacctgtacctgtttcacatggtggacgtttcatctatgccgatccaccaccagaaaagtatgcacgtcatttacatgaaggcatgaaattgtttgctcaagctttggatgaattggcagaaaaaagatggagggaataa

SEQ ID NO: 254 - DNA, 741 bp, Acinetobacter baumannii
ttttgtaaggcgtacccaatgaatcgtttttttatcgaaactgaacttacagttggctcaacaattcaactaactgaatcagtcttccatcattgggtacgtgttttacgcgcacaattacaagaacaagccatactatttaatggccaaggtggtgagtatctcgcgacattgaccgaaattaataaaaaaaatgcgtttgtcaccattgagaattttaatcctgtaaaccgtaatgccccatttaaagccattcttggtcaggtcatgagtaaaggtgaccgaatggattatgccattcagaaagcaactgaacttggcgtcagtaagattcagctcttgactagtgaacgttgcgaaatgcgtttgaaatacgaccgcgatcaaaaaaagttagatcattggcaagctgttgcaattgcagcatgtgagcaatgtggactcaatttagttccagaagttttagcacctattgctcttcatgaatggttaaactcatccgaccttcctacatctaaatttgttttggctcctgaaaaagaacaaaaagatgtattggcagggatacaacctgaactagccctcttaattggtcccgagggtggtttaagtgaaaatgaaattacgcaagccaatcaagctggatttatgaactggtgtattggggaccgtgtattacgtactgaaactgcacctgttgtagcattatctattttaaattatcggtttttatccatataa

SEQ ID NO: 255 - DNA, 1401 bp, Acinetobacter baumannii
acaattcattttgtcgtgcaaattaaaatttcgttcagttcagggggacggcgtatgtcttcaaatattaatttaaatgcaaaaaaagcgactgaaattaaattattcagtttttcaaccccagccatgcgtgctttccacatgacttggctcgcgttctttgtctgcttcttcgcatggtttgcttgcgctccattaatgcccgttattaaaggtgagttcggcttaaccaaagatcaaattgccaatattaatattgccgccgttgcaattacaattttagtgcggcttgctgtcggaccactttgtgataaatatggtccgcgtattacttacaccacccttctcttacttggcagtattcctgtatttggtgttgccgctgccaacagctatgaatcttttcttttcttccgtttactcatcggtgcaattggcgcaagctttgtcattacgcaatatcataccagtatcatgtttgcaccaaatgtcgtaggcacagcaaatgcagctgctgcgggttggggtaatgctggcggtggtgcaacacaagctctaatgcctttattactcggtgcaattgtaatgttcggtgtcgagcaaactatgggttggcgcgttgcattaatcgtaccaggcgtaatgatggtaattgttggggttctttactggaaacttacccaagactgtcctcaaggaaactttaaagaagttcgtgcacaaggtattgaggtgggtagcggtaaaaaaggtggcatggcaatcttaatgcaagcggctcgtaactaccgtgtctggattttattcctcgcttatggtgcttgctttggtattgaaattttcatccataatgttgccgcaatgtactatgttgaccaattcaaaatggatttaaaaacagcagggttaaccgcaggtatatttggccttcttgccttatttgcacgtgcattaggcggtattatttccgataaagtcgcacttaaaaaaggtttagacggacgtactaaagtacttgtactaatgattttaggcgaaggtttattcttaatactcttctctcaaatgaatgtcgtagctcttgcaattatttccatgacaatttttgcattgtttacccatatggcttgcggagcaacatatgcactggtcccttttattgaccgaaatgcattaggcggcgtcgccggcattattggcgcaggtggaaatgtgggtgcagtggcagctggtttcttactaaaaggcgtactcgatctgcaaacttgtctatttattttaggtggactggttatggttgcaggctgtagtgtaattttgattcgcttcacaaccgagcacaaagaaaaagaaaaaatactttttgaacaagctctacttgaacgcaattccgcagcctaa

SEQ ID NO: 256 - DNA, 1461 bp, Acinetobacter baumannii
ggaggacatttggtgattacatcaaaacaaaactggttgttgtcctcactcatgggaagcctgctccttgcaggctgctcattggccccagaatatcaacctgcaaaagttatagtgccagtcaaattcaaagaatctgaccccaaacttgaagataataactggaagattgcccaacctgctgatcagcaaactcgtggtgaatggtggcgcatttacaatgatgctcaactgaatgaacttgaacagcaagctatcgcaggcaaccagaacctaaaagcggtggcagcaaatattcaggcttcacgtgcattacgttcggcagctcaagctgaacgcttaccaagtattgatgccggatttgggccaacccgccaaaagccgtctccagcttcactcggtttagatgacaatacacatacttcggctcaaaccttatggcgagctcaagccaatgtttcatatgagctcgatttatttggtcgtgtagcaagtagtgtcaacgcagcaacagcggatctacagcaacaagaggcactatatcagtcggcacttttagctctacaagcggatgtagctcaaggttattttctgatacgtcaacttgataccgaacaggcaatttataaccgtacaatcaaattattaggtgaaacacgagatttaatgcagcttcgttttaaaaacggactggtcagtgaattagatgtttctcgtgcacaaaccgaacttgctaccgcacaaaccactgccctaaatattgctcgtaacagagccagtgcggaacatgcgcttgcagtcttattaggaaaaccaccagcagactttaacttggcagttcaacctttaactgcaaatagtatccgtctccctgccggtttgccgtcaactttacttgaaagacgacccgatattgcggctgcagagcgtgcaatggcagcagataatgcgcgtattggaattgctcgtgcagcatttttcccaaaactcagtcttacaggagctttaggttatgaatcttcaagtttaagcgagttgggtaaatggtcgagtcggacttttttactaggacctgtcgccggtactattttgtcgttacctttatttgatggtggacaacgtaaagcaggcgttgctcaagcaagagcggcttatgaggaaagcgtcgccaactatagacaaactgtactaaacgcatttcgcgaagttgaaaatggtttatctgatcaaagaattctcgatcagcaaattcaggctcaaaaccaagcactctcctcttctcgtcatgccaatcaactttctcatttacgttatcgagaaggtgctattagctatcttgatgtaattgattctgaccgcactattttgcaacaagaacaattagcagctcagctgaaaggtaatcaaatcattgcaagcattaatttaatccgtgctttagggggcggttggagtagttaa

SEQ ID NO: 257 - DNA, 594 bp, Acinetobacter baumannii
gtgcttttttattttatacttttactaaattttctattgatacttctcatggcaaaaaacatccgtccttatttagaccatcacccacaaattgatccaagctgttacattgatgaaatgtccgtggttgtaggtgatgttaaattggccgaaaatgtttcggtgtggccttttgcagtcattcgcggagatgtaaacagtattcaaattggcaaaaacagtaatgtacaagaccactgtatgctacatgtcagccataaaaatgatgcaaaacctaatggttcacctcttattattggtgaagatgtgacagtaggccatcatgttaccttacatggttgtactattggtaaccgagttttggtcgggatcaatacggttattttagatgatgttgttattgaagatgatgtgatgattggtgcgggaagcttagttccacctcgtaaagtcttaaaaagtggttatctttatgttggaagccccgtacaacaagtacgtcctctaaccgaaaaagaattggcatttttaccttactcagcaagacattatgtaaaagtgcaaaataaccataaagataatcaaataaattaa

SEQ ID NO: 258 - DNA, 195 bp, Acinetobacter baumannii
aagcccttttatatgaaagggctttttagtcactgctaccgcccccatcacatccgcctgagtcggaaaatgatgagcaatcatttgatgaatgagaactatggtgactgttatcgtaaatatggtggtgtggtgaatatgttgaagctgaataatcatgctcacccgatggtgaataattttttgaatttctga

SEQ ID NO: 259 - DNA, 657 bp, Acinetobacter baumannii
agacttatttataaaatgatcgaaaaagaattcaaagttaaacactatattgcgcttggtctgctttttattgccattatcatttcaggtattcaaccacttgagtttgaggcttatttgcttcatcaagctggcactgtttttatggtgattctgctttttattattttcaaaaaaattggactcgatttcttaagttttactttttatctactgtttttattaatccatattattggtgctcactatctctactcctacgttccatacaatgactggatacaacaggtgttccatttcaacctagatcaatatatgggctggtcccgcaatatgtatgatcgtttagttcatcttgcctatggtgttttgctctatcctcttatttatcgtgtattccaagtatggttacccactgcacgtcctttttctttattcttacttgtagtccagtttgtgatggcgtctagtgtcttttatgaactgatcgaatgggcaattgcaatcgggctatcacctgaacaagctgaaaattataatgggcaacaaggtgatatgtgggatgcacataaagacatgttactcgctacaattggcgcaatcctctatgggctaatcgctcttctcacaacaccaaaaaatcaaacaataaattaa

SEQ ID NO: 260 - DNA, 669 bp, Acinetobacter baumannii
aatagcacttacgtattgttatttagcggttcttctatgtctgagcaaattttcatccagggtccagtaggtaaaattgaacttttcgttgaccgccctgaaggtgaaatcaaaggctttgcagttgtttgtcacccccacccattacaaggtggaacccctcaacataaagtccctgctcttttaacccaaatctttaatgaatatggctgtattgtttaccgccctagtttccgtggtttaggcggcagtgaaggtgttcatgatgaaggtcatggagaaactgaagatattttagctgtgattgagcatgttcgtaagcttcatgcaggtttgccattttatgcaggtggctttagctttggctcacatgttttggcaaaatgtcatgcgcagcttagccctgaattacagccagtacagttaattttatgtggtttaccaacagctactgttgtgggcttacgtcactataaaacacctgaaattcaaggtgatattctactcattcatggtgagcaagatgacatcaccttactttcagatgcaattgagtgggcaaaaccacaaaagcatccaattacgattttgccgggcgctaaccacttctttacaggttatttaaaacagcttcgccaaatcattacacgttttattatcatgaaataa

SEQ ID NO: 261 - DNA, 432 bp, Acinetobacter baumannii
catttgaatttccaagccccaatgcttcatcagggcttagacttttcttttagtggtttaaagacggcagtttctgttcagttgaaaaaattgaacggcgaaaaccgtgatgctgatattgctgcttcattccaagaagccattgtagataccttagtaaaaaaatctgtaaaagctttaaagcaaactggtcttaaacgtttagtaattgctggtggggtaagtgcaaatttacgattacgtgaacagttggaaacttcattggcgaaaattaaagctcaggtttactatgcagaacctgctttatgtactgataatggtgcaatgattgcatttgcaggttatcagcgtttaaaagcaggtcagcatgatggtttagctgtaacgaccacaccaagatggccaatgactgaacttactattcctgagtaa

SEQ ID NO: 262 - DNA, 948 bp, Acinetobacter baumannii
tgtgagaatttcatgactgatgctttggttttaagagatttgtccaaaacatatcgtaatggttttcaggcgttaaaaggtattaacctcactgtgcctgaaggtgaattttatgcgttgttaggtccaaatggcgccggcaaatcaacaaccattggtattatcagctccctcacgaaaaagacctctggaacagttgagatttttggacataatctcgatactcatccatccttggcaaaacagcagcttggcgttgtccctcaggaatttaactttgggcagtttgaaaaagcatttgatattttagtaacgcaagctggttattacggtatccatagaaagattgcagaaaagcgcgcagaacattatttagaaaaactgggcctatgggagaaacgtaatatacaagcacgtatgctgtcaggtggtatgaaacgccgtcttatgattgcccgtgccatgatgcatgaacccaaacttcttattttagatgagcctactgcgggtgtagatattgagttacgccgctctatgtgggattttctgaccgaaatgaacgaaaacggtacttctattattttaacgacacattatctcgaagaagcagaaatgttgtgtcgtcaaattgccatcattgaccgtggtgtcattaaagaagataccagcatgaaaagtttcttaaaccagctgagtgaagagtcttttatttttgatttggctgaacctattgccccactccagctcaatattattggtgtgaagttcaatttaattgatagtagtactttagaagtaacaatggataaagcacatacattaaatgatttattccaacttttagagtcacaaggtattcgtgttcgcagcatgcgaaataaatcgaatcgtcttgaagagctatttgtcaaaatggtcgagaaaaatcttgaaggagcggcaaaatga

SEQ ID NO: 263 - DNA, 219 bp, Acinetobacter baumannii
cgggggtcctataaattagggcttttaagccgtgctaagattgcggcatattgtagcatgaactttataattaaacagaatgaagttagctcagttttaaataaaaatggctcaagttttataaaaaatgagccattgtttataaatcaattaaaaagctcgtttaaagcttatattttaaatttatccatcgttaattttagcttacaacaatattaa

SEQ ID NO: 264 - DNA, 318 bp, Acinetobacter baumannii
agcatgaaatataaagctttatctgaagctgaagttttggcagttcttgctgaaggtgaattagatgcaagcgatttgctttacacagctaatccaaactttgaaaaacgttttaaacgcttaaacacagcacttgcaaaactccttgatgaagtacgcgagtatttcccaaatgcccaatattactgtccaagtgatgccatggtattactacttggaagttcgcatgctgataaagatggtcaaccacatcaacaagaattggttgcagctaatagcgacgctcttagtgggagaataagtggaggtgactggtaa

SEQ ID NO: 265 - DNA, 1545 bp, Acinetobacter baumannii
ataatgaaatatgactttgaacaatcggataaagcttttttcggccatcctaaaccattacaaacgctattttttacagagctttgggaaagattttcttattatggaatccggcccttacttgttctttatatgattgcgatggtcaatgacggcggtctagcacttgatcgaccaactgccgcagcaattgtcggattatttgcaggctccatgtatttaatgaccgtttttggagggtgggttgccgataactggttaagccaagcacgtgctgtctggtacggttcaattattattgccttaggccacttatcaattgctcttacatctgtatttgatcaatctttcttttacttaggtttagtactgattgttttaggtaccggattatttaaaacatgtatttccgtgatcgtgggaacactatataaagccaatgacgcaagacgtgatgcaggtttttccattttctatatgggaattaacatggggtcatttattgccccacttattacagggcttttggcgaaagaccatggctggcatttaggctttggtattggtggcattgggatgttaattgctttattaattttccgttttatggcaatgcctcagctccaaacatttaatgagctacgccaagaagccaatagctgtagcaaacctgtcgtagaaaataaaaatgcgcctaaaattgtatttagctttttattcgcagttgcagtcgttattgcgctaaccttccttggtatcattcacatcaatcccgtggctgtcgcgacctatttaaccgtaggtattagcattgggattattgcttattttgcatatttacttcttttcctgaatttagagcaacatgaaaaatttaaaataattatttgcttcgttttattagcagcctctgccctattttggtcagctttcgaacaaaaacccacaacttttactttatttgcgcaagattatacggaccgtattgttttcggatttgagattcccactgtatggtttgaatcaatcaatgctctttttattattatctttgctccagttgcagcttggctatgggcgaaactaggtaaagcgaataaagatccaagctatatcagcaaatttattattgcgttgttattcgcagcaggtggctttttacttatgtctctagccagtcattttgctattcatggcagagtagtttcaccattttggttagtcggtactttatttcttcttaccataggtgaactttgcttaagcccaattggcttatcaaccatgaccaaacttgcacctgatgtcatacgtagtcaaattatgggtttatggtttacaggtacagctcttggcaacctcatggcaggtttaattggcgggcaagtctcggcagatggtattaatcatttacctagcctatttatgcgctgtgtattagccttggttattggcgcaatcgtgttatttttattaaagaaaccaatgaataaattaatggacaaaagtaccaacaaagttcaacctgatttggaaacgatatga

SEQ ID NO: 266 - DNA, 1290 bp, Acinetobacter baumannii
ttttatagatatatcgatattattcgatatatcttctacaatgatttatcacattcttataattttctactcacaatgactaaaacaagccatcagttttctcaatcactcatttatatgctcattggaagtgccattattttggctttgtcactaggtgtacgacatggttttgggctttatttagtcccgatgagtcatgagttcggttggggacagcatgtttttagtctagcaattgccatgcaaaatctaatctggggtgcaattcagccttttactggggcaattgcagataaatatggcagtaaagttgtggtaacagtcggcggattactttatacccttggcttactcttaatggcttttagttcaagtgtactcattttgaatttaagcttaggtcttattattggtttagctttatcagcaacctcatttacagttttgcttagcgcagtaggccgagctgctccgccagaaaaaagaagtatggcaatgggtattgctagtgcagccggttcttttggccaatttattatgctgccttctacccttctcttacttaagacagtgggatggtcatcagctttaatggtaagtgccctgttaatcgctcttattattcctctagcatggatgttaaaagggccaagcaaccaaaccccaaaagcaattgcccaacctcagctcacctttaaacaagtacttcacattgcgagaaaacataaaccgttttggtggttagctttaggctttttagtatgtggcttccaagttgtcttcctgggtgttcacctaccaggttatttaatcgaccacggctttgatgccactacaggtacggtgtttcttgctttagtcggattatttaatatcgtagggacttatggcgcaggctggttaggagatcgtttctcgaaacctaagttattaatggcactttatggtagccgcggcattgcaatcattgctttcttattattacctctaagcacttatacagtatatgctttcggtattatcatggggcttctatggctttctacggttccgctcaccaatggtatcgtggcaaatatgtttggtgttaaatacctttcaatgttaagtggtattgtatttttcacccatcaagtcgggtctttctttggtggttggcttggcggtgttaaccatgatttaacaggtaattacaatgcgatttggctctgttctatcgcattgagtatattaggggtaatcgtacatttctttgtaaatgaggaggctgttattcatgacgcataa

SEQ ID NO: 267 - DNA, 489 bp, Acinetobacter baumannii
ttttggagatatacatctatgttaaaaaaattagctttagctgctttgttagcagctggttcaagtgttgctatggctgataacgatgtaggttgtggtgtgggtacgcaagtatgggctggccaaaaaggagtggtgcctaaaattcttgctgcaacaacaaacggtatttttactaaccaattattaggtattactttcggtactttaggttgccgtcaaggtggaacagttacagcacaagttgttactttcacaaatgaaaatgcagaagctctagcgcgtgacatggctgtaggccaaggtgaaagcctgaatgtacttgctgagttaatgcaaatcaaaccacaagataaagaccgtttcttcaaagtttcaaaagcaaactttggtgaaatctattcaacaaacaaccaaaacacacttcaagtattagcatcattacaaaacgtaatggctaaagacgaagttttaaaagcttacgtataa

SEQ ID NO: 268 - DNA, 1107 bp, Acinetobacter baumannii
gagagaactcttatgaatatgccagtgaaagtcgaatattttaaaaatcctaaaaatcgagatttgactccagcagaacttgaagcatttgcaaaagagcttgatcagatcaaacaagaagtattggatgatttgggtgaaaaagacgctaaatatatccgccgtgtctatgctgctattcgttatagtagctttttaggccgagcttgtttatttgcaggttggttcccgccagcgtggattttaggtacaggtttattaggtttctctaaaattatggagaacatggagctcggccataatgttatgcacggtcaatatgactggatgaatgacccgaaatttaatggtcaaacttatgaatgggatactgtaggtacctctgacaactggcgtcaaacccacaactataaacatcatacttataccaatattaaaggtattgatgatgacattggttatggcttacttcgcttattccctgaacaacgttggaagccagggttcttattgcagcctatttacagtattccattttgcttattgttccagtggggtgtagcaattcagaatcttgaaattgggcgtgtactttacaagcgtaagactaaggcacaatttttagaagagttaaaaccagttaataaaaagattggcaagcaactctttaaagattatgttttcttcccacttattgcagggccggcagcattaccagtatttacaggtaacttggtcgcaaatggtcttcgtaatatctggacctttagtattattttctgtggacatttcacgaaagatgcagaagtgttcccaaaatctgttttacaagaagaaagccgtggacactggtatatgcgccaaattcgtggttcttctaacttaacaggttcagaagcattccatattttgtctggtcacttaagtcatcaaattgaacatcacttattcccagatattcctgctcgtcgttatcgccaaatggctccaaaagttgaggcagtttgtaagaaatatggcttgaactataacaatgccagctttgttaagcagtttggacaagtggttggacgtattgtgaaatatgcgttcccatttaaaaaataa

SEQ ID NO: 269 - DNA, 1032 bp, Acinetobacter baumannii
atatatatgtatattggtccctatcaactgtcaaataatttaattgttgcccctatggccggtgtaactgaccgtccatttagaacgctgtgcaagtatttcggtgcgggtcatgcagtcagtgaaatgatgactgctgacaagactttacgtatgactaaaaaaagtctttatcgtgctaattttgatggagagttagctccaatttctgcacagattgctggttccgatccggaacagttggctgaagcggctcgttaccaagtcgcaaatggcgcgcaaattgttgatatcaatatgggatgtcctgcaaagaaagtatgtaataaattagcgggttcagcattattacaagatgaagatttggtagctcgaatattagatgcagtcgttgcagcagttgatgttccggtaactttaaaaacccgtttgggatttttaaatggccaagagaatattctacgggtggctaagcgtgccgaagaggctggcatcgctgcattagcactacacggccgtacgcgtgaagatatgtatttaaataccgcccgttatgaattgattaagcatgttaaagaattaatccatattcctgtgattgctaatggtgatattgatagtcctgaaaaagcaaaatatgtactggactatactggggcagatgcaattatgattgggcgggctgcacaaggtcgaccgtggatttttcgtgaaattgcccattacttaaaaactggtgaacaccttgctgctccgaatattgaagaagttaaagaagtgcttttagggcatttgtctgagttatatcagttttatggtgaatactccggttgtcgtattgcccgtaagcatattgcttggtacaccaaaggtttacgctcaagtaatgagtttcgacaaaatatgtataaagttgaaacgactgctgaacaagctttagttgttgagagctattttaatcaattgcttgctgaaggtaatttgatgagcgatgttcaggttgaacaggttaatttattagatactcactaa

SEQ ID NO: 270 - DNA, 1467 bp, Acinetobacter baumannii
attgatatgtacaaatataaaaaagtgagtgatgacctcactcttcaaattcagaatggcaggcaacctgtgggttctcggttgccatcaattcgagattgtgcccagcattatcaggtcagtattaacaccgtaaaggaagcttatcggaagcttgaagatcaaggtttaatttcagttcgcccacagtctggctactatgtttgtcatgcgccttcaaacttgccagatcttgaggagcgttatatcagtgaagaaaaagtgcccctttcaggaattagctgttttctcgcgcaaattgttaaaaagcagatggaccccgactatgtcaatttggccctagcttgcccatctggtgaaaacttctacccgattgaacgcttaaaacgtttaactgctcaggttttacgaacacagccagatatttttaaaagctatactttaccgcccggctctatacgtttacgtactcaaattgctagacgtagtttacagcttggtatgtttctatccgcagatgacattgtgctgactcatggcactatggaggctttaagtctcgcgattatggcaaccacccaagcaggtgacagcatagcgcttgagatccctacttttcataacttatatccacttcttcagaatttaggacgaaaaattgtagaagtgccaacttcgccgcatacagggatgtgtctagacgcacttgaagaactcttaaaatctcaaagcgtacaagccatattaactattccaacaggacataatcctcttggttttagcatgcctgaaaacaaccgacgtcgtttagcagagctcgctaatcaattccaaattcctgttattgaagatgcgatgtatgccgaattacaactcaccgagcctcttttgcccaacattaaggcatttgaccaaaatggatgggttttggcctgtggcagctacaccaaaactgtggcacccgactatcgaatcggttggctagaagctggacgcttccgtaatattgtacagcagcttaaatttacaaccactgttgccgagccagctttactcacagaaacgttgggactttttttagaaaatggcggatatgatctacatttacgtcagctcaaaaaacgctatcaacaacaaattgacaccatcaaatcttatatttgtcgttattttccagtcggtactcgagtcagtcgtccacaagcgggatttattttatggttagagctacccgaatcaattgataccctagaactgtttcatcaggccatggatgaaaaaatcttatgtatgccgggaattttgtgctcggctgataaacgttttagtcattgtttacgtattgcagcttgttttgagttaaatcctaaaatgttaaatgctttgatgcgtttaggagagttagcaaaaaatatgctacctgtacaaaaagatatagatcaaatccctactaattcagtaggttga

SEQ ID NO: 271 - DNA, 183 bp, Acinetobacter baumannii
atattttttcacttggtcgctaccctgcaccataatttttataaaattttaataagtgtctataatataaaaattacgcatttgactaaaaaattccaagaatatgcttcattttacctttttaggcacatcatcaggtgtacccacgctttcacgcaatgtttcaggattagctgttcgtaa

SEQ ID NO: 272 - DNA, 1260 bp, Acinetobacter baumannii
tgtgtgtttcagtatttttatatccttatatttaaaaagaagtactacagaatttgcttgaaaaaaatcaatgtgagaggtgatatacagatgatgcagactcaaatatcagtagagcaaaatttagatcatatcggtcaaaagaaattttcatgtttttctacgaagaattattatcttgaggtgagcgaatttattaaaacgttaaatacacctgcagcaaataccacattattgaatgaagagattgcaaaatgctttgaagagattaaaaagcaaggccatcaaaatccagttttaattggtgctataccttttgatattacaaagaaaagtagcttaaattcttatgctaatcataaaaaaataacacaagcatcttctacgattaactcattaaaaaatcgtaataacattgagataattaataaatcattactcattcaacgacaaaaatttgaaggtacagtacagctagctttagatgcttttgagaaaaagaaggtagaaaaagttgttctctctcaggctgttgaatatgagtttaaccgtcatcaagagcctgaaaatctattggctgctttattaaaacaaaatccaaatgcttataattttgtgattccagtcgaacataataattatatcctaggtgcaagccctgaactgcttttgtcaaaacaagggcgtattgtaaccagtaatcctttggccggctctcgtcctaaatctaaaatttctgaaaaaaatttcgtcagccaacaagaattaaatcattccgagaaagaccaacatgaacatcgaattgtggttgaaaatattattagaaatttagctactcattgtgtagagcttaaggtttctgaatttccagatattttagaaacttcaacgatgttgcatttatcatcagaattccaaggtgtgcttaaacaacaggctcccgatgccttaaaccttgcattagaattacatccaacaccagcagtttgtggctcaccaactcatgttgctaagcaatttattttagatcatgaaggttatgaccgacattattacacggggttagtcggctggatggatgcggagggtaatggtgagtgggtagtgacaattcgatgtggtctactcagtgaaaataaaatgcgcttatatgctggtgcggggattgttgaagggtcagatgctgaagctgaatggctggaaacagaagctaaaatgcaaaccatgttaaatattctaaatacaaaaattgctgtgtaa

SEQ ID NO: 273 - DNA, 537 bp, Acinetobacter baumannii
accattgttcaaaatcattcacacaaccattcacatcattcacatggaattttgaggattaaaaaaatggaaaaatatttacgtttattaaatcccaagacaaccaattatgatgcaatcccttcgggtaaccacggtgctttgactgctgcggacgtatgcattgctatgagttatgcaaaattaactcctttgcaggataatttatttcgattgaagtacttgggcgcaaacaacattgagaatgtggaattatttagcaagttattacttacaaagtatcaagctaaatttattcaagcaggagtaaatgcggtttctcaccagccaactgttcgtgttgctttggttgagttctgtttggtatctgctgattacaagcctacagagcgcaatcgagaaattatttttggttttagtgataccactgtccgcaaccatatgaaaagtcatattgataatgtgttagctgatctaaaacaggcatgtgaattaggcgtagaaaagattttttggcagatcaataaaactaactaa

SEQ ID NO: 274 - DNA, 387 bp, Acinetobacter baumannii
gtcatgtctcaaaagattaatgcaacagatattactgaagaagaagcgttaaatgctgttttctttgagcgtgcggatgaattcattaaacaagcaaatgatttttgtcgcccgcctaaaggccaaaagccagacccggctgagcttcgcggtcaagtgagcgcagccatgttatttgcaactgctcgttttaatacatgggtggctgccaataattttaaagatggtaatgaaatgcgtgatgcaaaagatcaggtgatgtcttaccttcttcaacagttccaaatgatgcttgaagataactttgatgagtattgtgaacagttcgataactacttacgtttccgtaagaatgaagattttcatactcacaaacacgaccattaa

SEQ ID NO: 275 - DNA, 2835 bp, Acinetobacter baumannii
aagtcagctcaaatttcctactatagtcacacaactattgattttttattattcaaattaattggtatttatatgtttatgcagtttaaacaactgactctctccctatgtatttttggtttaagtgctgcctcttttgcacaaacaacattagtaaaaagtaagcaaaatgttgaggaatataaattagataatggttttcgggtagtgcttgcgccgaatgacaaagaaaataaaatctttattaataccatttatttaacgggttctttaaatgatccacagggtaaaagtggtttagcacatttactcgaacatttagcatttaaaggcacgcaaaatgtaaaaggtgaagaattccaacgccgtttagatcaatatacgttaatgacgaatgcgagcacggattactattcaaccaaatacaccaatattgtccgtccagaaaaaacagcactcgatcaagtgctgtaccttgaatctgagcgcatggacaaattagttctacaagaaaaatttgtgccttctgaaattgaaatcgtaaagcgtgaacgtgaagtccgtatggatcagccttttgctgtcttgatggatcaaatgtggaagtcggcttatggtaatcaatatctaggtcgattaccgattggtgatttacctgagcttaagtcaattaaaatgcctgagttgaaccagttctatcgcagttggtatgcacctaataatgcggtcatggtgatttcaggcaagtttgataaaactgatgttttgaaaacgatagaccaatattttagcccaattcctgcgcgagctgtgcctaagcctgttcaagtgcctgtgttagattctacaaaactcaaaaaccgtgagtttgtggtgaaaaagggtagtgatttggccaaattccatatctatatggatggtaaaaacacaaaaattcaaccggaactggctttcgcacctatgttgtataccatgcagccaagtggtcatttgtaccaaaatatggttgaaacaggtgttagtacagacgttcaggcatcaacatggctagatcaagattttaatgtggtatttttaggtgctatttattcaccaaaaaatgaccctaaaaaagttgaaagcgctttgctctctggaattgaaaagggtaaaccttttacagagactgagctaaatcgtgtaaaaagcttaatgaaaacgcaaggtgagttagtcaataaagatgccgttgctttgggttcccgtttaagtgattacactgtagcggatgggcaatgggaccaatattttaaagatttagattcaattgataaagtgaagctcaatgaggtaaatcaaaccttaaaacagttccttgttgcaggtcatcgtattgatggcgatattttgccaacaccagaagaccaaaagaaagcattacaactcgacgcaaaagataagcctaaaacattagatcaaacagatgttaaagcagagcctttaaaagatccgaaagtttatcaacaagaagttgccgagtttttaaaaacgtctaagcaatatgccgagagtaatgagaaaaagatcattcgcggaaaacttaaaaatgggatgaagtatgctttattccctgtagaaacccgtgatgatcgtacctatgccaccattactatggattttggtactgaaaaatctttattcgataaaggtacggttgttgatttaacttcatatttattgcttcgcggttctgataaatatagcttgcaagatattgccgataaatcgattgatgcaggtggcgcagcttatgcgagtgccgatggcaatggcatgaccattaatattcaatctaaaactgaaaagttcgatgagtttttcaagtttgttctagaggtcatgaaaaatcctaaatttgaacaatctcaatttgacttaattaaatctcaaagcttatctagtcttgatcgtccttatacagaaccggatgtggtagcaggtctaacattatctcgcttggttgaagaataccaacctggtgatttgcgttatcactttgaaccggagctagctaaaaaacaattaaagaatgtgactcaagaacaagtgaaagagctatatcagcatttctttgccatgaatcatgcgcaaattgcgattacaggtgcatttgatgcccaaaaaatgaaaaagctattgaatcaagagttcggaagctggaatagcaaacaaccgtatgaaaaaatcttgattcagcacgttgatttccctgctcagcaagtacatgtcttatctgagcagcgagagtttggtagttatcaaagtgtacttgccttaccggttgggaaaaaccatcctgacgcttctgcattaattttaatgaattacattttgggtgaatctcaaatttcatcacgtttggctcaagagcttcgtgaaaaaaatgcattggtatatggttttggtactggtttgcaattagatcgagacacgaatgtaggtgcgttaagcattagtgcaaattatacggctggtcgctcagcacaagtttctgcttcagttcataaggttctaaatgacttaattactcatggtattacagagcaggagcttgcagcagcgaaggcggatatcatgaagaaacgtgttactgccttagaagatgaacgtaatatccacggtatgttaaatctagagcttgagtcaggtaaaacattacttgaccgtgttaaacatgaccaagagttaacaaagttaacggttgctgatgtgaacgcagttattaaaaaatatattaaaccttcaaatcttgttgaagttatggctgaccagtatggtcaagcacaaaagcagtaa

SEQ ID NO: 276 - DNA, 2307 bp, Acinetobacter baumannii
aaaatgaatcaaaacattaaaggtctttcaatgaacaacgttagcgataaccgtaattttaaaagtgggaatgatcaaagaattaatcaccgttcttttgtattaaatggtgttgcatctgcacaaatggcccttcgattaggctatgcattaggcaccgtatttgttctatgtgcatcaaacacctatgctgctgttattgataattcaacaaaaactctagaacaacaacaggctgctcaaacaaatgtagcagctttacccgcaattaccgtaaaagctgaacaagatgatacttatgcaggtggacaagttgcaacatcgagcaatgttggatttctcggtagtaaaaaatttctagatacgccatttaatacgattagttataccgataaatatatcgaagataaacaggcaaaagatattacagaagtgattgcagcaactgatccatcgatatataccaacggtgcaagtggtggttggagtgaaaactattatattcgtggatatgcttcgagcacgaatgatatgtcaatgaacggacttttcggtatcacaccattttatcgaacttctccggaaatgtttagtcgcgttgaggtgttgaaaggtccttccgctttgttaaatgggatgccgccagcaggatcggtgggtggaacggtaaatctagtgaccaaatatgcggctgatgaaccgtttgcacgattgaccacaacttatatgtcggatgctcagtttggtggacatgtcgatgttggaagaagatttggtgaaaataaagaattcggcgttcgtatcaatggaatgtatcgagatggagatgcagcagttaatgatcagtcgaaagaaagtcgtttattttcgcttggtttagattggcaaggtgaaagagcacgtgtttttgttgatgcttacgatgccttagatcatgttgatggtgtaacacgtggtgttaacgtctctactgcagttggaattccgaaaccaccgaaagcggataccttacttagtccggattggggctctgtggaaaccaaagataaaggtgccatgattcgtggcgaatatgatttttctgatcagttaatggcatatgcggcttatggacaaagtacaacccaatataaatataatggggcaagtgcagggacgattacgagtagcactggaacactgagttcaatgcttggacaacttacttttgaagtcgataaaaaatcagcagatgcaggttttaaaggcaagtttgagacggggcctgtgaaacatcaatgggtcgccaatgcaacctactataatcatgcacaagatgattatggttatagaattatcccaggttttagtgatcctgttattacgaatatttatgatcccaatccaaattgggggcctaaaccggaatttacaccgccgtttctatttcattcgacactctctacctctagctttggtttagccgatacattgtcgtttgctcaagataaagtacagttgactttaggacttcgtcatcagactgtaaaagcaacaagttctgttaatacattacctgaaaatgctaaatcagcaaccacgcctggtgtcgccttactgattaaagcgactgataaaatttctgtttatgcaaactatattgaaggtttgacaaagggtgatcaggcacctgcaactgcatcaaatccaggggaaatatttcctcctcaaaaaaccaaacaacaggaacttggtttgaaggttgatttggggacatttgcgcataccttgagtgcatttgaaattaccaaaccaagtagttatttagatccttcaaagcttgtgaataacttacctacctttgtttcggatggagaacaacgaaatcgtggtattgaatggtcattttttggttcaccgattgaacatgtgcgtttaatgggtggctttacctatcttgatcctgaacttaccaagactaagagtggaggaaacgatggtcatacagcagttgctgtgccaaaaaatcaggctaagcttggagcagagtgggatactcaagtagcacaagggactttaaccttatcaggaaatatcaatgcagtttccaagcaatatattaatgcagaaaataccttgtccgtacctgggcgtacgctcttagatgttggcgcacgctatagcacgaaagttgaggaccacccagttactttccgtgctaatatctacaacttaaccaacaaagcgtattgggcacagccacaattgacgaatttggctttaggcgcaccaagaacgtatatgctatctgtatcatatgacttttaa

SEQ ID NO: 277 - DNA, 411 bp, Acinetobacter baumannii
tgttttgatcaaataaaaatcaggaagatgatcgtgaatgcacccgtaatttttaatcatgaaactcagccagagtttgaattacctattaaaaactatcaggaattttatcgtttttatttaactgaacaccgtaacattatgagtagacgcttacatgcggtgggcagtagcattggtctatactttttttcaaaagctattcgtaagaaacaggccaaatacgcactctatggtttggtttctggctatgcatgtgcatgggttggacattttatgtttgagaaaaataaacctgccagttttaaacaaccgctttatagctttatttctgattggcgaatgctctccgatgttgcgactggtcggttaagtttaattgatcgcaagcacgataaaattccaagttaa

SEQ ID NO: 278 - DNA, 1134 bp, Acinetobacter baumannii
cttatttgtcatattttctattcacaatgcagctatcgaagagcgtacaagcactcaacaaaaagtgacgtacaacctattgcattaatgagagagaacagaatgcgcttaaatccacgtcaaatcgcaattgcattagcagtaactggggccgctgtaacaacgactgcaaatgcagctcgtgatacgattcaaattgctggttcttcaactgtattaccatttgccagcgttgtagctgaagagtttggtaatacattccctcaatttaaaactcctgttgtaggttctggtggttcttctgctggtttaaaacagttctgtcaaggtgttggtgacaacacaatcgacgttgcaaacgcttctcgtaaaattaaaagcactgaaatcgaagcttgtaataaagctggtgtaaaacaaattcaagaaatcaaaattggttatgacggtattgtatttgcgtctagctcaagcaaagcagcttataaattaaaaccttaccatgtgtttgctgctttagctgcacagttaccttcaaaaggtaaattggttccaaacccttatacaaactggaaccaaattgacaaatcacttcctaatgagcctattacgcttgttattcctgcgtctaaccacggtacgcgtgaagttttccaagagaaaatggttgaagctggttgcgaagcgtatgaatacttcaagagcctagacaaagacgctcaaaagaaagcatgttctactttccgtaaagacggccgtgtaattgaaattgctggtgactatacagaaactctagctcgcttaaaaacttctccaagtgcagtaggcgtatttggtttaagtttctatgacatgaaccgtgacaagttacgtgtagcgacagtaaacaacgtagttccttctgagaaaactgtgttaaatggtacataccctgtatctcgtccactatacttctatgtaaaaggcgagcacttaaaatcagttaaaggtttaccaaaatacgtagaatacttcctaagcaaaaaagcgactggtaaaggttctaaagctgagcgtgatggtttaatcgcgatgtctgatgcagaacgcgctaaagttttagctgactttaaagcaggtaaaactgttaaataa

SEQ ID NO: 279 - DNA, 330 bp, Acinetobacter baumannii
agtggttaccactcgaggagaataaagatgaactttaaatttgcaaaaaatggtactgtcattattgcgaaaatcatcaaaatgaccgtgctttcgcaaaaagagatattactctctccaaagaactggtcacgtatcgcaactttgtggcagcgtttacagcaaagcttccgactcatggttggtgtgccggactatcaaacgtatctggagcatatgaaagcccatcatccagatttaacacctatggatgcacaaactttctatcgacattgtgttgatgcaagatacccatctgcaggtggtactttgaagaagtgcccttgttaa

SEQ ID NO: 280 - DNA, 2292 bp, Acinetobacter baumannii
gcactgggccaaaagctcggtcctcaaaactcaattcaacggaaggggctatatatggctggtgaaaagtcaaccatcatttacacactgactgacgaggcgccattattggcgacttattcgctactgccgatcattgagacctttactaagccagctggtatcgagattgttaaaagtgacatctctgtagctgcacgtgtgctcgcagaattcgctgactacctaagtgaagagcaaaaggtatccgacaaccttgctgagctaggtcgtcttacacaagatccagatactaacattatcaaactcccaaatattagtgcctctgttgcgcaattgacagcatgtattaaagaacttcaatctaaaggttatgcaattcctgactatccggaaaacccagcgactgaagaagaaaaaacaatcaaagctcgttatggcaaatgcctaggttcagcagtaaaccctgttcttcgtgaaggtaactctgaccgtcgtgctcctgctgccgttaaaaattacgctaagaaacaccctcactcaatgagcgagtggaaacaatggtcgcaaactcacgtttcacacatggaagaaggtgacttctaccacggtgaaaagtcaatgacacttgaccgtccacgcaatgtaaaaatggaacttatcacaaacagtggtaagagcattgttcttaagccaaaagttgcgcttcaagaaggcgaaatcattgactcaatgtttatgagcaaaaaagcgctttgcgacttctacgagaaacaacttgatgactgccgcgaagcaggaattttattctcattacacgtaaaagcgacaatgatgaaagtttcacacccgatcgttttcggtcattgtgtgaaaatctactataaagaagctttcgaaaaacacggtaagttgtttgacgaattaggtattaacgtaaataacggtatggctgggttatacgagaaaatcgaaactcttccaacctcattacgtgaagaaatcattgaagatttacatgcttgccaagaacaccgtcctgcacttgcgatggttgattcagcaaaaggtatcactaacttccattcacctaatgacatcatcgtagatgcttctatgcctgcaatgatccgtgctggtggtaaaatgtggggtgctgatggtaagcaatacgatgctaaggcagtaatgccagaatcaacatttgcccgtatttaccaagaaatgatcaatttctgtaaatggcatggtaactttgatccaaaaacaatgggtacagtaccaaacgttggtttgatggctcaaaaagctgaagaatacggttctcacgacaagacttttgaaattcctgaagcaggtattgcaaacattactgatcttgacactggtgaagtgttattgactcaaaatgttgaagaaggcgatatctggcgtatgtgtcaggtgaaagacgctccgattcgtgactgggtaaaacttgcagtaactcgtgcacgtaactcaggcatgcctgcgatcttctggcttgacccataccgtccacacgaaaatgaattaatcaagaaagtacagaagtacttaaaagatcacgatacgactggtcttgatatccagattatgtctcaagtacgtgcaatgcgttacacacttgagcgtgtagttcgtggcctcgatacaatttctgtaaccggtaacatcttacgcgactacttaactgacttgttcccaattatggaacttggtacttctgcaaaaatgttgtctatcgttccgcttatggcgggtggtggcatgtacgaaactggtgcgggtggttcagcacctaaacacgtacaacaacttgttgaagaaaaccacttacgttgggattcgcttggtgagttccttgcgcttgcagtttctctagaagaaatgggtattaaagaaaataatgctcgtgcgaagttacttgcgaagacacttgatgaagcgactggtaaattgcttgacaatgacaagtctccatcacgtcgtacaggcgaacttgacaatcgtggcagccacttctacttgtcactttactgggcagaagcacttgctgcacagaacgaagatgctgagttgaaagctaaatttgctccacttgcaaaagcattagctgaaaacgaacagaagatcgttgctgagcttgctcaagtacaaggtaaaccagctgatatcggtggttactatgcagttgacccagcgaaagtaagcgctgtaatgcgtccaagtgctacatttaatgcagcgctttcaactgttcaggcttaa

SEQ ID NO: 281 - DNA, 708 bp, Acinetobacter baumannii
tttttaccacaatggaaaactgtattaaacgctgtagtttccttcagagctgaaaagctctctttcaaagcccgcatgactccctttgacatgcgggcttcttttttgagatttggaaccatgacaagccgtccaccacaaagagctaagcgcccatgtcttgtgggcagttgtaaagatttcgcttcgaacaaaggttactgtgaccagcatcaaaaccgaatcaaacaaaaagatcgggagcggggcacagcacaccaacgcggctatgatgcccgttgggaaaaagaaagaacaaaattcttagatgagaacccgttatgtgcggaccatcgaaagcgcggacttgttgaggccgcaacggttgttgaccatatcgtcccacacaaaggcgaccaggtgttgttctgggataagaacaattggcaaccgctttgcaagtcatgccatgaccgcaagacagcaaccgaatacaaaggcggttggtcatatcaacgaccagttacacaaaagccagttgattgttatgtctttaaggttggtgagatggtgcaagctgcaacggcttatgcaattgacactttgtcctgtggttggactgatagttttgaaatcaaatcaatcgaagataaaaagattgaagtgcatgatgccgatggttttgttcataagctgcatcactcacacttcaaggcggtgactgcatga

SEQ ID NO: 282 - DNA, 1428 bp, Acinetobacter baumannii
aagatgacacaagcaataatttggagtttgggaatgaatatacccttaatcatcaatattgtggtttttgtcgggttaatatttttactcgcccaaacacgtaaaacggactggagcttatctaaaaaagttctagctggcttaattttaggtgtagtgtttggtttaggactacatttgatttatggcggtggccatccgattcttgctgaatctattagctggtttaatattgttggtaacggctatgtaaaacttttacaaatggtcgtgatgcctttggtctttgtttcgattttaggtgcggtagcgaagctacaccaagcttcttctttaggaaaaatcagcttctacaccatcgggactttgttatttaccacactcatcgctgcgctggttggggtatttgtgacgaacttgtttggtttaactgccaaaggtttggtacaaggagcggctgaaacagctcgacttactgcaattcagaccgactatgtgggtaaagtaacagacttaagcgtaccgcaatttattctttcttttattccgagtaacccttttgctgagttaacgggtgcaaatccgacttcaattattagcgtggttatctttgctgtctttttagggatagcagcactcaacctaatgaaagatgacgcagaaaaaggtcaacgtattctgacggctattcaaacattacagtcttgggtaatgaagcttgttcgtttagtgatgacgcttacaccatatggtgtttttgccctcatgacgaaagttgtggcaagttcaaatgtcgcagatatcttaaacctaggtggtttcttggtggcgtcttatttaggtttggcgattatgttcgtcgtacatgccattattttgactgtgaccggtgtttctccacttaagttcttcaagaaagttgctccggttctaacattcgcgtttacgagtcgttcaagtgctgcaagtattccactgagcattgaagcgcaaactcgtcgtttgggtgtgcctgagtctattgcaagtttctctgcttcttttggtgccactattggacaaaatggttgtgcgggtttatatccagccatgctcgcagtcatggttgcgccaactatgggtattaacaccctagacccaatgtggattgcttcgttagtgggtattgtgactttaagttcaattggcgtagcaggtgttggtggtggtgcaactttcgcagcattgatcgtacttcctgctatgggcttacctgtaacattggttgctcttcttatttcaattgaaccactcattgatatgggacgtactgcgttaaacgtaaatggttcgatgactgctggtgtagttacaagccaatttatggggcagaccgacaaagctataatgaatagcgaagatgaaattgaattaactcaacatcattaa

SEQ ID NO: 283 - DNA, 735 bp, Acinetobacter baumannii
gtgaataaacatcaatataatatgttctgtttaccgcctgcggggagtagcgcgagtatttatcatccatggaaaaagcagatctctgacaatattcgtattattcctattgaatattcgggtcatggtataaaaataaatgaaccattgattgatgatcctgatctattggctatgcaaattgccaatgaaatacaagcttactcagacaagccgtttattttatttggacatagtgtgggaggtggcttgatttggaaagtactcaattatttgaatgaaaaacccataattgatcagttgagattaattgttataagtagccgacctgagcaccactatattcaacatatgcggtacaagcatgagctaactgatgaaaaaattattgatgaattaaagcgatacaataattttcctgacgaaattttaaataatcaggaagcactcacattctttctcaaaatcattcgtaacgatttctatcttagtgatcaactacttagcgagaagattcataagactgaggttccgatcgttacattttatggcaaacaggaccctgatattcctaacaaaagaatgatggatgcatggcaacaacacacagaaaattggttaggaagcattgagtttgaaggggaccatttctactttctcaatcccgagactcgagtaaagatgcttgaaaatattgctgccatcgttgaaacattgactgtgaatattgaataa

SEQ ID NO: 284 - DNA, 222 bp, Acinetobacter baumannii
tgcatcaaacaacatttggttcactggcgatttaccggctataccaacaactccacacatagcaacctcgcagacaagctaggaattaataaaaaggattctttgttgaatggtcaggtcgaagctctgtttcctccgactcgtccattggttttggagaagtgcgcgttacaccgcccccagatgttatctgatgaaatgcctcacttgctgcatctttag

SEQ ID NO: 285 - DNA, 675 bp, Acinetobacter baumannii
caggaaaaacagatgagaattttgcttgcagaagatgatcgctctcaagctgaaagtattcaatcatggttagaattagacggttatcaagtagactgggtagaacgtggtgattatgcccttacagcaattgagcagcatgattatgactgtattttgcttgatcggggcttgccccaactggctggtgaaaaagttttaacaaccatccgccacaaacaaaaaaacgttcccgtgatttttattaccgcacgtgacagcattcatgaccgagtagaagggcttgatttaggtgcaaatgattatttggttaaaccatttagcctagaagaattatcggctcgcatccgcgctcaattacgtaaacaaactctgagtcagcaatcgattttaacttggggtgatttgcaacttgatacacaagcgaaagttgtattatgtgctggtaaaactatcgatttaacagcaaaagaatttcaaatattacgtaaacttatggttcatcctgagcatattattacccgtgatcaattagaagaagcactttatgcatggggcgaggaaatcgagagtaacgcaatcgaagtttttatttatcagcttcgaaagaaaatcggaagcagcagtattaaaaccatacgggggctcggctaccgtatgggagatttaaaatga

SEQ ID NO: 286 - DNA, 2205 bp, Acinetobacter baumannii
aatttaggacaggaaataatgacaagaataattgtagcatccaaagagggtttggacgttctgcaagatggtcagctcaataaggtggttttaaaccaacctactattattcaaattggtgtaagtcaaaaagatatcgcatcgatggaaaagcagggtggaagtctagtcatccatttaaaaaatggagaaacaattgtcttagaaaatttctttaatgaagcaacgaatacaacagagcattcactcgtttttccaactgaacaaggaaaatttgttgaagcacaatttgatgctcaaggtaaggttatagattatagaggcttaaatcatgttacggatttggcctataccagtaccagcccttcagctgcaacaatggccgttgataatgatccaagcttttcgatgggtaatgtactaaaagcaggcttagcagttttagccgctgaaggtttatatctttgggcatttgataaagatgataaagatgattcacccagtactcccgatttaatagcacctgctgctcctacagctacgcttgctgatgatactgtgacagtgactggcaaaactgaagcaaatgcgaaaatctacattaaagatgcagcaggtaatacagtggcctcaggtgttgctgatgcgagcggaaattacacgattaaattagataagccgttagtgaatggggataaattaaatgttattgcccaagatgcggctggaaataattctaaagttactgtggtaacaggaacaaaagatacaattgccccagatgttccacaagctcaattgagtgatgatggttccttattgacaggtaaagcagaagcaaatgcaaaaatcactgtttatgatgccactggcaaagtattaggaactgtttttgcgaataaagatggtatttattctttaaaacttactccaccattaaccagtgaagcgggcggtaaagtggttgccgaagatgctgcgggtaacaaatctgaggaagttaaaattattgcgggtaaagataccataccgccagcatctccttttgttgaagtaaataaagaagggtcggtaatacatggtaaaactgaagcaaatgcaaaagttcaaataaaagatgccggtggtaaagtgattggaagtgggaccgccgatgctcaaggtgaatttcaaattacactttcacctgctttaaaagaggcgcaaaagggcacagtggttgtggaagatgctgctggtaatgtatctaaaccagttgaaattacgccaggctttgactcgattgcaccagataaaccgactgttcaaattaatacagatggtacttctgtaaccggtacggctgaggcaaatgccaaaattgaaattaaagatacaacaggcaaggtaattggtagtggaacagcggatgcgaatggaaaatttacaatttctatttcaccagctttaacggataataaacatgcttcggtatcagctatagataatgctggaaataagtctgaagttgttgatattgtaggtacaaaagatacaacaccaccagcaaaacctatattaaatagcgtagatgatgatgtaggtgctgttaaaggagctataacggctggttctgaaactgacgatgctagaccaaaacttacaggctcaggtgaagcaaatgcaactcttactatttatgataatggtgttgcaattggagttgtgacggtaacaagtggtagatcttggtcatttacatttgataaagacttagctcttggtaagcatactattactttgactcaaactgatgcggcaggccttaccagtgaggcaagttctccatttaccttttatgtagttgctccaaaggctgcgagtctgtctgaaacttcagtagatattttaagtacagagggaccatctttggcagatagtgttggattgcatactttaaaggtagcgcaaaatacaacaactgagacgaataacccgcagaaatcggttcctttagatgatttattaaaaagttctacggctagtgaatcagacccaatcgcaaaacttctctcatcaacagcgttaaaaacgactcaggcatctgagccaatcgaagtaaatgcatcagttggtcagacaacatcaaatcctaatcatcctttacctgatacaacttcttcggttttacaaaaccttttagatcaaacttatccagttgtttag

SEQ ID NO: 287 - DNA, 990 bp, Acinetobacter baumannii
aagattatgcaacatttacaatggtggactgattttgtagcgtggcaagccgatgcgttgcctatggtattagtcacagtggtccgtgcagatggttcaacaccacgagaggttggtgcaacgatgttgttgcgatttaatttgcaacagcaatggcagcagtcagatacgatcggtggtgggcatttagagtttcaggcgattgatattgctaaagcaatgttaaaagaatcggaaacttgtgtgaggcgtattgaacgctttaacctcagtgctcggcttgggcagtgttgtggcggagtaatgtggttattgtttgaaaaaatattacccgctgaaattgcgtcggatttatctgggagtttgcaagcatggcgagctggaaagcatatatggcgtaatgtctcatatcaatatgcatccacttggcaaacgatggatatggaacaacaaccaagtttcgagtttcattctggcagcagtgaagaatggcaatttagccagcagattcaaccaaataccatgcaagtgctgatttgtggcgcggggcatgtggctgaagcaattgtccgttgtttattacctattggtgtgagggtgaaatggattgatccgcgtgatgatattttcccatccgatttactggaacaggcgtactgtataacaactgataccttagacgctgagatcgaacattttgaccgttcaggtgcagttttaattttaacgcacgatcatcaactagatctgcaactgtgttttacagccttaaaacctacggcaaaaccatttgcttatgttgggatgattggctcaaaaagtaaaagagccatttttgaaaaacgtatgcaggtgcgaggttatacttcggaaacattacaacgtttggtttgtccgatcgggatagacgggatttcatcaaaacaacctgcaatgattgccattgcagtagttgctcaattattacaggtatttgatgtaaaaaaatga

SEQ ID NO: 288 - DNA, 801 bp, Acinetobacter baumannii
ttttttgtgcaatatctgtttttgcctcttcaatttattggcaaggctgtttcggcagccttgtttggtattttgcttctcattgcttttgccctaactgcgtcgatgggaagccatgaatatatgggcttttatcgttatgattatttactcatatatgcactgattattcagatatgtctcttatatttaaaacttgaatcatgggcagaagccaaagttattgctttatttcatgtcatggcgatggtcatggaaatattcttgactcatcctgcgattgcttcatggcaatatccgcagcctgcggtatttaaaattttgactgtgcctttatttgcaggctttatgtactctgccgtaggtagtttttttgcacgctcaatacgcctgctgcaagtttcttttgaaaaacttccgagtttcggaagtatgcttttgctcgcatttttctcatatataaattttatgagtaaattttttgtacccgatattcgctatattttatttgctatcagtgtttttattttttggaaaacaaaactttatttccaattaaatgagcataaatttaaaacaccgatgctacctgtattgttaacactcgcttttctcatctggattgctgaaaatattagtactttttataaaatctggctctatccaagtcaggtagaggcttggcatatggtggggtggggtaaacttggatcatggtatttattattgcttttgagtttagtgttagtacttaaaatattaggtcatcgagataatcaaggtaattggaatttaagataa

SEQ ID NO: 289 - DNA, 1371 bp, Acinetobacter baumannii
catgctgggcatctgtgttccgtatttgccagtaaacgtcaaggtcacctagtgaaattcttcctatctctttttacgctgtttagtattttctgtactactcttaccaatgctgctctacttaatattgctcctgaaagtgttgaagccgctgcatggacaattgtagatacccaatctggtcaaattattgctgagcataatagtcatgtacaacgtgcgccagcctctttaaccaaaatgatggtggcctacattgcattaaaagagattaaggctggaaagttaaaactgaacgaagtcattactgcaacaccagtcgtaagcgtggtgcagtgggatgaatcacaaatgtacctcaaagcgggcgagcaaatttcagttgatcagctcttggctggtttaattgttatgtctgcaaatgatgcagctgtgactttggctgaaaaaatttctggtgatgtgcctcatttcgtacaacgtatgaatcaagaagcacaagcactgggtatgaaagacacgcactttagtaaccctgctggtattacaatgccggatcattacacgacagctcatgatttgagcttattaagtcaggcagtgattcaccagacccctgaatatttacattattcgaaaatgccgagctttagctacaatcaacgttttcaccacgcgacgaaccttgctttaaaatatgacccatctgtagatggcttaaaaactggctataccaaagcagcaggttataacttggctctaacagcttcacgcccttcattttcaccgaacttaccgcaaagacgtttactggtaattgtcttaggtacaccaagtgctgtgaaacgtgctgaaattgcagataaattaatgaatcttgcttatgcttatacacgtgatgaagtggttattcctgagcaaaaattaattgctgaattgcctgttattaaatcaactttaaaaatgtttaaagtagaaactaagcagccaaccattgttacgacttctttatatgctgagccaacaccaattgatttaaatacgtttgattatgctacacagcgtattcaagttcttgatagcaatcaacaacctaaagttattgctccacttgaaacaactcaaacacgtgtaaatattcagttaaatgagcaaaagttaacagcaccgttaatgaaagcgatgaatttggcaacagtttcaatttatcaaaacaaccagctcattcgcagtcttcaaattgaaaatgatgtacacattgaagaagcaaatattttccaaagaattatgatgtggttctcaagcctattctcaatcttttcatcaagtgagcacagtgcagcaaaactctaccctatagattcgcactaa

SEQ ID NO: 290 - DNA, 1311 bp, Acinetobacter baumannii
tggtcggggcaattttattattgctgctcatctcttctattattaggagggtccgtaaaaatggctccaattgatatcctgtttttatttggctttttaggtatttggattccacaagcattttgggcatggttaagctatcaagcgtggaagtattccaaaacggctgaaaaagagctgcaaaacttaccaataccagaaagatggccagtcttaagtgttttgatccctgcttataatgaaggcgttgtgattgaggacactttgcatgccattgctcaacaggattatccggcagagtcttatgaagtcttactgatcaatgatggctccaaagacaacacccttgaaatcgcagaaaacctcgcaaaaatttatccttgcataaaaattgtcaatgtacccaaaggtatgggtggtaaaggtaaatcaagaacgcttaataatggccttccccatgccaaaggtgagttaattgttgtttacgacgccgatagtacccctgaacccgattgcgtccgattacttgcccaaaccttgttagccgataaaaagctagtcgcggtaaatggcaaagtcagaacccgtaactggcaggatagtattttgactcgttttattgcgattgaattcatctttttccaatggatctttcaaggtggacgctggcaacgttttgaactatcaacattaatgggaacaaattatgtcatctggcgcgatgctctagagactttgggcggttttgatgaaaaatcactagtcgatgatacagaaatgagtttccgaatttttatcggacaaaaacgaattaaatgggttccctatgcaattggttggcaacaggaccctccttcgttaagcgtattcgttaaacagcgctcacgctggactcaaggtaatttttatgtgacacgcaaatatttacccgtagcactaagaaccccattcccaatcggaattgaaattctaaataacattatgtgctatatcctttttgtaccggctttattctggagtcatattaccttaacgcttggcttacttgatattgcaggtatttcagttcctggtccatttacactactgtggggactctcattttgtctctatgtagcacaaatgtggtttacgctttctttagaaaaagttaaaccagaactctatttttattctgtcttatcttacgtaagttactcacaaatcttcttatttattgtgtttaaagccgcattcgacatgctaaaaaataaaatacagggcaactcccttcaatggtacaaaacggaacgtagcaaggagaaaaaataa

SEQ ID NO: 291 - DNA, 618 bp, Acinetobacter baumannii
atatattttaattatcatgaggttaagttcatcatgcttctaatgatcgacaattacgactcttttacctacaacatcgtccagtattttggcgagttgaatcaggaagtaaaagtagttcgcaatgatcaagtcacattagaggatattgaacgatggcaaccaaaatatcttgtgattggtcctggcccttgctctccaagcgaggcaggtatttcaattcctgcaattaatcattttgccggaaaaattcctttgcttggcgtgtgtttaggccatcaaagtattgggcaagcttttggcggaaaaattgtaagagccaaaacggtgatgcacggacgtttatctgacatgtaccatagcaataaaggtattttcagtaatcttcctagccctttctcagcaactcgttatcattcattagtgattgatcaggaaacgctacctgactgtcttgaagtaacatgctggaccaatgaagcagatggctcaatggaagaaattatgggcgttaaacataagacacttcctgtcgaaggtgtgcagttccatccagaatctattttgagtcaacatggccatcaaatctttaaaaactttttagatatttatgcataa

SEQ ID NO: 292 - DNA, 441 bp, Acinetobacter baumannii
atttttcttaagattcacctcatctatcgatggtgtaattgttttattccaagggtaaaccaaataacagagggtaattttatgaaaatgcttaaagtaattttgatgactgcgggtatggcaactgcgggtgtggttgtagcaaatacacctgtgaatcaggcagctattgctccagcgacagttactacagtgaaacaagctttagcatcaaaagataatacacctgtaaaattacatggtcaggtcgtaaaatctttaggtgatgaaaaatatcaattccgcgataagagcggtagcattacaattgatgtagatgatgagctttggcaaggacgtcctgtttcagccaatacaaatgtgactttaattggtgaagtagacatagattataagcctttaaaacgtgtagaaattgatgtggatcaggtccagttctaa

SEQ ID NO: 293 - DNA, 963 bp, Acinetobacter baumannii
cattttcttaactttattatgcttaaatcttttttctttttatcttgtaatttctttctaggctctttaataagtagttccgttttggctcaagcccctataaaaaatcaatcaaaaatcgattttcacaacaatcaggcccagttccaaatcaaatctaaaaatactggacatgaatatcttattcaaatttataaaccacctgttgccccaccccaacatggttatccggtactttacatattagatggtaatgcaacatttccaagcgcaatgaatattgcccagtcgattggagcaggctctgcaaaattaggtttagatccgctcattattgtagctgtgggctatcctcagcaaaaaacctttgatgtgcaaaaacgcgcttatgattacaccccaaaaccttctgccgagtttcaagcgcaaggtaaatataaatatggtggtgctgaccagtttattgcttttttaaataatgagcttaagcctgaaatcgctaaacagtttccaattaatagccaacagcaaagtctctatgggcattcttttggaggattgtttgtgctttatcatttttttcaaaaacctactgccttccaacgttactttgctgcaagcccttctctctggtttgatcaaggcatgttatttcgagaattagaacaatggcaaagtcaaaagcaaaccgtgttcccaatgctgatgacgacagccggtacacatgaacaaggtgggccacatacccagtttaatcaaagaattaataaagacgatttctttaaagtcttagaaaataaacgttcagaccaatttacttattggcatttcaataatcctgctgaacagcatatcaccaatttgtatgcgagcttacctaaagcgcttatgtttgcttcatgccaaaatctagaaagctgtaaatctttattcgatgaaccatcgcagaaaacagctaaataa

SEQ ID NO: 294 - DNA, 1248 bp, Acinetobacter baumannii
tatcatattaaatcatttctaatgataaataaactcgcttttaataataaaaaaattgagagatttctcatgtctacgttctatcgaatgagcctacttgtctttttagcgacttgcctaggaattggtatttttagattttcctataccgcactcatgcctattatgattgtgcaatatggatggactcatgattttgcaagctacttaggcagcgcaaatttattgggctatctggttggcgcactattggccctgtttagcattaaagaaaaatctatccccgctttgattataacttcggcgtttttaggcagcttaagcctactctgctgttcttttatacacatgtctttggcttggtttattctctggcgcaccatttcaggtatcgcaggtggcctactcatgattttggcgcccagctttgccatgaaaaatattgcaattagccaaaggctcaaagtcaattttttagggtttagtggtattggcgcaggcgtgttatctgccactctcattattcctgcacttaaaaatatgcctgttcaatatgtctgggaaatttttgccgccatttccattattggcagtttggtactttctcagttattaaggcacccacctaccgagtccgttcaaacggtcaatcaagctcctcaaaacttcaaacattcacgtttaggactggtcattattattgcttatatgtgcagtgcttttgcatatatcccacactctttgttttggatggactatttatcgggaaccctacattttccattgcaacaacgaaacttattttgggttctttatggggttggaagttgtattggcgcctttgtggcgtattgtttaagccgctttattggatatttgcaggcaattaaatgtctatacggtgtctattgcttggcagttgccctaccttttttttcacatgctattgctttgctcactttatcgtcctttcttacaggtttactcacacctgccaccgtatttattagctcttatagcctgctacagatttatgaacagcgttatcaaaaaatctggagccttgccaccattgggtttgccaacactcagttattaggtggcgttgttattagtactttacatcacttgcattggtcttatgcccatctgtttttaatgggcggcattgttttgttatttgcattgagccttttaattcctatccgttcttccatgccgaacactctcggagaaaccgaatcgtga

SEQ ID NO: 295 - DNA, 2589 bp, Acinetobacter baumannii
aatgaaattaaagccctgcattatgcggggcttttttttggagaaaattttatggcgattatcactgaagaaaaaatgcagaatcttgatcgcgatattgaggatgctgggaaatgcctaaatattgatggaattattaccccacgatatggggagctttttaaatcgtttcctatggtatcgcgtgaaggtgaagaaaactttttatttgccactcaacaaattattgaagcaggattgttagaaggttttacaactgaagctgaattgttagcaagtagaccgactgtttcaaagaaatatgcaaaagcaaacgatactaaaatcgtatggttttggaataaaccagtaggggcaagtgatggtaattactggataagcactggattaagtgaatatagtcagtcaaaaaactattttgatcagtatagttcgcttacaaaaaatgcgactgtgttttatcctttttcgagcaccaagcgaaataatgtgaatgctagtagtgtttccgcatcacatgaagcttacttgaaaccgtatattttaaatattacggtgaatggtgctgatccaaataaatattatcgtattcagcagattagcactcccacaaatgcttccgtgccgaaccgttgggtttttgaagttctaaaccgaacaaattttgatacttcagaaacggtagaaaaaactattccagttgtttttcctattgtgaataacacaggtattaaaactttcagtgttgttgatggtgatgtcactattattgtgacagttgatacaagtaaagtgcctacaggtgatttctactcagttgcttcaggtgatagctcatatacatacattattgacccaagccgttatgtattttcagcatttaaaaaatctgatgcagtcggttatgttgattcaattagtacactgacaaagaactcaactgttttattcccgtttagtacattaaaacggaataatgtgaatgaaagcactgtaggtacacacgacaatattttgcgtaatttcatacttgatgttcgagtaatgaatgctgatccaaataaatattatcgcttgcaacagatgagcagtcccgatcaagcaacaaatccgaatcgctggatatttgaagagcttgatcgcgctaattttgatacagtagagacaaaaggtaaggcgattactgcagtttttccaattgtcaaaaatactgggatcaaaaactttgttgttaaagagggtgatttaagtatttcagttacagtaaatactaataaaacgccttctaatagcttttattcagttgcctcaacagataactcatatacgtatattattgatccaagtttgtattcttatgctgcggttacaagctcagacattaatgcagttaatacacgtattgataagtttactaagccgatgcagcttaaaaacttgctcaatgatttacgaaatccaattcaggatgttgatattattttcggtcctgccgattctattacctatggattaggagcaactggaaatgaaggaggtacaggacagcccggaacgcatggaccagctactacgcaaacatatgtaaatatctttcgtaattttctaggtacagctttttgtacaagtccccgctatggtgatgatacgattacacagactggtacagcctatttcacaagtgaaggcacaagtgtattaagtgctgagcttgcgaactatacatttaagaatagtgttactggtaaagtgtttacacttacggaaatgcaatcattaattggcattaatggtagctctccgacgggaagttttcttgatttaaaaagcccttcagtcgctggagcagtgacagatatggaatttaatttcaatggaaatgcattcactatcaattacgcaagactcggaaacggaagtgctactgaatcaaacattgatgtttttgtagatgatgttttgcactctagctttaacgtgtacacagcatctacacctgattttttaggaacttatacagtaggcgaactacctgaaggtcagaagaaaattcgtatcgctaacagattatctaactcgactatttatgctcgattgatgtctattacagctacgcgaaaaatctcagttactaatgaagggctttctggtacaaactctaaacaatggcttgataataactggattccaaacgtaattaccgctaaagctaattatgttttcatgatgattggtactaacgatcggcacactacgcagaagatagggacatttaaaaatcaatatcttcagttgattgaccgtattactgcaaagaatccaaaagcacaaatcattatcatgtcaccgcctgccgtgactcaaaatgaagatcctaatacgacggtatataaatttaggattgcagatctgaattatgcattaagtcagattgcgcagctaagaggtcattcttttattagtctctttgaggcaacatccaagctcaaagctaaaggtgaaaactatttgtttgatcaaatacatccaaatgattatggttatggagtgattgccgaatacattattaatcaaatcttgaatgcataa

SEQ ID NO: 296 - DNA, 390 bp, Acinetobacter baumannii
atgatgttcctgaagcaaaatacgtacaataagagcttctcatgtgaacgatgtgaatggtcatgtgaaccatttaagcaaatcattcacacgctcaaagccttatctgccaatgcatacaataaccatgtgaatgatgtgaaccattttcttgcgcgcgcacgtgagagaaaaaaacacctattgcttaatttaaatcaatttaaatcaaatattgttcataatttaaacacaagtgaaatcactctcacgcaagaaaacacacataaatcattcacatcattcacatgtaatacaatttattgtttttactcatgttttcatgtgaaccattgttcaaaatcattcacacaaccattcacatcattcacatggaattttgaggattaa

SEQ ID NO: 297 - DNA, 462 bp, Acinetobacter baumannii
ttgactgctaacattatgactactttaaaaaaccaaattactgatgcattaaaaacttctatgcgtgccaaagatatggcaacagtgacggttttgcgtagtctacaagcagcaattaagcaaatcgaagtcgatgagcgcatagagcttgacgacgctcaggttcttgcggtcattgaaaagcaaattaaacaacgtaaagaatcgatcaaagccttcgaaggtgctggtcgtgatgatttagctagtaaagaacaagccgaagctgaggttttatctcagtttctaccagaagctatgactgaggaagagcttgattctctcattgagcaaacgattgctgctcaagaagcaactagcatgaaagatatgggtaaggtgatgaattctctacgtccgatcatagccgggcgtgccgatcctgctcaagtttcagcaaaaattaaagctaaattagcttaa

SEQ ID NO: 298 - DNA, 723 bp, Acinetobacter baumannii
aacattaataaggaaaaacacatggcttttccacatcatacagagcatcatgccattcagcgctcaggttggctaagagcctcagtattaggcgctaatgatggcattatttcagtgactagcttaattatggggatggctgcaagtggggcaagctcacatactctatttatcacttgtgttgccgggctcatttcaggcgcaacctcaatggctgccggagaatatatttctgttaaatctcaagaagatattgaaaaatcagatttagctattgaggcaaaagaattaaaaaaataccctcaaaaagaattggatgaattaactcaaatctatatttctaggggactttcaaaagaactagcaaaggaggtagctattcagcttacaactcatgatgctttgggtgcacatgcccgagatgaaatcggtattcatgaaaatacggcggcaaacccaattcaagcagcactctcctcagcagcttcattttcatttggggcatttttccccatgcttgccattttgtttagcccagagcatttaattatgccaagtgtgcttattacaggtatcgcggcattagcaattttaggtgccctttcgagttattttgcaggcacttctaaaatcaaaggtagtttacgtattaccttatggggtattttagcgatggctttttcaagctggattggttccttatttaatgtcactcctttataa

SEQ ID NO: 299 - DNA, 777 bp, Acinetobacter baumannii
atattgaataaagtccatgctatgaatacgaagaagcagttaagtagaggggctaattcatgtctggatgaaataaatattcaatatgaaaagctaacagctttcgggctagatatacataaagtccagctcagccaaatcaaagaaatacctcagcttgatcatatctatcaggagctgaatatatttcttccaccgaatataaaaagctcacgcttcattcgtcaattagagttcttgacggggcgcttagcagcaaaatatgcattacaaagctttaacttacaagattctattgtctatcaaggtagacatggggaacccctatggcccgaaggagtgatggggggtattagtcatgttggatcaaaaaaatcatgttatgccatcgcatatgctagaaataacacacctaaagaaaaaatatttggaatcgatatagagtctcaaaaacatcatattttttttcaaaagaaagatgaattttatgatgtttttctcaataaaaacgagcaagaagaaattgaaaagctactaaaagatcaagcatatttatatttgataatattctccgctaaagaaagtatcattaaggcattttatttaaaatataagcaaattattgattttaaaaatataaaacttaaagcactagatggcgcgtttctttatttttaccttagacaagaaagtttaagcgggataactctagaggttaaagtttatttttttcatacaaataacgagataattacaatttcttgcattgaaaactaa

SEQ ID NO: 300 - DNA, 459 bp, Acinetobacter baumannii
aagggcgataagcccttttgttttatctggctatgtttagccaacctattctatggtaacgttgcctttcattattcagttgcgttttttgttatgtggattgccatttcagcccttaatcttgctttcgcagtcatgttgggtgcttttggagcacatggtcttaaagctcacgcgagccctgaacaacttgcttggtggcagactgcaaccgactactttttttatcatgcgcttggattgttagcgcttggtattttaagcaaggttcttcctcatttcccaatcaagttatctttcttgcttattcagattggcattctgttcttttgtggttcgctttatatcatggcattgggtttaccgcggatattaggtgcgattacgccaataggtggagctttgatgattgctggatggctaatcttggcttggaatgctttcaaatacgcaaaataa

SEQ ID NO: 301 - DNA, 1275 bp, Acinetobacter baumannii
acgatgagtaaaaaccgcaataaagctaaaggtcgtcaaaaagatgacctaaaaaagctgaaagtgcggggaactggaccaatacaagacagaacggggacgaccttaattgatcgtccccgttctgctgtaaggacggcaaagcccgttacttttgatagtgcaatgacgcttagtgcggtttttgcttgtgtcaagattcttgttgagtctgtagcgaccctgcctttacagatgtttaagttaaatgcagatggaagtagaacaatcgtaaaggatcatccagtaattcagcttttaagtaataagcctaatcgttatcaaactgctgtcgagtttcgagagcaatttatgttgaacctggttgctggaaatgcagtttgtaaacgtgactatataggtaaaaaattggtcagtttgcaggtcattaatagtggttcggttgatctaaaaattaaagataacggtgaccctgtttatgaatgccagatcaatggtaggaaagtagagctgactgaaaaacagatttggcatgtaaaaatgtttggtactggtttatgggggatgtctcctattgcctacggtgctgcttcaattggtgtgggtttatctgcaagtgataagactactcgtttaatgtcaaatggtgctaagcctactggtgcattaaaaactaaacgaattcttaaagatgctcaaagagatacgttaagaaaagaattggatattttagtgaatggcgatgatggtgatattgctgtcctagaagatgatatgcaatttgagcaaataagcttaacacctgctgatcttgagctaatcgaaattcgtaaattatcggttgaagatgcatgccgattctttggtgttcctccgattcttgtctatatgtctgatggatcgactacgtggggaagcggaattgaacagattatcgacggtttctataaatttggattgcgcccatatctggagcgtattgaagagagtattcgaatccatttattagaacggcatgaatgggatgaatacgaatttgagtttaagacaaaggacttgctcagagcttcatatttacaacgcattgcagctaataaagatcgaatcattagcggccaatcttcaattaatgaaattcgtcgagaagagggtgatttacctgatcctaatggtgatttcttacttgttccggtcaatatgactacggctgaacgtatgaaaaaaggcaattttaaggtgaatgaaaatgggaaaacaactgcaagcgcggaataa

SEQ ID NO: 302 - DNA, 225 bp, Acinetobacter baumannii
caccaatacaatatccttcatgagtatgctttgaaaattgtgtttggtgataatgtgcttttaataattctaaaccgcccaactctcgcaaatgcaagtagtcagcctgttcccggtgcatatatacatctcatctatttatctacaaaaaacatagcatgttttaaaaagatgcatagaacaaaattgctgttatggggaaatggatatcctattttctattga

SEQ ID NO: 303 - DNA, 414 bp, Acinetobacter baumannii
aacatgagcaataacaattatattgatgagcttttaaagctcttggcgatgttcgcttttatcggtgttttattactggcatttaaatgtcagaccatctttgcactagatatgacaacatcatacgaagtctcggtaaggattgttatctatattgtcacagcagctattttgggctttttaacacgtaatcatattgagtttacaacacaatttttaattgctgttccatttgcatacttttggctaaagccaattcttgactacaaggccattcaaactatcccagatgttccgttttatctctcaggtcatggtcaaagtttagggctactcatcgtgatcatattttgttttgccctatgggtatttaaagaaacaagctcaaactcgtttgagtctcaaaatgtctaa

SEQ ID NO: 304 - DNA, 786 bp, Acinetobacter baumannii
aggagcggcaaaatgaactttaaccaactgcaaattgccctctggactctagttcgtaaagaagtacgccgatttctacgcatttggccacaaaccttattaccacctgcaattaccatgagtttgtactttgtcattttcggtaatttggttggctcacgtattgggcaaatgggcggcgtaagttacatgcaatttattgtacctggcctcatcatgatggctgtcattaccaacagttatgccaatgtatcatcgagtttctttagtgtgaaatttcaaaaaagcattgaagagctgattatgagccctgtgcctctgcatattattttgtggggctatgttattggtggtatttgtcgaggtgtcttggttggtgcaatcgttaccgcgatgagtatgttttttactgacctttttatccataactggttcgtaactatatatacagtattaattacatccgttttattttctttaggcggtttcattaatgcagtctacgcaaaatcattcgatgatatttctattattccaacatttgtacttactccacttacctatttaggtggtgtgttttatgccattagtgcacttggtcctttttggcaaaaactttctttaattaatcctattgtttatatggtaaatgctttccgtttcggcattttaggtcatagtgacgtgaacgtttcgttctctttaatcattgtgacattgtgctgtgctgtactttacggaattgcttattatttacttgctcgtggttcaggaatgcgtgaatga

SEQ ID NO: 305 - DNA, 549 bp, Acinetobacter baumannii
tcagttttaaattttttggaggttcttatgtcaactatgggtcgtccaccaaaagggctacaagaaaaaattcttagcggcagccgtatccgaaccgatcgggatggagacgcgcaagaagctaatgcatcggttgctttaggaatgccgccttgtcctcgttgggtaaaagggggcgcaaaaaaacattgggatactttgggacctgtattagttcaagcgggtttgctgtcggttgtagacggtgatgtttttggtttgcattgtgacaacatggctgcttatgaaaaggcccttgaaaagcttgaagagatcaattcatgggtgactacaacgccaaatggttttgaagtccaggcagcttggttgcaggtgcgtaataaattacaagaacagattattaaaactgctgctgaatttggattaacgccaagagcgcggtcaagtgtcaaggttaataaacaacagcaattagatttgttgggtgctgatgctggtcagaaagaagaaaatgacccttatgcaaacttttcaattcgatctagttag

SEQ ID NO: 306 - DNA, 1788 bp, Acinetobacter baumannii
tatattataaaaatatattggggaaaaaacatgaatatacatgtagaaatagacacacattggtgtctagaacaactattacaagaaggccgtatcactgaacgagataagttacttgtacaaaccacaaataggcaaaaagatcagttgaaatggcatccattacagtggattgcgcattttaatttaaaagaccaacatcatgtacaagcacatttaagtttaaaccgtctctgccaatggtttgcagatcgggcgcaattacctttatttgtgattgatcctttaaaggcagatgtgagtgctttaactcaagtcatgtcgcaagagtttgcgatccgtaatcatattttagctgtagaagtccatgcggaccgaattgtgataggaacagaccagccttttcaaacagactggctaaataatttagagaagagtttagcacccaaaaaaattgaacgggtatttctcaaccccgagcaattacaacgttatttacgagaatattatcaagtcagccgagcagtaaactcagctcaaaaagatgcggctcataaccgtgataacaaaggtgtagaggcgcttttacaacttggtgatagccaaaaccctgatgccaatgatcagcatattgtgaaattggtcgactggatattgcaatttgcatttgaacagagcgccagtgacattcacatggaaccgcgtaaagacaatggcaaagttcggttccgtatcgatggtgttttacataccatttataacatgccttcaaatactctgaccgccgtgatttctcggattaaaattttagggcggctaaatgtagcagaaaagcgtaaaccgcaagatggtcgattaaaaacacgtacgccgaaaggccaagaaaccgaactacgtctatctaccttaccaacagcgtttggtgaaaaactggttatgcgtatttttgatccagatgtgttagtacgttcctttcagcaattgggttttgaccagtctttattacagcaatggcagcgtattacgcaaaatagtcacggcattattttggttacggggccaacaggttctggtaaaactacaacgttatattcttctttaaaacagcttgcaaccgagcaggtcaatgtctgtaccattgaagatccgattgaaatgctagagcctagttttaaccaaatgcaggtcaatcatgcaattgaactgggctttgcagatggtgtgcgtgcgcttatgcgacaagacccagacattattatgattggggaaattcgtgaccaagatactgcgaatatggccattcaggctgcactcacaggccacttagtattatcaactttacacaccaatgatgcgccgtctagtttgacccgtttacatgatttaggtgtacaaccatttttaacagccgcgactattttaggtgtattggcacagcgcttagtgcgtaagctttgcccaaactgcaaacaacaaactcatattaatgaagatgaatggcagcacctaacatttgactacattatggaaatgccagaaaaagtttatcgggcagtaggttgtgaagagtgccggcatacgggttataaaggtcgaatcggcatttatgagtttatgccagttagtcttgagcttaagcatcttattagcagtcatgcgacattaaatgaattaagaagccaaactaaaaaagaaagtgtagagcctttaagaattgcaggagctcgcaaagttattgaaggtttgaccaccttggaagaggtattgcgggttgttccattaaattaa

SEQ ID NO: 307 - DNA, 345 bp, Acinetobacter baumannii
tcgaaaataaaatgggagaaaaataaaatgtcatggcttatgattttaggactggcagctatcatattttttaatcgttattattttttggaaccaaacgtaaaagttaaattaccagtacttatgaataaaatgttgaattattcagctccttgtttattaagtgctatttgtattccagtaattttttttgaaaataatgaattaagaggatttttagataatccttacttatacgcaacgatattttgtactgtcgtggctttctattttaaaaaagtgttaccgagcgttctgctgagcctagcatttttttattttataaattttctaataaatcattaa

SEQ ID NO: 308 - DNA, 861 bp, Acinetobacter baumannii
acgcttgtaaattaccaaaagtttttagagatcatgaacagtacttatacagctccacgtcgattaatcaaaactccagatgaaattgaaaaaatgcgcattgcaggacgactggcggctgaagttctagatatgatcaagccgcatattaaagctggtgtaagcacactcgagcttgatacgatatgtcgtaatcatattgaaaatgtacagcacgctattccggcctgtgtaggttacggtggtgcgccaggacgccctgcttttcaacactctatctgtacttcggttaaccatgttgtatgtcatggtattccttctgaaaataaaatcttaaaaaacggcgatatccttaacatcgacgtgaccgtcattaaagatggttatcatggcgataccaacatgatgtatatcgtgggtggtgaaacctctattctggcaaatcgtttatgtaaagtagctcaagaagcgatgtatcgcggaatggcaacagttagagatggttcgtatttaggcgatattggacatgccatccaaaaatatgtcgaatcagaacgttttagcgtagtacgtgaatattgtggtcatggcattggtaccgttttccatgatgaacctcaagtgttgcactatggccaagctggtacaggcatgcgtttagaagctggtatgactttcactattgaaccaatggtcaatgctggtgtttggcaaactaaactgcttggtgacaaatggacagttgtaaccaaagaccataaactttcagctcaatatgaacatactattttagtcactaaaacagggattgaagtattaacagctcgcccagaagaagatctttcacgcttcaatcaataa

SEQ ID NO: 309 - DNA, 2163 bp, Acinetobacter baumannii
tctaatgtaaaaatttgcgaaataaaaattgatgaaaatagccatttgataaaccaggattcatttatgttggaacaattttccaaatcgccctctctcctttcggttactgattacgaagaacatatctggatgttgcaattacaacagcctgaacaagttaaccgacgttttaatctatggaaacttaatcaagatttagacattcaactgctcattaaagcaattcaagatatcattaaaactacacctgacttaaatgttcgctatacatttagtgacgaaggtgatttatacaaatatccatttgatgaccattcagcttgcctagaagtaaaaaagagtaatacagaacaagtttttgagcaggtagctaccttaaaagcacaagcatggaacgcagaatttcatccccctttttttacaagtctcatagaaacagagcaagactattttcttattttagcgctccacccgattcttgatgaaaactatcaaaagtcagatttcattcaggccatacaaaatcgttatcaacaaaactcaccaaataatatgccattggtgctgactgaaattgatatctcaaatcatctagctgcaaattcctccaaagcgccagaacaacctaatcaaacttatgtttcagaaattattttagaagagtttcgaaatacgctcgctgaaccagaaatgagtcagcatgatgacttttttgattttggcggccattcactattagcaacgcgaattattggaaacctacttaataaacatggaattgagattcaatttaatgatttctttaaatctccatctgctgccgatttagctcaatacgctttcgttaaatctgcaaaaactgaaaaaactaccttacaaagtgtagataaagccccgcttactttagctcaagatttcctgtggcaagcttattctgcattcgattttagcccaatttataacttaccatttgccgtagaattccttgaagaaattaatgaagatgttttctttcaggcgtttacagatattgtggagcgccatgcaggtttacgtacaatttttaatagcgccaatggtcaaacctatcaacaggtggttcctacgtatgaacttaaacaattcaaatggttttggaacagtgccgaaagtcacgatgcaacgcttgcaagtgaagcttcatataaattcgatttaactcgcgaacttcccttaagaattcgtttaattcggaatgctaaaggtcgccaaactctatcatttttagttcatcacatggtgattgatgaatggtctttaaatacgattatggctgaccttgcacatgcttatcttgctcgctcaaatgctcaagctccaaactggaaggcacctgcccaatccattcttgatttttctttactccagcaaaagcaagggatcaaccaagaccatttaaattattggactaacctgttaagaggagcaaccaaaggactaaaccttcctgtttcggaacatgaattaaatgctgaaaaggaaaaacctccagtccaatggctcgaacttaaatttgcaccagaaatgcatgaaaagcttctcgcattttcgagacaacacagctcttctattttcacggttctctatactgctatcgcccatgcattacagcaacaaggtaatttaaaagatattgtgattggtacttctgcctctggacgaactgatcctgagttttttgatacggtgggttactttacgaccatggtggcgcatcgcacacagtttagcccttcagattcattccaatcgttgctccacaatatcagcacaatgattaatacctcgatggcctatgcagatattccaatcaaccatattcaaaatgcattagggatgagcgcagatgaaggactgttatttgatgtgtttattcatatccattcaaataatgctttaaacggcgcgctcaaaacacctcagggacaagaccttccttatcgtcagattttgccggaacgtgatgaatcgatgttcgggttacattttgaaattatggaaaatgtgattgatggacagcatcagttaagcatgattattacgtatcaagcccaccgcttcccgactgcaacagtgcaaagtatctgtgaaaaaattaaggcaaccttagctcaaatctag

SEQ ID NO: 310 - DNA, 294 bp, Acinetobacter baumannii
ataggagtaaagactgtgtctgttgattttaatcaagctatagaaattgctaaagaaaatgcaagaatcctactacctaaagcttcaagttttgatttagaagggattattttaaacaataatgagtatgaagttactttgagttatatgattgattattcagataaaattaaagatggtagtcaagatagtggagttggtttcataatggcagctttggctagaaaaagagaagaaaaagtttttatcgttagcatcaatggaaaatttaaaggtttccggaattctaaataa

SEQ ID NO: 311 - DNA, 450 bp, Acinetobacter baumannii
aggactcaaaaaatgaaaaatcctatggaaatgacaggcctcgaatttttacaagccatgattgaaggtcatattccacctgccagtattagcaaaactattccgatgcaacctactgagatttcagaaggatctgtaactttcaaagcacaagcagatcataatcacctaaatcctttaggtggtgtacatggtggttttgctgcaactgttctagattcagtgactggctgtgctgtacatacaatgctacctgctggtgtgggttatggaaccatagatcttaatgtgaaaatgtgccgccctcttccacaaaatcaggttttaattgccacaggtaaagtgatcaatttaagtaaaaatttaggtatttccgaaggaaaaatgactgatgaagaaggcaaactttatgcttatgcaacagcaacctgcatgattattcgaccataa

SEQ ID NO: 312 - DNA, 1779 bp, Acinetobacter baumannii
gtgaaccaaaaccaacaagcaggacagccacaagcaactttcatcccatcggacttcaatgacctgcatttgatgtttgggttggaagaggtaaaggctcagatcgtccaggctattaatacgtctattccttttccccccgaaccccctaaaaccaacaagcccatccatagtgagggagaaattgagaaaaattctcatgttccaatggttgaggaaaatcttgtggctggtgaatcggggcaagggggcgacatttcgatagaaaatgatgctgtacctgaatctattcaaaaattcattgatcgttattacttaattgaagcaaaaacagatgtttgggataactttgacaaagtcgtaataaagaaaaatgcttttactgctttgttaggtcaaaagcagtacaagctatggttagaccataaaaaagttattccaaaatctgagtttgaacacaatgttaatgtggctactaatttaactattcaggaattattagataatttcgttgtcctggcaaactcagaggaagcttggaatttagttgagcgtaggacttggcttattaagcatatacgaattgcgtaccctaatatttttgacttgtggtttaagtctccagctagaaaaatcattcctcgtcaaaaccttatttttgacccgaagcaagaacatgatcatgatgagaattacataaatatttatcgtggattgaacattgatgtaatgcgtgatcagcatggtgaacaattgactcgtgcagaagtctatgaagattgtaagggcatcatgaccttgattaatgatctttgcgatggagagaaggaagcagttctttttttattgaaatggctagcgtttcctcttcaaaacattggcgcgaaaatggctacatgtgtgctgatgcatggtcatattcatggatctggtaaatctttaatgttcgtttcaatcatgaaaaagatttatggtgaataccatacaacagttgggcaagctcaacttgataaccaatataacgaatggattgaaaacaaacttttcggtgtgtttgaagagattgtagataacaagaaaaaacataacgttatggggatgattaaacatctcattactggtgaaacgctctatgtaagtaagaaattcgtatcaggatgggaaatgaataaccacctgaatactgtatttttatcaaacaatactcaaccactaccaatcgaagaaaaggaccgtcggttcttagtgcttaacccttgtaaagacttggatggacctttgcacgaaagggttatgcaagagttaaagactaacggtgtacaagctttttacacttatttgatggggcttgatttaactgattttcatgaacacgtaaagccgccaatgaccatagctaaaaggacgatgattgattattcgcgtgcaggctttgacacgttttatcatgaatggaaaaacggtgacactaaatacccttacatctcttgtaaatcagagcagctttataaagcgtttggtcaatggtccagaacaactggagagcatcaaatcagcatgaaaagattcattattgagggtaagaagcatggcattgttccaagtgataaggccaagcattggaaaggtaagcgaagttctggacaaaataaagtcattatcattggtgaaaaacccaaagatgaacaagagcagcttaggctggggttgcaaatcgaacaatttcaagatagcttagacggggtgaatgatgttcctgaagcaaaatacgtacaataa

SEQ ID NO: 313 - DNA, 939 bp, Acinetobacter baumannii
ggtggacaaaaaacaacttcgcagcattttaaatacatctacaacatcttaataaatattgagcagcatatggctatttcaaaaatttctacttatctcatgcccaaacgagagagttatccaaataataaaacagactggcaattagatccttctcgagcagttttattaattcatgatatgcagcgctactttttaaatttttacgatgctgaaagtgaattaattaaaacggttgttaatcatttagttcaactaagaagttgggcacatcagaacaatgttccagttgtctataccgcacagccttatgaacaaccagcggaagatcgcgcattactgaatgcgatgtggggaccgggtttgccagcctcaacaattgatcagcaaaaaattattgatcaactttctcctgctgaacatgacattgtcttaacgaaatggcgttatagcgcgtttaaacgttcggatttgcttgaaagaatgcaaaactggaatcgtgatcagctcattattggcggtgtctatgcccatatcggttgtatggttacggcaattgaagcctttatgagtgacatacaaccctttttggttggggatgcagttgccgatttttcagaagaagaacatcgcttagctttgaaatatgtatcttcacgttgcggtcaagttgtggataccgaatctgtagtggggcaggtggcaacaggcattacacgaccttggctagagcaaaaggtccagcagcttattgaagaagatgaattagatccagaagaaaacctgattctttatggattggactcattacgaattatgcagttttcttcggaactcaaagcgcagggaatcaatattagttttgaagaattaggacgcacacccaccttatcaaattggtggtcattggttgatgcacggcaaaggattgcagggtag

SEQ ID NO: 314 - DNA, 768 bp, Acinetobacter baumannii
cattacaaaaaaggtagcataggccacatgcaacaaaaacaccccggtagaacactcgtcttatggattatcgcagctcatctatttatgggaatggttgcatacgagtggctgcctgtgagttttagaggaagttggatttttattcttcttcttttaatttcaggtgcttttttagaagtcggtttgtctttaattgtaggtttagtcgcttttattggagttgccgtatactttttactcgacttaggcgcacaaacacatattgaacgtcagttacttttactattcattattcccctaatacctctctttctaagtgctgtacgccacaatattgaaattaatgtacagaaataccgtgatattcaaagctatgaccgaaattatcgccgcgatattttcccgctcagtgctttaaaatactttcagcgtagtttttttaaattacttgatcaccacaatgtacaagattatgaagtattcgaaattcgaattcttaatcgcagtctgattaaagaaatgttaggcgatgatgtctggaaaacaactcaaaatgaaatgattaaaattttgagccagcatgaacccaacgagattgttttccagtttgcagatgatgatctggaaaatatttacagtattatgattcgccagcagaaaacagaagaagaccctgtattcttaaaaaaattaaaagaaattacgactttgcgtcttgaggtggaatacaaaattgttcctcttccacctgaggagatgagctaa

SEQ ID NO: 315 - DNA, 384 bp, Acinetobacter baumannii
aattgtgaaaaaatgaaaactttcgctcctttttttcaagtattggggatcagtatcacattgtgtactcaagcggtttttgctgatgagggtatctcaacacaagaagctgacagcttaattaaagatgacattgcctcgactcaagtcttacaagaaatttgccctacttttgttggtgcaaataaaaaacttgaaaccaatactcaaaagattattgccatgtacctgagtggttattccaataaatcaatcaccttctctgcactgcaaaatgattcagaatataaaaccctgttaagtgaagcacgtcaggctgccaaagaaatggatcaccacgaacaacatgaactttgtgaggaagtggtaaattacaaagattaa

SEQ ID NO: 316 - DNA, 2193 bp, Acinetobacter baumannii
tttatggaaaataaaaaacgaatgaccacacaaacctctggttgggtctcggcgtttaaagcatttttagaccgtcgtgcattaattatgctatttctgggtttttctgccggaatacccattttattgattttctctagtctctctttatggctaggtgaagcaggcattgataaaagtgccgtcacttttttcagttgggcggctttaggatattcctttaaatttgtttgggctcccttaattgatgagttacctgtaccagtcttaactaaagctttaggccgaagacgtgcatggttgcttattgcgcagtgtttaatcgtacttgcgatatgtacaatggcttttgccgaccctgctttaggtcacagttatcttgttcaaatggcggcaggcgcagttttacttggcttctcggctgcaacgcaagatattgtgattgatgcttatcgtattgagctggctgaaactgaaatgcagacagtgttggcatcaacttataatgcgggttaccggattggtatgattgtagctggtgctggtgcattattcttagcggcgcatttggggaccgcaaaaggaaattatatttacgaggcttggaagacgacctatttaacgatggcagcagtcatgttggtcggtattattacaactttactcgttcgtgaacctaaagttgatcgtatatataaaaactataaatcaagtgattattaccgtctggttttagtattttttattgcagttatctcatttgtattaacctatatttactcaggtcaagttaccgaagcaatttcaaaagctggcaatattcaagatagtgctgctttatttggtttagaagctttaaggttcttaacggcgacaggtgttgccattctagttggttatctattggttaaaataggtgtggtgaaccagcaaatggctaaggaaacttggattgccccaattctggatttctttaaacgttatggtgtcaaacttgccttagtacttctattcttgattgggttcttccgtatttcagacattattgctggtgtgatttctaatgtcttttatcaagatctgaactttagcaaagaacaaattgctgaagccgtaaaagtttatggtgttattttcagtttggtgggtggtttcttaggtggcttattagctcaacgtatgaacatcatgaaactgatgttcgttggtgctgtattggcaagctctactaatctcattttcattggcttagtaaaatctggaaaaccgcttgatatggtggatgtccaaattgggaatcaccattataaagtgaagccagatgaagtggggtattggaagctcaaagtgccaagctcaagttttaatagcacccaacaaattgatgtaaaagccggctatgctttgcaagatcaacaagccgagactatcgttcgggctcaacctctagtgacaactcattctgagagtgttcctttacaaattttacctttaatgggaagtgatcagatatcggctaaatcttccgaaggtagtgtcgtggttcgtggtcagtattttggcaaagccttatcacctactcaaaagattgtggtgaatcttgatggacaaaattttgatgcaaaaatgacagatcaaaagggcgtgtttaacgcagcaattgatatgcaaaaattattgtcatcaccaagtcagcaacttactgcttcaattgtcgatggaaatcaaaaaatattatcgattgctcaccattatgaagtcgcttcaaattctgtaccaaaacctgaattagatgtgaatattgaccctttaccgtacattgatactcaatcaggtcaagaagttgagattagtggtaaagtcattaaaccttatagctcgctatggctttattttgccattgtcgttgataacatggcttcaggcttagccggtgcggcatttattgcgttcctttcaagtttgaccagtgtgtcatttactgctgttcaatatgcgatctttagctcacttatgacccttaccccaaaacttttaggtggatattcgggtaccatagtgagtaatattggatacccaaacttctttttgatgaccacaatgatcgggattccaatcttaattttagttgtttgggttggaaaactgcttaaagatcatcaaacacatgacatagaaaaggcaggtgaataa

SEQ ID NO: 317 - DNA, 309 bp, Acinetobacter baumannii
attggcagaaaaaagatggagggaataatgcctgaatttatcgtaacgattgaagcagattcagcccctcaaattgttctcggtcaaatgcttttaggcggtacagttaccgccctaaagctagaaaaacgtaaacttgtatcagtggcagagcttgttgctaaatatggcctttcagatgaaaccatacgcactaaatgcatttcaattaaccaaggcactaacggcaaacacatgtatgatcccgacgcggccgatgcaattctaaaaaatcaaaaggtccgacgtggaccaaaaagaaaaaactaa

SEQ ID NO: 318 - DNA, 975 bp, Acinetobacter baumannii
atacatatgaactggaagaaaaagtatgggggagtcgccctcatcatagcggcagctgtcactctacaagcatgtgatcaaaaagttgcagataccactcaagcttctcagaagctagcagaaccgattacggtaaaacatgcgcttggaactacggtgatagatcatctaccgcaacgcgttgccgtacttgatatgaatgaagccgactttctagatcaactcaatgtcccgattatgggaatgccaaaagattatgttccacactttttggaaaaatataaaaaagatgcacaaattcaggatttgggtgcaattgtacagcccaatatggaaaggatatatgcattaaaaccagacctgattttgatgacgccattacacgttaatcagtatcaggaactgtcaaaaattgccccgaccattcattacgatattaacttcaacaatagcgagagtaatcatattggtctggttaaagaccatatgatgaccttaggaaaaatatttaataaagaagatttagcccgccagaaagtttctgaacttgatgaacaagtgaagcaagtacaagccgtaacggccaatcgcccagaaagagcattagtcgttcttcataacaatggggcatttagtaattttggtattcagtcacgctatggctttatttttaatgcctttggggtaaagcctgcaagtggtgtggtggatacaagtctacatgggcaacctatttcgagtgaattcatcaaaaaagcggatcccgatattctttatatcgtggaccgaactgctgtgatggaacatcgctcaaacattaatgctgccagtgttgaaaatccattattacgtcaaaccaaagcatggaaaaacggtcgtgtcatttttgtcgatgccgatgcgtggtacaccacggctgcaagcccaacctcactcaaaatagtgatggaagatgtgaaaaaaggctatcaataa

SEQ ID NO: 319 - DNA, 3186 bp, Acinetobacter baumannii
tcacatatgaatatttctaaattttttattgatcggccgatctttgctggtgtgctatcagtcttgattttactcgccggtctcctttcggtatttcagttaccgatttctgaatatcccgaggttgttccaccatctgtggtggtacgtgcccaatatccgggtgcaaacccaaaagtgattgctgaaacggttgcttctccgctcgaagagtcaatcaacggcgtcgaagacatgctatatatgcaatctcaagcaaacagcgacggtaacctaaccattacggtgaactttaagctcggtatcgatccagacaaagcccaacaattggttcaaaaccgtgtatctcaggccatgccccgtttacctgaagatgtacagcgcttaggtgtaaccacactaaaaagctcacctactttaactatggtagtgcatctgacctcaccagataatcgctatgacatgacctacttacgtaactatgcggtgctcaacgtaaaagaccgtttggcacgtttacaaggtgtaggtgaagtcggtttatttggttctggtgactacgcgatgcgcgtatggctcgacccgcaaaaagtagcgcagcgtaacctcaccgcgaccgaaattgtgaatgcaatccgtgaacaaaatattcaggttgcagcgggtacaatcggtgcatcaccaagtaattcacctttacagctttcggtcaatgctcaaggtcgtttaaccactgaacaagaatttgcagatattattttaaaaactgcaccagatggcgcggttacccgattgggtgatgttgctcgtgttgaacttgcagcctctcaatatggcttacgttcattacttgataataaacaagcggtcgcaattccaattttccaagctccgggtgcgaatgctttacaagtttccgatcaagtgcgtagcacaatgaaggagctttcaaaagatttcccatcttcaattaaatacgacattgtttacgacccgactcaattcgtacgggccagtattaaagcggtcgttcataccttacttgaagcaattgcactggttgttgtggttgttattttattcttgcaaacatggcgtgcctcaatcattccattgcttgccgtaccggtttcaattattggtacattcgcgctcatgctcgcttttggttactcaatcaatgcgctatcactgttcgggatggtacttgccatcggtattgtcgtcgatgacgcgattgtggtcgtcgaaaatgtcgagaggaatattgaagcaggcttaaacccaagggaggcgacttaccgtgccatgcgagaagtcagtggaccgattattgccattgctttaacacttgttgcagtatttgtacctcttgcctttatgacaggcttaacagggcaattctataaacaatttgccatgaccattgccatttcaacggttatttcggcatttaactcgcttaccctatctccagctttggcagcgctgttactgaaaggacacaatgctaaacctgatgccttaacacgtattatgaatcgtgtattcggacgtttctttgcactgtttaaccgtgtgttttcacgtgcttcagatcgttatagtcaaggtgtcagccgtgtcatttcccataaagcttctgcaatgggtgtctatgcagcactcctaggtttaaccgttggtatttcctatattgttccgggcggtttcgttcctgcgcaggacaaacaatatttgattagctttgcgcagctaccaaacggcgcatcattagatcgtaccgaagcagtcattcgtaaaatgagtgataccgcactaaaacaacctggtgtagaaagtgcagttgcctttcctggcctatcaattaacggtttcaccaatagttcgagtgccggtattgtctttgtgaccttaaagccattcgatgaacgtaaggctaaagacttatctgcaaatgctattgcaggtgcgctcaaccagaaatattcagctattcaagatgcctatatcgcggttttcccaccaccaccagtgatgggcttaggtactatgggcggctttaaactgcaacttgaagaccgaggtgccttaggctattcagccttgaacgatgctgctcaaaactttatgaaagcagcacaatcagcccctgaactgggtccaatgttctcaagttatcaaattaacgtacctcaactcaacgtagatctggaccgtgtaaaagctaaacagcaaggtgttgctgtgacagatgttttcaacactatgcagatttatttaggttctcagtacgttaacgactttaaccgctttggacgtgtttatcaggttcgtgcacaagccgatgcgcctttccgtgctaaccctgaagatattttgcagcttaaaacccgtaatagtgccggacaaatggtgccattatcttctttggtgaatgtaactcaaacctatggtcctgaaatggtcgttcgttataacggttacacatcagcagatattaacggcggccctgccccaggttattcatctagccaagcagaagctgcggttgaacgtattgctgcacaaactctaccgcgtggtatcaagtttgaatggacagatttaacttaccaaaaaatcttggctggtaatgcaggactttgggtattcccaattagcgtattactcgtgttcttggttttagctgcacagtatgaaagcttaaccctaccattagcagttatcttaattgtaccgatgggaatcttagcggctctgacaggtgtctggttgacagctggagataacaacatctttactcaaatcggtctaatggtactggtcgggctagcctgtaaaaatgccatcttaattgtcgaatttgcgagggaacttgaaatgcaaggcgcgactgcctttaaagcagccgttgaagcaagtcgtctacgtttacgcccaattttaatgacctctattgcatttattatgggtgtagtgccactggttacttcaactggcgcgggttctgaaatgcgacatgcgatgggtgttgccgtattcttcggcatgatcggtgtaacattctttggtttattcctgactcctgccttttatgtgctgattcgtaccttgaacagtaaacataaattacattcagcagccgttcatgaagcacctttatctaccccacacgatcattaa

SEQ ID NO: 320 - DNA, 1635 bp, Acinetobacter baumannii
aatgtcatgaaaaaacagttgattgagtttgttcgctggtctcccgagagagcgcaacactatcgaaataaaggttattggattgaccaacctttgacgcgcattttaacggtaggggttcaatcgcatccgcattcgccggcaattatttgtggtgaacgtcagttgagttatatcgagctggatcggctatcaacaaatttagcttctcgactagctgaaaaaggcttgggcaagggcgatactgctttagtacaacttcccaatgttgcggagttttatattgtcttttttgccttgcttaaagcaggcgtggttgtgctcaatgcgctatatagccatcgccaatatgaactaaatgccttcattaaacagattcaacctaagcttttaattggttcgcgtcagcatgaagtctttagcaataatcaatttattgactcacttcatgaagtaaatttaagtcctgaaattattttgatgctcaatcatcaagctaccgatttcggactattagactggattgaaacaccagcagagaccttagtcgatttttcatctacacctgctgatgaagttgctttctttcagctatcaggtggaagtacgggaacaccaaaacttattccacgcacgcataatgactatgactatagcgtgcgagccagtgccgagatttgcgatttaaactcaaatacccggttattgtgcgctctgccagctccgcataactttatgttgagttcacctggtgcattaggtgttttacatgcaggtggatgtgttgttatggcaccaaatcctgaaccgctcaattgcttctctattattcaaagacatcaagtcaatatggcatctttagtgccgagtgctgtcattatgtggctagaaaaagccgcgcaatataaagatcaaatccagtctttagagttgcttcaagtggggggagcaagtttccctgaatctttagcccgtcaagttcctgaaatcctcaattgtaaattacaacaagtatttggaatggccgaaggcttggtcaattacaccagactcgatgactccgacgagcaaatctttacgacccaagggcgtcctatcagttctgatgatgaaatcaaaattgtggatgaacagtataaagaggttccagaaggtgaaataggaatgcttgcgactcgtggtccttataccttctgtggttattaccaaagccctgaacataattcacaggtctttgatgaggacaactattactattcaggcgatctcgtgcagcgtacttcggatggtaatttacgtgtagtaggaagaattaaagaccagattaaccgtggtggtgaaaagattgcttcggaagaaatagaaaaacttattcttctacatccggaagttatgcacgcagctttggtcgcaattgttgatgaacaatttggtgaaaagagttgtgcctttattgtttctcgaaatcctgaacttaaagctgttgtgctcagacgccatctcatggagttaggcattgcacaatacaaacttccagaccagatcaaattaatcgaaagtttgccactgaccgcagtcggtaaggtggacaaaaaacaacttcgcagcattttaaatacatctacaacatcttaa

SEQ ID NO: 321 - DNA, 1020 bp, Acinetobacter baumannii
attgccatgaatactaaacgtaatatctataaagatgctgaacatccctttgctcaatatgtccgtattttaggtaaggggaaaaccggatctcgctcactaagttatgaagaagcctatcaggcttttactatgattttaaaaggcgaagttcttgacgttcagttgggtgcttttttaatgctgctacgtgttaaagaagaatcgattgatgaacttgcaggttttgtacaagccaccaaagaccagcttcattttgcacctttagaagttgacttagattggtcatcttatgctggtaaacgtaaacattatccttggtttttattagcggctcttacccttgctcatcacggttataaaatcgtaatgcatggcgcttccggacataccattaaccgagtttataccgaacaagttttggaatatttagattataaaatttgccattctgaacaagaagttcgcacccaattggcagaacaaaatttcgcttacttaccgctagatgtgatttcaccggttttaagcgaattaatatctctaagaaatgtcatgggattgcgttcacctattcatactttagcccgtttaattaatccttttaaggctaaagccaccttacaagccatattccatcctgcttacagaacttcacatcagcatagtgcacttcgcttaggctatcaaaatagcgcagttattaagggcgaaggcggcgaattcgaacgaaacccagacgcgaaaacgctgatttgcggaattaaaaatggtgaactctatgagcatgagttgccaaagcttacgcctgaacgcagcccaattgaagaagagttagacttagcaacctttaaagctgtctggcttggtcaacagcatcacgaatatggggaaatggccgtaacagaaaccatgggtattgcgttatataccatgggcgtagtttctaatttcgaggaagcgatgcaaaaagcaaaagtattatgggaaacacgaaatttaagcaatcttaattcgtag

SEQ ID NO: 322 - DNA, 594 bp, Acinetobacter baumannii
ttgaacatgaacaccattgatatcattattctgatacttttgctcattggggggctaaacggtttgcgacaaggatttataaaagcctttgcgaacttggtaggatggatttttgcattaattatgggtgcaaaatatgctgttcttctagctccgtcaatgtcaggtttaagtcaggatccggtggttcaaaagatcgcggctttcgcttttattgcacttttaattatcgttttaacttggatcgtcactgcatttttaaatggcctcttgaaaagtttgaagttggggccattaaatcgtttagcaggtggtgcttttggttcgttgaaaggtttattggttgttcttattaccatgcagggtgttggtccttgggtagaaagttcgcctcattggaaacaatccaaatttatccagtttttattgccttatgcacctttagcgacagagctttctaaagatgcagcaagtgaggcatttcatcagataacatctgggggcggtgtaacgcgcacttctccaaaaccaatggacgagtcggaggaaacagagcttcgacctgaccattcaacaaagaatcctttttattaa

SEQ ID NO: 323 - DNA, 465 bp, Acinetobacter baumannii
aaaaaaatgaataacattgatttagctattgaggactttgttaataaaacactcaatcttgaaggtttaacacttaagggatttgagaaattagcaatctcaaatggtttttatttcaagcagcaaggcggtgatgaaaatcacgggacttatgcaatttttaaaacttacaacgctcattctgcagcgattaccaaatgtcattgcggtcatattcaccgattagaagacatgtgcattaaatgccatccagtaaatgagaacttaaaaaccctcaatattaaatttccaacgacgtgttcgctatgcgagttttcggaatacatggaaatacaagttgaggctcaaaacacaggctatttatggtcaggcaaagttaaatgcccgaactgctctaatactggtgatttgctttattcagatggcaatgcattcatcaactgggcaatcgatttacctttttaa

SEQ ID NO: 324 - DNA, 1749 bp, Acinetobacter baumannii
gtgatgatgaataatgcactttcggacatttttcacaatcaaaccgcacttactcgtgaacggttaagcttttgtgaagccaacattaaagatcttaatgagtgggtcactaccctttctattatgcaattgggtgatacttcaaaagcgctatttacagcaattttggagctgaatgagttaaattgcagtgaaaccttacgctttgacttaattcagacacttcaccccaccattaataatgtgttggcaagtttagaaaaaaacttctttaaccaaggcgtcattagtactgaccgtaacgagcacattattgaactggccatgcttctgcgctgttattttgccagtatttatttaaatattgcgcaaacaagccacgaacagctacaaaagcagaagttttctttgttctcttttaaacaaaagaaaaatttacaaaccgcacgaattctggcgacattccacgcattgcagcagttgaccaatcttttatatcaacagcatatgctttatagcgaacctgtcaaaggtcaatggttaattgcccaccagctttatgaaacagcggttcaatacaaatatcatttaaccaatattaatcatattcaaggtgtacagcacccgttagccaatattacgcaggcttatgcacagcttattttattagatatttttaacaccaatcagattcgccagtcagaaattcaagccctgtttcaatgtagttttgattgggcacgcatgattcagatcttgccgaaagacactgcctcaacaaagtatgtggtggacccaactaaagatcatccgcctgtatataacaaaaaacaaagctcgaatttcaacccaagtatttttattagcacgcaagctttgcttgagcatgtcactgccaccatgcataaaaatgctcaatatatgtctaaaaatgaaaagatttatttaagtcccacattaaagtttcacgttcaaacgattttgggaaccacagcacagcgccgtcatgagcgttatgaatataatgcagctttacaaatttgttttggcttaagtaccgcacatttctatttgtctaaagccaaaaactttgaagaaacgctacaactgagtaataactataatttacaaagtgaatcgaaagtcttatccaatttagagaaaaaagaacaacaaacctcgtcttatcaacgcttaagccgtgagagtaaaaccatttatcaaactaccgtacttgatattagtgttaatggctatcgtattaaatggtccggcgaagcacctaaaaacttaagaactggcgaatatattttggtgaaagaaacgctacatggtcagtggcgtggcggtgtaattcgctggattaaacaatctacagaaaaaagtctggaactgggtttagaaattctttcacaagccatgttcccttgcgctgtacatattcaggcagagcgtcatacacgtaattatcaccctgcattattactacaaactcaaaacttagaagaaatacaaaacacgcttattttaccggggtctcaaatttttagagagcaacaaacaattcatttacgattggggacagaagaaatcaaagtgtatctactcaaagcacaactcattactcaaagttttattcaatttcaatttgagcttctgaatgagcagcaacagtacctgcttgatcagttcatgctgaaaaagaataacaccgtgaatagccaagatttatgggaagcattaaagtga

SEQ ID NO: 325 - DNA, 846 bp, Acinetobacter baumannii
gtaagttcgaaatactcaagtttttatcaccttatttgtgttttaaggagaagcttcaagatggcaagctttatgaaaaaaatattcgtttcaacaaccttagttctggctgctgttgcgacgaatgtacaagcaaaggattggaaggtgattcgttttggtactgagtcgtcttatgcgccgtttgaatataaaacaccggatggcaagttaactggttttgatgttgatttgggtaatgctatttgtgcaaaactcaaagctaaatgtgtttgggttgaaaactcttttgacgggatgattcccgcgcttaaagcgaaaaaatttgatggcattctttcatcaatgactgttactgatgaacgtgcaaaacaaattttatttagtagcaaaatctacaacacaccaacgcgtatggttgcaaaaaaaggttcaccgttattaccaacacctacttcattaaaaggtaagcgtgtcggtgtacagcagggcacaattcaagaaacttacgctaaaacctattgggctccaaaaggtgtaagtgttgtcccttatccaactcaagacttgatttaccaagacatgatgtctggtcgtttggatgcaactttacaagatgcaatcatggttgatggcgctttcttaaaacaaccgaagggtaaaaacttctcttttgccggcggcaatgtggttgatgtcaaaacattgggtgtaggtgcggctatcggtttacgtaaagaagatgcagacttgaaagcgaatattgacaaggcactcgctgcaatcattgcggatggtacatacaagaaactcgagaaaaaatacttctcttttagcatttactaa

SEQ ID NO: 326 - DNA, 201 bp, Acinetobacter baumannii
cacgatcagaaagacgtacgtccacggcaatattcctcttatgggattaaaaataaaaagcacactatcttatcgcaaaaattaagcaatttgcggatgtggggatttttagatgtaaaaaagtttaatttaggaaagatcttgttgcggttttattcaattgaagcttttttcgaaagaaacaagaaaaatcctttataa

SEQ ID NO: 327 - DNA, 189 bp, Acinetobacter baumannii
aaatattttgatagggtggttaggaagtttttgatgcaattaaagtttttaaaaaaatactttttatatgattttcttattcatgcttttttaaagccgaaaatgacaattcttgctggtcaattgaagcgagattttattttaagtaccgctttttctatgaaaataaagagagataagcatgtctga

SEQ ID NO: 328 - DNA, 183 bp, Acinetobacter baumannii
gcagactttgagcaaactctttttcatttcccaaaaagtaaaacggtacatggttcaaccacataccgtctttgtttagccaaatatcaaggtcaacttaacaagggcacttcttcaaagtaccacctgcagatgggtatcttgcatcaacacaatgtcgatagaaagtttgtgcatccatag

SEQ ID NO: 329 - DNA, 204 bp, Acinetobacter baumannii
gttgaccttgatatttggctaaacaaagacggtatgtggttgaaccatgtaccgttttactttttgggaaatgaaaaagagtttgctcaaagtctgctcatttgtatttttttcactggtaaatcacttgttttgcttttgaaaaatgaatatgatgctttccatcttaggcgtatagctcagttggttagagcgctacgttga

SEQ ID NO: 330 - DNA, 2856 bp, Acinetobacter baumannii
tgcgaacttgagaaaaaggtggaaaaattgcagcagtatgctattggtcaacgttggctatcagatacagagactgagctcggtttaggcgttcttattgatgtagatgaaagatctgtcagcattttattccccaagagcgatgaaacgcgtgtttatgcgcgcaacaatgcaccgctttctcgtatcatctttaatgtaaatgatgaagttcaagaccaagaaggcaataagtggaatgtcgagtctattgaagaccgtcatggtgttttgcgttataacgtggttcgtactttagaaaatggcgagcaagaacgtaaagcgctaaacgaaacgcgtattggtgcacaaattcaattatcaaaacctttagatcgtttgctggcaagccagattgattataaagagtggtatgacctacgcattgaagcaatgctgatgcaggcgcaaatgcaaaccagcccattacgcggcttggttggggcgcgtgtgggtttaattccgcatcagctctatattgcacatgaagtcggtaaacgtttcgcaccgcgtgttttacttgccgatgaagtaggtttaggtaaaacaattgaagctggtttaattatccaccaacagcttaaaaccggccgttctgaacgtatcctgattttagtccctgattctcttcagtatcagtggatgattgaaatgcgtcgccgtttcaatttgcaattttctctgtttgatttaacccgtactgcatctatcaaagaacatgatccagaacttaacccgttcttaactgagcaatgcattattgccagcgtcgacttgatggtggaccatgacgatttgcgtgagcaagcattagaagctggtttcgatttactcgtcgtcgacgaagcacatcacttgatgtggagcgaagaagagggcggtaacgatcgttacgacttggttgaagagcttgctgaaaatacggcaggtgtattgttgcttactgcaacgcctgaacagctgggtgtggaaagtcactttgcgcgtttacgtttgttagatccacagcgctttagcagtttagagcgtttcttggatgaagaagcccaatatcagcaaactgcgcaaattgcagaagtgcttatgtcggatgagcctttaactcaagagcatttatctgctttagaaggtttgttaggtcattcaattgaagaccaacctgagcaacgtttcagagcgattcatgagttgttagaccgtcacggtacaggtcgtattttattccgtaatacgcgtgaagcgattcaaggcttccctggccgtgattgccaacctgcgcctttacctgcgccagcagattggtcaaaagacggtaaattacgtgagcaaatgtggccagaagaagcacaaattgatggctcatggatgcaaaatgatccacgtgtaccgtggttaatggaaattctacgtaaagaacttaagcataaaaaagttcttttaattgcccgtagtggtcctgttgtcgagtctttagaaagtgcgcttcgtttgcatgcagggattcgtacagccatgttccatgaaggtatgagtttgcttgagcgtgaccaagcggctgcttactttgcagaagaaagctacggtgctcaaatcttactttgttcagaaattggttcagaaggccgtaacttccagtttgcgagtgatttaattttatttgatttgcctgcaaaccctgacgttttagaacaacgtattggtcgtttagaccgtattggtcaagaaaaccgtatccagattcatgtaccttacttaatgggcaccgctcaagagcgtatgttccgttggtataatgaagcattaaatattttcagcaatatttctccaacagctcaaactctacaagaaaactttattgttgaattaaaagattgcttgcttgccgaccaaggtcaaacatttgaagatttactcgaagaagttaatgttcaacgccaagctttagaagcagagttacaagctggtcgagatcgtctgcttgagtacaactcatgtcgtcctatcgttgcacaagaaattgttcaagcgttagaagactatgatgacaacacaacgctgcctatgtttgtgaagcgtttcatgtcttcaactaatattgactttgatgagcaaagtaacggtacagtcattattcgtccaaccgaccagatgcaagtgcaaggtttggcattagacgaagaaggtatgactgcgactttctatcgtgaccaagcgcaaatgcgtgaagacgctcagtatctaactttggaacatccgtttattgaaagtgtcatggaaatgatccgcacacaatcatttggtagtaccaatgttgctgtgcttaagtccaatgcattaaagcaaggttcggttttacttgaagtctggtttaaagttgatgtggtggcaccaaaatccttgaacttgccatcaagcttaccaaaacaacttattcgcgtattgttaagtgaaaatggtcaggacttatctgaaaagattgacccaaccattttaaaaccgtatttgcatcacttagatggcaatagctgccgccaagtggttaaagcccgccgtgaagtgattgaagagcgttataaacaagcgtttgatattgctaaagaaggtttacctcagcttcaacagcaagcaaaagagcattatggtaataaatggcaatatgagattgatcgtttaacttacttaaaacagttcaacccgagcattcgccaagacgaaattgagcgcttacagaagttgcaaaaagaaggtttaagcttgcttgatggcttaaccgtaacacctgaagcgattcaagtgcttgtagtagttaaaccataa

SEQ ID NO: 331 - DNA, 2118 bp, Acinetobacter baumannii
ttatttattgagaggttaagaatggacacaatgcaagcgaaatctacgcttccctccaaattggtctggagcctagtagcaattataggtgctatttctttcgggatgctggcgctaagtcgtggtgaacatgttaatgcagtatggttggtactggcagctgcatgtgtgtatagcatcgcatatcgattttatagtctatttattgcaactaaagtatttgaattaaacccgagacggttaactcctgcgcatcgtttagccgatggcttagactatgtgccaacaaataagtatgtactgtttggacaccactttgccgcgattgccggcgcagggccattagtcgggcctattttggctgcacaaatgggctttttaccgggcaccatctggttattggttggtgtggttctggcgggtgcggtacaagactttctagttttatttatatcaacgcgtcgagacggtcgatcgctcggtgaaatggcaaagcaggagcttggtccttttgccggtattgtggtcatgttgggcgcacttggggtaatgattattatccttgcggtattggctttagttgttgtgaaagcacttgcacatagtccgtggggtgtctttagtattgcagccactattccaattgcattgttcatgggcgtttacatgcgctttattcgtccgggacgtattgcggaagtttcaattattggcttcgttttaatgatgctggcaattgtatatggtggacatgttgccgcagatccatattggggtgagttcttcactttaactggaacacagctcacttggtgtctcatcatttatggttttatcgcatcggtactaccagtttggttgttattagcaccacgtgattatttatctactttccttaaaatcggggttattcttggtttggcagtcggtattgtgattgcattgcctgaccttaaaatgcctgctgttacccattttattgatggtacaggtccggttttctcaggtagcttattcccgttcttatttattaccattgcctgtggtgccatttcaggtttccatgcgctggtatcgagtggcacgacaccaaaacttgttgataatgaagttaatattcgcatgatcggttacggcggtatgcttatggaatcttttgtcgggatcatggcgatgatctgtgcgacagtattagatccaggtgtgtactttgcgattaatgcgccagcagcagtgctcggtacaaccgtagaatctgcagcggaagctgtacgtaatttaggctttgttgttacgcctgaaatgttgacggttttagctcaagaagtgggtgaaagctcaatcctttcacgtacaggtggtgcgcctacctttgctattggtatggctcatatcatttctgaaatctttaacagccgtgccatgatggcattctggtatcactttgcgattttatttgaagcattgttcattttaactgcggtagatgcaggaacacgtgcttgtcgttttatggtgcaagacacggttggtattgttattccggcggttaaatcttcaggttcattctttggtaacttgttaggtacagccgttgcggtaggtggatggggcttcttcgtctatcaaggtgtgattgacccacttggcggcgtcaactcattatggcctctatttggtgtgggtaaccaaatgctggcttcgatggcactcattttgggtacagtgattctgttcaaaatgaaaaaagagaagtatgtgtgggtgacgatcattccaaccattttcttgttcattacctgtatgacagcagggtggcagaagattttccacgaaaacccgaaaatcggtttcttggctcaagcacataaattctccgatgcgattgctcgcggtgaaattcttaagcctgcaaaaaccattgccgaaatgcaaactattgtgatgtcgaaccagattaatgctgcactttgtggcttctttatgattgtatcgattgtcatgattattgcctcaattggtattgttcgtcgtgctttagcaagtccaacaccgactgtaaatgaagcgcctgcggtatataccgatcctgaagtggttaccactcgaggagaataa

SEQ ID NO: 332 - DNA, 183 bp, Acinetobacter baumannii
atcatgactgagcaacagccaaaacagaaaaaggctttggtgaaattgccatttccaatgccgaatgaaagtaaccaagcaggcgatgctgtacacaaccaagtacgtccgaaacctgaacaatatgcagatagaacttggatgccaccgcgtggtactcgtcgttctatgggtaagcgctaa

SEQ ID NO: 333 - DNA, 1077 bp, Acinetobacter baumannii
agcatggctgaatttaagtttacagatttggtggaacctgttgcggtcgataaaaaaacggcattacgtattaccgttttagggggcggtagctttggtacagctatggcaaatttagctgctcgtaatggctgcgataccatgatctggattcgtgatgccgaaacagcagaagaaattaataaaacccatattaataaacgttatttaccagacttcactttagaatcttcattacgtgcagtttctgatcttgagcaagcggtatgtgatcgagatattattttagttgcaattccaagccactcattccgtgatgttttaaaacaaatagcgccttatattactgcacaagctgtggtgtctttaaccaaaggtgttgaagctaaaacatttagcttcatgagtgatattattcgtgaagaattaccagaagtgccgtatggcgtattgtcaggaccaaatctcgctaaagaaattatggcaggtatgccttctggtactgtaattgcaagtgattctgaactcgtccgttatgccgtacaacatgcacttcatagtgcgttattccgcgtttttggtagcgatgatgtgcatggagttgagttaggcggtgcgcttaagaatatttatgccgttgctatgggaattggagcagcatataaaattggtgaaaataccaagagtatgattttaacgcgtgctttggctgaaatgagccgtttcgcggtaaaacaaggtgcaaacccacttacgttcttaggtttatctggagtaggtgatttatttgcgacttgtaatagtccattaagccgtaattatcaaattggttatgcgctaggttctggtaaaacgcttgaacaagcgagtaaagaattaggtcaaactgcagaaggtattaacacgattgttcaggtgcgtggcaaggcacaagaactagacgtatatatgccaattaccaatgctttatatgaggtcatttttgaaggcgctccaccattaaatattgcactttctcttatgaaaaatggacaccgtagtgatgttgagtttgttttacctcatcatgaagtctga

SEQ ID NO: 334 - DNA, 1170 bp, Acinetobacter baumannii
ataatttatgagctaatcatgcgatttaaaaaaatttcttgtctacttttatccccgctttttatttttagtacctcaatttatgcggacaatacaccaaaagaccaagaaattaaaaaactggtagatcaaaattttaaaccgttattagaaaaatatgatgtgccaggtatggctgtgggtgttattcaaaataataaaaagtatgaaatgtattatggtcttcaatctgttcaagataaaaaagctgtaaatagcaataccatttttgagctaggttctgtcagtaaattatttaccgcgacagcaggtggatatgcaaaaaataaaggaaaaatctcttttgacgatacgcctggtaagtattggaaagaactaaaaaatacaccgattgaccaagttaacttacttcaactcgcgacgtatacaagtggtaaccttgccttgcagtttccagatgaagtacaaacagaccaacaagttttaacttttttcaaagactggaaacctaaaaacccaatcggtgaatacagacaatattcaaatccaagtattggcctatttagaaaggttgtagctttgtctatgaataaacctttcgaccaagtcttagaaaaaacaatttttccggcccttggcttaaaacatagctatgtaaatgtacctaagacccaaatgcaaaactatgcttttggctataaccaagaaaatcagccgattcgagttaaccctggcccactcgatgccccagcatacggcgtcaaatccaccttaccggatatgttgagttttattcatgccaaccttaacccacagaaatatccgacagatattcaacgggcaattaatgaaacacatcaaggtcgctatcaagtaaataccatgtatcaagcgcttggttgggaagagttttcttatccggcaacgttacaaactttattagacagtaattcagaacagattgtgatgaaacctaataaagtgactgctatttcaaaggaaccttcagttaagatgtaccataaaactggctcaaccagcggtttcggaacatatgtagtgtttattcctaaagaaaatattggcttagtcatgttaaccaataaacgtattccaaatgaagagcgcattaaggcagcttatgttgtgctggatgcaataaagaaataa

SEQ ID NO: 335 - DNA, 1305 bp, Acinetobacter baumannii
tcaatttatgagatgaaaccgcgtgttttttgcttggttgatgtaaacaactgctatgcaagtatagaacgtttcttcaaccctcaattaattaataaacccgtaattgtgctttccaacaatgacggttgcgctgttgcacgttctcaagaagccaaagcaattggcatcaaaatgggcgaccctttatttaaaattattgatttagttaaaagacataatgtcgctgtactctccagcaattaccccgtttatgcagaaatgagcaaaagatttcatgcaatcttaaagcagtttgttacagacaaagaacatgagacttatagcattgatgaagctttcctagaactcacagcatacaaacagcactatgatttagacgcttatgccaggctaatgaaaaatcgagtatggcaatggatcggtctgcccgtatgcgtgggtattggccgaagtaagactgaagctaaaatggctaatcatcttgcaaagacttataaaacatttgatggcgtatgtaaccttacatcgttcccaaccaatataagagatttgctttataaacagaccagcgtttctgaagtttggggcgttggccgccagcatgctaaaaagcttgaatcaatgggaattactaaagtttatgatcttatgatgtcaaacccatatcacatggaatcattgtttagtgtcgttatgaagcgtacagtgctggagctaaacggcatcgcttgcattgaaattgaagatacaccaccatctcgtaagcaaatcatttcatcacgtgcatttaagcaaaaaattactgataaagatgacttaaaagaagcaattgcacgacgcacacaagaagcattcacacgcataagaaaagatgaagctctatgtggctgtatcatcggttttgctcactctagcccatttgatgtgcataaaccctattataaaaaggaattatcacagtcgtttgccgtacctactgacgatgttagaaagcttgtgaaagcaacaacaagaatgatggagtatatttataagcctggtgtggacttcaagaaatgtggagtagttttgactgcactggagagtaagcacacttatacttatgacttactaacagattatagtgaattagaaaaaacagaaaatttaatgcaggctattgaagggatacaagggaaattcggaaagttcaaacttggatttggtgggagtatgtatcaaaaccgatcatggtcgatgtctcaaaatctaaagtctaataattattttacttgggaaggtatgctaactatttctaattga

SEQ ID NO: 336 - DNA, 1782 bp, Acinetobacter baumannii
aagatagatgaaatattatttttctatggaataaaaattggtctcaaaggatatagagcaatgttcatagaaattggtgaatttttaaatcttcgtctaaaacaaatgggtatccaacatctttttggtgtacctggtgattttaacctctcatatctagaacaagttgaagcagacccacaactcgaatttattggaaattgtaatgaattaaatgctgcctatgcagcagacggttatgcacgaattaacggtttttctgccttggcaaccacttatggtgtaggtgacttaagtgcgattaatggtattgcaggtgcctatgcagaaaatgtacctcttattcatatctcaggtattccacctttacatgcagttcaaaagggtactctcatacatcatacgttagttgatggtaactacgacaatattatgaactgtatgaaagagttcacagttgcccaaactcgtttaactcctgcaaatgcagcttctgaaattgaccgtgtattgcgtcagtgtttccttgaacgccgtcctgtacatatccaactacctggtgatattactcacgttaaaattgaagtgtctgagcgtccgctcgacctaagctacccagctgttgaacctgaattattgcaaagtgtggtaagtaaactttgtgacattattgagaatgctcaaagtccagcgcttttaattgataatgaagcctcagtttttggcgtaacttcacttttgaatgatttgtctcaaaaatgctcaattccatttgcaggtatgaatactgcaaaaaatattatggatgaaggctcacctcgttacatcggaacttatgtgggtggagcaagccaaccgcatgtaaaaaatatcattgaacaatctgactgtttaattggtgttggcgcgcgctttaccgatgtaggctcagctgtatttacgcatcaaattgagaccaagaactatatcgaaattaaatcttacggcttaaatatttttggtcaggattttccgggtattgaaattggacaattacttgtcgagctaaataaaaaagttgcgtcacgtaaatcgtcaatacctcttcttgaaaaacaacctcagaaagtaattgaagcgccagctcaacagaagcttagccaagatgtgctttggaactacatttcagggttcttaaaagaagatgatgtaattattggtgaggtaggaacatcaaactctgcattgtcaggtatcaaacttcctgctacagctaaatatattgcgcagccgctttggggttctattggttataccttgccagctttgcttggtagtttgttagctgctcctgagcgtcgtcaaattttgtttattggtgatggttcattccagcttacggtacaagaactctctacgattatccgccatggtttaaaaccaattattttcttgttgaacaatggcggctacaccattgaacgtttaattatgggtgaaaatgctgcctataacgacgtgcaaaactggaaatacaccgaaattccagcggtatttaacggtaaaaaaggccatacaacttatgtggttgagactgctggacagctgaagagcgttttagacaacgttcagcaaaatgatcagttaacctttattgaattgaaaataccagcaatggatgcaccggtgagtttgaaaaaattagcttctgtgattgcacgttttgactacggtgatcgcggctatgaaattttaaaggagcgttcccaaccagttaaatgtaaggatgcaatctctttttaa

SEQ ID NO: 337 - DNA, 546 bp, Acinetobacter baumannii
ggaaattgtgatatggacataacacataaaatggttggtctagacgacatgcaaaaacaaatgtcaaatttggtcgatctagctactgaaaagaaaaaaaccaaagctgctgcaatgtatgcggttaaacccatgcttgatgaagcaaagagtcgggcaccagttgctgaaaaggcatattaccgttattaccgtggttcttacagacagcgtaagcgtggtaatgcaaatcctagccgtcaattaatgatacccggtaaattgagagctgcaattaaacgtaaaagtgtggaattgaataagtctgttggtgcggctgtttatgtgggtactactaaggctttatttgatcgcaaatattatcctttttattggcgatttatcgaatatggtacgcccacaatgcctgcaaattcgatatttagaaggacttttgacgcaggaaaagtcattgctttagagcgtttcaaattcagatatagaaaatatatcgaagcaattgttaagcgccgaccagttgagggcctaaacgatgttagtgagtga

SEQ ID NO: 338 - DNA, 858 bp, Acinetobacter baumannii
ataattttcgaaaatgagcctattaagaaagagagcactaacatgaaaatgtatcaagtcgatgcttttaccaaagagttatttcgtggaaatccggctgctgtgattgttggaaaagagtggccagatgcagatttaatgcaaaagatagcacttgaaaataacttatctgagactgcttttgtaaaaattatagactctgaaaattatgaaatacgctggtttactccaacggttgaggtggatttttgcgggcatgcgactcttgcgagtgctttcgtattatttaaagattttactgagaaaaagactcttaattttcatgtacgaaacttaggtttgtttgtagttcatcaagatgaagacggcaaaatcagaatggattttccaattcgtaaagctcagcaagttgaagattatccggctattttacgtcaagcattaacaaaaccttttaaagcggtttatcaaaatgttcaagcctacattgttgaatatgagtcagtgcaagatgtgttagatgagcaacccgacatgaacttacttaaagccttaggtaagcggactgcaattacaactacagcaatggatgttgcaatcacctcaaaagctgacgatcaatatgactgtatttctcgttattttgcacctgtcgcaggcattgatgaagacccggttactggttcaattcataccgcaatagcgccactatgggcagagaaactcgctaaaaataatattgtggcctatcaggcttctagccgtggaggcgtattgtattgtaatgtcttaaatcaggaacgtattgaaatttcgggatatggcaaactttatatgcaagccgaaatttttccttaa

SEQ ID NO: 339 - DNA, 813 bp, Acinetobacter baumannii
atgagtgtcgaacagtctttattgggtaaagaaacccaatatccaactagctatcaacccgatgtgttatttccaattgcacgtgctcaatctcgtgaaaaatatgctcatatcgaaggtataacccaaggtaaagattggtggcacgttttcgaaatttcttggttgaatgctcacggtattccacaggttgctatcggcagaattacactgccagcttcttcaccgaatttgattgaatcaaagtcattaaaactttatttcaatagtcttaacttcactcagtttgactctacacagtcattcattgaaacagttgaaaaagatctatctgctgcggcaggtgcaaaagttgaattaaccctatttcaagtagatgatttagagatttctaaacctcaagggatctgtattgatgatcttatgccagagcgtttagaacaacatcctgatgctactctcttaaaacttgatgagtcaggtgaagaaatcgaagttgaattgtattctcatcttttgagaagtaactgcccagtcacgggtcagccggattgggggacagtttttattcgttttaagggcaaaaaaccttgttatcgtagtcttttagcctatattatttcgtaccgtcagcataacggtttccacgaacaatgtgtcgaacaaatctttgccgatatttggcaaaatttgcaacctgaaaagctgatggtttatgcaacttatactcgccgcggtggacttgatatcaatccttgccgagtatcggatcttacatggatgccaaaaccgattcgattggcacgacaataa

SEQ ID NO: 340 - DNA, 855 bp, Acinetobacter baumannii
ttacaaaacgaccgtcagcattctggtcaatctggtatgtggcatttatttccttgcgctgacggttcgtacccgaggtgttgcatgattcatgtcaagaatatcaataagtcatatggaaataagccaatactgactgacgtaaatgttgaatttcctacaggtcaggtgacgtcactcattggtccaaatggagccggaaaatcgactttgctcatgatgatggcacgtttaattgagccggataaaggagagatttttcttaatcatcaaaatattgctgatattaaaaccgctgtttatgccaagcatgtcgcgactttacgtcaagcacccggctttaatttgcgcttaaccgtagaagagctggtttcatttggacgctttccttatagccgtggtgttttaaccgagcaagatcgtcaggtggttgatgaggcgattgagtttctttctttagaacccctgcgcaaatcttacatagatgaaattagtggtggtcaaaggcaaatggcctttttggcgatgacgatcgcacagcaaacagacgtacttttattagatgaacccttaaataaccttgatatgaaacatgccgttcaaattatgcgcgcactcaggcgcttatgtgatgaacaagggcgcactgtgattttagtcattcatgacatcaattttgccacgaattactcggaccatattgtcgcgctcaagaacggcaagcttcatttcagtgggttaacggaacaagtgattacagaggcgcaattaaatgatctgtacgagcttgattttgaaattacatacagtgagcgtggctgtatgtgtaattacttcaactcatctggagcttga

SEQ ID NO: 341 - DNA, 1815 bp, Acinetobacter baumannii
tttggaaacgatatgaacgacttaactgttccagaaaaactagcgaaacttcgtgaactcatgaccaatcaaagtattgatgctttggttgtcatgagtgcagacccccatatgtctgaatatttaccagactattggaaagcaaggcagtggttaagcggttttagtggctctgttggcactttagttgtgacccaaaattttgcaggactctgggccgatgggcgctattgggtacaagccgaacaacaactcgctggaactggctttcaattacaaaaactgaccagtgatgaatcttctacacatctcgcatggattgagaaaaatctaccggctggttcggttatttcagtaaatgggcaaacactttcaatccagcaatttaaagcgttggaaaatacagcaaagcaacgtggctttaagcttgaaacacagcaagatttaattggttcaatctggtctaatcgtccagaacttcctttagagcagattcatttaatgcctgaagggttaaatgccctatctcgtaaagaaaaaattcaggcaatacgcgaaatattaaaaactaaggcgattgaaggacatttcatttcatctttagatgatattgcttgggtcttaaatgcacgtggacaagatgtggaatacaaccctgtatacctttcgcatttatatatcagtactcaaaaggctgttttattcattgatagcaacaaagttgatttaactacccaacaggctttcaaagctgatggtattgagattcgtgactacgaagatacagctaagtttttagcgaatatttctgatgcttcagtgcttttagatcccgccaaagtctcgatttttcatgaacaagccatcgcaaaagatattcaggttgtctacgacatcaacccaagtacactttttaaatcgcgtaaacatgaaagcgaaattgcttatatccgtcatgccatggtgaaagatggtgttgccctttgccatttcttcaactggttagaaaaagcacttcatcaaggtcaacgcatttcagaactcaccattgatgaaaagattacggctttccgtgctcaacaagagggttttataggcccaagcttttcaacgattgccggctttaatgccaatggtgctctacctcactaccgtgcaactgaagaacattactcattcattgaaggcgatggcctattactcattgactctggcggccagtatgttgatggaacaacggatattacccgtgttgttcctgtaggaacaccaacagagcaacaaaaacgtgactatactctggttttaaaatgtcatattgctttggcaaaaacgatttatccagaaggtttagctgccccactactcgattcaatttgtcgccatacgttatggcaatatggtttagattatcgtcacggtacaggtcatggcgtaggctttgcgcttaacgtgcatgaaggaccacaagtgctttcttattacgcacctattcatgcctatagtaagttgcgtgaaggtatgattctttctaacgagccgggcttataccatgagggacaatacggtattcgtattgagaatctggttgcaaacagacttcactcagggtttgagaaaacctacggcgatttcttagagtttgaaacgctgaccctttgcccaattcatttagattgtatcgtcgttgacatgctaacggatgaagagaaagactggttaaatggttatcatcaaactgttcaagaaagactggctgaacatttatctggcgatgttttagattggttgatttataacacacgtaagatttaa

SEQ ID NO: 342 - DNA, 1560 bp, Acinetobacter baumannii
cttgtctgcgaggttgctatgtgtggagttgttggtatagccggtaaatcgccagtgaaccaaatgttgtttgatgcattaacgatgttgcaacatcgtgggcaagatgcagctggaatagtaacctgccatgaaggccgtcttttccttcgtaaggataacggtatggtacgtgatgtttttcatactcgtcatatgagagcattacttggtaattacggtattggtcatgtgcgctatccaactgctggttcttcgagcagtgcggaagctcaaccattttatgtgaactcaccttacggtattacacttgcacataatggtaacttgacaaatgcagaagaaattcatgatgacctgttcaaaacagatttgcgtcacatgaatacggactctgattcagaagttcttttaaacgtctttgctcatgagttgcaaaagataggaactttaaatcctacaccggaagatattttccataccgtttcgcgtgtacatgagcgctgccaaggtgcttatggtgtcgtggcaatgattactggtcacggcttagttggttttcgtgatccaaatggtatccgtccgcttatttacggttctcgtgtaactgagcaaggcgaaatggaatatatcattgcatctgaatctgtagcgattacggcgcttggctttaaaattgagcgtgatattgctccgggtgaagcaattttcattaatgctgacggcgagttatttacaaagcaatgtgctgcaaatccaaaataccgtccatgtatttttgaatatgtttattttgctcgtccagatgcaattattgatggtatttcggtttataaagctcgcttaaaaatgggtgagaaattagcgcataaaattttgcgtgactggggtgaagaccatgatattgacgtggttatcccaattccagatacaagccgtacctcagctttagagttggcaaatattcttggcgtgaagttccgtgaaggttttatgaaaaaccgttatatcggtcgtaccttcattatgccaggtcaacaacagcgtaaaaaatctgtacgtcagaaattaaaccctgttgagttagagtttaaaggcaagaacgttctattagtggatgactcaattgtgcgtggtacaacgtgtaatgagatcattcaaatggcgcgtgactcaggtgcgaaaaaagtatactttgcttcagctgcaccgaaagtgatgtatccgaatgtatatggtatcgatatgcctgctaaaactgagcttattgcttcagagcgcagtgtagaagaaattcaggaaattattggtgctgatcgtttaattttccaagatttggaagatttgaagaacgctgtacgtacaagtaaagtacctacattaaccgagtttgattgctctgtttttgatggtatctatgtaactggtggaattgatgcagactatctgaataatttggagcagaaacgtaatgattctgcgaaaaagaaaaaagatggttatattgatgtcaatattgatgcagcatcagtagatttgaccggtattaaagaagaatag

SEQ ID NO: 343 - DNA, 540 bp, Acinetobacter baumannii
actaggtgcgagttttcatgtgagcagattatgcgtaaacgacaaccagtacttaagcaggaaaagactttaaatcctgaattgaaaacatggttgtatgcgtctggttctctgacacaacaactcactgagctgggtggtgggaagttcagcgtaaagcctttcaaagaacatttccagcgtttaacttttgccgacagtcaatggatgaacatgccccatactcacacttcttgggtgagggaaacctatttatatggcagtgatgtagagccttgggtgaaagcaaaaagtatttttccaattcaaagtttacaaaaaaaagcccgtatatttcagcatattggttctaagccgataggtctttttttatttcaaagaacaacaccactttgtgatcgccgggttattcgtttaccagaaggctggacgcgacaaagttgttatacttggcatggatgtaaatttattgttcaagaaacattcttaccggcttttgaagcttttttatatcagcagcacgacaaggaattactatga

SEQ ID NO: 344 - DNA, 1251 bp, Acinetobacter baumannii
gcggttttagagtttttagaggattggcaaatgcgctttgttgatgaagcagtcattaccgtagaggctggcgacggtggcaatggcgtagccagttttcgccgtgaaaaatttgtaccatttggtggcccagatggtggtgatggcggacgtggtggaagtatctatattcaagcagatgatgatacaagtaccctagtcgattaccgttacacccgtaaattccgcgctgagcgtggtaaaaacggtgcaggtgctaactgtaccggacgtggtggtgaagatgtggttttaaaagtacccgttggtacaacaattgttgatacagattcaggcgatattattggcgatctggtagaagacggccaaagagtaatggttgcaagcggtggtgaaggtggtttaggaaatactcactttaaatcatcaaccaaccgtgctccacgtaaatgtacgacaggtacaaaaggtgagttccgtgaaattcgccttgagttgaaagtattggcagatgttggcttattaggtatgccaaatgctggtaaatcaacatttattcgtgcagtaagtgccgcgaaaccaaaagtagcagattatccatttaccactatggttcctaacctaggtgtagtagatgctgaccgtcaccgctcgtttgtgatggcagatattccgggacttattgagggtgcagcagaaggtgcaggtttaggtattcgtttccttaagcatttagcacgtacacgtattcttttgcacattattgatgtacaaccaattgatggttcagacccggcccataatgctaaagcaattatgaatgaacttgccaagttttctcctactttggcgaagttaccaattgtattagtacttaataaacttgatcagattgctgaagaaagccgtgaagaatggtgtcagcatattctagatgagttgcaatggacaggtcctgtctttaagacctcgggtttacttgaagaaggaaccaaagaagttgtttattacctcatggatcagattgaacaacaacgtgaacgtgaagttgaagatcctgagtacgcagcagaagtaagagcattccgtgaacagcttgaagctgaaacacgtgaacagaccattgcagcgaaggaagcataccgtgctatgcgtaaggcacaacgccttgaaagcatgatggacgatgatgatgacttcgatgacgatgaagacgatggtgatgtagaaagcatctacgttcgtgactaa

SEQ ID NO: 345 - DNA, 1503 bp, Acinetobacter baumannii
aacatgttagaacgtccaatcaccttctttttccgtggtggtcagcagcaagtagaaaatgtagtacctacaatgacggttttacaatttctgcgagaatatactcaaactggtaagactaggcagactggtacaaaagagggatgtgctgagggcgattgtggtgcatgtacagtagtgattggtgagttggtcaatgacaacctgcaattacgtagtgtgaatgcgtgtattcagtttttaccaactttagatggtaaggccctatttacagtagaagaccttcatagcttattgccagtaccagatggcacacttcatccggtacaacaggcgatggtcgatatgcatggttcacaatgcggtttttgtacacccggttttatcatgtcgttatggtcaatgtatgaaaatgaacaacattctccaagtaaagataaaatcagtgattatctttctggaaacttatgtcgctgtacaggctatcgccctattttagatgcagcacaaaaagcttataactatccacgtgttgtattagaacgtcaaaaagtaattgatgtattaaaagagatcaaagcattacctgcattgcatttgaatgatcaaaagcagcaattttttgcacccaaaactttgcaggattttgctactttacgtttacagttgccgcaagcacgtattgttgcaggtagcacagatgtaggtttgtgggtaacaaagcagggccgtaatttgggcgatatgctttatataggtcaagttgaagagctgaaaaagattgtagtcacagaccatgctttaacgattggggcaaatgtaagtttgagtgatgcactcattaaaatttcagatttttatcccgactttcaagaattgcagcgccgttttgcttccatgccgattaaaaacgcaggaacgctaggtggaaatattgccaatggttcgcctattggtgattcaatgccagcattaattacgctaggtacacgattgattttgcgtgtaggtgagcagactcgtgaaattgctttggaagacttttatttagactatcaaaaaacagcattacgacttggtgagtttgttgaagcgattgttattccgcttcgcgaagggcagacacgttttaaatttgccagctataaaattgccaaacgatttgagcaagatatttctgcggtatgtgcagccatttcttgtgagttagataatgatgatgtcgctcacaatgtaagaattgcttttggtggtatggcggctattcccaaacgtgcaaaatatacagaagccatattagaagaccagcaaattacagcagaattgatgattcaggcgcagcaggcattgtcacaagactatcagcctttagatgatggacgtgctagctcagcgtatcgtttacacgtcgcgaaaaactgtttaaagcgtttttatgtagaaaaaatcctgtctcaaacgatcactcgtgtgaatgacctgattgctatggtggagatctaa

SEQ ID NO: 346 - DNA, 1239 bp, Acinetobacter baumannii
tttactgtagaggtgaaaatgaaaaatatcaaaacaataaactctataacacattcaatattactgatgggagcagtgatctcttctttgggaatgatcggtataagctcagtttatgcacaagagcaagtcgaccctgcatataagcccggtaaccctatttatgataaatgggatagattttataaaattgaacagtctcaaccgcaagaagcagaaaaaatattagttgagcttagtaaactgacaccaaccgatattaaagtctggaaaagtcttacttatttacagattcggcttgaaaaaagaaaagaagctttacaaagcttaaggcaagcaagaaatttagctcctcaagatgacaccttaaaattacaagaagcttatttgctgaatcagcagaaaaaagatcgtgaagcattggttttatttaaagagttaagttcctcttcagaccctgaaattgctgctaaagcaactcaggcagttaaaaatttaagtgggggagaagttaaaccatattttagagatatttattttgcaccgtcttatgagtcacgttatgacgatgttattttccctttaaaaatcaggtatggcaaaaacatcgataacgggcgagcccaagtatatggctttcttaatttaaaccgcgatactcaatcacaaggtggggtccgacctgaaattattgatgaaaatgcagccactttaggggtgggggcaaattatcaaccgtggacttccattcctgtgcgagcctatgtcgaagttggtggaagttatgacttgattgatagaaatagaaagcgatttcgtgagagtgttgtaggcggtgtaacgggttatcaagaatggtattcacaatcaaactgcgatcattcactttgtttagataattattttactgacttatatggcaatgtcgcgacttattcgagagaggactataacgttattggggacttacgcttacgcacaggtttaaatctctataagggtgagagtggatctgtgcaggcttatgtgaaattgcatggcttagcggatagcgaagatgaatattacaataatttatttgaatatggcccaggcatttcatggcagccttttaattatcaaccgataaaactacgggttgaacgtctatatggcaattattttaaagacgtaccggttaatacaaaagatcattacaacaatactcgtgtagaacttgttttttataaggatttctaa

SEQ ID NO: 347 - DNA, 384 bp, Acinetobacter baumannii
ttattaaaagataattttatgctttcaaaatctaaaattgtgattgactgtattggccaagaatctttgtatgtattagaaaaatctggtagtgcaatttataagacaccagggtttgatactaattttgcaaaagatcttttaaaatcttataaagaagggcttcagaagctaaaaactataattgatagctcaccaagttatgataattcatattatgattttgagtttaagacaatgatttatgcaattgataaattattactagccataggaaacatcaaaagcgaagatgatgagattgaggctgctatttttcaaagctatcttcgaaaacaagatgagtctattaggaaaacaattgaagaagaggaagcgggttaa

SEQ ID NO: 348 - DNA, 1848 bp, Acinetobacter baumannii
atgctaaaagatttgagtcaaaatttagggcaaatgaatgataaaaataacaatgtagaaaatttcttaaagcaaatttatgaaaatatttttgagcaaaattccaatcgaacagcactcatttttgaaaaccgtagcattagttatgctgaggtagggactcaggtcgccaaagtcatgtatgcgctaaaaatgcaagacttggcaacagggtcggtggttgcaatttgtctgagaaaaagtcctgagcatatttataccgctttggcatgtgcgctcactggcatcatttggctacctgtagatatggattctccgccatcgagactgaactatttattgacgaatagtcgggcagatgttgtggtgagtgactcatccattgcaggtgtgcaaacactaaatattaatgagattttatcggctacaactgagtacaaaccgagcttaaatgccgaaattaaccgacttccagcatattatttatatacttcgggaagtacaggaactccgaaatgtgtggtcttaaataatcaggccacagaaaacacgctacaacagacgatctcggaatgggaaattactgctgacgatgtgattatggcggtaacaccgtttcatcatgatatgtcggtatttgatgtatttgcttcaatggcagtgggtgcaactttggtggttccatcttttgagcaaagtaaaaatgctgttgtctgggccaatttagtagatcgttgcaaggttacgatttggagcagtgtccctgccattgtcgatatgctgttcagtgtagctcaaaaagaacaattacagtctttgcgtttaattgcccaaggcggcgactatatcaagccttcacttatagcgaagttaaggcaacaattgcctaacgctcgtttattttcattaggtggacctaccgagaccacaatttggagtatatggcatgaaataaatgagcaggatcaggaaattattccgtatggaaaagctttagaaaataacggttattttattttggataaaaatctaaagccttgccaaatgggcgaggtcggtacgatgtatatgattggcctgaatttatcaaatggttatttacttgatggggaaattaattataaagatttcgttgatattcaagtgagtgaaaatgaaactcaaactgcttttcgcatgagtgatcaaggatattttagggaagatggaaatattatttttgcgggacgtgaggaaggttatttaaaaataaaaggtgtgagaatctctgcggcagaggttgaaaatgctttgaccaagaacccgtatatccataactgtgtggtgatcagttgtgtacatccaacaactgaaactcaagagttagtcgccgtttacaccctagaaaataaatataaaactactcgcctaaatagccccgaattaaagaacttcttaaaaatacatttaccgagttcacatattccttcgaaatatttggccgtcgaaaccatacctctgacccgaaatggaaaaattgatcgtaaagctgtgcaagaaatcgctcaggggaaaatttacgtaacttctacgttgtccgcaaactcttctaaaacacagtcatcaatcgctgaggtgggggattcggttttatcggttttccgtgaatgcatagctgacagccaagctgaaaaaatggatattttttatagaagtgaaatattagatataggaattcgtccgaaacaactcatgagtattgctcagaaactttctcaaaagctcaatacacaaattgatttttatacgctagttagctgcaaaacaattcaggatgtggtgaataaagtagagcagcaaataaaatag

SEQ ID NO: 349 - DNA, 1446 bp, Acinetobacter baumannii
gacaaggaagaagaaatgcaacaagcgaatatgcttaatgaatttaaacttattattggcggtcaactttgttcaggtgaacaaggtgaactggaaattattaaccctgctactggcttaactgcggcacgttgtgcaaaagcatctgttgcacaagtgaatcaagctgttagtgcagctaaacaggcttctaaagcttggcagcttgtctcgcatgatgagcgtaaatcaattttaaacaagattgcagatggtattgaaaagcacgctgaaatgcttgcagagctggtggtgcttgaacaaggtaaaccactcgcactggcacaaatggaagtgcaaggtgcaattggctggacgcgttatgcggcttctatggatttaccggtagaagtaattgaagacagtgaaactaaacgtattgaacgccatcgccaaccattgggtgtagtggcttcaattacgccatggaactggccactcatgattgcagtttggcatatcatgcctgctttacgtgcaggtaacgttgtcattagcaaaccttcggaatacacaccattatcgactttacgtctatgtgaaatcattcagcaagaagttccggcaggtgtgatctcaattgtggttggtgctggtgagattggtgaagcattatcttctcatccagatgtgcaaaaagtcgtgtttacgggatcaactcgaacagggcagcacattatggctggtgcagctcagcagctaaaacacttaactttagagcttggtggtaatgatgctggtattgtattaccagatgcaaatatcgatgaaattgcagataagatttttaatatggcgttcttgaatgctggtcaaacatgtgcggcgttaaagcgtttatatgtgcatgaaagccaatatgaagctttatctcaaaagttagctgatattgccaacgctcaagttgtgggggatggtatggcatcttctacaacatttggaccagtacaaaaccagatgcaatataacaaagtgaaagctcttattgctgaagcgattgcacaaggtgcaaaagcactttctggacaaaaacagctaccagagcagggctactttattgcaccaactattttgactgaagtttctgattcttgccgtgtggtgcaagaagagcaatttggtccagtgttacctgttttaaaatataccgatatcaacgatgctattgctcgtgccaatgacagtgagtttggtttgggtggttcaatttggtcttctgatcttaaaaccgcacagacctacgctacacagcttcaatgtggaacggtctggattaatacccatgcagaagtactgcctcatgcacctttcggcggctggaaaatgtctggcttaggcgctgagtttggtttggaaggtttgcttgaaaatacgattggacaaacggtccatattagtaaagtctaa

SEQ ID NO: 350 - DNA, 651 bp, Acinetobacter baumannii
ctggtcagagaatacaaaatggtatctgctcaaaatttattagaacgcttatatcctggaagaagagctgctttaaaacgacaaatattattagatgctttagattgttttttagagcagggcattgaaacgactagtattgaaatgattcgtgccaaatcagaaagtagcgttggggcgatttatcatcattttaaaaataaagagggtatagttgcggccttatttttttcagctttagatgatcaaacagctctgagagatgaatatttaaaacagtccaaaacattaaaagatgttgtagaagctctaatttatagttatgtggactgggtaagtgagcaaccggaatttgcaaaattcttaattactgcgcgttttaacattatagagggggaggaacagcaacaacttacacaaaaaaataagagtagaaaccaaaagatatttagcttgatttcgaactttgaagaatttaaagcatttagtttaattccacatgaacttttgctttcattagtgattggttctacagagagctattgccgtgcgtggttatcacaacgtgtaaaagctgaccccaaagactatagagaaattctggcaaaagcggcttggaattcattacaggatttgcgtttagaacattaa

SEQ ID NO: 351 - DNA, 444 bp, Acinetobacter baumannii
ttgcctggagagattctaatgcatatttgcccattacattcgtattttaagcaaagccttaatgatcaagttgaagcttcgttagcacaaggcaatgaaatcaaaaaactggctcatggtgaaagtggtcatgattggtatttcaacaatcagccaatcagtgctcaatcaactttgcgtgaaatgatgaccaagtctattaaaaaccataaggctaaaaagtcagaaaagaaaagtagtaaacgagctactagagcgcagataaatgaattgatcaaatggcttgatcaaagcacaggccgcggcactctcttaactcaaaagttagaatgttccccttcgtttatttcacaaattaaaaacttcactcgtccttgttctgccgagaactataaaaagatcaaggaagcaattttggaaattgaacaggatgaaaaaaaatga

SEQ ID NO: 352 - DNA, 522 bp, Acinetobacter baumannii
atgaaatcggagatttttaacatggttttatcattaatcgaacgtcgtgaaaaaacggttatgtcattagagcaagctttgaaagctgctgtttatcgtccaggtgatgaatacctaatggcacaaattgccgaaaagaatggatggaatatcaatacgttccgtagctctatcaatccaacgacacctacacataaggcaaatatttatcatttcgaagctattttagatgaaacaaaagatagccggattatggatagtgtttgtgcaattcatggaaatgcggcttggtttgagttgccgaaaactgaaaatttaaataccgctgattttgttatgaaaataggcaaattggcacaagagcagggtgatttatctcaatccgtagctaaagcaattggcgatggatgcattagtgaagatgagttagcggtaattcgtaaagatgcttttgaactcattcgagttgtttcaactattttggctatggctgaggaacaacatagaggtgatcatgcctag

SEQ ID NO: 353 - DNA, 2664 bp, Acinetobacter baumannii
tttaataaggaaaaggccccgttaagcggggtttttttatgggtgaaatatatgtctgatgttttaagccgtgttcagattctccttgatgccaatactgctaaatttgaacaaaatataaagtctgcccaaaagacttcagaaacgtctttcaccaaaatttcatctagtgccaaagctatggctggaatcgttgcaacggcaaccgttgcgggtgcggcttctttatataactattccaaagaacaagctaaggtgataggtgagttagaacgaaatgcatttcttgcacagtcaacagttcaagaattccaaaaaatgtctgttggtgctgaaatgtttggggttcagcaagataaacttgctgatataaccaaagattttaacgaaaaattaggggattttttgacaactggcggtggtgagtatgtcaattttcttgaacaagttgcattaaagactgagggaagtacttctaaagcattagagcttaccaaagcaatggcccggttgtctggtcctgaagcaatggctctctatgtaaaaaagatggaagaagcaaagctatctcaagatcaaatgtcattcttgatggaaagcatggcttcagattcaactttattgattcctttattaaaaaataatgctgaaggtatgaaactttggggggaagctgctgaagatgctggaattatcctgaatgataaaaccattaaagccgctcgtgaactccaagttcagaccaaaatgcttgatatgcaaatgcagggcatgaaaaatcaattaatggcttctgttatgccagctttggttgatattgccgatgcatttaatactggtgataaagaagctcgcggaatggccgacggtgggaaagttctagctgattcattacgtggggttgcagctattgctatgggtgtttgggcagcgctcaatttagtttctaactcaattgcaggtgttactaaccaggcgattgactcttatactttaacaagtaaagcggctaaagatggtggttttttagaccaattgccaggtattcaatgggcaaaaactttcataactgctggagttactgccagtgctgaaaacagttatataaaaatggctggacgcgataatgatgcagtaattaaagagttttcagaaaaatacaccaagatatttgatgacactgtgtctggaagaactaagactttaagtggattaatggagcaagccaataaaggttctgctgctgcaacgcaaggtgtacaagactggaaggataagcaagacaaggcagccgaatctgcaaaaaaacttgctcaggctcaacaggaattaaaccgaaaacttgaagaacgcaaaaggcttcaagattcaataatttatgaatatggtgataaagaatatcaaatgcagctcaattatgagcggcaagcaaatgatattaaaagggcttttgatggtgaacaacagcagagattcctaaccattgcaaaaaatcgatacgatactgaaaaagctttatacctatcaaagttagcttttgaaatatcagaacatcgattaactgaagaggaaaagcttaacttccaatatcagattgaccaaaaggaaattgcggccagaactgatattactgatgcagataaagcatctttttaccgtgcagcacgtgaaaagcatgaccagtctatggcttggatgcgtcttgagtcagctcagcgcttaaatgatgctcaagctgcattccaaactgaaatgcagaatttaactgcaaagtttgaatttgaacgtgaacaaatccgtctaaataagtcgcttgatccggcagagcaaagtaccttgatagcatcatcgtacagaactcaagatttggaaaatgaggcttcaagacattcagcctggatggattatcaaagtgctacaggtgttgatacttctgctgaggatgcggcaaatagacgagctgaagcaattaaaaatgcttttgaatggcagttgattacccaagaagagtaccaacaaaagatgttggcgtctgaggctcaatttaacacggataaagcggctttaggtgcccaagctgctgctgacactttaagcgggatgactgatctcatggggtcattaataggtgagcagtctggggcatataaggcaatgtttgcgatgtcaaaggcgtttgcagtagcccaggctattatgaatgctccgcaaactttctctaatgtatatacgtctgtttctgctattccattaattggtccatacattgcaccagtgatggcaggtgcagccgttgcagttcaagttgctcaagcttcacaaattaagtcagttagcttggatggtatggcccatgatggtatctctagtgttcctgaagatggtacttggttccttaaaaaaggtgaacgtgtacttgatgatcaacaaaatagtgctttaacccgattcttaaatagtaatggcggtcaaatgaatggttttaatatcaatattaataactatgcgggcgcaagagttaatactagacgtgatgaaaatggtttaaccattgatatcgttgatgagcgaattgctggagcgtttacacgtttgggcagtgaatcaaatagtcatgaatcgcaaatggtgcagcaagcctttaatgttgaacgtagacgatag

SEQ ID NO: 354 - DNA, 720 bp, Acinetobacter baumannii
tttttaaaggataaatttatgcgtactttagcaatatctactcttctccttggtacggtactcagccctatggtttttgcccaagatgataatgcccttcactacaatattgtaaatgttcaagcagaagcttctcgccaagtttcaaacgatgaaatgcatgcaactttatatattgaaaaaagcaataagcagcctgcagaactttcaaaccaaattaaccagttaatgaaccaagcactcgcaacttcgcgtaaatacccacaagtgaaagtggaaactggtgcccaaagcacttatccaatttatgacaatgacagtaataaattaaaagaatggcgtggccgcgcggaaattcgtttagaaagtaaagatttcaaagctgctagccaattaattaatgagttacaacaaagctttcaaactcaatccattaattttagcgtttcagatgagcaacgtaaaaaagttgagaatgaattgatggtagaagcatctaaaaactttcaacagcgtgctcaaatgctgactcaagcatggaataaaagccaatattctttggtcactctaaacctgaatacgaataactattttcctcaacctgtaatgcgtgccagcctagctaagttcgctgctgctgaagcggcaccagctcaagacatggctgctggtgaatctaaaattactgtaaatgcaaacggttcaatccagtttaaataa

SEQ ID NO: 355 - DNA, 1149 bp, Acinetobacter baumannii
aaaaccgaggaaaacatgatagaagtggtcgatgggcaacgtaagctcagtgagtgtaaacgaatcgttgttaaaatcggatcatctttactcacggcaaatgggcagggtctagatctggatgctatttcgcattgggcgaaacagattgcagatttacacaatgctggacacgaaattattttagtgtcttcaggagctgtggcagaaggtatggttcgtatgaagcttgcgagtcgacccaccgatctacccagtcttcaagcatgcgccgcaattgggcagatgggcctaattcatacttggtctagtgtgcttgaaaatcatagtatccgaactgctcaggtgttgttaacacatgatgatttggcagaccgccgtcgttacttaaattcatgtgatgcattgcagaacttgattgattggcgtgttattccggtcattaatgaaaacgatactgtatctaccgatgagattcgttttggtgataacgatacactagcagctatggttgctggtcaagtacatgctgatttattaattattttaacagatcagcaaggtatgtttgattcagacccacgtcataatcctgatgcaaagttattatcaactgtgcgtgccatggatgatgttttatttgaaatggctggtggtggcggtgtgcttggacgaggtggcatggtcactaaagttcgtgctgcacgtttagctgccaagtcaggttgcccgacattaattgctagtggtgaaagcgacaatgtattgtcacgagtgatggctggtgagatgctgggtacattgtttacgactgataaagaccgtatgacagcgcatcagcaatggcttgctgcacatttacaaacagcgggtcgtcttgtaattgatgatggcgcagttgaagcgattaaattgaaacatcgcagtttattgcctgttggggtaaaaactattgaaggacattttgatcgtggtgatgtggttgaatgtgtcgataaacaaggtaaacgtgttgcggttgggcgagtgaattttagctctcgttctgctgaaattattaaaggtctttcttcagacaaagtttaccaagtacttggtgaagcccgttcattagaaatgattcatcgtgatcatatggcaatttactaa

SEQ ID NO: 356 - DNA, 789 bp, Acinetobacter baumannii
caacttttactactcaattcaggaaatatcatggcaaatttgcatgaaattattcagtggtgcgaccaaaccttaaaagcagcagaatttaaagattacgcaccaaatggcctgcaaattgaaggttcaactgaagtaaaacgtattctttgtgcagtaactgcttctgaagatgcaattgatgcagccattgctaagaatgctgatctcttactcgtacaccacggttatttttggaaaggcgaaccgtatccaattactggtatgcgaggtaaccgtataaaaaaacttattcaaaataatatctcattagtcgcttaccatctgcctttagatgcacatccgagtttaggcaataatatcgctattgcagaaaaactaaacttacaaaatttagaaccacttgatctaactgagaaacatccaattggtaatatcggttatttagagcaagcgctttctgtagaggaatttaaagcaaaactacaaaacggttttgattttaaagtgatccatttaccggctgaaaaacaaagtattcaaaaagtgggcttctgtacaggcggtgctcaagattttattgctaaagctgctttacaaaattgcgatgcttatatttcaggcgaagtcagtgaacgaactttttatgaagcaaaagaattaagcgttcattattttgcctgtggtcaccatgcaaccgaacgttatggggttcaacgtttagcacaagcaatttcaaaacagtttgctattgaaagtgaatattttgaattgaataatccgatttaa

SEQ ID NO: 357 - DNA, 255 bp, Acinetobacter baumannii
gctgcatcactcacacttcaaggcggtgactgcatgagttgcgaaagagaagttattttgcttggtgatccggttgtatatcgtgatgacttgaaagggttcgatgaacttggtgttgttgttgaagctggctcatgtctcaaagtcttatggaatggtgaagatcatccacgatctgaaatacaagaacggttacgcggtgctcgacttgatgaagttgatgcaagtcaacggatgattcgggagaatttttaa

SEQ ID NO: 358 - DNA, 2946 bp, Acinetobacter baumannii
caaatgcaactggtaatcattttcatttgtttgtatgatgctgaaacaagattaatttgtcaaccgagttatcgttcaatgtgtgaattaacttcgatgcaagcggcctgctggtttggtcgctctggcaacgcaactttaggtggggttgctgcccacctctatgcagaatttgacggtcaatttattgatctacaaaaattacatttagcacttcaacgactttataaagaacaccctattttgagattaagtttgagtgccgatggcatcgcaaacatcatgtctgagaagactcaacagatattagaagtcgatgatttttcaaagcttagcgatcatcaaattgagcaaatgctcatgcaaaaacaggagcaatggacccatcaaaaacttgatttaagtcagggccagactgcaagattttctataagtgttcttaaaaataatatttttcgttttcatgtagatacagacatgattgctatagatccgtctagcttcttgaatttaatggaagatctttctttgttttatgaagacccagaaatatcattctcccgtccgcctaatttttttgactggtatcaaaaaatacggacagatcctgacctaaaaaaattaaaccaacgagaccgcttatggtggaaacaacgtctgcctcatattagtcctgctccgtctctacctttcattcatcaagaattcaaaacagcaaaaagtgatcgtttaagtacgtggttatcgccggaagaacgaacagcattacaacaacttgctagagaacaacatattactgtgaccaatctgatattaggtctatttgcctatacgcttggtcatgcaaccaaagatcacagcttccgattaaatattcctactttttggcgtgagccggttttaaaaaatgtcgaaggcactattggtgattttgctaatctagtcatccttgatgttgatatgaaaggaataactaccttagccgcattctgcaaacaaatagcaaatcaaatgcttgagttattagagcattcacattattcgggtgtgaatgttctacgtgacctgtcccgttatcatggtagtgcacagattgctcccgtggtatttacagcggcgctcgacttagaaaatgataatttactttccgaacgtgtccgccgtgtttttggctcaatgaattgggtcatttcacaagggccgcaagttgcacttgatgcacaagttgctcaagtagatgacggtattttagttaattgggacatccgtttagatgctctacccaaagaatggatcacgaatttatttgaatctttcattcatttacttaaaaatcttgccgcacatcctgagcaactgaatacacaaattataaactcagcacaaaatacctcgtcagatcgtacgtctcaaaaaccattaaatgcattacagcaagcttatctattaggtcgaactcaagcccttcctttaggtagtgttgccatgcaagagtttaggcagtatcacggcaaaatggatattgttttattaagacaacgattggcagaaatggtacggcggcatgacagcttacgaacctatattgataaaaataggttaatacaatatgtaagcgatcaagtgagtgtcaatttaaaagaaatagacctaactacatgggaacctgaacgtgcttctcaccacatcgaatcctataaaaatagttatacgcatgagctatttgatttaaatcagtcgccttggaatatcaccgtatttttattaaaaaataatctattaacgatttttgtccgctttgatgcattaattttagatggccgatctatagcttcacttatgttagagctatttgatggacaacaacatgatatccaaacacaaatagaaaaaaatgaagttgaaaatagcttatctgttcatcacacagatatggcttactgggaaagaaaattttctaaattatcggctattcctacgcttccgtggaaaacacccttacagcatttaccgacttcacgttaccaacgtaacagtctggttatagaaaaagatcaatttaaacagttgtctaaaattggcgcaaaacattcactgtttaaaaactcaattattatggcgattattttggaagtgctatctcattggagcacggacaaatctctatgcgttgctgttcctacacttcccctctatgccggcccattttccaatagctctacgtttattgctgttgagtggaaaacttcagatcaatttgctgaacaagcaaaccgtttgcaaactgaagttttagagggtttacagcatctttccttttcaggcgttgatctcgctcgactattatttgaaaaagttggcactgctccagtattgccgattgtaattacaaatggtttgtcatggcctgtattatctgaatctcatcctattcagcaacaagatggccttactcaaacaccccaagttgcaattgatattcgctttagcacaagaaatgacggcgctttgattttcgatattgattatgcccaagaagcattttcatcccaaatgattgaagatttcttggatgcactgcaattagcaatcaagcaaattattggttcagaaatattcagttttgatctcagcaattttttcagtgagcttcaaaagaaacgaccatattttaaaaataatgagtccgatcattcatctataccacttgaaaataatgctaaacagcaaaatcaactactcgacatttacttagaagtgataggtcacacgccaaataaggaagtggacaactcaactcattttactcatctcgggctgcgtccacatcatttaaaggtcgtttcaaaacgtatcaatgaaatatacgcgattcagctctcacctgttcaacttattcaatgtcgcaatattgctgatgtagagaaactactaacaccacattaa

SEQ ID NO: 359 - DNA, 330 bp, Acinetobacter baumannii
gttaaaaaactccgaagccgaccagaattaaaatttaaatatcaactagctttaaggcttggtcggactgttgaagagctagaaaatacaatgtcaaataaagagtttgagtactggaaagcttttaatgttcttgaaccaattgggctattccgagaggatattttatttgctggtttaggtcgtactattgcagatgcaatggtgccagggcataaccttaaacttgataattttatgatgtttaaagaaaaacagcccatgcctaaagcggaaattcaaaataatttaaaagctttctttagcggttattcaaagtctaaagtttga

SEQ ID NO: 360 - DNA, 792 bp, Acinetobacter baumannii
ccgcaattttgttcaagcgaagctgagctaaataccagaaaatctataaataataactgttatagatgtctagggatgaatactcatttaaatcaatctattagattttctaaaagccgaccaccgcatctttttttacgaggggcgatagatatattgccactatctatttcggttataccatgggctattttagctggatcaatggcagttcatgcgggtttatcattttataaagcactagcgatgtcaggaattgtgtttgctggcgctgcgcaattagtaagtttaagcatggtgatggaaggggcatcgttattaaccatctatgtcactattttctttcttactgctcaacattttatttatgctttaactttaagaaatgacatttctattttgcctctctcaaaaagattaactttaggttttctgcttaccgacgaattatttgcagtaagtgttcctaatgagaaaaaacatcctcaatacttattcggagcaggtctttgcttttatttattttgggtggtttttagtttagttggtattttattagcaacggcgctacctaacttattaaattatcatttggatttttccattattgctatttttgttgccatgattgttcctatgtgtaaagggaagcctgtaatggcaggcattttaatgacttgtgtcagtggttttgttcttaaattttttcatatagaaggtgccattctaatttctggtttattggggatgtttattgcggtaatagtcgaaaataaaatgggagaaaaataa

SEQ ID NO: 361 - DNA, 1203 bp, Acinetobacter baumannii
aaacttctttgcgtagaggatatgaacgtgcgccgcacctttacatggttaccttgggtgttacttattattgtaattgccagttttattgcatggcaaaaataccatcagccgaaaccaactgttgcagttgatggggtgcaaatgccagctgagaaagttgagccactggttgatacttctcgaacgggcggggtggtgtcttatagtgctgcggtaaaagttgcagcaccagcagtagttaatatttttacgacccagaaagttaaacaaaatcatcctttattaagtgatccggtattccgtgaattttttggaaatcaggttcctgagcaacaacagcaaaatgaaaatagtttaggttcaggggttattgttcgcgccgatggttatattctcaccaataatcatgtgattgctcaagctgaccagattgtggtggcattacatgatggacgccgagcagaagctacaattgttggcaccgaccctgatacagatttggcggttattaaaatcgatttagataaattaccagtattgccttttaagctcagtggtaatgaagttggtgatgttgttttagcgattggtaacccatttggcgtagggcaaacagtcactcaagggattatttcagcaaccggtcgctctgatttaggtatcaatacctatgaagactttattcaaactgatgctgcaattaatccaggtaactcaggtggtgcattaatcgatgtggctggtaacttgattggtgtaaatacggcgattttctcacaatcgggtggctctttaggtattggcttcgcgattccggcaaaggtttgtcagcaagtattaaactcgattttaaaagatggtcgtgttgttcgtggttggttgggtattagtttacttccacctacacaagacgatgtattggcacctaagcagcaagtaggtgtagtggttgctgatgtcttaaaaaatggtccggcagatgctgcagggattaaagttggcgataaaattgttcaggtgaataatgagccaatcacttcagcttctcatttaattaattatgtcgctttgcaagcaccaaatagcgaaattaatgttctggttgaaagagaaggtaaacaacaaaactatgttgtgacggtaggtgagcgaaaagcacagaatacacaatctcagtatattccgcttccaagacgttaa

SEQ ID NO: 362 - DNA, 1158 bp, Acinetobacter baumannii
cttctcatttggatgcctagtcctatgcaacaacgtgtcatcgtcggtatgtctggtggcgtagattcctctgtttctgcggcgctcttacttcaacagggttatcaagttgaaggtcttttcatgaaaaactgggaggaagatgacggcacggaatactgtacggcaatggaagatttagccgatgctcaagcagtcgcagataaaatcggtattaagcttcatactgcaaactttgctatggaatattgggaccgcgtattcgaacacttcttggctgaatatgcagccggtcgcactccaaacccagatatcttatgtaataaagaaattaagtttcgcgcatttttagatcatgccatgaccttaggtgcagattttattgcaacaggtcattatgctcgtcgtgctgaaactgcttataactctaaaggtgaagcatatgcacctttattacgtggtttagataacaataaagaccaaacttatttcttacatgcagtgcatggccgtgaaattaacaaaacgctcttccctgtaggtgaaattgaaaaaccggaagttcgtagaattgctgaagaactggacttagcaactgcgaagaaaaaagattcaactggtatatgttttatcggtgaacgtcgctttaatgacttccttaaacaatatttacccgctcaaccaggtaaaattgtacttgataacggcaaagaagttggtgaacatcacggtctgatgtactatacgctcggtcaacgtggcggtattggtctaggcggtatgaaaggtgcatcagaaggtgcatggtttgtacttcataaagatgttgccaataaccgtttagtggtcggccaaggacatgatcacccacttatgcaaagtacacagctttggagtgagtccattgactgggtagcaggcgagcaaaatattccggctgaaggattacgttgcaccgctaaaacacgctatcgccagcctgatcaagcttgtacagtgtttattgatgaaaatagtgagcatggtgttcgtgttgagtttgatgaacctcaacgtgcagttacaccaggccaaagtgttgtattttattcggatgaagtttgcctaggcgggggtgttattcaccatacaaacgcccctacaccaaattttatttaa

SEQ ID NO: 363 - DNA, 477 bp, Acinetobacter baumannii
cgtttaaattgtttaagctatcgacatatttcaaattttagtttcaggttatccatgtttatgaaaaaaagcttagttcaatcactttctgttgttttactcatgacaatggcaacagtgagttatgctgctgacaagaaaaaaacagctgaaaagaaaactgaaaatgaaaatgttgttgaagttacaccgtccaaaggtactacaccggaagaattagcagcaattcaagtactttctgaaatttgcccaagtttaattggtaaaaaagatgccgaatttgctcaaggttatgagcgtcttgtaaaagactatttgccaaatgaagccgatccagttgccgctttagaaaaacgtagtaaagacaagagcttcaagaaagtcttaaaagaagcacgtaatgatgcaaaagctgctggtaacgaacaaaatacgttagtttgccaagacgtgaaagcttatcaatcgcaaaactaa

SEQ ID NO: 364 - DNA, 483 bp, Acinetobacter baumannii
tgcaggaattgtttacaaggaaattttatgcaactgacattagttcgtcatggggaagctgctccgccagtaaatggtaatgatattaaacgtccccttactgcgcgtggacatgcacaggctgagcaaacggcaacctttttaaaggatattgtaaaaccagatatttttgttgttagtcctttgctgcgtgctcaggaaacgttggcgcatatccagacctattttaaagatgtgccagtgttgttatgcgacaaaattaagcctgacgatgatgcaaaagaagcgattgaatggctatctcaaattccttatgagtcgattgtggttgtttgccatatgaatgtggtagggcatattgcagagttacttactcatgaaaatttcaatccatttgcacttgctgaagctagaatttatgatcaagctgttattgcaaatggtttatcaacacaaaaaaatagttttatacccacaatataa

SEQ ID NO: 365 - DNA, 510 bp, Acinetobacter baumannii
tggtgcgattggggtggtgaaaatacaataatgaaaatgttagctcagttgcaaaaccgttttgatcagtgggttgaacaaattgttcaatatttagatcgcttaactgtccgtgaacgtattatggtggtctttactactatttttgttgtagtcgtcattgttggatattcactttggaaaatgcattccttggcagaacaacagcaaaaacgtttaaatgatttaaaagatttgatggtgtggatgcagagtaatgcagtcacgatgaagcctgccaatgagcttgagctagataagtctggaaaaatacaacgagtagctcagcaacaaggtttaactgtgtcttcccagcaaaatggggaacagttacaaattgttgtaacacatcagaattatgcaattttggctaactttttaacacaacttgcacagatgggcttaagtattcaaaagatggaaatggtttctagtgaaggtcagattaaattaacagcgacagttcaataa

SEQ ID NO: 366 - DNA, 1578 bp, Acinetobacter baumannii
gaaagcagttgcagaagcattggttgcagtgcgaggcgcgtaagtatggtggattttgcagaacatcgtaaagcgttactctgcaatgatgcacaatccattgctgactatgagtcagcaatgggcgaagcggtaaaagccgtttcagcatggttgcaaaatgaaaaaatgtacacaggcggtagcattaaagagttgcgttcagcaatttctttccaaccttcaaaagaaggtatgggtgtacaacaatctcttcaacgtatgattgagcttttcttgaataaaagcttgaaagtacaccatccacattcattagcacatttacactgcccaaccatggtgatgagccagatcgcggaagtgttaatcaatgcaactaaccagtctatggactcatgggatcaaagcccggcaggttcattaatggaagtgcagcttattgattggttgcgtcaaaaagtaggttacggttctggtcaggcaggtgttttcacttctggcggtactcaatctaacttgatgggtgtattacttgctcgtgactggtgtatctcgaaaaactggaaagacgaaaatggtaacccatggtctgtacagcgtgatggtattccagctgaagcaatgaaaaacgtcaaagtcatttgttctgaaaatgcgcatttctctgtgcaaaagaacatggcaatgatgggcatgggcttccagtcagttgtgactgtacctgtgaatgaaaatgcacagatggatgttgatgctcttgaaaaaacaatggcgcatcttcaagctgaaggtaaagttgttgcttgtgtcgttgcgacagcgggtacaactgatgctggtgcaattgatccattgaaaaaaatccgtgaaattactaataagtatggttcatggatgcatatcgatgctgcgtggggcggtgcactgatcttgtcaaatgactatcgtgcaatgcttgatggtattgagctgtctgattcgatcactctcgacttccataagcattatttccaaagcatcagctgtggtgcgttcttgttaaaagatgaagcgaactatcgtttcatgcattatgaagctgagtacttgaactctgcttatgatgaagagcatggcgtacctaaccttgtgtctaaatcattacaaacgactcgtcgttttgatgctttaaaattgtggatgaccattgaatcactcggcgaagagctatatggttcaatgattgatcatggtgtaaaactgactcgtgaagttgcagattacatcaaggcaactgaaggtttagagcttttagttgaaccacaatttgcttcggtattgttccgtgttgttccggaaggttacccagttgagtttatcgatagcttgaaccaaaacgtagcagatgaattgtttgcacgtggtgaagcaaatattggtgtaacaaaagttggtaatgtacagtcattgaagatgacaacattaagccctgtagtaactgtcgacaacgttaagaaccttttagctcaagtattggctgaagctgaacgcattaaagatgcgattgcttctggtaactacgtaccaccaatcgactaa

SEQ ID NO: 367 - DNA, 696 bp, Acinetobacter baumannii
gaacagtactgtttgatagaaaaaatcaaacaggctgcttcatttttatattggggaaaaatgatggctggtttttatcgaaccaatttgggaaaagtcgcgcttcaacaacgtaatattgctttaaatgccaaacaaagacgtttacttctattaattgatcatgaagattttcaaagtctcaataccgagtttaaaaaacgcattgctccaccagaactcattcaacaacttattgacttaaagcttattgcccctattagcgaaaacgattcagaatttactgaacaaatacctctcttagtatcacctaccacgagtttagaagtaaaagcgcaacaaaaaagcactatagatgaaaatgaaagtgccgatttgactggagaaattaaagtttctctagaaccatcatgccattcttcaaatattgaaaatactcagccaccaattcctgttcaacaacttacttttgaagaaatacaactattaatgaaacaaagcttaagccaatactgtggacttatggccaaaccacttattcagaaaatagaacaaattaaaaatcttcaagaactgaaaatgtgccaaatgcaatggattaccagtttgcaagagtcaaggattccccctcatgagctcgcacatacgctttactctattaattattcaattcagctcattcagcaaaagaactaa

SEQ ID NO: 368 - DNA, 324 bp, Acinetobacter baumannii
tttgccgcatgcaaaagaaagtattactgcatctacattggcttattcagcgagttaaatatggcacttttaattacgagtgactgcatcaattgtgatatgtgcttaccggaatgccccaatacagctatttttgaagggagcaaagtttatgaaatcgatccgctttgttgtacggagtgcgtaggcttttacgatgcgccaacatgtaaggctgtttgccccatcgattgcataaaacaagaccctgtgcatattgaaaacaaagaacaattattagagaaatttaaaggcctgaatttaatcggctcattctcttcttaa

SEQ ID NO: 369 - DNA, 504 bp, Acinetobacter baumannii
ttgattgaatggatcaaaaacatgactgcaattgcaaataaccacgtggtttcattccactataaattaacaaacgctgagggtgaaacacttgatcaatctcaaggtgaaccacttgcctatttgcatggcgcaggcaacatcattcctggtttagaaaatgcattaactggtaagactgttggtgataaattcactgttaacgtaccagctgctgaaggttatggcgaatacaacccagacctagtacaagaagttcctgctcaaatgttccaaggcgttgataacattcaaccaggtatgcaattccaagctcaaacagatgacggcgttcaaatcgttactgttaaagcggttgaaggtgacaacgttatcgttgatgcaaacttcccacttgctggtcaagatttaacgtttgaagttgaaatcgtagaaatccgtgaagcttctcaagaagaattagatcacggtcacgtacacggtgcgggtggtcaccaccactaa

SEQ ID NO: 370 - DNA, 669 bp, Acinetobacter baumannii
aacttgagatgtgccaagcacagtctttataggctttgctgtgcctttttttctcccaaaaaagtatctcatttacaaacaacaagaatttataacggtaaaactatgccaaatttagttctcccaacacgtgccttatacgttgtaaataaagcaattgatctgtttcatcaccgtgggttccaccttattggggtcgacagaatagtgagagaatcagagattacaaaagcgactttttataattattttcactctaaggaaaggcttattgaaatctgcctgatggtgcaaaaagaaaagctccaagaacaagtagtcgcaatggttgagtatgacttaaatacttccgcaatcgataaactcaaaaagctttatgacttacataccgatctagaagggccgtattatttattatttaaagccatttttgagattaaaaatagctatcccaacgcttatcaatccgcagtgcgctatagaacatggctaaaaaatgagatttatagccaacttagattgcttaaacccgatgtctcttttaccgatgccaaactatttttatatatggtggaaggcacaatcattcagcttttaagctctggtggggtaagcgagcgagagagtgtgtttgaatgttttttaagaggaataactacatgcaaatga

SEQ ID NO: 371 - DNA, 1143 bp, Acinetobacter baumannii
gcaattcagtggcttataagtctttttttatgcctatttgtcgcatttaataattggcagagttggaaattttggcaaaaaatggcaatatttccacgccatttgcgacaaatctgcgacaaaatgaagttaccgacaccgcgtaaaagaggtgagacatacacaataacagtttctcatcaaggaaagcgctattattgcacccgtgatactgcaaaagaatgtgaacaatgggctgctctcaaactgctagagttaaaggctcagaaaaaaattgaaagtggtgaagaaaaaccaaaatttctattccgtgatttgaataataaatattatcaggaagtaggaatgctaaatccatccaaatcatcaagagcatggattaaagggcagcataaaaattttgaagtgaaatttggggcattagctcaaaaatcaatttatgacattacaccaaaagatttaacaaattggcgaaataaacggttatctgaagtaagtgaaaatacagtattaaaagaaatatcacacttcagtgcgatgtttacattcgcgcaaaaagaactgtttttgattgatgaaaacccttggatgcaaatgacaaaacccaaaaagccaaaagctcgggaccgtcggatacatccttcagaaatagatttaatgctaaaggctttagattatgaaaggggcagtgttcctgtgttgccacagcactatgttgcatggggctttttgtttgcaatagagactgccttgcgtcgtggtgaattgttggcaatggaaaagaaagatatttatgacggctatgttcacctaccaaaaactaagaatggagattcaagaaacgtaccgctatctgaagaggcaaaagagttattaaaattaattcagcatactgggcgcaatattattcctcagtctgaaaatgcatttcgattaatgtgggaaaaaagaaaagcgagtattggccttaataatcttcatttccatgatactcgtcatgaagctattactcgtatggttagagtcagaaagttacctgttgaggtgttagccaaaattactggccataagaaaattgatgtattggttaatacttactataaccctgatgcaaccgatctgattgaagcatttaacggataa

SEQ ID NO: 372 - DNA, 2397 bp, Acinetobacter baumannii
ttgctatggtggagatctaatatgaatcaaaccattgacttaaatatttctaaaaaatcagctaaagcaggcgactcgattccacatgaaagtgcacatttacatgtgacggggcaggcaacttatattgatgatttacccgagcttgaaaatacattgcatttggcagtcggattctcgaattgtgccaaaggcaaaatcagtaagtttgatttagatgcagtacgtcaggctgaaggtgtttatgcagttttttcggcaaaggatattgaggttgaaaataattggggaccaattgtaaaagatgacccaatttttgccgaagagcaggtcgaattttatggacaagccttatttgtggtcgttgccgagagttatcagcaagcccgtcaggcagttcgtttagcaaaaattgagtatgtgcccgaaactccgattttaacgattcaagatgcaattaaaaaagaatcgtgggtgttaccacctgttgaatttagccatggtgaagttgagcaagcatttcaaaatgcagctcatcaactttcaggtgctattgagctgggtgggcaagagcatttttatcttgaagggcaaatttcctatgcgattccacaagaaaatcagagtttaaaagtctattgctcgacacaacatccaaccgaaatgcagttactgatttgtcatgcattaggcatgaatatgcatcaggtgagtgtggaaagccgccgtatgggtggtggttttggtggtaaagagtcacagtcggcgcagtgggcatgcattgcatctttggcagcaaaaaaaacgggccgtccatgtaaattacgcttagatcgtgataatgacatgagtgctacaggcaaacgtcacggttttgcttatgagtggtctgtggcttttgatgacactggtattttgcaaggcttaaaggtacaactggcttcaaactgtggtttttcggctgatctttctgggccagtgaatgaacgtgcgatttgccatattggcaacgcttattatctaaatgcagttgagctacgtaacttacgttgtaaaaccaatactgtttccaatacggcatatcgtggttttggtggaccgcaaggtatgtttgtcattgaaaatattattgatgacattgcgcgttatttaggttgcgatccggttgaaattcgtcagcgcaatttctttgccgagcagcccggtaggggacgtgatcgtatgcactatggggcagaaatccgtgataatgttgcgccaaaattggtagccgaattattgcaaagtagtgattacgcgaagcgtagacagactactcatgcctttaatcagaacaatgacatcattaagcgtggtattgcgttaaccccattaatgtttggtatttcatttaacgctgtgcattacaatcaggcaggtgcactggtctatgtgtatatggatggtactgtcgcgattacacatggtggtacagaaatgggacaggggctatataccaaagtacggcaggttgctgcacatgagttgggtttacccatcgatagcgttcgtttaattgcaaccgatacttctcgtgtaccaaatacttcggcaactgcagcatcgagtggcgcagatttaaatggtaaagctgttcaaaacgcctgtattaaaattcgtgagcgtctggcaaaacttgcagcagacataagcgatagtgacgcagggctagtccagtttgaagatagtatggtcacaacagcgaatggtcattcatggacatttcctgacttggttcaacgggcatatatggcacgtgtacaactatgggacagcggtttttataaaacgccagaaattcactatgatcaggtcaaccatttagggcgtccatttttctattatgcctatggtgcggcagttagtgaggtcgcaatagataccttaactggggaaatgaaagtattacgtgccgacattttgcatgacgtcgggcggtcaattaaccctgcaattgatattggacaaattgaaggcgggtttgtgcaagggatggggtggctcacgacagaagagttgtattggcagccgcaggggccatacgcaggccgtttgtttacccatgcaccttcaacttacaaaatcccgaccagtgtggacatacctcatatttttaacgtcaaactgtttaataatcaaaatcaggcagacaccatctatcgctctaaagcggtaggtgaaccgccatttatgttggcattatcggttttctctgcaattcgtcaggcagtacaggcagctattccagaaaatgcaccgctcgtactcaatgctccggcaactgccgaggaaattttacgtgcaattgcgattggacggggacaagctttggctgctcgcccacaggctaaaatgtag

SEQ ID NO: 373 - DNA, 210 bp, Acinetobacter baumannii
tttatgactcgcgacgatgcaatcaaactacttaactgcacttattcagagcttgcagacaaattaaagctatctacggcagcggttgcacgctgggcaaatcgtgaactcccatatgatcgtgaatatgaaattcttgaacttgcggctggccgtattcctaaacgccttttgaaagcagaaaagaatttatcccaagcaaataattaa

SEQ ID NO: 374 - DNA, 1146 bp, Acinetobacter baumannii
acaaatgctcggacatggagtccttttatgatgaaaaagtcattattttgtatgacagctgccttatttgctctgccaacagtcacttccgccgcttccccatattttagtttaaaagatggtgatggtttcaaacgtttttcagtctcagctggttggctccatgctatgcctcaaggctcaggaaaccctgtcaatatcaatactagcgttgcagaaggtacaaaatctaaagttggagatgtatctacaaaagccgttttagacgcaatcgatcaaagtaaaccttcaggacaattttggcatagcactattagccttcttgataagtttacagacactcttccctcatcacttgcgggtacagcagaaattaatggtctttctcaatgggaacaacaaggttctggcttagaagctgctgatgttgataccgttggtcttatgtttaactacaactttacggataatttatctttagaaattaaaggtggtattccccctaaagtagatattaatggaaaaggtaatatttacgctcccctctctggaaaagcgactccactaaaagatggatctgtgattggaggaatcatcggagatggtattgccaaagcgggtggagatattcctttaaagcaagacattcatattactgatctttctcaaggcggtaaggctgcgaccgcacgtgcatggttaccagctgttgagctacattatcaatttggtaaaacaggtgtaaataagttccgtccttatatcggagctggcgtgatgtatgcatactttaatgatttaaaaatgaattccggtattgaagccgatttaattcaagcgggtcacatgatccagaatatccatgataataaagcaggtgcagcattagatcgtaaaacatcttctgctaatcctattgtgaaactagaagcgacagatacatttgcacctatcgttaccgtaggagcaacttatgattttaatccgaacttgtttgctgtaggctcagtttcttattcgaaaatgaatagcgaagcaaaaatttacgtgactgatcaaaatacaggtaaagaattaattcaggcaaatagcaaaattgatattgacccgcttattacttatttaggtgtgggttaccgattctaa

SEQ ID NO: 375 - DNA, 1023 bp, Acinetobacter baumannii
agtgccgatcggacttaccgcaggtggtgtggggggaattattttcctcatcctcattttgagggagttcagataatgcgcattacaaagctgtggatgatttatctgattgtcatttgtctagcagtttgttttttatttttaaactcaggactagattttgattacgtcattcctaaccgacttctgcgtcttgccacgattgtgatagccggtatttgcgttgctttttcctcaattgtttttcagacattggtcggtaatcgtattttgactccctcaattatgggctatgaagcgatttatctcttatggcaagttttgttgttgttcttttggggaacacatggactaagccagttaggggtaaatggtaatttctttatctctatcgttttaatgctgctttattcgtgggtaatccataagtggttattgccatatggcagaaatgatgtctttctcctgttgcttttaggcttagtccttacgatggtcgtcgggacggttactcaatttattcaactcaaaattaatcctggtgaattttctgttttccaaggccttagctatgcttcttttaatcgctctcaaccagaaactttattttatgccagcctagccgtagtcattgttctattcctcggtagaaaagcgctccctgttctggatgttctggttttagggcgtgagcaagccatttcattaggcattgatcatcaccgctatgtcagtttctatttagccctgatcgctattttggttgcggtatctaccagtctgattggcccaacagtatttatgggcgtattcattgccaacattacttatgcactagcaagaagctataagcataaattaacgctgcccataggctgtgccatcacgattgccatatttattgctgctcaaattttagttgagcacgtttttaattacaaaacgaccgtcagcattctggtcaatctggtatgtggcatttatttccttgcgctgacggttcgtacccgaggtgttgcatga

SEQ ID NO: 376 - DNA, 222 bp, Acinetobacter baumannii
catgaggtgctcctagttatttggatacctgttttcagacttttagttatggtccgtatgggagaaacagggtttatggaatggacggagcataaaagtttgtcaatcacgaataaatatattaaatttgataacactattcgtatttttataacaattgatgtgtttgcactagaaaatgcattaataggagtgtgcgtgtggatctatttcatgccatga

SEQ ID NO: 377 - DNA, 861 bp, Acinetobacter baumannii
agcaaattacgattgctcaacatgaccgtatcgaaattattcacgctgttggcggcggctaagtcggagttatccatgcaagacacccctctcattattggttcacgttcttttcaatctcgtttattggtaggaacagggaaatataaagacttaaatgaaacggatttagccattcaagctagtggtgcagaaatcgtaactgtcgcaatccgccgtgtgaatattggacaaaatccagatcaaccgaatttactttctgtcattccaccagaaaaatatacaatcttgccaaatactgcaggttgttttgacgctgacagcgcagtacgcacgtgtatgctagcgcgcgagctactggatggtcacaacctagtaaaacttgaagtgttgggtgatgaaaaaactttatatccaaatgtaaccgagactttaaaagccgctcgcactttgattgatgacggttttgagattatggtctatacctctgacgacccaatcattgctcaagaacttgaaagtatgggctgtgttgcgattatgcctttaggtagtttgattggttcaggtttaggtattttaaacccacacaccatttcaattattaaagaaaatgccaaagtaccggttttagtagatgcaggtgttggtacagcaagtgatgctgctattgcgatggaacttggttgtgatggcgtattgatgaacacagcgattgcagcggctcaaaatcctattttgatggcttctgcaatgaagaaagctgttgaagcaggacgtgaagcatttttagctgggcgtatgccacgcaaacgcatggcaaatgcaagctcaccagaaacaggttatttctttaagtaa

SEQ ID NO: 378 - DNA, 1845 bp, Acinetobacter baumannii
gtctttatgcgcgattatttcaaaatcgcacttcagtattgccatgacgtgcgctctggagtgcgaacggcagggcagctagaaaaatttgctgttaaacgttttttaaatgacttaaatcgttccggtattcctttaggttcaggtgatgaagagttagaaaaattacttacatcattaaagatcggcacgaagccaccagatattaattttgaatttaaatttgatgtagagcgcgcacaacatgcgtgcttttttattgaaacctgtccccatgtggaaggggaattagcacgattaaaacgtgatggaacccgacatttattagtgatgtcaccgtggcaggtttttgtcacggttaatatttttgggtgggtaaattatgaaggtttacgtcgcttcacatacgtctatctggaagttgctaagaaaaacggaaaaactacgtggcttgcggctgttggtttgtacatgggattcattgatggagaaccaggtgcaaatgtatatgctgccgcaacgacaagagaccaagccaatattttgtttggcgcagcaaaaacaatggtcgcttattcgccaaagatgcaagaacgctttggtatcactaagcaagagtattcgattttccaaacgacaacaaattcgtcgtttaaagcgctatcacaggatcgggacggatcaaaggacggttataacgttcactgtggcctggttgatgaattacatgctcataaagattcgggcatgtatgacattgtatcaaacggtattgcttcacgaacgcaaccattactttttgcgattacaactgctggaaaagatacgacatcggtttgctatcgtgaaagaaaagttgttgttgcaattcttaagggtgaagcaactcacgaaagatatttcggcatgattttttgcctagataagggtgacgactggaaaaaccctaaaaattggcctaaagccaatcccaactatggaatttcggtaaaacctgaatatctgcaaggaatggccgataagtgcaagatttcaccatcaaatgaagcgatttttcggcaaaagcatttaaatgaatgggttggcgcggtagacggctggcttgctgaatctgttgtgtcaaattgtgaggttgaagtctcctataaaaaatttaaaggcgttgtaggttttggcggctatgacttggcaagtcgattagaccttgcctcatgggtggagatgaggccagattttgaagatggaaaaattatttggtatgtctttgctcatagttacatcaatgaaagagtaatggagtcaaccgaagcaattaacggtgagatgcgaccggatgattaccctgtttggcgggatgaaggttggttgatagaaacaccaggtgcttcaacagatttcaaccgtatcaaagaagacattcttgaacatcataatgactacccattttatgaagttggtcatgacccatatcatgctgagcaggtaactgctgatctactcgatgcgggtttaaatgtaattgaagttcctcaaagaactgaatatttaaacccggcaatgcgttggattgaagttttgatagctgaaaatcgcatacgtttttgcggtgatccagttttaaagtggtgcattctcaatgtggtagttaaagaggatgcaaaagagtgtatttttcctcgaaaaatttcacgcgccaaaaaaattgatgctgcggttgggatgattattgcagcttcaagagccatgtactgggataaggaagaagtttttgaacttgtaccaggcgaagagaatgggaattttgatgattttctgagtggtatgattaaggtatctagacgatga

SEQ ID NO: 379 - DNA, 408 bp, Acinetobacter baumannii
ataaacatgcgaatgcttcatacaatgttgcgagtaggcaatttagaacaatctttaaagttctataccgaagtattagggatgaagttacttcgtaagcgtgattatgaagaaggtcgctttacactggcatttgttggttatggcgatgaagaaaataataccgtgcttgaacttactcataactgggatacctcaagttatgatttaggaaatggctatggtcacattgcgataggtgttgaagatgcttataaagcatgtgaagaaatcaaagcacgtggtggtaaagtcgttcgtgaagctggcccaatgaagggtggtgtaacggtgattgcatttgttgaagatccggatggctacaaagtcgagcttattcaacaagacgcaaatgctagaaataattaa

SEQ ID NO: 380 - DNA, 231 bp, Acinetobacter baumannii
tcgacgatgcgcgccgatattcacccaaaatatgaaaaattagttgcaacttgttcttgcggtaacgtaatcgaaactcgttctgctttaggtaaagaaactatttaccttgacgtatgttcagcttgccaccctttctacactggtaaacaaaagaatgtagacactggtggtcgtatcgacaaattcaaacaacgttttgctggtatgtctcgctctatcaagcgttaa

SEQ ID NO: 381 - DNA, 1197 bp, Acinetobacter baumannii
cgactccttagacgacttgtaatcgtcatattaacggagcaaaaaatgattttatcgcctgctgatcaagagagaatagagacattctggaattactgtttaaaacatcaatacttcaatattggatatcctgaatctgcagattttgattattccgctttattccgttttttcaaattctctattaataattgtggtgattggaaagactatagtaattacgcattgaattcttttgattttgaaaaagatgtgatggcgtattttgctgaaatttttcaaattccctttgaagaaagctggggatacgtaaccaatggtggcacagaaggtaatatgtttggctgctatctggcgcgtgagctatttcctgattccacattatattactcaaaagatacgcattattcggtgggaaaaatcgccaaattattgcagatgaaatcttgtgtgatcgaatcattggataatggtgaaatcgactatgatgatttaacccataaaataaaaaccaataaagaaagtcaccccattatttttgcaaatattggtacgaccatgaccggtgcaattgatgatattgaaatgattcaagagcgcttagcgcaaatcggaatcatgcgccgagattattatattcatgccgacgctgccttgagtggcatgattttacctttcgttgatcatcctcaagcatttacctttgctcatggcatcgactcgatttgtgtgtctggtcataaaatgattggttcaccgattccgtgtggcattgttgtggccaagcgccaaaatgtagagcgtatatcggtagatgttgactatatctctacacgtgatcaaaccattagtggttctcgtaatggtcataccgtcttgctgatgtgggcagcaatacgtagccaaaccaatttacaaagacgacagagaattcaacattgtctaaaaatggcccagtacgcggttgatcgctttcaggcagttgggattcctgcttggcgaaatccgaattcaatcactgtggtatttccgtgtccttctgagcacatctggaaaaagcattatctggcaacctctggaaatatggctcatttaattactacggcacatcaccgagatacacgtcagattgatagcttaattgacgacgttatttttgatttacaaggtgcctctaaacgtacagttggtttttag

SEQ ID NO: 382 - DNA, 909 bp, Acinetobacter baumannii
ggagatgagctaatgtctaatcttcttaatatttgtggaattgtaatcgcctctagccaatatccagatgccacattacaacaattctatcgacaatattatcattgcgaaattaaagctgagcaaataaaagccgagattcaaagtcctagtgatctttccatgtttttcccttaccaagatacatggtggcctgtctttacgattgatcagattagctctgaaagtttccaaaagtttatccataacggaattagacccggcattatattgccagacgaagtatttggttttccacactatttcttgttaaaagaagcagtaagccaaggtgctattcctattgtgctttttaaaactgaacaacctcaatattttgccgcaaaagcaactttttcgaccgctattggtttacgcccaatggctgcttttgtgagtacgggatgggatgaaaatttaatttctcaaccagcgggtagttatattatccagctaaattcagcaaatttaccattaccctcaagagaagtcagacaaggccaacatttattttactcggccaagggttttgacggtcatgtttcaggttatgaaattattattaatccccctgccgatttacccctatctaatattcgatatcctcaactcggcatttcttggaactttaataatattgattatgagagtactcctgaacatgtaagtacgaatcttataggttatatatttattgttttaagtattgttgttgttccacttgacctgattttaacaacgacgtatccagatctactcggtacatttggtagctatatttcatggatctccttagtggtcggggcaattttattattgctgctcatctcttctattattaggagggtccgtaaaaatggctccaattga

SEQ ID NO: 383 - DNA, 666 bp, Acinetobacter baumannii
tctgtaaatagcctaagtattgggagttttaatatgcaagatgcaattgccgttcaaagtctaaaaacagacattgctttattacgccagcatatttttccaccccaatatttggagcatgtagaagggctgccaatttattatggtttgcaagaagaagttgtggcctattatcagcaatggaaagatttaatagaaagggcacaagagctttttcaaccttttatggaagatgaattaccagatgcaattcatttaccaagccatctaaacttacccttattctttttccatgtagaccgtattcgtattaataaaacacgcgcaaaagaatcaaaaactttccgaggtgttgcgagtcttattgaaaaatgtgggcagtttgaaacagatcagatatttaccatgcaagaatggttgcaaagtgatgatacagcagcgctagttgcacaccgtgaatttattgatttacggacgtatgtattccagcatggtcaaagtgaatatacgcgttcacggttttataccaatggtattgtgttaggggtagagccacactttaaactcgtcgatgctcgcgataaaccaagaaaacagcgtagtgatagctatagcgatccattagcagataacggtgtatggaaagtatttggtaaatatagataa

SEQ ID NO: 384 - DNA, 1134 bp, Acinetobacter baumannii
aacaaagatagcccttctttaggtttatatatgaaaaaacaattgccaaaaatttctacaacaagtaaagcgcttgctaaaagtttattgcttgcacaaggcgttttagaccaagcaaaaaaatattcaactcttccttttactcaaactcatatcatccgtccacgaattgacgaaaaatattatagctggacacactacggtatctttttcccacttttaccagagccgcatcgttacttaaatattatgattttaatcggtacaccaggtgcacttgcttttgatcatgatgacatcatcactggtaacccgagacaaaccgctactttcttttcaagcacagctgctctggaacaagctttactgaaggcctatatcattcctgaaaatacaaaaattaataaagatgggaccttaatagaactaggtcaggaaatttcaattcaaggaaaatttccacacatccatattaatggacattatgatgggtttgatttcgactttgatatcgatatcacttcacatgtttcatggtttataaaaacaccaatctatgatcattttagtttattggcaaagtttaaaggctttttaaactatcaagcaaaacgcattgaaacccaaggactttgtacttacgaatatgcacgagcagtgggtcctcattccattacaaacaaacttattcctgatgcatataaactgccacttgatttttttacttatcaaattatcaatttaaacgaggccactcaacttcttcttaccaaagccgatattgcaggacaaacagctgcatacaccctgcatattagacatctggaccagccagctgaaatttacacagatgtaagctttgatattatttcgcatcaagttgatgacttcgtttcacctagtgggcaaaaaatgcgacttccaaaatatttttcatggatcgctcgaaatgatgcaaagcaaattatcttaaacattcaggcagaaattgactgcccattccgctatggtcatgggcgaggttatgcaagtagctatatatttactggtcattattttggcaatgaagttcaaggccgtggatacatcgaatatattgatatcgaaaatccacaagcctttgacgatgaataa

SEQ ID NO: 385 - DNA, 543 bp, Acinetobacter baumannii
atggctgtcagatgcgttgggagtaaatcaatgattgaacttacacctgaacaacttgctgtacttgaccagtcagcgggtccaattggttggcttgagtctgttgaaatttctcatcagaattggccgcaagttttgcgttatgtggttaattcaagtgagccaattttattaacacatgaggacggtcaaacatttgaatatgtctatgtacctttaacgattaacagaggcggtgatgaggataatcttgatcaaaagcttacggctgttatcggtgatgtgggcaccattgttccggatttaataaagttggtccttcaggatgatgaaattactccacctattttaaattaccgtgcatacattattggccgttatgacgtacctgcgtatgtagtaagggacttagaagttgtgacggtaacacgtgactatcgtggatctagttttgaagcacaggcgcctggcttaaatgattcaggaaatggggaaatctattctgcaagtacagatgaaagtttagaaggtttttatgcatga

SEQ ID NO: 386 - DNA, 1269 bp, Acinetobacter baumannii
aaattcttaaggttgaattacatgtttgttcgctcattactcgctatgagtttaagttgtattattgctaatgttgctttggctgcgtcaacaactgagcaaccactgaaccctaataaagtatctgctcctgtagaagatccgattgatccgcttgctgtagatgctgcttcaactgtaaaagctcaagctcagactcagattactgcacaagaacaaaatgacctaaatagagcgtctacaacattacaaaatttacaaaaagctgaagaccaaaatgctgattcaggtattgccgcttcaacgccagtagctacggctaaaaccacaacagctactgcgtctacagcaacttctgcgccagcggttacatggacattagatagcttaaacaacgctgagtggtatgaaaatattggcaaaggccaacttccagtttatgcacgcgctcacgttatgcttaataatgcacatgcttcaccgggtgctatcgatggcatgagcggtaaaaatacattaaaagcaattgcatctttccagcaaatgaatggtttatctcctactggcgagttaactaaagagacttgggatgcgcttgttgctaaacaaaacaaaccagcatttattgaatacaccattaccgatgccgatttaaaaggtccttacgcacaatcaattccttctgactatgctttacaagcaaaaatgaaaggtttgtactacacacgcgtaagtgaaatgttgggcgagaagtttcatattgatgaagccttcttaaagaaaattaacccgactgcgacattcaaaaaagttggtgaaaaaatcattgttccaaatgtacgcaatgacttaccagaagatattcacttgattattgcgcataaaggtgcaaaacagttgtatctgtttaacagccgtaatcaaatgattgcgtcatttcctgcaacaattggcagtactgatacgccatctccgaccggtacttacaaggtagtaggtgtagcacgtaacccttggtacagctactctccttctaactttgtacaaggcaataacttaaaaccgctttcattaccaccaggtccaaatgctcctgtaggtaatatctggattggtttaagcaaaaaatcatttggtattcacggtacaccaaacccgtctttaatttctaaaactgcatcacacggttgtatccgtttaacgaactgggatgctaacgatttaggtaataaagtacgttcaggcgtaactgttaaattcttagaataa

SEQ ID NO: 387 - DNA, 1458 bp, Acinetobacter baumannii
tttttaataagagaagaacttttgaaatttttgccagttattttaagtttggctttgataacaaatgcctcttacgctaatccttttgaccccaagccagcttctggacaggttgaaattccaaatattggaagtggaatagggctgctcgaccaacagaaagaaaaatttattggcgaaaaagttttccgtgaagttcataagcaaatgccggttatacaggatgtatggctagaagatcagttttttcaagttttctctaatattttaagtgaaactcagctggggcagcctatcgccttggttgtaattaaagaccctcaaattaacgcatttgctgttccaggtgggttatttgcattaaatactggccttatctcatcggcacgaaatattgatgaaattgcgggggtaatggcccatgaaattgctcacgtttcgcaaaggcactttagtcgttcggaagaagcttttaaaggacaaacccttttaagcttggctggtttgttggcaggggtggctttagctgctcaggctggtggagacgctggtgccgctgttatgttgggtactcaagcagcacttcttgataaacagctcacttatagccgtaatcaagagcgtgaagcggatcgaattggtatgcaatatatgtatgccgctggttataacccgcaaagcatggcggattattttgaaacgatgcatagagcgacgagccgtgtaagttttttaccagatttttggctgactcaccctcttacatctgaacgtatgagtgaggctcgcttgagagcaaaccagatgcctaaagttaaaagtcgaatatatgatgtcgattttgaaattttaaaatggtataccatggtggttgctggagaagctactgaaaatcagttgcaaagtctggcatcgcaaaaaaatctggcaggcttattggctttgtcggctttctatcttaaacaaggtgattatactcaagcccaagcaacgttggagcaggcgaaatcaagcggtaagccattagttgccttaattcaaacagatatttatttaggccagaataaacttgatcaggcctataattcaattgctcctttgcaaatgacaatgcctgaaaataaagcttttagctacaaattggctgaggttttattacgtcaaggtaaatatgctcaagtgcaaactttggtgcagcgttttattaataaaaatgcccgagatattcaaggttggcaattattacaacaagccgccaatttagataaaaattcaccattaagagctgtgaatgtattacgatatcgtgctgaagcacagtactggtctggtagtgaagaggatgcaattaaatcgatgttgcatgcacaacgtcttgcaaaaggtaatcaggccatgtcagccagaatagatagtcgattaaagcaaatgcaagatgagcgacgaatgaaaatttaa

SEQ ID NO: 388 - DNA, 1623 bp, Acinetobacter baumannii
agagagataagcatgtctgatttaaagttatctcatctgatgacagactcttccttggcacctgcactcaagccagcatttcctaaattatttgcaggaacacttgctgccgtattttctggtttagccattttaactgctctgtggggcatgattcagttgattggttatttatcttcttattgggtgatcttttcagcggttttttggatagtcggggcggcattggcagcactagcttcatggttagtgcatgatgcagaggctggattttcggcacgattacgtcgtcaaattgctcatcatttaattcggttacctaacacaaccctatcaaaacagggtgaccaaaacttaaaacgactggtttcagacgatatcgcaactttacatcatatggtggcgcatttaccgtcggaaattgcgatttttgctgtaatccctttagtttctattgttttattaattgctttggttggcccgatggccctttgggtattattacctggggcaattgcttcactctattatttaattattgttccccatgtatcaaaacgagatggcgctgcacgtatgcaggtcatgttagatattattggttctgctgatgattatgcacgtggcattcgtgataatcgaatatatgggcaacaatcaggcgctttaacagcctatactcaatcagcacaaaatttcactcaaaatatggtgtcttgggtgagtaaagtcgcaacactcgctgctgttgccactgcattactacaagctgttgcaacctttgccatagcctattttgtagcttatcaatacgacagcatgaccttggctgcaacacttttctttagcttggccatcgtgacaccttcgctacgtttagggcatggtcttgattatgtcgctgctgggcgagctgcagctagtcgtttatctgctttcttaaaagagccagtactctcatcgggcaatctacaacagattgaggaagatgtaacacttgaaatagtgaatgcaagctttgcaattgaaaatcaaaaagtattcgatcgattaagttatgcatttccaaaaaattcaattactgcaattacagggccaagtggagttggcaaaacaaccttactgcgagcacttgctggattagccgtattgcaagaaggtgtcgttcaattagcaaaaacagatattttgcaattacatgaaaaactaaggcatgaaaaggttttgtttattccacaaggtggagatgtattaccgaccacagtaagagaaaacttgtccttatctgccgttaatgcaaatgatgcacaacttgagcaggcattactcaaggcccaactaaaagtagatttaaatgcagatgcaactttactttcaggcggtgaaaaacagcgcctaggaatagcgcgtgcgtttttatcctcagctcctattattttattagatgagccaacgagcgcactcgaccagaccaatgcgacaaaaataatattggaattaaaccacttagctaaaaaccagaatagaactatcgtcatggtcactcatgatcttgccttagctgctcatgccgacaacaggttagtgcttaaaggcccaactgactcagggaaatctttatga

SEQ ID NO: 389 - DNA, 1608 bp, Acinetobacter baumannii
agcttctcaagaagaattagatcacggtcacgtacacggtgcgggtggtcaccaccactaagtcttcttttagaagataataaaaggcaaagcttcggctttgctttttttatgtctttaatttatataatattcatagagttaatttattttttagggacttgcatgtcaaatgcttatcagctcatttggtttcgccaagatttgcgtatacatgatcatgcagctttatggcacgccagccagcaaggaccttcactgggtttagtcatcttatcgccagagcaatggaaacaacacgccgatgctccaataaaaataagtttttatttacgacaactcagaacgcttcagaaagagttatcagcacttcatattccactagttattcaagtcattccctattggaaagagatcgcaacctttatttctgatttcagcaagaaatataatattgaaaatgtgtatgccaatatcgaaataggcgtaaatgaattaaaaagagataaaacggtacaagactatttaaatcggcatggcaaagaactatttttattccatgaccgtactatttttcctttacgttcaatccgtaaccaatcacaacaaccatatcaagtatttagtgcattcaaaaaagcttgttatacaaagctcgacacaagcggtttgcctcaatgttatccggtccctaataaacaaaatgaagtaccactagattttttacagggaaaaaatattgatttagacgaaattgaaaagctattttgctcatctctctcaaaagaacagcaagatttatggcctgttggcgaacaatacgcattagaacaattagatcaatttattgaacaatcggtttgtcactataaagtcgagcgcgattttcctcatatacaagctacaagtaagctttcaccttatttaaatattggtattttatctattcgacagtgtttacaagcactctttcgtaatcaacatggcaactttcacttagtcaatgaaggtcaacaaacatggttagacgaacttctttggagagagttctaccaacatattttatttgattttccgcatgtttctaaacacatcccgtttaagaaagatactcagaagattaaatggaatcataatccagaacatttaaccgcatggcaaatgggtcaaaccggtattcctattgttgatgctgggatgcgacaacttttacaaacaggctggatgcataatcgagtacgtatgattacagccatgtttttatgtaaaaatcttttgattgattggcgcattggtgaacaatggtttatgcgacatttaattgatggtgacctcgccgcaaataatggcggttggcaatggtgtgcctcaacaggaacagatgccgtaccttattttcggattttcaacccaattgctcaatcaaagaagtttgatccggagggagaatatattcgccaatgggtgaaagaattggctcatttggacaataaaacgattcatgaaccctactcaagcaaaaccgatcttggtttaaattatccaaaacccatagtaaatttaaaagaaacacgccttaaagcaattgaaactttcaagaatatttag

SEQ ID NO: 390 - DNA, 2478 bp, Acinetobacter baumannii
caaggagcaagtatgattttcctactctttgttttaagtattgtcattcagcttgttgcaatatgggcaattttcttttttaacctaaatagagtcgctggtagtgttattacgattgctgtagccatactgactgctttcattttaacgccgtgggcattacttttagggattccccttattgcacttagcattattattttgtttaaacctttacggtttaacttaattacccaacctgcatataaaactctggccaactcaatgccgagcatcagtaccactgaacaagaagccttagaagcaggaacaagctggtgggaaaaagagttatttatgggggctccagattggtcgcaatttgaaaaatatccctatcctacactttcaccagaagaacaaagttttatcgataatgaagttgaagtgctatgtagcatgcttgatgaatgggaaattcaccatcaattaaaagaccttcctcctgaagtttggcagttcattaaagataaaggcttcttgggtcttattattccaaaatcctttggtggtaaagagttcagctcatttgctcaaagtcgcattatgagcataattgcctcgcgttcattaactgctgcggtgagttgtatggttcctaactcattaggacccggtgaattactcatgcattacggtacagatgcgcaaaagcagcaatatctaccgggacttgctaaaggtgaagaaattccatgctttggtttaaccagtccggaagcaggttcagatgcaggtgcaattccagattcgggtgtagtctgctatggcgaatatgaaggtgctcaagttcttgggctgcgcatgaatttctctaaacgttggattacgctcgctccaattgccacagtggtcggtctagcatttaaactttatgaccccgaaggtttacttggagataagactaaaactgagtacgggattacctgtgctttaattccagccaatcatgcaggcgtaaaaataggtgcacgacactatccaggctctccattcatgaatgggacagtagagggtgaagatgtcttcattccaattgactggattattggcggacaagaaaatgctggtaaaggctggcgcatgctgatggaatgcttaggtgttggccgaggtatttcactgcccgcattagccacggccgcaggtgaaatgagctatctcactgtcggtgcttttgcaagaattcgtcaacagttcaatatttctgtcggcaaatttgaaggtgtacaagaagctagcagtgaaattgccagcgatgcctatatgcttgaagcatttcgttatttagtgacgtgtggtctaaaccaaggtggaacccctgctgtaatgactgccatggcaaaatactatgcaaccgaaacaatgcgtaaagtggttaatcacggaatggatattgctggaggacgcgcaattcaacttgggccacgcaatttccttgcccttacctatcaagcgattccaattgccattacggtagaaggtgcaaacattttaacccgctcgttgatgatttttggtcaaggctcaatgcgttgtcatccttatctttttgaagaattgcaattacttcagtctgacgacaaagccaatgccgtacaaaaattcgatgatttgttgtttaaacatttagcctatacctttaaccgcggtgctagatcatttgcttatggttggacgggtggttcaagtgatgcacctcaatcagcagatcaattcactgcaagttactataaaaccatcaatcgttttagcgccaatttttcacttgtttccgatatggcacttggcttactcgcaggagacctaaagcgtaaagaaatgctatcaggccgtttagcagatattaatgcacacttgtttattgccactgcaattttaaaatattatgaggctggacaaaaaactgaagctgaacaacttcatgccaaactagcactgcaaaaagcattcttgaatattcaggaagcattttggggactatttgacaactttccagccaagcttccagcagcatttgtcaaatggatatgcttcccgttaggtcgtgtgatttcaaaacctgacgatgagttaaaacaacaagttgctgaactcatgatggaagaacatccgtttagagagcaactcaaacgccatgtgtactattcaactgaacctaatgatgtcactggccgtctagagcacacgttccaaatgttaagaaccattgaaccgctttgggataagtttaagaaagctgaatccaaaggcaagtttacgggtcttacttttgaagagaatattgcgcaagcgataaaagaaggctttatttctgaaagcgaagctcaacaattattgcagtacaacgcaattcgattcgatagcatgcttaccgatgtttttgatgaaaagttaaataaagacctacctttatcaaatcctcatcaaatagtgtga

SEQ ID NO: 391 - DNA, 765 bp, Acinetobacter baumannii
ggaacaaaaagaaatagtaagggattggaattgcagcagtttaaaagattattgatcgtcttcttttttattatcatcgcgaatatatgtggtgtacttatcgccatttgggtgtttaaacattttaatatttatattccgttgaaaaaccaagcagtagcgatcgatttacaagagccattacaggtgcaagttaaagtaaaagatgctttaaatgtcgatgttaaagggcgagtgaatgctaatattcctattaatgagaagttaaatattcctttgacacagactttaacaccacgtgtctatttcgataatatggtgccgattagtacggttattccagttaaagaaactttaaaagttgaccaaagtttgccaattgacacgaaagttcaggtgagagtacttggtaaagatattactttgccattaaaaggtaatattcctttacagttagatgtacctattgatattcaagttccactcgatcaaaaagttcatttgaagtttgatgcgccagtaaaaacggtcttaaaagaaaatcttcatattccattaaatgctcaattaaaaacaaatattccaattcaaggaagtttgaatgtccccgtgaaaacagctttaaatgcgtcggtagatgtaaaaaataccttgccagttaaaatcgagcatggtgagttaaaaataccactatcgagcatgagcctgaatcgcgttaaatctggcgaagatcactcttcacctgttcagaaccagacaaaatag

SEQ ID NO: 392 - DNA, 519 bp, Acinetobacter baumannii
attcagaaaagaacaagcgtttggagtaatccaaacagtgtggatttaaaccaacttgccagcactaaaatggctaaatcggagataagtatgaaaacacttactgttgcttctattttttctaattttgatttttatcaacgcaattatctcaatattttaaatcaaccagaatcttattacacacctgtagaagatgcatggatcgatgcttttccatttaaaaaacaagatttgtacttaggtgacttactacaactctggtttagttcaaaatgggatgtgcatacttcgttgaaagttttaaagtgttccaaggtattagatcaatctaaacctctctatattttccagctcgaaggggaattattcctaggtaaaaataaagttttagcctggtctactcagcatcatgaagtgatagagcttcaacttaagaatatttgggcaccttatgtggttgcgaaaacttgtgaccgcccagatattccttacttaatgaaaaaggcagccgtttaa

SEQ ID NO: 393 - DNA, 732 bp, Acinetobacter baumannii
atctggcgaagatcactcttcacctgttcagaaccagacaaaataggtgaatggcttatgtttggctcattaaaaagtatattaatcagtttctttctgattatgatactcacggcaatcttattttggttctatttaaacatacaggcttcagttgtagtttcagcacatgagtcggatattcgtctaccagaatcattagaaactaaaatacatgttggtaataatttgcaagtccaatcggtaggtaaattagacacatctattgatattgaccgtcagatttcagttccattaaaaggaagatacttggctgatttagagtttgaagtcgagactccaattacggtaagtgttgattatgcgacaacattaaaagtcgatcaggtgatgcctttggaaacaaccactgatttaatttacaaaaataagttattaccaaggtttccattaaaattaaatatcccgattaaacttgatattccatttcagttaaaacgtagttataccattccggttaaaattgcttttaatggtccggtttattttgagtttgacgaatctataaatttgccaattaaacatcagtttaatccaagtttgaacgttaacgatgcaatggaaatggggaatatttcaagctttaatgccattatgtataactctgttcagcacactaaagctaatttggacatgaagatggatttacctttacgtaatgtccatccttag

SEQ ID NO: 394 - DNA, 390 bp, Acinetobacter baumannii
aagtttagaaggtttttatgcatgaatatcagcaaacttttttactgtaagtatgatcctgaaaaatttcactgtgtccatttcgttattaaagcagccgaatatatttatggacaagattattcaccgtgctttgttgggttatctagtccgttaagtgaggcaattaaaacttcaagagaaacggttcatcaaaacaagcgtattgataggccgaaagaaggctgcatagtcctaatgacatatatgaatgaaagctcccacgtggggcttttttttcagggcaagatttttcatttaggtgaaagcggggttcagcgcatcacagttgaacaagccaaaatttggtttaaacggattcgatattatgagccgaatttacatcattaa

SEQ ID NO: 395 - DNA, 2277 bp, Acinetobacter baumannii
atcactttgagcaaaagtaaagttgaagttatgtcacaacccctatttaaaaaagttgcatttattggtttaggactcattgggtcgagtttggctcgcgttattgttgcagaaaagttggcgacaactattgtggcatctacacgttcacagaaaactttagaagatgcaaaatcacttggcttaatacaagaagggttttccgatcctgtagaagctgtgaaaggggcggatttagttgttttagccttgccagtgcgtgccactcaaaaagtgcttgagcaaattaaaccttatttgtctgaaaccacaattgtaactgacgtgggaagtacaaaaggtaatgtcgtagatgcagcaaaagctgtatttggtgaagatttaccagcagggtttgttcccgggcatccgattgcgggaagtgaacacacgggtgtccacgcaggtaaggtcgatctctttgcaaatcacaaagtgattttgacgccattaccaaccagtgcagaatgggcagttgagaaactgattcaactttggtcagctgctaaagccgaagtgatatgtatggatgttgccaaacatgatgaagttttggcgcataccagtcatttaccgcacttaatggcatttaatctggtcgagcaacttgcaaaccgtgaagataatcttgatattttccgttatgcagcgggtggttttcgtgacttttcacgaattgctgccagtgatcctcaaatgtggcatgacattttctttgccaataaaacagccatattaaatgctgtagatggcttcgagaaacaacttaccgtacttagaaaattgattgaaaacgaagattctcatgcattaatgggtttactcggccatgctcaggcagcacgtcagcatttcaatcatatgttagccaaaaaacctttaatggagaaaaataaggtgacacagcaattcagtatcttaccgggaaataaggcttttaaaggtaaatttaccgtaccgggtgacaaatctgtgtcacatcgctccattatgtttggtgctattgcagaaggcactacgcatgtaacaggcttccttgaaggtgaagatgctttagcaactttacaagctttccgtgatatgggtgtaagcattgaaggccctaaaaatggtgaagtgaccattcatggcgtgggcatgcatggcttaaaagcaccagcaagtgcgttgtatatgggtaattctggaacaagcatgcgtttgctttcaggtatgctttctgcacaaaagtttgattctgttatgacaggtgatgcgtcactttctaaacgtccaatggagcgtattgctaaaccattacgtttaatgggtgcgcaaatccaaacgacaggtgagaaaggtacaccacctgtaagcattactggtggtcagcaattaaaaggtattcaatacgatttacctatggcatctgctcaggtgaagtcgggtattttacttgccggtttatgggctgaaggtgaaacttcggtaactgaaccggaaccaacacgtgatcatacagagcgtatgcttcgtgcatttggctatgatgttaaaactgaaggcaataaaatttcccttgtgggcggcggtaagttagtgggtactaatattcaagtaccatctgatatttcatctgctgctttcttcatggtgggcgctgcaatcactgaaggcgcagacgttgttctggaagctgtaggtattaatccaacacgtactggcgtaattgaaattttaaaacagatgggtgctgaactgactgttgaaaatgagcgtatcgctggcggagagcctattgctgatattcatattaaaggttcacgtacccttaaaggcattcacatgcctgaagaccaagtacctttagcaattgatgaattcccagccttatttattgcagcggcttgtgctgaaggccaaacagtattaacaggtgcagcagagcttcgcgtgaaagaatctgaccgtattcaagttatggcagatggcttaaaaatcatgggcattgattgcacacctactgaagatggcatcattatcgaaggtaaaggcaaatctggtgattggtcaccaatctttgctggtggtgaaattgaatcacatcatgaccaccgtattgccatgagttttagtatggcaggtcttcgtacttctggtccgattacaattcacggtactgaaactgttgctacaagtttcccaacttttactgagttggcgaatcgtgcaggcttaacgattgaagttagccaataa

SEQ ID NO: 396 - DNA, 702 bp, Acinetobacter baumannii
agatatatgagtaataaagattcatcgctttctaaagagcaacaaaagttattgaagcaatttaaaaagcaaatctccaatcctcattcaagcaaaatcgcaaatcagcctgagtctaaaaaatctcaggctgagtctgaagaattggaagacacacatctatttaagcaggctgttgcaggcgttaaacccatcaacaatagtaatattgccgatgtaaaaaccccacgtgccaaaaaagttgatgcacaaactctggcgaaacgtgcagctgccgaaggtggtcgtgataccgaacatgccgagctatcagatacacaagctgctttaaatccggtcgcaagtcaagcaacgttaagctatcgcattgcgactcttcaacataaggtttttgaagacttaaaagcaggcaagatgcgttggtttgaagctgtagatttacacggctgtaccattgaacaagcacgtgacgcagttttacaaatcatccagatggcaaaagatgaaaatcaaaatgtcattaaaattgtgcatggtaaaggcccagaagcggtcttaaaaacctatgtcaacggatggctacgccaacatcgtgatgttttggcatttgtaagtgcccctgaaaaccaaggtggcaccggcgctgttctcgtactgcttaaacgtgcagaaaaaaatccaaaatttgaacaaaaaaaatga

SEQ ID NO: 397 - DNA, 1380 bp, Acinetobacter baumannii
tccgatatgagcgttacttctgtcaaccctgccactaatgctaccaacgaatattatttgactcgccaaagtcaaatggaatcgaatgttcgtagctatccacgtaaattaccgttagcgatagcgaaagcacaaggttgctgggttactgatgttgaaggtacacagtaccttgattgtttagctggggcaggtacattggctttaggtcataatcatcctgcggtgattcaaagtattcaagacacattggcaagtggtttgccattgcatactttagacttaaccacacctttaaaagatgcgtttactgaagcgttgttagcatatttaccaggtggtaaagaagaatattgcttacagttctgtggtccttctggtgcagatgcgactgaggcagcaattaaacttgctaaaacttacactggccgtagctcagtgatcagtttctctggtggttaccatggtatgactcatggttcacttgcaatgactggtaacttaagtgcaaaaaatgcagtgaatggcttaatgccaggcgtacaattcatgccatatccgcatgaatatcgctgcccacttggtttaggtggtgaagctggtgttgacgctttaacttactatttcgaaaactttattgaagatgttgaaagcggtgtaactaagcctgctgctgttattcttgaagcaattcaaggtgaaggcggtgttgttacagctccagtaaaatggttgcaaaaaatccgtgaagtgactgaaaagcacaacatcgttttaattttagacgaagttcaagcaggctttgctcgttcaggcaaaatgtttgcatttgaacatgccggtattgaacctgatgtcgttgtaatgtctaaagcagtaggtggtggtttaccacttgcagtattaggtattaagcgtaaatttgatgcttggcagcctgctggccacactggtactttccgtggtaaccaacttgctatgggtacaggtcttgttgtattagaaacgatcaaggaacaaaaccttgctcaaaatgcacaagagcgtggtgaattcttacaagctgaattgaaaaaattagctactgaattcccatgtatcggtaacgtacgtggccgcggtttaatgattggtgttgaaatcgttgacgagcgtaaacctgctgaccgtatcggttctcaccctgctgactctcagttagcggctgcgatccagactgcttgctttaacaacaagttattgcttgaaaaaggtggtcgtaacggtacagtaattcgtttactttgcccactcatcattactcaagaagagtgtgtagaagtaattgctcgctttaagaaagcagttgcagaagcattggttgcagtgcgaggcgcgtaa

SEQ ID NO: 398 - DNA, 330 bp, Acinetobacter baumannii
ttcatgcagagcggaaaattagacgttttgttcgatgtcttaaaacggggtactgaaaaaaacagcgctggtgaagtcaaacaaatctggtcgagcatcggccaattttatggagatattgaaccaatcagcgcagctaatttcgtgcaatcgggtgttcaaggttcagctttagtttgtcgtgtggttatgcggccagatgatttccctggtattaaggctgaatttctattacgtgatgttgatacaaatgacatctatgcaattaatggtgtactcccaattacctcaagtaaaaaggcattgatgtgtagcttagggaaattgtga

SEQ ID NO: 399 - DNA, 1257 bp, Acinetobacter baumannii
tcccataagaggaatattgccgtggacgtacgtctttctgatcgtgtcaatgctatcaaaccgtcccctacacttgctgtaactaacaaagctgctgagcttaaagctgctggcaagaacgtgattggtttgggtgctggcgagccagattttgatacccctcaacacatcaaagatgctgcaattgaagcgattaataatggtttcaccaaatatacggctgtagatggtactcctgggttaaaaaaagcaattattgctaaattaaagcgtgataataatcttgattaccaacctaaccagattttggtttcttgtggcggtaagcaaagcttctttaacttggcactagcattattaaacaagggtgatgaagtgatcatccctgcgccattctgggtaagctatccagatatggtcattattgctgaaggtacgcctgttatcgtgaaatgtggcgaagagcaacgtttcaaaattacacctgaacaattagaagcagcaattactcctaacactcgtttagtggtattaaacagcccatctaacccgacaggtatgatttatagcaaagctgaattagaagctttagctgaagttttacgtcgtcatccgcaagtatttgttgcatctgacgacatgtatgaaccaattcgatgggaagatgagttctacaatattgcaactgttgcacctgatttatatgaccgcacgattgttttaaatggtgtttctaaagcatatgcaatgacaggttggcgtattggctatgcagccggcccagcaaaaatcattggtgcaatgaaaaaaatccagtctcaatcaacttctaacccgacttcaatttcgcaagttgctgctgaagctgcgttgaatggtccacaagatgttttaaaaccaatgattgaagcgtttaaacgtcgtcatgacttagtggttaatggcttaaacgacatcaaagggatctcttgcttacctgctgatggcgctttctacgcgtatgcaaacattcgccctcttattcgtgcaaaaggcttaaaatcttgcacagaattctctgaatggttacttgaagaaactggcgtagcggtcgttcctggtgatgcatttggtttaggtggtttcatgcgtatttcatatgcaacagctgacgaagtacttgttgatgcgttagcacgtatcaaaaaagctgctgaatcaatcgaaggcgttgatgctgcaattgcatctatcgaagctgaaaaagctactaaataa

SEQ ID NO: 400 - DNA, 963 bp, Acinetobacter baumannii
agtataaagaggttagtgatgttaaagggcgtgattttgtctgtcatggcatcattaacttttggtgttctttatttttatactcaattactcggccagcttgatagtgaacagactttcggatggcgtattattgcgactttgccatttttaactttatttatgtggtggagtggtgatttaaaccatattaaaaatatatatcaacgtattttagcgaaaccttctttacttctattactcattacaacatccgttttgacttcggtgcagttatggctgtttttatgggggcctatgcatggacgtggtttgcaagtttctttgggatatttcctgttaccgcttgttttggttttagcgggtagtgtcttatatggagagaaaatatcgaaatttcagtggatcgctattgttcttgcaattattggtgtagggcatgagatttttcgactaggaagtattgcttgggaaactgctttagtggctataggttattccgcttatttcttgttacgtaagaaaattaaaacggataatttagggggcttttggtgggaccttctgattattatgccagttgcaatctatctgacacatacagggttattgccatatagtaagttcctcgatcaaccgacactcgggttggttattgcgggcttaggtgtgcttagtgctataggcttgggatgttatatattggcaagccgttatttacctttggttgtgtttggtctgcttggatatcttgaaccggtattacttgctttagcatctttagtgctaggggaaagcattggtaaagaagaatggtttacttatcttccaatttggtgtgccgttttcgtattggttttagaaggggcttttcatctttaccaacagcagcaaaaagccaaaaatttgcaattaaatatcgaaaaatatcaaaaaagattaaaaaatgatgctcacgattag

SEQ ID NO: 401 - DNA, 642 bp, Acinetobacter baumannii
gtcattaggagaaatacattgggcaatcgtgataaacatttactcactcaactcgataccatcgcgaaagggttaagtgaaacactagcgccattttgtgaagttgttgtccatgacttaaccaatcctgagcatgccatactttcaatacacaataatttgtctggccgaaaagttggagatccggcaactgagttggggctggcaagaattatgtctccggagtttccaaaccttattacaaactatgctaaccagtttgcagatggccgccctgcaaaaagcacttctattggtattaaagatgaagagggccagtacgtagccgctttatgtatgaatattgatttaacgttatttagggggatgcaaagcgctttagagcatttcactaaaattgaaactgacaatattattgaaaacttggaaccgaatggcacggaagcaattcgaagatatatcgatcagtttgcttcaaaacatgccactacaccgcgtatgctaaaactcaatgagagaaagcaattaatacaagaactcaaaaataatggcttactagaaattaaaaaggctgtggaaacggttgcccaacatttaggtatatccagagccagtgcctatttgtatgtaaaggaaacttaa

SEQ ID NO: 402 - DNA, 246 bp, Acinetobacter baumannii
tcttggcttggaatgctttcaaatacgcaaaataatcggaatgtgatcatgcaaatttatttaaatggcgaattaacggacacgcctagccaaaacctgttgcaactcattcaggaactggcacttgaaggaaaacgttttgctgttgaacacaatcagcaaatcgtgcctaaaagcaaattagagcaaattacgattgctcaacatgaccgtatcgaaattattcacgctgttggcggcggctaa

SEQ ID NO: 403 - DNA, 1017 bp, Acinetobacter baumannii
actgtgattggtatgttatattcacttgctcgcccgatgttgtttagtttagcaccagagcgtgcccatgaattaacattatccatgcttgataaagcgcataagctaggcatgatgcgccagaccgtagaagcaaagccaactacatgtatgggaatcgaatttcctaatccggtagggttggcagctggtctagataaaaatggtgatcatattgatgcattagctgggttgggtttcggtttcattgaaattggtacaattacacctcgcccgcaatctggtaacccaaaaccacgtttattccgtattcctgaagctaaagctattattaaccgtatgggttttaataatgatggcgttgatcagctaatcgagaatgttaaagcatcaaaatttagaggcattttagggattaatattggtaaaaatgctgatacacctgtcgaaaaagccgttgatgattatttgatttgtcttgagaaagtttataactacgcttcatacattacggttaatatttcatctccaaatactaaaaatttgcgtagtttgcaaagtggtgatgcattaactgaattattgcaaaccttaaaagcacgtcaacttgagttggcagagcaatataatcactatgtacctttagttcttaaagtcgctccagacttaacagctgaagatgttgaatttatttcggcacaattattagattttaaaattgatggtcttattgtgacgaacacgaccttatcgagagaaggggtagagaacctgccttacggtaatgagtcaggtggtttgtcgggtgcacctgtatttgaaaaaagtacggaatgtttacgtttatttgctcaaacattaaaaggacaaattcctttaattggtgtgggcggaattttgtcgggtgaacaagctgcagcgaaacaacaggctggagcaacgcttgtacaaatttatagtggtctgatttatacgggaccaacgcttgtgaagcaatgtgttgaagccatgacttaa

SEQ ID NO: 404 - DNA, 471 bp, Acinetobacter baumannii
cttatggctggttgtgttgaaggtttaattgatgctcaaggagcctcaatctcgttccgtgaagagggtgcaacctcttgggaagttactgctgaagtcactgatttgccaatgcctgattcaactcgtccagttgatgatgtaactacggtagattcaaaatttaaaaagaaagcaacggcaggtgcaattgacaatggtgctttagcgcttgagttcttacagatcagtggttcagatcagcaagcaaaacttcgtgattactacaataaaggcaagtgccttgagtggaaaatcgaactaaatgatgaagctaaaacatcttatgaattttgtgcttccatgagcaaatttacggttgttcgtgctgctgacaaaaagaaccgtgtacaaactcaactagaaatttctggtgaagtagtggttaaagaaaatgatgtagtcgttgttgtgccacctgtaacaccttaa

SEQ ID NO: 405 - DNA, 936 bp, Acinetobacter baumannii
tcttcttgtggtattggttacgacgtaataatgaaaaaacagataccaattaaaataactgcttttattattttaattatatgtagtgtagtgggttatgcggggttgttcaaaaatcatgggcaacctcccattattgagggtattttctggcaacctgacaatgatactactcctcctaaaggaaactggcattacttaggaataaatacttttgttcctcaatggtcagtcgttgaatctaaatcttggtggaaaaactccaatcttcctcaatgggaaaaagccattgatttacaaaaaattaaacagcaaccttgggccaaaaatcttatattggggttagcaggtgaatataatgaacacgaagcgcgtgctaatgtcgttgctttgggtgaaaaatctgcacaaattattcaagaacaaaatgatacatctttaaaaggctattattttccagtagaagccgacccaacatggctaagagtaagtaccttaggacatgttttggaaaaattaccctcacctatttgggttagtgtttatagtggtgaaagtgaacctgaaaactacgatttatgggttaaaagctggcttcctcaacaagcaggcgtttttttccaagatggtgtaggtgtcggagtacgaactcccgaacaagctagacgtattttagatcaacttgaacagacacttggaaaagataaaacggttattgttttagaagcatttcgaaccaagaaaaatggtcaattccgtgcagcctatccttgggaaattatctctcaaattaaggcgtatgaagggaaaaaaatttatatttttgatggcccccactatatgggccgatggtccgtttatattgtcggtctatggtatcgattcgtttatggcagcacacccgccaccataaacgaacccaaaaactcaaaataa

SEQ ID NO: 406 - DNA, 1398 bp, Acinetobacter baumannii
gaaaacagtggagaatacatgaatctgctacttatcggtgtgttgttagcccttgtggcaattgcatatcaacttgggctgagaaagagccgccacctagcaggtaagggaagcaactcggcgacattacattctcgtcctggttattatggcgcactggttgggctttggtgcggtatccctgcttttttaattttgatcatttggaacttggttgagccaagtattttaaatcatattatctttaacaacgtacctgcttctgtgacagcttctctagatgaagcagcaagaagtgtacttgttgatcgagttcaagcgatcgcttctggttttggggtaagtgatcatcccgcggcttatgagttggctgctgctcagcaatatgcaaaatttcaaactattggctcttttgccaaatttgctgttgttgtctgtgccgctttgttgggcttagtgtgggcaaagaaaaaaatcagccaagaatatcgcgcacgtaaccaagttgagcgtgcaattaatgttggtttgatcttatgttctggcgttgcaattttaaccacgatcggcattgtaatgtcgatgtttggtgaggcaatgcacttcttccattttgtaagtccaatcgactttttctttggtacagaatggaaccccggctttagtacttcaggtaatgcagaaggtagttatggtttattaccattactatggggcacgctcatggtcagtggtattgccttattagttgctgtacctgttggcttaatgattgctatttatttagctgagtatgcttcgccgtggttacgctcatgggcaaaacctaccattgaagttttagcgggtattccaacaattgtttatggtgtttttgccatgatgattattgggccattctttaaagctgctggtgcgtatgtcggtattgaaattaatgcaactagtgctttgactgccggttttgtaatgggaattatgattatcccattcgtttcatctttgtctgatgacattattactcaagttcctcgcgcacttcgtgatggttcgttaggactgggcgcaaccaaatcagaaacgattcgccaagtggttttaccagcagctttaccgggtattacaggggcatttttattggctgtttcgcgtgccgtaggggaaaccatgattgtggttttggcagcagggaacagcccacttctacatgcaaatccgtttgaagctgtttcgacagttaccgtaaccattgtaaaacagttaacgggtgatactgattttgcgagcccacaggccttggtggcatttgcactgggattaacactctttgtgatcactttaggattaaacattgttgcactgtacattgtgcgtaaataccgtgagcaatacgaatga

SEQ ID NO: 407 - DNA, 615 bp, Acinetobacter baumannii
agtatgcgcggtttatacctcattaccaatgatgacccaatccaattattattagaaaaattagacgccgcactcgcaacccgtcaaatcgcaattttacagtaccgccgtaaaaaagtagacaaagccgaccagcctgctgaagtcgaacagatcaaacagttatgtgaaaaatatcaggttccttttgtcattaatgatgacctaaaactggctgctcagtttggtttaggtgtgcatttaggtcagagcgatggtgaaatcactgatgcaaaatcgcagttaccagaaagtgtcattattggccgtacttgcttaaactcattagaacttgcccaaaaagctattgccgatggtgcaacttatgttgcctttggtgcggtttatgcaactgccactaaaccagaggctggcaatgtaggtatagaagtgattaagcaagcagcagctcaatatgatttacctatttgtgcaattggtggtttgactgtcgaaaattcaaaacctgtgattgaggctggagctgacctctgtgcagtcattagtgatatattaggtcgatcaactgctgaaattcctgcccgtgtacaagcgtgggcacaattattttcttaa

SEQ ID NO: 408 - DNA, 933 bp, Acinetobacter baumannii
aatcgcagcggagcttactcattcgtgcaaatttcacataagtccttcagaaacgtcgggttaattggtcgaccagataaatcatcagttgtagaaacactatgtttaattcatgaccatttgctaagtttaggcctaaaccccatttttgatcaggaaactgccgaattagtgccctatgatcatgcgcaagtcgttagtcgtcacttattaggtgaagtcgctgatctggtgattgttgtaggcggtgacggttcattgcttcatgcagccagagctttagtgcgctacaatacgcctgtaatcgggattaaccgtggacgtttaggttttttaaccgatattaagccttcggaagctatttttaagcttgatcaggttttacaaggtcatttccaacttgaccgccgtttcttgcttgaaatggaagtacgtaccaatggtgaagtcatttatgatgcaattgctttaaatgatgtcgtactacactctggtaagtcggtacatatgatcgattttgaactcaatatcgatgggcaatatgtttatcgccagcatagtgatggtttaattgtttcgacaccaaccggttcaactgcttatgctttatcaggtggtggtccaattttacatccaagtatggatgctattgcattagttcctatgcatccccatacattatcttcacgcccgatcgtagttggtgggcaaagtgaaattaaaatcgtcattcgcgaaaatcgggtattaccgatggtgagtgcagatggacaacatagtgtctctctcaatgtcggtgatagtttgcacatccgcaaacacccatttaaattaagtttattacacccacctggttatgatttctatatggcttgtcgtaccaaattgggttggaaccaagatttcgaatcttttcaaagagatgaatcatga

SEQ ID NO: 409 - DNA, 324 bp, Acinetobacter baumannii
tctaagttaggtgttcgtatgaaaaaacataacccttctaaaacgcaattcgacatccttgttgatgctcgactattcgcccctgattttgcccagccaaagcgtgattttgatttctaccgtgaaagatcgattgatcaaattaaatgcgctatttccaatatttcaaaagcctctaatggcaatgaactcgttatcgcgattgcccaggctaatgccttcattgattcagcttacaaccttgaatttattaatcttgttgaaaaggttaaatggactgaagaactaagttctgcttttcacggttcggttttggaggtttga

SEQ ID NO: 410 - DNA, 987 bp, Acinetobacter baumannii
atagaatcaggtttaattatgaaaaatttaacccttccaaattatgaagatgtcgcagccgctgctgaacgtataaaagattttataaataaaacccctgttttaacttcacgtacggtgaacaatgaatttgaagcagaagtgttctttaaatgtgagaattttcaacgtgtaggcgcattcaaatttcgtggtgccatgaatgcacttttacaatttaatgagactcaaaagaaagcaggtgtagttgctttttcttcgggaaatcatgcacaagcgattgcgctttcatcaaaaattcttggtattcctgcaaccattatcatgcctaaagatgcacctgctgcaaaaatggcagcaacgcgagaatacggcggcaatattgttgaatttgaccgttatacggaagatcgggaaaaaattggaaaagagattgccgaaaaaaatggtctgacattaattccgtcttatgaccatccgcatgtgattgcaggtcaaggtacggctgctaaagagttatttgaagaagtcggtgatttagattacctgtttgtatgtttaggtggtggcggtttgttggcaggttctgccctatctgctcgccagctttctccgaaatgcaaaatatatggcgttgaacctgccctaggaaatgatggacaaatgtcttttagaaaaggcgaaattgttcatattgataccccaccaaccattgccgatggcgcacaaactcaatatttgggcaaattgacctttcctattattcaacagaaagttgatgacattttgactgtcacagacgaagaactcattaacgctatgaagttctttgctgaaagaatgaagatggtggttgagccgactggatgtctcggatttgcggctgcccgtaacttaaaagatgagttaaaaggcaaacgtatcggcattattattagtggtggcaacgtcgatatttctaaatatgcggagtttttatctgcctaa

SEQ ID NO: 411 - DNA, 1419 bp, Acinetobacter baumannii
aggtgtacaggaagtgacaccaacattggagataatgttatggatgcaaacaataagcacgagttaaaacaaggcttatccaatcggcatattcaactcatcgcactcggaggggcgatcggaacagggttattcttaggtctatcacaaacaattaaactggcaggtccttcaattttattgggatatgcaattgcaggaattattgcctttttgattatgcgtcatttaggtgaaatggttgttgaagaaccggtaagcggctcttttagttattttgcgaacaaatattggggcaaaatggctggttttatgtctggctggaactactgggttttgtatgtactggtgagtatggccgaactgagtgcgattggtacttttattcagttttggtggccagaaattccgacatggctgaccgctctatttttctttattttaattaacggcattaacttggtaaatgtccgcttttttggggaatcggagttcttattttcctgcattaaaattgttgcgattttaagtatgattggcttcggcgcttatcttttactttcaggctcagcaggtccgcaagcgggtgttgcaaatttatggcaacacggtggtttcttcccgcatggtattcatggctttattatggctttggctgtcattatgtttgcattcggtggtctagaacttatcggtattgctgcggctgaaacgaaaaaacctgaaacaacaattccaaaggcagtaaaccagattgtttatcgcatcctgattttttatatcggtgcaatcggtattcttttatgtctttatccatggaatatggtggcagaaggcggtagtccatttgtcttaattttccagtccctcaatagtaatggcgttgcgaatgttctgaactttgtggtcctgattgctgcaatttcggtttataacagttgtatttactgtaatagtcgtatgttgcatggtttagcagagcagggcaatgcgccagcaattttgaaaaaagtaaacagccgcggtattccggtccctgctgcaattgtgtctgcttcaattacagcagtctgtgtagtggtcaactatttaattccaggtcaagcttttcagctctttatgatgttggtggtggctgcgcttgttattaactggcttatgatttcagtcacgcatttgaaatttaccaaagcaatgaaattgcaaaagcgtcaaaccaaattccaaagcattatgagcccatggagtaattatttaaccattagctttgtatgtttcattctcattattatggcgatgacaccagatatgagactcgctgttattttggggcctatctggcttgctgttttagcgattatgtatttctttaagtatcgtaaaaaaatggtcgcaataccggaagtacaatcaaactaa

SEQ ID NO: 412 - DNA, 441 bp, Acinetobacter baumannii
cctaaagcagggtcggcaaaagccattgtacatatcgcaagtacgattaaacactgcgcaataagcaaccatgcacgtcttcggcctaaagctttagttaagactggtacaggtaactcatcaattaagggagcccaaacaaatttaaaggaatatcctaaagccgcccaactgaaaaaagtgacggcacttttatcaatgcctgcttcacctagccataaagagagactagagaaaatcaataaaatgggtattccggcagaaaaacccagaaatagcataattaatgcacgacggtctaaaaatgctttaaacgccgagacccaaccagaggtttgtgtggtcattcgttttttattttccataaattataaatgcgcctattcaatcgcttcttacaattgctttcaagattctttatgcaatcaagttttgttttga

SEQ ID NO: 413 - DNA, 705 bp, Acinetobacter baumannii
ttgtttaaagggccggatatgcaagccattattttagatacagaaacacatacactaaatggtttgcctattgaaattgcatatgccccaattgaaattaatgcaggcaagctcaccttagataaaagcaaattgtttgatcaactttatcaagttgggacccctatctcttacgcagctatggcagtacaccatatattagaatcagatttagaaaatcagccccactataaaacttttaaattgccagagactacaacttatattattggtcacaatattgattatgatattgccgcgattgctcgttgtggtgtggatgtatcgaatatcaaaccgatttgtactctagctttagcgcgcaaaacttggcctgatgcagaagcgcataatatttctgcactcatctatatgatttctcaaggcagcagtaaagctcgagaattgctcaaaggcgcgcaccgagccgatgcggatattattttaactgccaatatcttgatgcatattgtctatcatttaaatattcaagacattgaagagctttaccgagtttctgaagaagcacgtatccctacgactattaattttggtaagcataaaggcacagcaattgctgaacttcctaaagactatattcaatggctattgcgccaagacgagctggacgtttacctacgtaaagcattagaaagtgcattttaa

SEQ ID NO: 414 - DNA, 852 bp, Acinetobacter baumannii
tgctatggaggcataaatatatataattcaacaaataattcaattgagaaaacctctgggtttatttgtcgagaaagattttttgtgaatattttaattgccaatgatgacggtgtctttgcaccaggtatacaagctttagctgacgcattaaaaccactaggccgtgttgtagtggttgctccagaaagtgaaagaagcgggttttcgagtgccttaactttagatcgtcctttacgtcctattcaaattgctgaagatgtatgggctgttaatggcacaccagccgattgtgtttatttatccatgaatggattatttgatttcgaatttgatttggttgtcagtgggatcaatagtggcgcaaatttaggcgatgatgttttatattcgggaactgttggtgcagcctttgaaggtcgtttaatgaaacaacctgcaattgcagtttctttggctgggcctgatgtacgttcatacgaccataaagatgattatgcgcaagcagctaaatgggtacatgactttatcgcaaaaggactacctgcactgccaccgcgacatatttttaatattaatattccagatgtacctcagcttaaaggtacacaaattacttaccaaggccgccgtgcccaatctaaacctatcaccagccatgtagaccctagaggaagacaggtttactggattggtcttgcgggtgaggcggtaactgatccacagcgtattgctagtcaaatacaatctgatttttttgcggtcgcgaatggttttgtgagcgtgacgccaattcagatggatgcaacaaactatgcggttttagaagatttgcaggccagtttggggtaa

SEQ ID NO: 415 - DNA, 735 bp, Acinetobacter baumannii
atgaaaatgggaaaacaactgcaagcgcggaataaattttcgcctaacttgccaaaagtacagtgtcgatttattcctgctaattcggctgaatgtcgatttattaaaaaagatgcgaaaacaggcgcagtcattgtaagtggctacgctgtgaaatgggattctattaactattacggtgaaaagttccttaaaggtgcttttgccgatgtctgtgcagcatttaaagctggtacaaaaaaagttcattgttattacaatcatggctggcgtcagtggtatgtcgattcgactatcacgatgcgtatcgggaaaattattcgacttgaagaagatcatgttggtttactacttgaagttgaattaacaccaggattggcacttgcacaaaatgttggagcaatggttcaacacggtactgttgatggtttctcggtagctttttatccccctagtgatatcgatattgaggataaaggaactcatattgaaattaagcgggctgatctatatgaaataagcattgtagatgaaccagccgatggtgcagcacgaattatcaatgatgatgcaatcaatgcgattgaatcggatgatgatgtaacagagcttttgcgctcagttttaccaggcggctacgctgaaaagttaatggcccgattggcaaatttaaatcaacctaaacaaactccagagcctaaaaaagacccgtttgcttttttagacaattactaa

SEQ ID NO: 416 - DNA, 540 bp, Acinetobacter baumannii
aaacgcattttaataaaaatacatgatttgtgtatcataaaaggattttatgcaatggataagttcgactggcaaatcattcaggcactacaaaagaatggacgactcaccaatcaggaaattggagatttaatcggtttatctgcttctcaatgttcaagacgacgtcaattgcttgaacaaaaaggcgtgatccttggttatacggcacgcatccagcaacaggcgctagggctggaagttacagcgatgattcacataaatttaaggacacacgaggcgaaatcacagcaagctttccaagagctgattgaagctgaagacaacattcaggatgcattttcaattagtggtgatgcagattttattttaaaagtcgttgctgaaaatttagaacagctttctcaatttgtgactgaaagattgctttcttataattttatagggcacataaagtcttacattgttctgaaaaaaattaaagaacagaatcattttttaatcaagcctaaaagcatgagctatcatcactctcaataa

SEQ ID NO: 417 - DNA, 1398 bp, Acinetobacter baumannii
aaccatacgggggctcggctaccgtatgggagatttaaaatgaaatcaaatcggtcatccttgcagtcacaactggttaaaaccaccatgtggagcagtattgtggtggggctactggcattaagtttactcaccatattttcgatttatcacaacatgtcagtacaagatgaaatcatggatgaaatttcagataccttactggtttctgacctttctaaacactcgatgaagcagtttgacgagctgagtgatgaatttgatattcaatatgagttattagatacaggtcaggtgcttacccattctcatacctatcagcatgaactttttgaaaaaggtaacttatcagaaggtttttcatatttttggtttgatggccagttatggcgtagtctggctgcacaacaagaagattctcaactacaagttgaagtttttcagcccattagtacacgcattgaagaggtattaaaagcacttgctggatatagtggtcttatggtgctgttctggttactacagtgggttattgtaagttggcgtaccgagcaacaattggctgcgctgaatttactctctaaacgtattgctcaaaaaactgcctcaaacttagagccaattcaagaaccagatgttattacagaaattcagcctgtgattgatgctttaaatcagctacttgcaaggctacaaagggcattggttgctgaacagcgttttactgcagatgcttcacatgaattacgttcacctttatcagccatacaaatgcgtcttcaggtgttgcaacgaaaatatcagcatattccagagcttgatcatgattttgagcgtattcaagaagacgtttcaagaagtacaaaaatactggaaaatttattgttactcgctcgcttggaacctaatgaaacagagcaactagaactctctaaaagtgtcgttgatttaaatcatgtattagccagagtgatagatacagtaaatattgatgcacaagccaaacaaatggtaattgagacaaatattctgtcaaatgaaaccaaaacatttgcaaatgaagagctcatgtttattgcttttagaaatctatttgataacgctattcgttatagtccggctttaggtactattcatgttgagctaagccagtaccagcaaaagctgaagatttctatagaagatactgggaatggtgtggatgatgaggtcttaaggcgtttaggacagcgtttttttcgtgtattagggacaaagcaacaaggctcagggttagggttatcaattactaaaaaaattattcaactccatggtggggaattacattttatgcatgcaagccaaggtggcttaaaagttgaagtaatactgccttttaaccgtgaaatacaaaaatag

SEQ ID NO: 418 - DNA, 2892 bp, Acinetobacter baumannii
gtgaaagcggggttcagcgcatcacagttgaacaagccaaaatttggtttaaacggattcgatattatgagccgaatttacatcattaagaatgctttagaccaacaagagaaaattacagttgagtctgaaaatattcttcatacatttttgcaagaaaaaaccaagcatccccaagcgaaaatctataagggtaatccttgccctgaaaatgatataacccctacacgtgataatcgtgcatctattgcccgtcttatggaaatggatgatgaatgtacgattgttcgttatcctggtgagttgtcctcaacagtaacttggattgctacaaagttgcttggtcaagctgtctctgctttggtgaaggtgccaaaagcaccgacaaacaatagttcgatgacaggttcaagtaataacaatttatcgaacccggaaaaccgtcaacgaattaaacaacgtgtcccttacattctaggtgcacctaaagctattcctgatttatttgcccctccatatcgatatttcaaagatggggtagaagttgaagagcttttactaagtgtttgtgaaaaccctgtaaagctgtcccaatttaagacgggcgatacgccaattcaggaaataccaggaacaagcttgtcggcttatggcttaaatcaaagtctggttggtactgaaacaatctttaaatggggggatactttcaccgaacctccagtaattgcccggcagtgtgattctattaatggtcaaacagctttgccgcctaatagcacacgtgttgaagctggagatatatatttccaatatccgaatatgattaaggccaatgaccagagcacggcagatcgttttaactcattcaatattaatgaagctttgatcattagcggtgcaaactttggtgttggtgatttatccataacaggtcaagttactgttgacccggtaaacaagacgtttgctattgagtcaacacaaaatgtcttggattatcagaattaccgaaaaattaacgtgacttcattgctggtcactgatcctgtaaatgagcagcttgatttagcgggtttgtatgatattgattcaatcacatatgcatcaagtatctatacaatccatttgagaaatcctgtagcaactaacaccaatttttcaaaagtaactgaggtattaacttccacaatatcggcaaatctaactgcaaacacagcaaacatctttttagatggtgagtatgtagtaactggtattgatactgccaataagcagcttactttagcaacacctagcggtgtaaattccgattggaataagttagcagacttagaagatcaaaagaccagtactggaaatattaagcttcgcggaagccaggaaaactggattggttggtttacgattaattcaccaaaagcgacagggcttttattaaacttccaggctttaaacgggatttatcaaggttcagacgccaaatttgtggatatctttgttgaatatcaacaggtcgtttctgataatccaaccggaccagtatttaaccaaacgatacgtttaaatggtaaagctaataaccgtgatagcgtaggtgggtcgatgtggattaacttgccgttttcgggcgctgtgcgtttccgtgcaagaagggttaatgacaatggtgatgcggtagatttatcagatgaagttaaattttatacggcttatgcaattcgctatttatccaagcttgtttatgcaaatagggttttaatacgccagcgcacacaagcaacacgtgctgcaactgccgtagatacacgacaaactaactgtattgctgagagcctagtttattcatatcgcgggggtgtacgttctgctgagctaatcccttcacgcaatatggctgatctcatcattgacctagctttgaataaacttattggccgacgcactttaaatgaaatcaatactgaagaaatttatcgtgtatttgatgatgtggttgaatattttggctcttccaagatggctgaatttaactacacattagacaatgcaaatcagtcatttgaagaaatttgccgaatgatggcgggggcatccggttgtaatgaacgtcgtttaaatagagcactgtactttgattttgaaagggcagatcggcaaccaatattgttattcaatcacaggaataagaaagctaaatctgaagttagaacatataactttaaggttgagaataattatgatggtgtcgaaataacatatgtcgatagtgaagcaggatggattgaaaagactttgaaaatcccgaatgaccaaatcacgaacccgaaaaaaattgatggatatggcattgcctataaagaacaggctcatatcatcggctggcgtgcctggaataaactgaagtatcagcgagtcaattgtaagtttgactgctttgctgaaggtgagctaacagaacgcggggacccaatcattgttgttgacgatacccgtttgtcacctatagccctgggtgatgggtcaataacgtctggagaaattacagcgtggaatggcttaaccattggaatcagccaaccgtgtactttgacagcaggtcatgattatgtgattcatctacaaaagaaaagcggttttactgatcagataccagttagccagggcgcaagtgagtatgagctaattttggcacgtccaccgcttgaagcattggtaacagaaggtgaggtgaaaacggtttattcaatcacagtagatgatcgtcaagatgatgaattgttcctggtctcaaccaaaaatcgaaatggagtttttgaaaattccatttcagcaaccaattccgatgagcgttattatcgaaatgataaggacatcatcaataacttaatttaa

SEQ ID NO: 419 - DNA, 342 bp, Acinetobacter baumannii
aataattgggggttagacctgatgcaaaagaattttttttgtttaatagtttgttgttttggatttatctcttcagcatttgctgcttcagatgaaaaagtaaaagattgtttaactttagaaaaattagctggagttacaatggaatatcgccaaaaaggtggtgttttatctgagttgtataaaatggattttgggtctaaggaccgtaataaaattgttcgtagcttagctgaagaagcatttgaaacaccaagatatcatagtgaaaaggtacaacaagatgctattaaaaattttaaaaacgaaaagtttttatattgtttaaagcatttaaagtaa

SEQ ID NO: 420 - DNA, 987 bp, Acinetobacter baumannii
agcttttttatatcagcagcacgacaaggaattactatgacgactgcaacaggtacaacatggcgtcagcgtttagaagcttattattatctatgccgatttgataagccaattggtactgaactggtgttttggccaaccatgtgggcactttgggttgcatcaaaaggaataccgaatttgggtattttattcgtcatgattttaggcgtcatttttatgcgcgctgctggatgtgccattaatgactttgctgatcgtaaagtagatggtcatgtagagcgtacaaaaacacgtcctttagcaacaggggttattcgagcaagagaagcagtatatgtattcttgggtcttgttttagcaagtgcatgtttgttgttctttttacccatagaaactttctactggtcatttggagcattatttttagctttcatttatccatttatgaaacgctataccaacttaccgcaagtttttttaggagcagcattttcatggtcaattccaatggcctttactgcggtaggtaaaactccggatctgacttgctggctgctgtattttggtaatttggcttggacagtggcttatgacactcaatatgcaattacagaccgtgagtatgatttaaagattggtgtgaaatctaccgctattctttttggtcgatatgacatccagattattgcgcttttacaagcaataagtcttgttttgattggtacagcgctatatttagaaaatatcttatttccttgggccattattgctttagttgtagtggcatttgattttgtatatcaaacaattaaaaccaaagaccgcaaccctcaggtatgtttttgggcattccgtcacaatcgttgggttggattaatcctttttctaggcaatatttttaaatttcatatagtaaaaatgaccgtgaggttgaaaagtgttctatgcagagcactttttttatgtcttaatatttgtgcatga

SEQ ID NO: 421 - DNA, 969 bp, Acinetobacter baumannii
gcattttttataaatttagaattagatttgaggaaacctatgttagatcagcttcgtgcgatgggtgtttttgcttgtgtggttgaaaaaagttcatttagtggtgcggcacgtgaattaggcattacaacaagtgctgtaagccagcaaatccgttctcttgaaaatgaaatggatgtaattttattacatcgttctacgcgaaaacttagtttgactgaggcagggcaggcttttttctcaagttgccaagaaatgttggcagcagcagaaagaggcaaaatcagaatcaatgaattacgagatgatttgattggtgacttgcgtattgcaactacccctgatttagcggttcagcacattattcctgctttatctcactggatgtctgcccatcgtggtctatctgttcattttgaagtggggcatcgatatatcgatttaatcgaagagcgaattgatattgctgtgcgcatgagttctacagcggtagaagagagcgactctgttattcctatggcttttgtcgatcagattttggtagcttctcccagctatctcaatcaaacaagcccgatcttgcatccaaatgatttaaacaaccatgagttgctttctatcaatgcaatgaatgattcacgtagttttaattttcagcacgctaaaactggtgaaaaattaaatatcgagatgacaagccgtttgcaaagtaataatttacaagtggctaaagcgctatgccagcaagggcatggaattgccagaattttatatttagatgctcaaaaagaattgaagaatggttctttaattgaaattcttccagattggaaactcccagctttcactttatatgcagagattgcaaaacacgatcaacaaccaatgaaaattcaacgttgtgtcgaagcgcttaagcaatacttcagccagttggctggcggaagagcaatgcagattgttcgttaa

SEQ ID NO: 422 - DNA, 309 bp, Acinetobacter baumannii
gacgtttttatgagtgactacataacgcttgatttagcgaaatctcatttacgtgttttgcatgcgcgtgatgattcatacattgagttactgatcaaagcggctttgaaagcagtaacaaactttatagacaaagaattttcagaaattgagcagccagatggttcattacctgaagatttagtgtttgctgctttgttgatcattggtgatatgtaccaaaacagagcagcacagaccgatgcggctttatatgtaaatattgcgtgtgagcggttgatgtttccttaccgaaaaatgggggtttaa

SEQ ID NO: 423 - DNA, 573 bp, Acinetobacter baumannii
agtaaatttatacgtcttatgtcaatgcagcaatcgtacgcaaatattctgactgccgtcggtgaagaccttaatcgtcccggccttaaagatacgcctgtgcgtgcggctaaagctttttcatatttaacttctggctatagtaaaactttagaagaagtcaccaataatgctgttttcccatcagataaccatgaaatggtattggtgaagaatattgaattttattcgctctgcgaacatcatcttctcccattctatggccgtgttcatgttgcctatttaccagaaggcaaagttcttggcttatctaaatttgcacgtattaccgagatgtttgctcgtcgtttgcaaattcaggaaaaccttactcagcaaatcgctgaagctgttgcagaagtcactggcgctcgtggcgttgctgtagtcatcgattcagcacatatgtgtatgatgatgcgtggtgtaggtaaacaagaatctaccacccgtacagtttcatttgtcggagattttaaaaccgataaagaagcgcgccgtgaattcttaagtgcagtaccagaaagctactaa

SEQ ID NO: 424 - DNA, 2133 bp, Acinetobacter baumannii
ccaagatttatgggaagcattaaagtgagaaactctttactatctaaaaggttaaaacgtactgaaatacgtttactcattattgatgataaccagttacgttataaccaaattttaaatttattatcggggaatgattatcaagttaatgccttattacttgatgatttaaaaagttttgaaaagcagctcaatacatcttgggatgtcattatttttggtcgcgcctatgatttgaaaattgaacaaactctctcccttgttcaagcctcagaacagccgcagcttccaatattacttttacagccagatgattaccaagtgcagcaatatcaaagctatattcaaaaagggatttatgatgtagtccctttagaaccgctagattatttctatattacgctggttcgtgcactgtcatacagccgccttttacagacggaacaacgtcttttggctgagcttgatactattcatacgcatacgcaaacgctggtcgacaacagccataaagccgttgctatttttcaagaaggcatccacattaaggcaaataccgaatatttgaatctttttggtttccagcaagaagaagacattatcggattgccgattttagatgtcttacaacccaacgatttaaatgtttttaagcagcggtttaagaaaatttctttaggccagttcgatcaagcacgctttgaaatccagagtcagcatcaggctatttcgggtaataatgcattaaaactcgagtttattcccagccaagaagaagacgcggtacaactcaccatcgactatcaagttgatctaactactccagcaaatagtgctccgtccgaaaaaagtgttgggttgagtgcagcttggccgcagattaatcgtcatttatcgacccaccctgcccaagcaaacgccgttgttttatttagacttgcacagtgcccagaacgaatttttcaacagggttggcaaactttaggacaatatttcaatcagctccatggttttttaaaagaccatgcacagatgccgattttccaagtcgacttgggtagttatgtggggattttacaagctgagaataattcagttttaaactcacagctaacgagtttacaaactttgcaaaaagaacatttgttaaaagtgaatgagcaaaacttttcagtgcagttaaagcttggttatgcttttctcaaccaacccttaactgagaactcttttagctcattattgaacgaggcggaaaagcaaggcttacctcgggttacacctcaacttgaagtaatgccaaccgtagacaaaacggtttcaccgagcattgaagctgttcctcttgatttaacaattgaacattttgaccatacgcctcagtcctctttgctccagcaattaagacaaaaactagctcagggcgaaatacatctgaagtaccagcaaatttacgataagcatgaccaagaaactcataactatgaagtgacgagtggttttattgctggtgaacaatggtatgacttaaatgatttaagtgatctaaaagaagatgcagaactttcaattcagttagaccgctggatattggtagaagcgtgtaaacagcttcataatttcattgctcagtatcctaaagcgaaactcattattaaccttaatattgatattttgctgaaagataaaacattccccgagctgatttccaaactactgactattatcggaagtaaaattgaaagcccactgattttgcaattttcagaacaagctattcagccttgtctcccaattgctcaacagcacattgctcgcttacgccaacatggtgcggaaatttccattcgagattttgcttcttctatgtatagcgattcaatattacagaagcttgatattcaacttgtaaaattacagtccagcaaaactgatctattaagctcagaccaagggcttaataacttacaagaaaaaatattgaactatttgactgtaaaaccgattggaattttattagctcacttgaatgatatgaacctgtttgccaatgcatggaatgtagaagcacgttttctacaaggtgattatttccagaaaaaacttgaccgcttaacagacgtacaagaccagtaa

SEQ ID NO: 425 - DNA, 2859 bp, Acinetobacter baumannii
aaaaatcttatgtctggccttcaggaagaatatttacagcatcaaacaaaaattgagcagcttcgcctctcaattcaatatatccgctggtatcttgttagcctaattttactgtgcctaatttcaggtattattttcttttgttactttacttcttacattacaaactttatttggtcaattggctttactattttaacgcttacctgtctattatttgtcccaaagctattaacacattatcgtgatattcatttcattaagaaaaccgatttaatgctacaaggtatttgtttggtatctggaattttaatgggaataaatatcattgttctgcatttttcccttcctgacactttaatatctgtttctgatgttcatatcctgatagcattatttattacctcagcccacattattggtcttacatttttaactcaacaacctcgatatttttatttactctttattccaagtacagtcccactcattattggacagtttactcattctcaaatcacccaactccccttttactttgcttataatttagctttcgtcgcaactttgctttgtgcttatgcaactcagcgtaactatcaaaaaatttctcaactattatttaaaaataaacaacttgttcaagtagcagaacagcatactcaatgggctgaagagttatgtgtacagctccaacaagaagtaaataaatctaaagatattgaagcacagcttcaatttaataatcatttgctcgaacaaaaggttcgggaaaggacatatgacctcactaaaatgaatgagaggcttgaaagccatcatcataatttagcatttgcacatgaaacagcaggtatccgaccgtgggattgggatattgagaaacaaaaattagaaataacgttttttgatcaacaaaaacaaactcaaaatactcctttacacctcaagtcaattttagagcgcattcatcccaatgaccgaaagttatttgatgaacgtttaaaagagcacttggaaggaaagtctgatcacttcaatattactttccgcattttacgtcgtaatggttcttggcgttggattcatgacgtaggacgtgtcattagccgtgatcctaaaaccaataaagctttacgtatggttggaatgaccagagatattcatcaggaaaaaaaagatcaagaacatttgagactttctgcgattgtgcttgagcaagcagctgaaggaatttttattctagatgaaaaactcaactatattgaagttaacccctattatgagaaattaactggcttttcaaaatctgaattattaagccagcagctatttaatatcacaataaatcagaagctacagcaacaacaatttcacgactccattactcaacaacttctaaaaactggcgaatatatgggccaatttgatgaaaagtttacatcgggtaaaagtgtctatttatggcttcatattaatgcagttaaagatgagtacaaccagattattaattatattggttttgcacgtgatttaaccgaccaaaagcgacaagagcagcatttatcttatttaaaaaactatgatagattgactcaccttcctaaccgcttttactattataatcaattacatcaatatcttgttaatccatcttatagttttaaaaatctggctttaatacgtattaatatcgatagatttagagcatttaatgaatttctaaataatgatagtggggatgagttacttaaacaatttgcacagcgactacgactgaccaatatcaatgcaattttagtggcttacttaaacggcgatgattttgcaattatttatgaaatatcacctattcatcccaacattgagcaatattgccaaaatatattacaagctttaaatgcgcctttttatattgatgaacaagaatatttcattacagcttctattggagtcgcttgtttccctgagcatggccgacaaattgatcacctcaacaatcatgccgaacaagcgttgtcggaagcaaaacgtttaggtggcaacactattagctattattgtaataaaactacaaacccatataaaacagcagacttagaacaagagttgcgtaaagccattcaaaatgatgaatttgtggtgtattaccaaccaaaaattaatttaaatgacaaatcgattaaaggttttgaagcactcattcgctggcagcatcctgaaaaagggttagttatgccaaatatgttcattccttttgctgaacgtagtagccttatttccgatattggtaaagtcgttttagataaagttggcaaacagctacaagaatggaaaaaagctggctatgccgatgtccgagtttctgtaaatattgttgctcaacaaattcatcgaggtcttttactcagtgatttagacgaagttttagacacatatcatcttgatggttcaaatttagaactagaaatcacggaatctgctttattagataatactgacaatgtaaaaaaactattgcactccattaaagaacgtaatatttcaattgcactagatgattttggcactggatattcatcgctagcttatttaacagaatacccaatcgatgttttaaaaattgaccgagcctttgtttcgaaaatcggtgatcaaaaacaagaagcaattgtgaatgcgatgattgcgatgggtaaaagcatgggattaaagctagttgcagaaggtgtggaaaccgaagaacaagttatttatctacaaaagcagcaatgtgattttttacaaggctttttctttagccgtccacttcatccaaatcagattcttcaatatctacaaacaaatacgcatatttga

SEQ ID NO: 426 - DNA, 1287 bp, Acinetobacter baumannii
ttaaatattataaaagggagaatctacataatgggttatcagaagatcgtggttcctgccgacggtgataaaattacagtaaaagcagacctgtcactgaatgtaccaaatcatccaattattcctttcattgagggtgacggtattggtgtagatattacaccggcaatgaaaaaagttgttgatgcggcaattttaaaagcctatggcggcaaacgctctattgaatggatggaagtgtattgcggtgaaaaggccaataaaatttacggtacctatatgccggaagaaacctttgaagcgctgcgtgaatttgtagtttcaattaaaggccctttaactacaccagtcggtggcggcattcgttcactcaacgttgcactacgccaagaactggatttgtatgtatgtgtacgtcctgtgcgttggttccaaggcgtcccttcacccgttcaacatcctgagttaactgacatggtaattttccgtgaaaactcggaagatatttatgcgggtattgaatggaaagcagattctgaagaagctaaaaaagtcattaaattccttcaagaagaaatgggggtcacaaaaattcgtttccctgaaggatgtggtattggtattaaacctgtttctaaagaaggaacacagcgcttagttcgtaaggctattcagtttgcaatagataatgacaaaccttcggtgactcttgttcataaaggcaacattatgaaatataccgaaggtgcctttaaagaatgggggtatgagttagcgctagatcgtttcggtggtgaattaatcgatggtggcccatgggttaaaattaagaaccctaaaaatggtaaagacatcattattaaagacgtgattgcagatgctttcttgcaacaaatcttgatgcgtcctgctgactactctgtaattgcaacccttaatttaaatggtgactatatttcagatgctttagcagcagaagtagggggaatcgggattgcaccaggtgcgaatattggtggagctattgcagtgtatgaagcaacgcatggcactgcacctaaatatgctgggcaagataaagtcaacccgggttcaattattctctctgctgaaatgatgctccgtgatatggggtggatagaagcagcggacctgattattaaaggtatttcaggagcgattgcagctaaaaccgtaacttacgattttgagcgtttaatgccgggagcgaccttgttacgttgctcagaatttggcgatgccataattcagcacatggaagattaa

SEQ ID NO: 427 - DNA, 1278 bp, Acinetobacter baumannii
gataaaattatgactgcatatcaaaaattcccaatcggtgcgcctttcaatattttgatggcacgtgatgcttctgcatcactaacccaaattgaagaaatggcaaaacagcttaatgctcgaatgactacacttgatagcttaattactcgttatcaagatggtctcaaaaaagttgagggtattcccgataatattaaagaagaccttgaagcccgtgctaaagaagtcaataaattagcaggggaattatctgaactacagcaaaaattagttgatggtgtcaacgagcgtggaattgaccctaattcagttgcttctgttctaatccgcaataaagcgattcttgatcaagcatcctcaattcaacggtctaagggtaaattccaatttaatgatttgaatgcccgtaacatcgttacattaacaggtcttggagcgacagctcagtttgctgctaatgatttagggcgtactgttgagcgtgccttaactttacttgattggattagttttactccagtcactgctgaactggtgcctttgttacgtgaatcagcttatgaaatcatggctgatcttgttcctgaaggtcagacaaaaccagaatcaaacttaacctttggtgttgttgacttaaaggttgggactattgcccactggattaaaatttcaatccagcttatttcagatatgcctactttggcggcttatattgaaggtcgtcttgcttatggtgttcgcttaaaactagaagcaaaaattgtagtgggtgatggtgttacttctggagcgcgttcatttattggtttgattgaaacaaatcaatttgaagttatcacacctggagcagatgatactgcaattgatgtgattaaccgcgctaagtataaagctgcttctactggtctcttacctgaagccattattttgaatcctgaagattggggtgcaattgaacgtataaaaggtactgatggtcactatatctttggttcccctggtgcagcggtccagccagttttatggggtttgccagttattctgtctgctgcaatgacttccggtaaatattgggttggtaaccttacattaggtgtctctgccttcattcgtgaagatgttgctgttgagttatcaacagaagatggcgataacttcgttaaaaacttatgtactgtccgtgctgaaatgcgtgcttgttgtggtgtggcaattccagatgcttgtgctggtggtgacttgccagctacagcaacacctccagcgggtggttaa

SEQ ID NO: 428 - DNA, 303 bp, Acinetobacter baumannii
gtgccgattatgagcaatataagtctgagcaacgtacaaaaatcgaatatgttgagcgtgaagtgcaaaagatcgttgaacgtcctgtttataagtctgcttgtgttgacgctgatggcatgcagcaaatcaacgatcttatcaaagccggtaataccagctaacttaatgcagccatgccctaatttgaatgaattaacgggcacaacgggcaaagattggatgttatggtctgtcgatacggttgctaaatacaatgattgtaaagcccgtcatggtggagttataaaagccctcaattga

SEQ ID NO: 429 - DNA, 1398 bp, Acinetobacter baumannii
ggaatcgttatgaacgctttaaccgcactatcaccattagatggacgttatgccagcaaatgtgatgcgctacgcccttttctttctgagtttggtttaattcatgctcgtgtcactgtggaagtgcgttggttacaagcgctttctaaccgtccggaaattgttgaagttgctcctttctcaactgaaacaaatgcagctctagatgcaatcgtaagcaacttctctgaagaagatgcgaaccgcattaaagaaattgaacgcacaactaaccatgacgtaaaagcagttgaatacttcttgaaagagaaaattgcaggtattgctgaattacaaaatgcaggtgagttcattcactttgcttgtacatcagaagacatcaataacttgtctcatgcacttatgcttaaaaacggtcgtgaagttttagtatcaagcatgaagcaaattttaaatgcaatctctgctttagctacaactcatgctgaacaaccgatgttgtctcgtacacatggtcaaactgctagcccaacaactttgggtaaagaaatggcgaacgttgcatatcgtttagctcgccaaatcaaacaatttgaaaatgttgaattattaggcaaaatcaatggtgcagtaggtaactacaatgctcacctttctgcttatccaaatgtggattggccagcgcattcacaagcttttgttgaatctttaggtttaacatttaatccatatacaactcaaattgagccacacgactacatggctgaattatttgacgcgttacgtcgtttcaatacaattttgatcgactttaaccgtgacgtatggggttatatctctttaggctacttcaagcaaaaacttaaagaaggtgaagttggctcatcaactatgccacataaagttaacccgatcgactttgaaaactctgaaggtaacttaggcattgcaaatgcagtgttggctcacttaggcgaaaaattaccaatttctcgctggcagcgtgacttaactgactcaactgtacttcgtaacatgggtgttggttttgctcaaagcttaattgcttttgatgcttgcttaaaaggtattggtaaacttgaactcaatgcaaaccgcttaaatgaagatcttgaccaagctcaagaagttcttgcagagccaattcaaacagttatgcgtcgttataacgttgaaaaaccatatgagaagttaaaagcattaactcgtggtcaagcaatgacgcgtgacatgatggttaacttcgtaaatggtaacgaacttgctcaagtaccaagtgaagagcgcgcccgcttagctgagcttacacctgcaacttacacaggtaatgctgctgaacaagctaaacaaattaacgaattaattagcaaaatctaa

SEQ ID NO: 430 - DNA, 1368 bp, Acinetobacter baumannii
agtaaagttatggctaaaaaaccgatttataaatcactttattttcaagtgattattgcgattattgcgggtgttttggtagggcatttctcaccaagtacaacgcaaattgttaatggtgttgaacaacatattccaggtttaggtgagcaactcaagccattaggtgatgcttttattcgtttgattaaaatgatcatcgcacctgttattttctgtacagtagtaagtggtattgctggtatggaaagcatgaagtcagttggtaaaactggcggtgttgcgttgttatacttcgagatcgtttcaacaatcgcgcttctgattggccttgtggtgattaacattgcaaagccgggcgtaggaatgaatgttgatcctgcaactctggacacttcaggtatccaaaaatacgtcacttctggtgagtcacaatctaccattgatttcttgatgcacatcatcccggatacggtggttggtgcatttgcaaatggtgaaatcttacaggtccttctttttgcaatactatttggttttgcgcttcataagttaggtgatgcaggacgcccagttttaaagttaattgatcaaattgcacacgtgttctttaacattgtgaatatgattatgaagcttgcgccaattggtgcatttggggcaatggcgtttactatcggtaaatatggtgtaggttcactggtacagttaggccagcttattatctgcttctatattacgtgtttactctttattttcttaattttgggtacaatcagccgcattagtggattcagtattctgaaaatgattcgcctgattcgtgaagaactattaattgtacttggtacatcttcttctgagtcggtcttaccacgcatgttacgtaaacttgaaattgcaggttgtgaaaagtcggttgttggtttagttattccaacaggttattcatttaaccttgatggtacgtcaatctatttgactatggctgcaatctttattgctcaggcaacgaatacacagcttgatattcaacatcaaattactttgttgttggtactcctaatctcatctaaaggtgcagcgggtgtaacaggctctggctttattgttatggcagcaactttatctgcagtaggacatattccggtagctggtttggcattgattttaggtattgaccgcttcatgtcagaagcacgtgctttaaccaatcttgttggtaactctttggcaacgattgtagttgcaaaatgggtgggtgctttagataaagataagctcaatgatgctttaaacaacccagatgaagttgacagaaaaatgttggctccaaaaaatcctcaggttgcagaaggtttagattaa

SEQ ID NO: 431 - DNA, 876 bp, Acinetobacter baumannii
gcttgggttatatatatgacaaaaattgcagaaaaatcgaaacaagaatatggcgacttactaaaagaaaaagaccatttacaagatatggaacagcttgagatgactattgtctcgatccagacgccgtatccttctattgtaagaattcaaggaaaaatcaacacattacaaccagagctttggcaagctcccaatttggcaattcggttaattgtgaacaatccgccagagggacaacccatttcacgcgtctatacggtccgttcatttaaccctgtaaatgctcaaatcgaaattgattttgttaaacatgaagatttaagcccagcaatggaatggcttaattcggctcaagtgggtacaaaaatcgggcttattggcccccgccctcatttcattcccaatttcacagccaaaaagcatgtggtcatgtttgccgacgatacggcagtacccgcgttatattcaatactcaagcaatgggaaaatggtgtaagtgctgatattttcattgaaagttttgaaaaagacattgctagccaattacccgaacttgagcatgtcaaaattcattcgttccataaagaacatcacacgtcacagaaaggccttcttttaaaggcagcatttgcgctagaaaattatgaaaatattacgatttgggcggcttgcgaacgcaacgaagcaagagccttacgtcaattttttctagaagaccaacagttaaataaaaatgacgtgcgcattgctggctattggagagatggcatatctagctcagagttagacaaattgcgtgctcagcattatcaggaacatattcagcaaggtaagaccttgaacgaatatgatgacctcgatttagcaaattaa

SEQ ID NO: 432 - DNA, 879 bp, Acinetobacter baumannii
gagtggtctatgtctgttgttgcatttaaacaagttgatgtttttacttcacaagcatttaaaggaaaccctgttgcggtcattatggacgccagtaccttaacgtctgagcagatgcaagccatagcgaactggaccaatctttctgaaaccacatttgtattgccacccactgattcacaagctgactatcaggttcgaatctttactccacaaagtgagttgccgtttgcaggacaccctaccattggtacagcctatgctttgcttgaggcaggactagttaaagcgaaagaaggtcagctggtacagcagtgcgctgctggtttggtgacgctgaccgtgaatgactcaaatcatatttcctttgagttacctacacctaaaattacaccattagatgcactgcaaaccgagaagttggccgagattttaaaatgtaaaatcaatactcaatggaatgccgcattggtggatgtcggagctcgctgggttgtattgcaagctgttaatgctaaggctgttttggcaagtcagcctgatctaaatgctttaaagcaatttagtttagatatgaaagtaacaggctctacaatttatggattttatgaagaaagtaatgagcaaaagcgcatagaagttcgttcatttgctccggcatatggagttaacgaagatcctgtttgtggtagcggtaatggtagcgtggcatcttttattcgttaccatggtattttgcctgcgcaaaatgatgtggtgctttcttctcaggggcaagctttagggcgtgaaggacagcttcaacttgaattacatcaagataaaattttagtgggtggagctgctgttacttgtatcgacggtacgattaagttgtaa

SEQ ID NO: 433 - DNA, 1059 bp, Acinetobacter baumannii
atcatgactatgaatatccaacaggcgctcaaccacattaccaagaacattcatttgactcagcctcaaatggaagaaattatgcgcagcatcatgcaaggtgaggcaaccgaagcacaaattggtgctttaatgatgggcttacgcatgaaaggtgaaagcattgacgaaatgacagctgctgcacgtgtcatgcgagaatttgcgatcaaaatcgatgtgagcgatatcaaacatttagtggatatcgtgggaactggcggtgatggacaaaatttatttaacgtttctacagcgtctagctttgtgattgctgcagcaggtgcgaccattgcaaaacatggtaatcgtggcgtttcaagtaaatcaggttcatcagacctacttgaacaagcaggtattcatcttgatttagatatgcaacaaaccgaacgctgcatccgtgaaatgggtgtgggtttcttgtttgcaccaaaccaccacaaagccatgaaatatgctgctggcccacgtcgtgaacttggtattcgtagtatttttaatttactcggtccactgaccaacccggctggggtaaagcgctttgtcattggtgtgttttcagatgaactttgtcgcccgattgccgaagtgatgaaacaacttggtgccgaacatgtcatggttgtccattcaaaagatggtcttgatgaaatcagtcttgcagctccgacaactattgctgagcttaaagacggtgaaattacggaatggacacttaatccggaagatgtcggaattgagtcacaaactttaaatggtttagtggttgctgatgcatcggcaagcttaaagctcattaaagatgctttaagcaaaaataaatctgatattggtgaaaaagctgcaaacatgattgcgcttaatgcaggcgcaggcatttatgtagcaggcattaccaagacttatgctcaggctgttgcattcgctcaagatattatttacggcgggcaagcattagagaaaatgagtgttttagctgaatttactaaaacattaaaacaatctcaggcagattaa

SEQ ID NO: 434 - DNA, 1068 bp, Acinetobacter baumannii
aagtccgctataatacaatgtcaatgtctctataaacgagtggaaaagttaaatatgtcagaacaccgtaaacctgaacagggtgtaaaacttcgtggcgcagaaaaagtcgcaagaattcctgtaaaagttgtacctacggttgaagtgccgcgtaaacctgactggattcgtgtcaagatgacggcaccagaagaagttcagcgtattaaaacgactttacgtgctcaaaaactccataccgtttgtgaagaagcagcttgtccgaaccttccagaatgctttggcggtggtacagcaacattcatgatcatgggtgatatttgtacacgtcgttgccctttctgtgacgtagcgcatggtcgtccaaatgcattggaccctgatgaaccacgccacatggcagagacaattgccaatcttaagcttaaatacgcagtaatcacttcggttgaccgtgatgacttgcttgacggcggtgcacaacactttgtggactgtattaaagaagctcgcgcacttagcccaaatacattacttgaaattttagtaccagacttccgtggacgtatggatattgctttacgcattatgactgaatgtccaccagacgtatttaaccacaacattgagactgtacctcgcctatataaagcgatgcgtccaggttcagattatcagcactctttaaacctattaaaaatgtttaaagaatactgcccagacatcccaacaaaatgtggtttgatggtgggtattggtgaaactgaagaagaggtcattgcattgcttgatgacttacgtgctcacgatgtcgactatgtcactattggtcaatacttgcagccttctaaacagcatgcaccaattgaccgttttgtaacaccagaagaatttgaacgttatgcagagcatggccgtaaacttggctttagaaatatttggtctgcaccaatggttcgttcaagctattttgctgatcgccaatactatggtgaacctgttcctgaagttcgtcgcaaggtagatcctgcgaaaaaaattgcggtacaagcaatcgaagcttaa

SEQ ID NO: 435 - DNA, 1413 bp, Acinetobacter baumannii
gatctatatatgcaaaaaaaactgccaataccagataacttaccaaatcatttaacggatattttttatcacatcaatataagtttgcctaaaggcgatttaaaagaaactgtaaagttagatgaagctataaatcaacttaacgcaagggatgtatatgctgtacaggattatcctctgcataatttatctgaatatgcgggttgggctattaattcggaaataactcaaactgcgagtatagaaagccctttattcattgccaattggtactactgggggcaacagctttatagatctattaatccgtataaattagacctaaaaactccaagtttgttagaaattcctgcttatacaaaattaccagagcctttagattcggtcattcctgaacaagatgaaagactggatctttctgacaccgatgccaaaaagattactggccctatctctgccatgcatggtgttattcctaagggcagcatatttaaacaaggcgatgtgattctaaaaaaagatgagaggttaactcctgaaaaactaattatcttaagacgggcagggatcaaagaattaactatttataaaaaaccaaaaattcttattgtaagtatgcattcttttgataaagaagaaatgagtgaggaaagtctgtatgttaaagatgttttgaaaacatggggctatgagcaggtagaaatcaaatcacttaaacctgaacgttacgatgctgcatttaatagccttaaaaaagataataattcggctttagatgaatcattaacgacaagcaggaacgattatataaagttctttgaagaacagactatgaattttgatgtcattctttgttgtacatatcaaaatagtcgttccgctttatttcagcttgagaaacttccgatctttgatcaaagtagtatatcagcggctttgaatactcgttgtatgcctggtaatgaaattaaaattctcaagggtaaagatagaacgccacctagtcgtgagacagttcagatttatgatgagaacggtaaacacaaaggtatgcgtgtagtcgttacagaagacaaagcgactattattaacttaccgggtgatatccaagatattgcgattctgatgcatgcttttgtgaaatatattttaaataaacacatctcagacttttttgatcatgcttatttcaaaggtaaaacggacatagagattgttcctgatgtaacaaatagaaaattgttatggggtcattacaagactcacgaaagtggggaatatatattagaaattattgaacagcagccatatcaaatagagccacctcttagtgcaaattgtattgtaatggttccgtttcaagaaaaagtaattgccaaaggcaatgatttatattttatgaaaatagattga

SEQ ID NO: 436 - DNA, 834 bp, Acinetobacter baumannii
gatgtatatatgcaccgggaacaggctgactacttgcatttgcgagagttgggcggtttagaattattaaaagcacattatcaccaaacacaattttcaaagcatactcatgaaggatattgtattggtgtcattgaagagggtgcacagtctttttttaggacgggtcagctacatgttgcccctaaaggtgacattattttagttaatgcagatgaaattcacacaggctcatctgctgttgaatcgggctggcgttaccgtgcaatctatcctacacccgaaatgcttgctgaagtaagccaagatttttttgagcaaggccatggggcaccttggtttccgcaagctgtaattcaggacttgggattatctcaacaactctgtttattatttgatttattagaacaaaaagacaattttttgcttaaagaaaccatgtatttatcaacattagcctgcttaatggtacgtcatggtaagtcaagacacaccttttgcgagttgccagaagcttattcaaaagtattaaaagttaaagatttgttagctgatatacctgaaaagaatttttctttgcaggaattggctgatatggtcgggttaagtgcatggcattttttaagacaatttaaaaaacatgtgggtttaccgcctcatgcatggttagtacaggcgcgtttgcaaaaagcgagacaattattaaaacaaggcgttcaaattgtaatggttgcacagcaatgtggtttttctgatcaaagccattttaatcgtcattttaagaaggcgatgggtgttacaccaactcaatatgtggcgagtcttaatctttaa

SEQ ID NO: 437 - DNA, 1305 bp, Acinetobacter baumannii
catctacatataacaataaaccaaagaggaagtattatgaatcttccaatgacaatgtcattacaaaccttatcttttgaagagtttattaccaccattgcggctgcattaggctgcggcttattggtaggtctggagcgcgaacgaagtaagttaaaacacgaatataaaactttcgcgggttttcgttcttttgcaattagttccttactcggagcagtttgttttttatttggtaccgcaatcgggattgtaggcgctctacttataggcgcgatcagtattgtatctcttaaaaatcagccaaatgaccccggtgtcaccacagaacttgcctttattatgacttactttattggggcactttgtatctggaatatttcgttagctgcggggctcgccgtcatcatgacgattattttattagcaaaacaatcaatgcacggcattgccagtcaatggattaccgaatcggaattgcgcgacgggatttttttacttgctctacttctaattgctttacccttagttcccaataaacctttttggggacccgttctaaaccctcatgtgattttaaagttactgacgttgattttatttgtacaagccctcgcacatattgcaaagcggcttttatcctctaaaaatgccttattactttcttctttagcctcgggttttgtttcaagtactgccaccatcgcgagtctaggcttagaagtacgctctggtcgcgcgaatgcaaaaacaaatgcgggtgcagcattaatgtcatgcgtttccacattggtacaaaccttaattattgtcgtcggtataagtttggcatggttcaaactcattatatttccaacactcattgcattggcttttttagcggtatgggctttcatcttattacgtaaggcagaaccaagtacgacttcatctgaactcgataccagaatgttcagcttaaaagaagcgattattattgctgggacacttacgctcattcaggcaggggtttatggcctaagtctatatttaggtaatgcaggcttaatcgcagggacactacttgcctctttgttcgaaatacatgccgctattgcagcagtgattgtacaaggtgaaccaaataactctcagacttcgttattaatcgcgttcatgggtggctttgctgttcatgcaattgccaagagcattaactctgccatttctggtggactgcattatgcccttgctttcatacctgcccaaattttgcatatgacaatatttattggcttgctatggatgaacatacattggttctaa

SEQ ID NO: 438 - DNA, 276 bp, Acinetobacter baumannii
atcatgaatattgaacaaatgctatctgttttaaaccctgagattgtagagcgtttaaaaacagcagtagaaattggtaaatggccaaatggtgttgctttaacgaaagaacagcgtgaaacatgtatgcaagctgttattgcttgggagttaaagaacttaccagaagaacagcgtagtggttatattgaccgtggtacaaaagaagagggtgaggtttgtgaagatgatcatcacaagcatgagcctgaatttaaaccgattcgttttgtttaa

SEQ ID NO: 439 - DNA, 501 bp, Acinetobacter baumannii
aaacggaatataaagatgacaaataaaaagaatctaggtattggcggcataattgttttattgattgctgcatatttgggtctggacttatctgggcataaaagcaatccgacaccatcatcaagcatacctgcgaaacagcgtactgaaacgacgttttcaaatgatggagtagataccataaaggctgcttatgaacgtagacaaagtaacgttcaagtgcagggtagtggtcgagtaaaagcaatcttaagagaagataatgatgggtcgagacaccagaaatttattctaatattaaaaaatggactttcaattttagtagcacataatattgatttagcaccaaaaattgaagatttaagaaagggtgatattgtcgaatttaacggggaatatgaatataacgaaaaaggtggagtattacattggacgcatcatgatccccagaaccgtcatgaaaatggttggctgaaacataatggtcgtatttatcaatag

SEQ ID NO: 440 - DNA, 291 bp, Acinetobacter baumannii
caaagcctcttcttagaggcttttttattgccagtttctggagaaatgggtatggcagaaccagcaacatcaacaagcacagcaacatacggtttagtaacaaatttagcagggggtgggatggttttatatggcggtctttctacaactgaatggatggctgtagttgggggaatctgtgcctttgcaggtttgataattcagttgtggtccgcttatcgaaaagatcagcgagatgaagagttacataaaaaattgatgggtgaagataatcatgacaaacaagactaa

SEQ ID NO: 441 - DNA, 492 bp, Acinetobacter baumannii
atgaggatttttagggagttttataaagttaaaaatcgtcactgtactctatgtttttataatatatattttaagcaaattaatttatatcaattaaaaactctaaaaatgttcaatgtatcaaacccagcaaatgccgttgttgtaggtattatcgcaataattgctacagttagtcttctgatatggaagtttaatttttatctcggtatagatatatacaccagtggagaggtgctatttaaaacattattgtatgccgccctaataggactatttagttactattttcgccatacaattaaaattagtaatacagtgattttatcattaccgctttttttcttttgtattcggcctattctaaactacaaaatgacgcataccattggaaatgtaccactgtatgcaacacatcatgggcaaggcttaatattgctgagtttaacgatattagcatgtatattgtgggcctatacggctaattcttag

SEQ ID NO: 442 - DNA, 651 bp, Acinetobacter baumannii
ggctttttcatggaaaccatcggcaaacgaataaaaagtttacgtaaagctaaaaagcttactcagaaagatctaggaaaattgcttggcttatctgatgtctctgttttaaaatgggaaaacgagacaaatacaccaaaacttgagaacatgcatgaattagctttagccttagatacaactgttgagtatcttatgtatggtaaagcttctgaagagtcgagtgtaatagacttcagaccagtttcaagattattgcctgttctcactcacgttcaagcaggaaattggacctcagtgcaaagtataagcaaattcgatattaatcaatggcttcccgccccaccaagtgccggtaaaaatagtttttacatgatcgtaaaaggcacaagcaatgcaccttattttaacgatggtgattatatttgtatcgatccagatgtacctattgattgtgttcaaaccggtgaaatggttgttgttcagcatgaaggtgatgctaccttcaaagctcttgtaaaagaagataatagaatgtatttacaagcacttaataaaaactatcaacctaatattattttccttaaagaagatagcatctataaaggtaagtatgtaggtaagtttgaaactggccgaaaattcttataa

SEQ ID NO: 443 - DNA, 816 bp, Acinetobacter baumannii
ggacttctcatgattaatattcaaaataccattttaggtaaaattgttgaccgtaaacatgaggaacttgctgcgcgtttaaaacaacgtaatttgcaagatgtagaagagcttgcaaaagcagcgactccggtgcgtggctttgcaaatgctttacaacataaacgtccgggcgtgattgctgaaattaaaaaagcatctccatcaaaaggaatcattcgcgcagactttaatcctgccgaaattgctcagcaatatgaacaagctggagcagcatgtttatcggtattgaccgatgttgatttctttcagggtgcagatgaaaatattgcgattgcccgtaatcattgtgccctacctgctttacgtaaagactttttggtcgacccgtacaatgtagttgaagcacgtgctttgcatgctgactgtattttattaattgttgcttgtttgtctgaccagcaactcgaagaaatgtctaaaactgcgtttgagcatcaacttgatgtattggttgaagttcatgacgaagaagagttagagcgtgccttaaagctttctgagcaatgtttattaggcgtaaataaccgtaatttaaaaacctttgatgtagatttaaatactactattcggttgaaaaaattacttccggcctcacgtttattgatcactgaaagtggtattgcgacaccagatgatgtacgtatgatgcaagagcatgatattcacagtttcttggttggcgaaagttttatgaaacaaccacgtccagatcaagcttttactgccctttttggacaacctcaaacggtttaa

SEQ ID NO: 444 - DNA, 1230 bp, Acinetobacter baumannii
gagcacctcatgtcattttcccgcaaacagtttgcactgtctgccatctttgtcgctattttagcaaccggtggcagttttatgttgttacatgaaaatgccgatgcaaaagctgcaccaaccgctgcccaacaagctgctactgttgatgtagccccagtagtaagcaaaaccattaccgattggcaagaatattccggtcgtttagaagcaattgatcaagttgatattcggcctcaagtttcaggaaaacttattgccgtacatttcaaagatggaagcctcgttaaaaaaggtgatttacttttcacaatcgaccctcgtccttttgaagcagaactgaaccgtgcaaaagcccaacttgcttcagctgaagcacaggtaacatataccgcaagcaatctttcgcgtattcaacgtctcattcagagtaatgctgtttctcgccaagaactggatttagccgaaaatgatgcacgttcagcgaatgctaacctacaagccgctagagctgctgtccaatctgcacgtttaaatctagaatacacccgtattacagcacctgtcagcggccggatttcacgagctgaagtgaccgtgggtaatgtagtttctgcaggtaacggcgcacaggttttaacaagtttagtgtctgtatcacgcctatacgcatctttcgatgttgatgaacaaacttacctgaaatatatcagtaatcagcgtaattcagcacaagtacctgtctatatgggacttgccaatgaaacaggctttactcgcgaaggtacaatcaactcaatcgacaacaacctgaatacaacctcaggtacgattcgtgttcgcgcaacttttgacaatccaaacggtgttttattaccgggcctatatgcacgaattcgtttaggtggaggccaacctcgcccagcgattctgattagtccaaccgcggttggtgtcgaccaagataaacgttttgtcgtagtagtagatgcgaaaaatcaaactgcttatcgcgaagtaaaactcggtgcccaacaagatggcttgcaaatcgtaaatagcggattacaagcgggtgatcgtattgtagtgaatggtttacaacggattcgtccgggtgaccctgttacaccgcatctcgttcctatgccaaattcacaaatcactgctagcgctactcctcctcaacctcagccaacagataaaacatcaactccggcaaaaggttaa

SEQ ID NO: 445 - DNA, 876 bp, Acinetobacter baumannii
ggagaactcatgagtgacagcagcaatcaattgatgcccctgtcattgtctgcgcccggtgtaaaccttggtgcatatatcagtactgtcaatcagattcctattttaacggctgagcaagaaaaagagcttgctgagcgttattattatgaccaagatcttgatgccgcaaaaatgctggtaatgtcgcatttacgcttcgtcgttcacattgcgcgcagctatgcaggttatggcctacctcaaggtgaccttattcaagaaggtaacttaggcttaatgaaagccgtaaaacgttttgacccaaatatgggcgtacgtcttgtatcttttgccgtccactggattaaggcagaaattcacgaatatgttattcgtaactggcgtattgtaaaaattgcaacaaccaaagctcagcgtaaacttttcttcaatttacgcagcttaaaaaaatcgagtaaaaagctcacattagaagaagcacaatctattgcaaacgacttaaatgttactccagaacaagttttggaaatggaaggtcgtttaacagcatatgatgctgcttttgaagctcaaggcgatgacgatgatgacaccccgcacactgcgccagtgttatatcttgaagataatcgttatgaccctgctcgtttagtagaaaatgaggattgggaagaacaaagtacatctgctttgcatgacgcaatgaaccagctagatgaccgttcacgtaatattttgcagcgccgttggttagatgacgataaatctaccctccatgagcttgccgctgaatataatgtttctgccgaacgtattcgtcagcttgaaaagaatgcgatggaaaaaattaaagtcgcaatgtctgcaagctaa

SEQ ID NO: 446 - DNA, 1446 bp, Acinetobacter baumannii
aatatggtcattcaacagaggaaggagctttcaatgccacgtaaaaaagaggtcgttagtgggaatttcgttaagtacgatgcggtagttctcggttctggacctgcaggtgaaggcgcggcaatgaagcttgcaaaagctggtaagcgtgttgcaattgtagatgtacgtgatcaactcggtggtaactgtgcacacgtaggaaccattccaagtaaagcattacgtcaaacagtttctagcattattcgctatcagcgtgatccaatgtttcaaaaagtaggtgaatggaagcagttcactatgaaacaggtcttgcgtaatgcgcacaaagtgattcaacaacaggttgatacgcatacgcgcttttatgaccgtaacaaaattggtgtcttccacggtcgtgcatatattcaagacaaaaatacagttttagtttttagccacgaaggcattaaagaaacaattatctgtaagcaaatcgtgattgcgacaggtagccgtccttatcatccgcaaggtcttgattttgaccacccgcgcgtatttgattcggacaaaattcttgatcttgattactcaattcaaaaaatcattatttacggcgcaggtgttattggctgtgaatatgcctcaatctttattggtttagatcataaagttgacttgatcaatactcaacaaaaactcttaagctatctagatgatgaaatcgccgatgctttgtcttatcacttacgtgaacagggcgttttgattcgtcacaatgaacaaatggatcatcttgaaacatttgatgaccacgttgttctacatttacaaagtggtaaaaagattaaagctgatgcgattctttggtgtaatggtcgttcaggtaacacagaaggtttaggtcttgaaaatgttgggttggtaccaaatagccgtggtcaactttctgtaaatgatcaatatcaaactgaagttgaaaacatctatgcggctggtgacgtgattggttggccttcacttgcttcggctgcctatgaccaagggcgctgtgctggtgcaaacatgagtggtgaagacgctaagccagtacgtgatatccctacaggtatttataccattccggaaatctcatctattggtaagaatgaacaggaattaacggaagagaaaattccgtatgaagtcggtcaggcttctttccgtcatttggctcgtgcacaaattaccggtgatacagtaggtgagttgaagattcttttccatcgagacactttggaaattttaggtattcactgttttggtaataatgctgctgaaattatccacattggacaagcagttatgcacagcccaaacaatactttgaaatattttgttgaaacgacttttaactatccaacaatggctgaagcataccgtgtagctgcacttaatggtatgaatcgtttattttga

SEQ ID NO: 447 - DNA, 660 bp, Acinetobacter baumannii
ggatacaccatgccgttttttggttttaccccttctgaaggcttattgaacgatatacagactggaattgcgaataaaaattctagtgaaccgttatatccacttcgagacaaaatcgctttacaacttaatgaggaaattattgaaaatgtacttactcagttagtacaacatttcccagcgagtgaaaaaagagatactgccgaaaaactagctggttatgtcaaatcaacagttgctgtgcttttaaagcaattactcagcaaagcgccaaacgatgtggttaaacagtcagttgagttttcagagaaaagcttatttaaagatccgcaaggccaatataaagttggcgtagctttagatgctggcctagttaccaacttgaagcataattttgccgagcttcaagcgggtaatgatattaataaagcagcattagcagaactatataaacagttcggtgatgctatggtgagacattttatgtctgactttaataaaacattagatttaggcatgattaagcgtaaagcagccgatattggcgctgctgctgtaactaaagcagttcatattgcgatcgacaaactcattccaagtttaaatcgcactgaactaaaagcgatggctgaatatcatgatggactattctttaactaa

SEQ ID NO: 448 - DNA, 453 bp, Acinetobacter baumannii
tgtcttcacatgtttgaatcgagtcacttattttttattattttaggttgcttaagcacctgtatttttcttcttgtttgtttacgtccttatttatttcccaaacaaaagttctttgcccgtcctgttattactaattttgaaactcaaatgtttatacgcttaaaacagagtttcccaagttatcatgttctagcacaagtggcttttagcgcattaataaccagtaatgattataagattcgtagtcagttcaaccgtaaagtcactgattttgttttgcttgatgaaaacatggaagtaatagccattattgagctagatgaccctactcaccttgagaaagtagaagaagatcgtcttcgtgatcaaatgctcatagaggcaggttatatcgtaagacgctatacaaacatcccgagtgtacgccagctacaaaaagatatttattaa

SEQ ID NO: 449 - DNA, 885 bp, Acinetobacter baumannii
gagatcaacatgactgcaattactgcaagcatggtaaaagaattacgtgaccgtactggtcttgcaatgatggaatgcaaaaaagcattaacagaagcgaacggtgacatcgaacttgctattgataaccttcgtaaatctggtcaagctaaagctgctaaaaaagctggcaacattgctgctgacggtgcaatcactatcgttcaagacggtaataaagcgatcttagttgaagtaaactgtcaaactgacttcgttgctaaagacgaaaacttctctaactttgcacacacagttgctgctgctgcattagctgctggcgaaactgatgctgctaaaattgctgaattaaaattagctgatggccaatcagttgaagaagctcgtatcgcgcttgttcaaaaaatcggtgaaaacatccaagttcgtcgtgcgaaaatcgttgaaggcgaacaaatggctatctataaacacggtttaaaaatcggtgttgtagtttcttatactggtgatgctgacactggtaaaggtattgcaatgcacgttgctgcattcaatccagtagcagtaaatgctgaagctgttccagctgaccttatcgctaaagagaaagaaattgctgaagcgaaagcgttagaatctggtaaaccagcgaacatcgttgagaaaatggtaactggttctgttgagaaatacttaaacgaagttgctcttgaccgtcaaatgtacgttatcgacaacgagaaaaaagttgctgacgtattaaaagcgactggtacaaatgttgctaacttcgtacgtttcgaagttggtgaaggtatcgagaaaaaagctgaacttagctttgctgaagaagttgctgctgctcaagctgctgcgaagtaa

SEQ ID NO: 450 - DNA, 1320 bp, Acinetobacter baumannii
agtataaacatgaaaaaaatagatattaccggaattggtattgggccattcaacttaggtttagctgctcttttgtctcatcatcccgaaatcaaaagcgtatttttagaacgtaaaccagaatttcgatggcatgaagggttgctattgcaaggcacaacattacaagttcctttctttgccgacttggttactatggccaatccttgccatcccttaggctatattaattatttacatcaacatgatcgcttacatcagttttattattacgacagttttttaattccacgccgtgaatatgaccattattgccgttgggcttcaaaacaattacccgattgtcgatttggagaaaacgtaagccatgtggaatatgacgccaagctggataaatttattatagaaagtgaatcagcctcgggcgaaaaacaaaaatatataagccaaaatctggcgattggtattggaactaaacctcgaattcctaaatggctggaaacatgcaaacaccctttggtaaaacattcagcggagtttgcaaaaattcaggaacaactcaagcaatgtaaacaggtcacggttattggttcgggccagagtgcggcagaatgtgtacttgctttatttaattcacttacaccagaacaagtaaaagcaggtgcatctattcgttggatcacacgttctgccggctttcacccaatggaatattctaaacttgggcaagaatgttttacccctgcatatatgcaatatttccaaagcctgcctagagataaacgccgcgatattgctgctagtcagggcctgatctataaagggattagcttctcaaccattggcgatatatatgatgtgctttatgagcgttcagtggctggtgaaaaatctggtttaagcctatacacaagctgtgaggttgaatcggttgaagaacttgaatcgggttctctgcgtttaacctgtttgcacacccaactcgatcaacgttgcgaattagaaactgatgcccttgtcgcagctacaggctatgttcatgattggcctgaatggttccaaaatatgaaaggttctattttagcggttgatgataaaaatgattgtattgttcaagaagactttacggctttacgttgtgatcagggacaaggtcgtattttcattcagaatgccgagatttttcagcaaggcgttggttctcctgacttaggaatcggagcaactcgaaattcagtcattattaatcaattactaggacgtaatgcttatcgaattcctaaacagtcttctttccagcactatggtttgccagaataa

SEQ ID NO: 451 - DNA, 975 bp, Acinetobacter baumannii
gatgtgaacatgctgaagttcttggcacttgatcgatttacaattttgttggttggcatggtactactagcaactttttttccagtcagtggtcaagctgcgcagtatttcaatacattaactacagtcgcgattgctattttatttttcttgcatggtgccaagctgtctcgtgaggcagtcattgaaggtattttgcattggaaaatgcacttactggtatttgcaattacgttctttatttttcctgctattggtttattggctaaacctattcttttacctctattagggcagcagctctattggggttttttgtttatgtgtttcttgccatctactgttcagtcttctattgcatttacttcggttgcaaaagggaatgtagcgggggcggtatgtagtgcatctttctcaaacttggtaggtatgtttattacgccggttttagtcagtttctttattttaggacaaagtcagcacggatttgatcctacatcttcaattatacaaattactttgttgctattagtgccttttgttttagggcaattacttcgtccctatgtttttccatatatggcaaaagtaccaagtattgtaaaagcatttgaccaaggttcaattttgatggtggtctatggtgcatttagtggggcagtggttgcagggctttggcatcaggtgagttggaaaaccttactgcttttgaccattgcttgttctgttttactcaccattattatgctgcttgcactttatttaccgcgcgcttttggttttaaccgagctgatcaaataacagtgttcttttgtggctcaaaaaagaccttggccagtggtgtacctatggcacaaatcttatttattggccaacctttaggtatgatcgttttaccaattatgatctttcaccaaatacagttaatggtctgtggggtgattgcaaattacttggctaaatcccaagattaa

SEQ ID NO: 452 - DNA, 393 bp, Acinetobacter baumannii
cttaggtgcattatgaaaaaaataattttagcgaccgcaatgagcggtgttgttttattactaggtgcttgtgcaaccacgcctaaaaacactttagcaattcaaaaagaaaataatcagtttgaagtgactggaattggcaaaaccaatttaattgcaaagaataatgcggttactgcggcacaaaaaacatgctctaagagcacaacaccagttattgttgatgaaaaaacgtcttatcacggggttttaaaagatgtggtaagtgaaaagactggtcaaatggtagaagctgctgcgggtgtcatcggtactttaactggtaaaaatgcatctttagcaaaagatgatgattatcaaacaacgcttaccttctattgtaaaataaattaa

SEQ ID NO: 453 - DNA, 1026 bp, Acinetobacter baumannii
tcgtgtcgcatgataaactatttacaccaagagcaaaactggcaatcacaactcagtgaccttattaccgatcctttagagttgttgaacctgctcgagttatccactgatcagctattatcaggggcgattctggcttctgaaaagtttaaattgcgtgttccgcgtgcgttcgtcggaaaaatgaacgctaaagatcctcttgatccgcttttactccaagtgttgccacatcatttagaacttgaggaacatcctgagtttgtcaccgaccctttaggtgaagaagcagccaatcagttaccgggtgttttacataaatataaatctcgttttttactgactttgaccggtgcatgtgcggtccattgccgttactgcttccgccgtcactttccttatcaggaaaatttacctaaaaatgaagattggctaaacattaaaaattatatcgagtcgaaccccgatattaacgaagtgattttaagcggaggtgaccctcttacgctttctaaccgtaaattagcgctttggctagaacgtttatcatctctcaaacaagtgaagattctgagaattcattcacgcgttccaattgtcattccaaaccgtatcgacgaagagcttatttctttattaaaaaacagtaggctgcgtattattctggtggtacactcaaaccatgcttctgaactcgatgactttacttgttcaaaattgttgcagctatctgaacaccacattactgttctaaatcaggcagtattgcttaaaggggtgaatgattctgctcaaactttaactgatttaagttatcgtctatttgaagctcgcgttatgccatattacttacatgtattagataaagtaaaaggcgcacaacattttgatttaataccatctgaaatagatgcgatatatcaagacgtgttagcgagcctaccaggatatttggttcctaaactcgtcagggaaattgcgggcgaaaagaataaaacaccgctttttggggctacaactttttga

SEQ ID NO: 454 - DNA, 1446 bp, Acinetobacter baumannii
aagaaacgcatggaaactttagattcttcaatttttgacctcaccccaattccaatgtggattgaagacttcagtgaagttaagcagttatttgacttatggagaaatcaaggagttgaaaacttatatgaatttctaagtcaaaatgaaaatctagtggttgaatgtgctcataaaattaaaattattaaggtcaaccaaaaagtattagacctttttgaagcgaaaaaccaagaagagttatgtgccaacttaaatcttatttttaaaaaagaaatgtttgaagcccatattcatgaactcgaagcgttatggaatggcaaaactcatttctcgagtaccactataaattacacgctctctggtaagcgtattgatgtacaactacgtggagcaattttaccaggttctgaaactacgtttgaccgtattttaattaccaccgaagacattactccgtatcaaaatgcacttcgtcaggaagagaaaaatcgacgcctagcagagtcaatgtttatctactccccgacttcgctttgggttgaagattttagccgtattaaaaatagaattgatcagcttaggctattaggaattgaagactttagaacttttttagatgtacatcctgaatttgttcgccaatgtatagaagacattttaattttagacgtcaatcagtcgactctcgatttatttaaagcaccagataaaaccactctgttaaaaaatacccataaaatttttgccgaagaaatggtggaaacttttagagaacagctgattgaactctggcaaggaaatattcaccacaagcgtgaagccgttaactatgcgttagacggtcaaatcagaaatgtcttactgcaatttaccgtattccccggttatgaagaaacttggggattggtacaggttgcgcttacagatattactgcacgaaagaaagccgaaaattatctagaatatttaggccagcatgatgtactgaccaaactttataaccgagctttttttacagaagagcttaatcgtttaaatcgcagtattattcgccctgtttcttcaatttttttagacatgaacggcttaaaggaaaccaatgatcaacttggccatgatattggtgatggtttattacgtcgagtaggtaatattttaaatcaggcaattatgaatactgcttatacagcttctcgaatcggtggcgacgaatttgtcattttaatgcctggtgcagatgaagcgaatgttttgatgatgctgcaaaccattcaggagctttttaatatagataatcaatattattcaagtcaccctattagtattgcaattgggcacgccacaacaaaagaaaatgaacaagttgaagatatgctaaaacgcgcagatcatcatatgtatcaaaagaaaaaaagttattatcaagaaattcttctaccataa

SEQ ID NO: 455 - DNA, 807 bp, Acinetobacter baumannii
ataaaaagcataaccatgacctatcaatatcatgatgaaagtattgtaaccgaactccctgaagataccgtgtttgtcttcggtagtaatatggctggacaacatggtagtggagccgcacgtgttgccagtcagcattttggggctgtagagggtgtaggacgtggctgggctggtcagagctttgcaattccaacattaaatgaacatatccaacaaatgccactctcccaaatcgagcattatgttgaagactttaaagtttatgcaaaaaatcatcctaaaatgaaatactttgtgacagctttaggatgtgggattgcaggttataaggtttccgaaatcgctcctctttttaaaggcatacatcacaatgtgatttttcctgaatcgtttaaaccgtatgttgaagaagatgctgtttcacagttcccaacactcactcaaaaaatggttcaaagtttcattaatgatgaagttattttctactttaatcacggcagtgaatcttttgaagatgctttagataaaacggatttatcacgtgctgaaaaagcgatagcgcttattgtacttaatgaggaattgtatcctcgtgaccgctatggcagaggccgtgaccacgaattgagagatattttaggtaagctcaatggtaagatttttaatattcatggtaactcagaaggtgcaatgattttcgtaagtgtaattgttgcgcttatggaactttatgattttgatgagcaagattttataaaattatggcgcggtgagaaaaatattgaccacccaattaaccgttaa

SEQ ID NO: 456 - DNA, 891 bp, Acinetobacter baumannii
gatactggcatgttgcttaagtctttagagttttttttagcggttgcagagagtggaagtttttcattggctgcacaaaaaatgtgtacggttcaatccaatatcacgagccacgtgaaaaagcttgaagaagaattaggtgtgattttattaaatcgtcataaccccgttacattaaccaatgcaggacaccagctacatagttatgctgtgcaaatgatcgcactgcataataaagcgaagacaatcttccgagaaggtgatattgacccgaatgaaactattcgtttgggcagtatggaaacgacagcagcaatacgacttccgcaattgcttaatgaatgtatgcagcaacatccgaatttgccgcttgaacttcaaactcacccgacaggatatttgttaaatgctgtgcaacaaggagaagtcgattgtgcttttgtcgcttctaaatatgtgattccagagctatatagttttccggtgtggcaagaacaactggttttggtttgcccaaaacaacaaattgattttcccgacattgccaccctcgcaaagactcgatttattgcatttcgacaaggatgttcctatcggcatgcaattgagttgtttttaaatgatcacagtgtgccaccttcgcaaattatggaaatgggcagtctggatggcattgtaagctgtgtggaattaggtgtcggttttgctttattgccaaagtcatatctgaataaagtagccgataaagtctcattaagttgttttgaaattaacactgaatctgcacatttcactacttatttggtcgcccagcctcctgaaacatggggcagtaatttaaagcaatttatttgttttattgagcaacaatttatacagaaatgcgcttaa

SEQ ID NO: 457 - DNA, 360 bp, Acinetobacter baumannii
atgtctttaattaataaatttttagaaatcaccgaaaagcctgctattgaagttgttgaaatcgagcaattgggtaaagtgggtttgcgccaacttacgattgcaacacgtgaagagtggactgaagctcaaaaaaatgaccccaaaacagcggttggcgttctttttaaaagtacagtttgtgacccagattctggcgagcttgctttggttgatctgcaagaagaacaattacttaaattacctattgtggttgtaaatgatctgtttttgaaaatctgtaaagcaaatggtattaaaactcaagatgaaataaagcaggaagttgagttaaaaaactccgaagccgaccagaattaa

SEQ ID NO: 458 - DNA, 393 bp, Acinetobacter baumannii
gagaaattaatgtctaagcaagattacgaaaatggattaaaagtacgcacagaagtgatgggagaagcttttgtaaaacgtgcccaagaaaataccgtgccctttacccagcctttacaagactggattaatgaacatgcatggggatcgacttggcaacgtgaaggtgtgctgccacgtaaatatcgttcattaattactttggcaatgttaactgcactcaaatcaccaacagaactcaagggccatgttcgtggtgcactcaacaatggttgtacagttgaagaaattcaggaaactttattgcatagcctgccatattgcggtgcccctgctactcaggaagctttccgggctgcgttagaagtcattcaagaatatcaacaacaataa

SEQ ID NO: 459 - DNA, 591 bp, Acinetobacter baumannii
gttagattaatattaatgacggattcagcaatacaaataattcaccaaaatattcatcagcgtcagtctattggtcaattagttgagccagccccaaatacagatcagttagagttggcttttcaggcagctttaacagctccagatcatcatagacttaagccaacgcgttttgtaattgtgtcaggtgaccaacgtgctgcttttggtgaagttctggcaaaagcattggtcgatttgggtgagtctgatcctgcacagcttgaacgagtgaagcaacatccttttcgagctccgctacttattttagctcttacgcaattacaagatcatccgaaagttccacacttcgaacaaattttgagtacaggcgcagcagtacaaaatcttttgttatctttacaagctcaagggttctcgaccatgtggcgtagtggtgccgttgtcgaatcaaactggttaaaacagcatttaggtctgcaaccgcatgatttgatttcaggtattatttatgtcggcacagcagctaaagcaattgcaccgcgtgcagatattgatagtaaagaattcgtaaaagtttggcaggcttaa

SEQ ID NO: 460 - DNA, 372 bp, Acinetobacter baumannii
ggatttctaatgacttggattttaaataataagcgatggtctttgatcatcgttttgtcaattctttacctaatccaaattggttacaccaatcatctcgcaggaaaggtaaatcaagctgagcagcaatgccaagcacaaatacaagatattgagcgtaagcaggtaaaagcccttgctgaagcacaaaatgagctaaataaagtgagtgccgattatgagcaatataagtctgagcaacgtacaaaaatcgaatatgttgagcgtgaagtgcaaaagatcgttgaacgtcctgtttataagtctgcttgtgttgacgctgatggcatgcagcaaatcaacgatcttatcaaagccggtaataccagctaa

SEQ ID NO: 461 - DNA, 1149 bp, Acinetobacter baumannii
ggatttctaataatgaagaaaatttttatttcaattgtatttggtactcgtccagagctcataaagttggctccggtaattttattagcaaaacaagactcacgatttcaggtagaagttatttttacaggacaacatgatgaattagttcgagatgcgatagatttctttggggttgaaattgaccatcgccttaaaattatgaatgctggacaaagcctaaatcagcttttaattcatggcttaacgcaacttgaaaatatctatacagatggtcaaaaaagagatgcaattgttattcaaggtgatactacaaccgtgttagctgctgggctagttgcattttcaatgaagattcctgttgcccatgtcgaagcaggcttacgttcttatgatttagatcatccgtttcctgaagaaggcaaccgccagttagtttctcgtattaccaaatggcattttgcccctacagaacaatcaaagcgtaacttgttaaatgagcagattccaccttcattgattacagtgacaggaaatacggtagttgatgctgtatatttaggaaggaaactcatagctgaaaagacaggtttgaaaaatcaacttgagccttacggaattgaattaaaacaaaacgataaagttgtacttataactgctcaccgccgtgagaattttggcgaaggaattcagaatatttgtaatgctgttaagtatttagcaaaacagcatcctgatttacattttatttggcctgtacatttaaatcctgctgtacataatgtagtgcacgataaatttaaaagtcatgctcaaattcatcttgtgaagccactcgattatccaagtttattggccgttatcgaccgctccacctttattttaacggactctggtggtttacaagaagaaagcccatcatttaataagcctgtcttaattttaagagacacgactgaacgcccggaagtggtagaggtgggagcaggggtattggttggaacaaatcagcagaaaattattgaagaggctgagaaacttttaacggattcgcagcattaccaaaaaatggctcatgttgaaaatccgtttggtgatggacgtgctgcccagcgaatattagatgaaattgccagaacttataactag

SEQ ID NO: 462 - DNA, 417 bp, Acinetobacter baumannii
gtgcagataatgataaaagtgttaggacaaaggatgaaaaaattacaatttattgccagttgcccacaacatggggtgcttgatcatccaccaaatgaatgccatatcactcaagaatatgtagcggctttactgtttaaacaactggggaattatggttttgatgcacagcatattgtgcatgaacatgaaaaagtggaagtaagtattgataatcaccttttaccattgtctattacttgccagcaaaccgaccatgatgggcatttaatgtgtgaaatctctgccaatcctgatgaagaacaagactggtttgagaaaatcgaaacacaaagtattattcgtcagcttgcacaggctgttgaaaatagcttgaaagccgatcatagcttttcagcatttgagtggaaaagctaa

SEQ ID NO: 463 - DNA, 249 bp, Acinetobacter baumannii
tgtggagcaatatgctcattcataaaacgtttaaaattatcacggaataattctaaatctgcatcatatgccaacataatattttccttcggctttattgttttatcgaatctcattgctgtgcatgctaatcattttttacacaactgtcatggcttagctgctcatttaaactgtacttttcagtcagccaataaaaaaggaagccaaagcttccttttttatataggtagatttgaattaatctaa

SEQ ID NO: 464 - DNA, 1083 bp, Acinetobacter baumannii
agatcggcaatgacgacacttaaaaatgatcgtttcttacgtgctttattacgtgagcctgtagataccactccaatatggatgatgcgccaagcaggacgttatttgcctgaatatcgggaaacacgctcaaaagctggtgactttctatctttatgcaaaaatacagagtttgcttgtgaagtgactttacagcctttgcgtcgctacgatttagacgcagcaattttattttcagatattttaactattcctgacgcattagggcttggactatattttgaaactggagaaggtccgaagtttcataaaacggtacgtactgaacaagatgtggctaacttacctaagcttaatgctaaagccgatcttgattatgtgatgaatgcagtaagtacgattcgttctgctttaggtggacaagttccactgattggtttttcgggtagtccttggacactggcgacttatatggttgaaggcggctcaagcaaagagttccgttttaccaagcaaatgatgtatgcgcagccggaagttttgcatgcgttgctcgaccatttagcagattcagtcattgactacttaaatgcgcaaattgatgcaggcgctcaggcaattcaaatctttgatagttggggtggggctttagcacaccgtgaatatgtagagttctctcttaactatatgaagaagattatcgcgggcttacaacgtgaaaaagatggacgccgtattccagtgattgtgttcactaaaggtggcggtcaatggttagaaccaatgatcacgacaggtgccgatgcattagggctggactggacgacaccattaaatacggctcgaaccacggtggcaggtcgtgttgccctacaagggaaccttgacccggctattttatatggttcggcggcttcaattgaaaaagctgtaaaagcaatgttagatgatgcttacgcaaacggtgagaagaccggttacgttgctaacttagggcacggtattacccaatgggtagatccggcgcagccaaaaatctttgtagatacggtacatgaatatagtgctaaatatctaggatag

SEQ ID NO: 465 - DNA, 2790 bp, Acinetobacter baumannii
atcaaccaaataaaagtggatatagtagggcgatctttattttgtctattaataaatatgtatttaaataacatgaaatatgtaggggctttaaaaaataagcgctcatttatttttgtatttgttgcactgtttcatccacttgaaagctatgcgcaagaaaccgtagagcaaacacaaaaccaagctaaaccagataaagtagttcgtgttgcggtgacaggttctcggatttcaaaagcacaaaaagatggcccgaccagtgtgaccgtcattaccgcagctgatattgaaaaacaaggttttagtaatgcatttgacgcactcaataacctgacgcaaaacactggttttgtgcaaggtgccgattatggaaatacttttacacctgcagcgaacgccattagtttgcgaggtctgggacccaatcatactttgactttaattaatggacatcgggttgcggactatcctgtaccgtacgacggttctgtcaatttcgtaaatttagccaatattccaactgccattattgaccgtattgaaatattaaacggtggcgcttctgcaatttatggttcagatgcaattgcaggtgtggtaaatattattctgaaaaagaaaacagacggcacacaatttaatattaaggcaggtggaaccaaaaaaggtggtgaaaacttacgtttacaattgagtggcagtaaaactttagacaagcttagtcttgtttatggggttgaactcagcggccgtgaaccgatatgggcagccgatcgggattttatgaagagccgaactcgtttgggagaaaaaccagacacgattgtgggccgtaaaaatgctgatactggtaaatacctttctattggtggatgtcaggcctttaatggtttatttaacggatcagtcaataatattggacaagcaggggcggacaattgtgccagtggtttggcacggccaacttattggactgttcatacccaaaaccgcagccaaaatggttatctcggtttagattatgagttaaatgataaaacccaactatttgccgattttttaattggggcaaatcaaattgaaaataatacccgtagtccgatatggacttctttagctgcaacgagtggttatttcctaaatcaagattcgggaaattatgaaatttggaatcgccgttttgcacctgaagaattaggtggggtagaacgaataaataaaaaatggaaagaactttcttctaacttaaattttggaattcgaggcgatattggagagacgagctggagttatgaagcagcctataatggttccatttatactagtcagctaaaccgccaaggcttattacgttcgaatgttgatgaatatttcttaggtcagcaacttggtacagatgcagatggtattcctatttattcacctcatttagatcgtttaagtcgaccactaacagcaagtgaatttgaaagtatttcgggcacaacaaaagaaaaagataaatcgtgggcacaaagtttaaccttaagtgcgaatggtgatgtgtttaagttacctgcaggaatggccaaacttgcagcagtggctgaaattgggcgtcaaggcttttcgattaagccagatcaggcagttgaaaatggtgagttttataatacgagttctagtggagaatatagtggtactcgtacacgccaagcacttggcgcagaattattcttacctttagcaaagccattaaatttaaccttgtctggacgttatgaccgttatgctttgtcagataacagtattgataagctaactttcggttcaggccttgagtttaggccacatccgactttattggtacgtggtaactacgcaactagttttcgtgcgccagatatgaactatctgttcttaaataaacaaaaaggttatttcgcaagtacaacagattatttacgttgtaaccaaacgggacaacctttagataaatgtacctttaaagattactcgcctggggcgaactacactttaaccggaaacaaagagctgaaacctgaagagggtaaatcttatagtgcaggttttgtttggtcaccaaccaataaatttgatatcagcgtcgattactgggatatcaaaattgataatcttgtgaccaatttaagtgcggacaaaattctacgtttggaagcagattgtcgtttaggcaaccaagatattaactctgcggcctgtattgatgctttggcacgtgtagagcgtaaccctgcaaatgcagttgtcgatccaaatgtaattaagaatattaatatcgttccgattaatgcagcatcagaccatacccgcgggattgatttcactactagatggcgctggaaaacagacagctttggtaactttctctggacggtaaattatagccgtgtactagaacatgaatatcaacaatcaaaagatggcgaaaaagatgattacttaaaagatttaagcattcctgattggcgtgaccgttttaataccagtctcagctggagctttggtgattgggcatcaacagtattagttaatcgttatggcaaaattccaaacggagaccagactgcctatttaagcccaacgtatttggtgaactggagtggtacttatcaaatctctccaaaagcatctgcttcaatcattattaataacttatttgacaaagtgaaacgagatgacacgggcggttggccatattatccagtaggatcatattcaccattcggccgtcaaggttggttggagtttaactataaattctaa

SEQ ID NO: 466 - DNA, 480 bp, Acinetobacter baumannii
acttgtaaaatttggttgagcagaatattttataactctaaaaatataaactttttgtggaaaataataatgaacggacagtgtttatgtggtgaaacagctttcgaagttgagttaaaaaatcatgatgtacatgtttgccattgctcgatgtgtcgtagacaaaccagtggtgtcattatgacagttgatgtagttaaaggtagtttaaagtttattcagcaaaagcatcttagtgtatttaactcttctgaatggggtgaaagaggcttttgtaatgcttgtggaacaacaattttttggagaacaaaagatcaaagttactgcaatatcaatgtgttttctttaaatgaaccagtaaaagatttgaaattagatatggaaatttttattgattcaaaacctgatttttataattttaagaatgatacaaaaaaactgactgaggctgaggtgtcagctttatttaatttagaataa

SEQ ID NO: 467 - DNA, 1296 bp, Acinetobacter baumannii
gtgataaaaatgacccaaaacttacatcatattgttattgtcggtggtggcgctggtggtttagaactcgccacgcaacttggtgaaacttttgggaaaaatggtaaagccaaaattacattggttgaccaaaatttaactcatatctggaaaccattacttcatgaaattgcggcgggttctttaaatcctcacgaagagcaaaccaattattttgcccatgcagagaaacaccactatgaatttgtgttgggaacattaacagcagtaaataaagataagaaaataattgatttaattccccctcaagtctctaaagaacaaaatacccatattcaacaactcagttacgatacactggttttagcgcttggttcagtatcaaatgatttcaatacacccggtgttcgtgaaaactgccatttcctcgatagccgtaaacaggcggatattttccagcaagatcttttacacttatatatcgaagcgcaaaatcaacccgatcaacgtacattaaatattggaattattggtgcgggggcaacaggtgtcgaacttgcggctgaactgattgaaacgaccaaaaacttttatcgctatggtttgaaaaagatccatccgaatcaagtcaaaattacactcattgaggcctcagaacgcatcctccctgccctaagtgaaaaaacagctgaacatagcgcaaaacagcttcaaaaaatgggtgttgaaattttaactaaacaccgtgttgaaaaaattgatgaacaccatatctattttagtaatggtaaccagctcaacagtgatattacggtatgggcagctggggtaaaagcaccaaaagtacttgaaagtcttagcgatttcgaacgtgacaatattaaccgcttaatggtctatgcaacgctgcagacctattccgatcctaatgtatttgcatttggtgattgtgcgcattgccaacttgatgcaagacacccgcctctcggaccacgcgctcaagttgctagtcaacaagcaagctttttagtcgatgctatggctgctagactaaatggtcgatcacaaccgatgtttacttttaacgacaaaggttcacttgtgtctttaagtcgtaataaagcggttggagaattactgggggatgtcagtgtccaaggatatattgccaaaacgatgtatgtatctttatatcgtttacatcaagcaacaattcacggatacactcaagctggactactcacaatgaaagatttacttacaagacgagtacgaccaaaaattaagctgtattga

SEQ ID NO: 468 - DNA, 1611 bp, Acinetobacter baumannii
ctcagggaaatctttatgaatactgctgttaaattaaataaagatcagattttttcgatgcttcctcgtgcagccaaacaaaaattaatgattgttggtatcggatggatcattgttgcagcaattgaagcaatcgcatataccgtattggcatttgcaattgtcaatcaatggtcaccaagctgggttctcatcagtgcaattgcagcaatattagtgacagttatagtcactcgtgctggcttccttactggtgtgcgcttagctggagacctatttgctgagttaggcaaatctttagctcgtgccaagctctcttggtttaccaatgaacagcgtgctcagattaagacaattgctggacagggaattcctgggtttatgagtattcctgctcatcaattgcaaacctttttacatgcgccttttatgcctttatttctaacaataggaataagcatgcttgccggagcaggcgtagcatttgtcgctttaggcttacttttactctctttatttgctcaattcctagcacaacgtgcactcatgcatattgataaaaaacgtaatactgccgatttagctgcttcacaagcaacgttggaattggttgatcatgttgagttattacgcacagcagcgggaccagaacgtgcggttcaaaggctggaaaatcgttgggaagaacaagaagcgacattagtacagattaatcgtgctgctgcatttgcaagttttgttgcaaccttggcaagtgttttacccattgcagggatggcaacatatctggtgatcgctggagtcaatcatgctgctttggtattggcattactcgtcttaattggacgtgcagcagcgccgttaggtgaacttgctaccgcagggttgcatatcaatgatttgtttgctgcactgcgcaattttaatcagatcacacatccacctgagttgcctgagccattacaccctcaaattcctactggtcatcatatttcggtacaaggcgttagctatgcgccagcacttgaaaatatgtctctcgatatcgcattggggagtcgagtatgggttaccggaccaagtggtagtggtaagagtactttacttgaattgcttacacggtttgatgatccacaaagaggaaaaattacccttggtggcatagctcttgatcaaatgaaatatgaagatttggtctcgaatatcgcttatgtcacacaagaacctattttgttcacaggaacactggctgaaaatatccgtttaggaaaacctgatgcaactgatgatgaaatagaaaaggctgcaagagatgccgcattaggggcaatgattgaccgtagttcagaaggaattaatcaatcggtgggtaaacaaggcaccgcattgtctggtggtgaacgtcagcgggtcgcaattgcccgagcattactcaaaaatgcgccgattttaatacttgatgaagcaacctctgccttggatgaagagactgagcaggaaattgttacaacgatacgtgctctttcttctacggttatttttgtgacgcatcgtgattcaaccatttggcaaccgactcaaactatcaatttagcttcaacttctgtttaa

SEQ ID NO: 469 - DNA, 357 bp, Acinetobacter baumannii
ttaaaaccctttttggcgcagcttcccatgtcttatctttatttagcaattgcgattgcttgtgaagttattgcaacttcagcattaaaagcatctcaaggttttactgttccaattccgtctattattacggttgtgggttatgcagttgctttttatttattatctcttacgctcaaaacaattccgatcgggattgcttatgccatttggtcaggcgcaggtattattttaatttctgcaattggctggatattttacaaacagcatttagacttggctgcctgtattggtttagctttaatgattgcaggcattgtgattattaatgtgttttctaaaaacacccatctataa

SEQ ID NO: 470 - DNA, 1407 bp, Acinetobacter baumannii
gcaatacgaatgagtacatcaaatacatcgtctcctatggatcagaacgtatttgatccacaagccgctgctcaggcacgtgatcgccgtaaaaaagtgattgaaaaatcactggctaaacgtcaccgcaaagaaaaagctttccgctttgcaggtttatcagcagttgttattggccttgcattcgttgcgctactgtttggcagtattttggcaaaaggtttaccagcattctggcaaaccagtatgaatgtaccagtctacttcgatcctaaagtaattgatgcaggtccagtgccagtacgtacacaaggcgaaacacctgcacattaccaagaacgttatgtcgattggcaaacgaaaatgggtatggtcgattgggatagcctgatcgtaaatggcatgattgctaaagatccttcacttgcatcacaacgcgattatttaagtagcctttatgcaagttctgaagcttatcgcttacgtgatatggtgtttgctgacccatcactcattgggaaaaaagagaacctaactttcttgggtgatgccaatgtagatgtatggctgaagggtaatattgaccgctcattaccagacgatcaacaacaacttgatccggaaatccgcaagctggcagatgaccttaaagcaaaaggtgtacttgaaaatacctttaatacgactttatttaagaatcctgactctcgtagttcaccagcgattagtggtcttgcaggcgcattcatgggttcattattcatgatgctgattgtgatcattatctcgattccaatcggtgttgccagcgcaatctatcttgaagaatttgctccaaagaatgtcattacagacattattgaagtcaacattaataaccttgctgctgtaccttcaatcgtgtttggtttgttgggtgctgcaatctttattggttggatgcatttaccgttgtcagctccttttgtcggtggtttggtattaagtttaatgacactaccaacagtcattattacaacacgtgcttctttaaaggctgtgccaccttcaattcgacaagctgccctaggtttaggtgcttctaaagtacaaaccgttttccatcatgttttaccgttagcattgccgggcatcatgacgggtgcaattattggtgttgcacacgcactcggtgaaactgcacctttacttttaatcgggatgagtgcattcgttgcaagtgttccaaccaccccatttgatcaagcaactgctttacctgtccaagtttatctatggcagggtaatgagttgcgtaacttcttcgaaggccgtactgctgctgcgattatcgtacttcttgcattaatgattggtttaaacagccttgcaatttggttacgtaaaaagttcgaagtgcgttggtaa

SEQ ID NO: 471 - DNA, 1071 bp, Acinetobacter baumannii
agagaaagaattgaggtgaataaaatgagcctattacaacaacttgcaatcaaacatccaatttttctggctccaatggcgggcgtctctactcctgaattagcagccgaggtttcaaatcaaggaggccttggatcattaggcttaggagcaaacacaccgcaaagtgcacgtgaacaaattttaaaaactcaagcgctcacggaaaacccatttcaagttaattttttctgtcatcaatcgactgagcttaatgtagaaaaagcaaaacaatggcttgagtacctacgtcctcattttgaaaaattcggtgctcaaccgccccaagaattacactgtatctatccaagttttttagacaatgatgattttttaaatgttgttttagaaactaagccaaaagcagtaagttttcactttggtattccgcatccgcatcaaattaaagctttaaaagaggctggtattttgactatggtttcggcaactaatttgatcgaagctcaagctattgaggcagcgggtatcgatattattattgcccaagggattgaggcaggcggacatagagggattttcaaccaaacttttgatggggcaattaaaactagtgacttggttcaactgattgtgcagcactgcacacttccggttgtagccgcaggtggcataatgactggcttacaagccaaacatatgttgggcttaggcgcagccgcagtccaattaggcacagcatttgttcaatgccaaacttcaaatgcttctgccgaatatcgcaaagccctatttagtaaacctgtaacacagattagtgctagtctttctgggcgccctgctcgggggatactcaaccattggcatacaaaaattgattcacctacccgccctgtacaacctgaatatccttatacctatgatttagcaaagcaactaaatgctcttgcaagcaaacaccaagattacggttttggtgctttttgggcaggaagtaacgttgcacaaatacgtgaacttgaagcacctgatctggttaatcaactggtcgttgaaatgctagacagtgaatag

SEQ ID NO: 472 - DNA, 2655 bp, Acinetobacter baumannii
tcttcaaccttcgttttcttttgctggatatcaacagtgacacaaaaacttgatcaagtgacatcttcaactttatcactcgctaaaacaaacaccacaaacgtcacaataaatgcatttccttcagcttttgagcaacctgatattaaaatgactttagataaaacagcgttaaaacccgaacaacttacgcatattccaaattttgaaaatattccagcctcaacaaaacgcatcaagccgctcaacaactttttagggcaagaccgcgccaaagcttcggtagaagctggcatttccttaccctactctggttataacatttttgcggtaggaacagcaggcttaggtaaacgcaccatgattaagcgtttactacaacaacatgccaaaacaatgcctactccagatgattgggtatatgtttataactttaaacaggctcgtcagcccattgcgttacgcttccctgctggacaaggaaccaagtttcaacaaactcttcatcaaacttggcaaattattttaaagcagcttgaacgtcgttttagtgcagagacttatcataaccgtatcgagcgaatccgtcaggaaactggtgatgaacagcaacaggcacttgtcgaattaacgaaagaaggcgaagaacttgatctaaaattgatttctcgaaatgagaaacatggctttgtacctgtacagttaaaagataaccaggttcaagaactgactcaaacagaaattgacgctttaaatagtaaacagcgtgctgagattgcagccaatattcgctatatggataaaaagcttgagcgtcttggtctgcatttgggcgacttagaagatgacgcacgcgacaaagtttctgttttaaatcgagacatcgccactcaagtggttatgccacgcatggacttaattttaaataaatatggtcaagtgaaaggccttgaagattatttaaaacagtatgctcaagatatcattgacaatgttgagttaattttagaacaagaagaagatgactttgctcctgctatgttcaatcgcgtaccggcgcgttatcaagcaaatgtgattgtctcaaataaaccaaacagtggtgcgccagttatttttgaagatttcccaacacactacaacttgctgggtcatgtagaacaactcacccacaacggtacaattactacagatttcactcttattcgtcccggtgccctacatcaagccaatggtggttttttaatgctggaggctgaacaactactcgaacagccttatgcatggcaaggtttaaagcgtgccttaaaatcgggccaactcaagctctcttctcttgaacatatgttgactttaaccggcagtatctcgatagagcctgctgctattccacttgatattaaagtggtactgatggcagagcctgagatttattatgaaattttagaagtagaaccagagcttggtagcgtatttaaaattcgcgcagattttaccgatacattacaacgtaatgacgaaaatgaacaagcttatatgcagctgattgctgactatgtacaagccgataaactgcttccatttgaccgcagtgctctagcggcattactgacagactcaagccgtcaagccgaagaccaaagctccttgtcgttacatgcttcaacgttgggtgatcttattcgtgaagcgcatcatcatgcatttaaagccaatgataagatggtaaccgaccagcacattaaccttgccctacaacaccgacaatatcgcttaggctatttaagagaactttactggcaagatttatcgcgtggaacccagttaattgaaacttctggccatcgtttaggtcaaattaatgccctctctgtcattcactatgcagatgttgagtttggtttaccttcacgtttaactgcctcggtttatcaaggcggtggcgatattcttgatattgaacgtagtgtagaactaggcggttcattgcatgccaaaggcgtgttactcatgtctagcttcttaaaagctcactttggccgtgaacagattttacatttttctgctgctctggcttttgaacaaagttacggccaagtggacggcgacagtgcaaccgttgccgagctttctgcattaatctctgcaattagtcagttaccaattgatcagtcatgggcaattactggttctatgaaccagttaggtcaagttcaaccaattggtggcgtaaatgcaaaaattgaaggcttctatgatgcatgtaagctacaaggtctaactggcaaacaaggtgtcattattccacgccaaaacatgcaacacttaatgctacgtcaagatgtgattgatgcggtacgagagggccaattccatatccatgcgattgatacaattgatcaagcacttgagattttaatggctcgccctgttggtactctcgacaaaaaaggcaaatacagcaaacactctatttatgctgctgtaatggaacagcttgaatactggcaagcgatcgaagatggcgcagaagttgaagaggagccaaagaagaaaaagaaaaataagaaaaaaattaaaaagcatgaagagctcacagccgatgatcttcctcaagaaactcaagaggaagttgctacgctaaagcaaaaataa

SEQ ID NO: 473 - DNA, 1902 bp, Acinetobacter baumannii
ttaaaattgatgagcttaatgaaatcggttgttttaatttttgcctctttggcagtgaatattgcgtattcagcagaaacaaatccatctattcaaaactactggtccattgcagaacaaaaaaaattagaccaagacattacatggcaaaggctcatgtatgccaataaaaaccagaaaagtgaggtcacttatgctggctatttcctatcagaaaatggaaaaaataatttaaaagaagaactgaaagcagacatttcggcattatttatacctacgcaagataaccagtcaattcgctgtaaatttccggcacgcagtcagtggcttatacagcaattaggcattcaagaaaatgaattgccacaagtaaaatgttcagaatttgaaaactggattgggcagattaagccttataaagcgaccctaatttacgctacagattttatgggtaatccaagctcaatgtttggccataccttattgcgtctagatcctaaagatcaacagcagttaaacctcgtttcttatgccgtaaactatgcagcaactgtggcaggcaatgacaactggtcatatgcatggaaaggcttaacagggcaatatccgggtgaatactcacttatgccttactatcgtaaggtaaaagaatatggtgattttgagagccgtgatttgtgggaatatgagttaaatctatctccagaagaaacgcgttttttggtgagtcatatttgggaaatgcaacatgtaagcttcccttattactttgtgagtgataactgtgcatatcggttattgggcttagtcgatttagttaaacctgaatctcatctacaagaaaagtttaactacgcttctattccaatggaaaccattaaagcgatgcaacaacagggactcactaaagctcctgtgtatcgacctgctttagaaactcaattattggcccaagctcaccagcatggcgcatctttagctaaagttgctcatcagttagcaatgaagccaattaaagattcgtcggaaacacttaaatcatttagcccatcagatcaggccaaaattcttgagatggcttatgatgatttatatctacagtttattggccgcaaagttgaagaaagctttgctcagccacagcttagacagcttttagcactacgaagtcagattgatttagacaaacagcgccaagaacctaaaagaccatcaaccgagccgactcaaggccataatgcacgtaatgtctcgctaaaactgggcgaggtgcaaggtgacaagtttatcgagataggtcataggcaggcttatcatgacttaatagatccacagggcggataccgtgctggtactcaattattatttttaaatggtaatgcacagtggcgagatgatcatttaaaactagaacgtcttgatctgttagaagtgaactcttataacccgattcaaccatttaaaactccgctgacttggggatttaacttaggctggcgtcaggaagcggttcatgacggtgtttatagtgatgaaaagcagcatggcgtcgcgagttttaatgctcaggttggttacagtcttgcagattatgcgcgcaaacatatttgctatgggcaggtacaaacttatgtccaagcgggttcaaatttagataaaggctggcgtgtgggagtagggccgacattaggatgtatgaatcagtggtttgaaaaatttaacactgtggtacaagttgagctgccatattgggaagaccaaaaccaatggaacttacggctaaatacacagtggcaatatgccattaatagtaataatgccattcgctttaattgggattatgaaaaacaaaatcatctagattggatgaaatcaagcttaggatatgtttggttcttttaa

SEQ ID NO: 474 - DNA, 1392 bp, Acinetobacter baumannii
gagatcctgatgaacgcggttaatgcttcatttacagattacaaagttgctgacatctcacttgctgactacggtcgtaaagaaatcaaacttgctgaagcagaaatgccagctctgatcggcttacgtaaacgttatgcagcgtctaaaccacttgctggtgcaaaaattcttggttgtatccacatgaccattcaaacagcggttcttattgaaacgcttgttgaattaggtgctgaagttcgttggacatcttgtaatatcttctcgactcaagaccacgctgctgctgcaattgctgctcgcggtattccagtttttgcttggaaaggtgaaactgaagaagaatatgtatggtgtcttgaacaacaaatcaatgtaaatggccaaccttgggatgccaacatgatcttggatgatggcggtgacttaactgctcttgttcatgaaaaatatcctgcacttttagaacgtattcacggtattaccgaagaaactacaacaggtgttcaacgtcttatcgaaatgtggaaagacggcactttaaaagtacctgcaatcaacgtaaatgattctgttactaaatctaaaaatgacaacaaatatggttgccgtcactcattaaatgacgcaatcaaacgcgcaacagatatgcttttatctggccgtcgtgcgcttgtgatcggttacggtgacgtaggtaaaggttctgctcaatctttacgccaagaaggcatgatcgttcgtgtaactgaagttgacccaatttgtgcaatgcaagcatgtatggatggttatgaagttgtatctccatacaaaaacggcgtacaaacaggtaaaaaagaagacattaaccacgatcttcttggcaacactgaccttgttgtaacaacaactggtaactaccatgtgtgtgatgcagcgatgttagacagcttaaaagctggtgcagttgtatgtaacatcggtcacttcgatacagaaatcgacacggcttatttacgtggttacaagtgggttgaagttaagccacaagttcaccaagtttatcgttcagaagacgaaaacaactatcttatccttctttctgaaggccgccttgtaaacttaggtaatgcaactggtcacccatcacgtgtaatggacggttcttttgctaaccaagttttaggtcaaattcacttattccaagagaaatttgccgatctacctgcaagtgaaaaagctgcaaaaattcgcgtagaagttcttcctaagaaacttgacgaagaggttgctgctgcaatggttgcaggtttcggtggtgtacttactcagttaactcaagagcaagctgattatttaggcattgctgttgaggggccattcaaatctgacgcttacaaatactaa

SEQ ID NO: 475 - DNA, 741 bp, Acinetobacter baumannii
gaaaaagtgatgatgaattctgtcaccctcccaatagtcgggcatatgtgctcaccttttcgagaaaaatttggtattccacgtcagcctaatttggtcaatatcgagtcttatatcgaaatggtagaaccttataatgacttattagcttttgagggaatcgaacaatttagtcatctttggctcatctggcagtttcatgacaataaaaatcaggagactgcgactaaattccggcctcaagttcgcccaccacgtctagggggcaatgaaaaaattggtgtgtttgcgacacgtagtatgtatcgtccagcgcctataggcttatctgtagtacgtttaaacaaggttgaaaaagtcggtaaatcattaagagtttatattacaggcagtgatttattaaatggcacgccaattttagatattaagccttatattcaatattcagatgcaattgttgatgctcaaagtggttatgcgcaggccgaaccagaacgaaaatcggtcttatggtctgaaaatgcattgtctacccagcagtctctttttaaaaataaagaaattaatgcacaatatcttgatgaattagaacaagtattgtcattagaccctagacctgcctatcaagaagaccctgaacgagtctataaaatgaaattttcgaattttgatattcattttaaagttaatggcaatgtcattacagttgttgatatggtgaaagacacatcgctcgtgtaa

SEQ ID NO: 476 - DNA, 492 bp, Acinetobacter baumannii
gagggggtgatggataaatttatgcttgaacctcttcaagagagttatagctttacaccaggcaacaacattagagaacaggaaaatgaagggggaccgccacggcagtcccctttttttgttggtgctgttcatcgtgttggtgtgactgtatatctggaaaacgatgaagatcgacaatacttttgggcattctggcgcttaaagcaacgtaaacctgaaaactggctttggaatttggctttagatgaggggattcgagaggattgtgaatgtcggtttgcttatgacgttttaccttcagaatcatctcgtaacggtcaagctgtaaaaatgagtttccaggtgatagttaaacctatcaaacgtagtgctgacttagaccgcaacatcgttaatgtgcgtcaaggcatcgaatctaacgaagtaattgatgacattgaaaaagtgccgaatgaatggctgtcagatgcgttgggagtaaatcaatga

SEQ ID NO: 477 - DNA, 840 bp, Acinetobacter baumannii
gggagatcgatgcatttaactgggcaacaaagcagattgcatattcaaagagacaaaataatgaaaattatgatgttgtctgtagctgtaggttttactgttgcaatggcaggatgtgcttctaaaccacaaattaataatagttctcgctatgcaatggctcctaactattacacagtccgttcaggtgatactttaagtggtattgcaatgcgttatggtctggactatctcagtattgcagagatgaatggtattgcaccgccatatcgtatttatgttaatcaatcattacgattgaagaaatcttcttcaccaagaactgtgtcgacacaagtcatggcgcaaccggaaccaattaagcgtcaaacaattgctttaccgacaactactgcaccaaccacaaccactccaccgccagcaactgttgcgccatcaaccaatacaacagtgggagcatctattccaagctcaagcttacgttgggtgaaaccaaataacggtccggttattcaaggctttaatttggcgaataatgtcaaaggaatccgttacggtggtaaccaaggtgacccgatttatgcggcggctgatggtcaagttgtatacgcagccgatggtctgaaagaatatggtaacttagttttaattaaacatattgatggttacatcagtgcgtatgcccacaatagcaagatgatggtcaagagtggtgacaatgtaaccgcaggccaaaagattgctgaaatggggtcttcaggggcatctcgcgttatgcttgagttccaaattcgccttgacggtaaaccgatcaaccctgcaaatcttttaccaaattag

SEQ ID NO: 478 - DNA, 540 bp, Acinetobacter baumannii
attatggccttaaatattcccgaatctttggcaaacctcgaagcgaactgtggcctttttgcagtttggatggtacttcaacatcatggagtaccaattgatgttgctgagctgattaaagtttgccgctatgacgatgaaggaacttatacgattgctttagccgttgctttaaaaaagttgggctttgaggtgtcatttcactcagatcatgatcctaacattagcccaagcgaacgcatgagctataaagaagcaaaggtattaagaataccaactgggccagcgctgagctatcaagatattcaaacagagacgcaaaatggaaaaatggtgattgtgtactacgacactttagaaggggtagggaatcagtcgctcatttattctatagatcaaaatgaaatctgcttttttgatagttttgagccgatgtcggcagcagtttttgagaatcaacgtaaagcagaaggtatttgccgtcaggctgtcgtaattggtgaccgtaatttaaatattcattcgactaaattaaattaa

SEQ ID NO: 479 - DNA, 1029 bp, Acinetobacter baumannii
ttcgtaaagatgcttttgaactcattcgagttgtttcaactattttggctatggctgaggaacaacatagaggtgatcatgcctagaaaaaagaaagggtttgaactacccgatgtaaaacatgctgcccgtggtcaatgggaagatatttttgcacgttttaatattactgttcctaaaaaagatactcatggaccttgtccgtactgtggtggcgaagatcgttttcggtttgatgataaatatgaaaatggtgattggctttgtaatgtttgtacggaaagcaaaaacagagatggctttgatttaattggtaaagttacaggtttaccgttttctcaaatcattgaagaggttgcttcaattgttggtttagatgcaaccagtactatcacgcctcaaatgcgtaaacagtgggaagaagaaaaaaaaatacgtgatcgtattaaccaggagatgaagcttaaaaaacagcaacaagtagctagacaagcagcaggtttataccgcaatccttatcctggtgaaacaagcccatatcttgaacgaaagcaagtacccgttttacctggcgtgaagattgatcataaagggaatgtactaattcctgcttatgacactgaaggcttcatgtggaatatgcaaactatatatccggatggtggaaagttttttgtttctgatgaagaggacccaaatggaaacaaaaaaggtggacgtacaggcggctgttttttccttctcggaaccatcgagcttgttgacccaatcattatttgcatagctgaagggtacgcaactggtgcaagtattcacttggcaactggctatcccgtggctttggcttttgtagctaacaacattccaaaagtcggtgcagctttaagagaaaaatacccgcaagcaacacttgtttattgtgctgatgatgatagtgcaaaagatgatacaggcatgaaatacgctcaacaagctgtggctgtcactggcggcatcgtagtactccctaaatttaataaggtggcataa

SEQ ID NO: 480 - DNA, 564 bp, Acinetobacter baumannii
tgggtgaagataatcatgacaaacaagactaaacttttcgtaattggttcaactatagccgcctcaatgggcggtttttttatttttgggcctagtgatcagcaagttcaggctacggccgcaaaagagggttatacagctaaaccgaccatcccggtgaagggtgaccgtccgactattggcaatggcaccacattctacccggatggccgtgctgtaactatgaatgacccggctattactcgaaagcaggcttttgagtatttgaaattcacaatgaataaagatgctcgagcattcaacaaaacattgctgaatattccaatttcacaagctgaatatgacctttatctagattttacttatcaatatgggattggtgcctggtctggctcatccatgctgaaaaatctaaaaattggaaaatataaagccgcttgtgaatcgttattgaaatggaaatacgttgcaaagcgtgattgttcagtccgttccaatggttgttatggggtttgggttcgccaggaagagcgctatcaaaaatgcatgggggttaattcatga

SEQ ID NO: 481 - DNA, 1473 bp, Acinetobacter baumannii
agtgtagttttcatgacacaagttgatattgcagcattatctcctcaagtcgtttggcagcattttcaaacactttgtactattcctcgtccgtcaaagcatgaacagcaacttcgtgagtttttacaaaactgggccgaaagtcggaatttagaaacttatgtagatgaagtaggaaatttgattatccgtaaaaatgcgactccgggtaaagaacatatgtctggagttattcttcagggccatttagatatggttacacaagccaatactggtacggtacatgacttctttaaagacccgattcgtccagttcttgaggatggctggttaattgccaaagacactactttaggtgctgataatggcattggggtagctttggcattagctgttttagattcaaatgatattgctcatggcccaatagaagttcttttaacagtcgatgaagaagcagggatgagtggggcacggctattacaggcgggtgtactaaaaggaaaatggctatttaatattgatacggaagagtggggtgagttgtatctcggatgtgctggcagtattgatgttgaggtagagcagccgcttagttatgaaccaatccctgaaaatttgagtattgtgaatattcaggttgctggtcttaaaggtggtcactctggcgtagatattcatttaggacgtggcaatgccaacgttattctggcacgctttttaaatgagtatttggcaaagctgggtggacaccttgttgaatttacaggtggtacagctcgtaatgctttacctcgagaagcattggcaaccattgctatttcgtctaaccaattacctgaattagaaaaattactcgctgaatatcaaacgacatggaaagaacagctaaagggtattgatgacaacttgcaattaagtattcaatccactggtgctgaagtgaccgaagtgattactcaacaacagcaaaacgaatggttgcaagctttggcaacaagtccttatggcgttacaagtatgagtcaggttctaccagatgtagttgaaacctcaaataacattggggtggtgagactaaatcgagaaggtggaaaagctgttttaatggtccgttcaatggtgaaccaagaagctcaagattttgcagagaaaattcaggcacattttagccaatttaatatcggctctacacttacgccgttagtgtcgggttggacaccaaatccagattcggctgctctaaagtgcttacaacaagcttatcaaaatacatttaatattgagccaaatctaaaagtaattcatgcaggcttagaatgtgggattattgctgaacattaccctcatttacagatggtttcgtttggaccggatattcaaggtgcacatgcaccgggcgaacgagttaaagttgatactgtagagaaatgctggaagctactggtaaccgctttggcatctgtagagtag

SEQ ID NO: 482 - DNA, 981 bp, Acinetobacter baumannii
gtagtagggatttacatgaaaaaggttgtggtttttagccaaattgatgaggaaattttgtctcggttacagcaggattaccatgttgtcgtattgaaccctaaactgggtgatattaatgaacagatacgacaagaagtagtagatgctgatggcatgattggggctggtcgtttgcttaatgaaagtaatctttctcctgcccaaaaattaaaaattatttcttctgtgactgtaggttatgacaattatgatgttggttatttaaatcggaaaaaaatctggttagcaaacacacctcatgttttaactgaaacgaccgcagatcttgcttttactttgttattaagtgcagccagaaaagttccttttctagatcactggactaaacaaggtgagtggaaaagaacagttgggccacagcagtttggtctcgatgtttttggaaaaacattaggtattattggacttggtaatattggtgctgcaattgcacgtcgtggcttttatggttttaacatgaatattgtttaccataatcgtcgcgagaaacctgagttagcggaacctttaaaagctcaatatctggggttggaagaattattacaacaatctgattttgtagtgacagctgttgatttaaatgcggaatctaaagctttaatgggtaaggctcaatttgagcttatgcaaaagcatgccatatttattaatattgcgcgtggctcagttgtcgatgagcaagccctaattgaagcattgcaaaatgaagttatttttgcggctggtttagatgtctatgagaaagaacctctgcaagaatctgcacttttcaatttgccgaacgttgtcactttgcctcacgtaggttctgctacagctgaaacacgtaagaaaatggcaaatttagcttataaaaacttggtggaagcactagaggacaagacgcctagatatttagtgaatcctaattttgtgtaa

SEQ ID NO: 483 - DNA, 645 bp, Acinetobacter baumannii
aaggcagttttgatgattgttttaggcttggaaacttcttgtgatgaaacagggttggcactttatgatagcgaactcggcttacggggacaggttctttatagccagataaaacttcatgccgaatatggtggcgtggttccggagttagcttcacgtgaccatgttcgtaagcttattcctttaatgaatcagctgcttgaacaaagtggtgttaagaaacaagaagttgatgcagtcgcatatacgcgtggcccgggtttaatgggagcgttaatgaccggagccttgtttggaagaactttagcattttcacttaataaaccggcaattggtgttcaccacatggaaggccatatgttagctcctttgctttcaagccaaccgcctgagtttccatttgttgcattgcttgtttcaggtggtcatacacaattgatggcagctcatggtattggtcaatatgagctattaggggagtcaattgatgatgcggcgggtgaagctttcgacaaagtcgcaaaaatgatgaatctgccgtatccaggtggaccaaatattgctaaattggcgttatctggtgatcctttagcatttgaatttccaagccccaatgcttcatcagggcttagacttttcttttag

SEQ ID NO: 484 - DNA, 219 bp, Acinetobacter baumannii
cgatgtaacttattatttttaattataatatttattgatcattccaaagacttgccctccctaataagtctaatttactgtagaggtgaaaatgaaaaatatcaaaacaataaactctataacacattcaatattactgatgggagcagtgatctcttctttgggaatgatcggtataagctcagtttatgcacaagagcaagtcgaccctgcatataa

SEQ ID NO: 485 - DNA, 540 bp, Acinetobacter baumannii
cgcatatttgtaaacagaactatattcttaaacagaataatattctgcatttttaaaattaaaggaagtcaaattatggcaaccacattagagctctggaataaagtaacagcttttcctaaaggcaagtggactttctctcgtatgctgtgcttaaaagcaccttatttcggcagtatttcccctctttttattgagttaaaaccgaattattgcgaaatttctattaagaagaagcgttctgtgcttaaccacattggaacagtccatgcgattgcgatgtgtaatatggctgaactggcgggtggaacaatgacagaagttactgtcccaactacccatcgttggattccaaaaggaatgactgttgaatatttaaaaaaagctgaaacagacttaattgcaattgctacaccagtggaagctgattataactgggaaaaagctggagaatatttagtcaacgtagatatttacgacactcacaaagataaagtatttcatgccacaattaccatgtggatttctaaaaagaaataa

SEQ ID NO: 486 - DNA, 588 bp, Acinetobacter baumannii
gtttggagtgtgccagtcatggccaattattctacaaatgatttcaagccaggccttaaggtcatgcttgatagtaacccatgttcaatcatggaaaacgaatacgtaaaaccgggtaaaggccaagcgttcaaccgtgtaaaattacgtaaccttaaaactggtaaagttttagaaaaaacttttaaatctggtgatactttagaagctgctgacatcgtagaagtagaaatgaactacctatacaacgatggcgaaatgtggcacttcatggacccagaaagcttcgaacaaattgcagctgacaaaactgcaatgggtgatgctgctaaatggttaaaagacgactcaaatgaaacatgtacaatcatgttattcaacggcgttcctttaaacgtaaatgcacctaacttcgttgtgttgaaagttgttgaaactgatccgggcgtacgtggtgatacttctggcggtggcggtaagccagctaagcttgaaacaggtgcggttgttcgtgttccgttatttgttcagcaagaagaaagcgttcgtgtagatactcgtactggtgagtatttagagcgtgcataa

SEQ ID NO: 487 - DNA, 2304 bp, Acinetobacter baumannii
ctagtttgcttttttgtatcaatagagactcagatggacgatcaatctttaaaacaggccgctttaaattaccacgaatatccaaatccagggaaaatcagcgtcacgccaagtaagcaacttgtcaaccaacgagatttggctctagcttattcaccaggggttgctgctccatgtttagagattgaacgtgatccttcagctgctgcaaaatatacagcgcgtggtaacttggttgctgtcgtcagtaacggtactgcggttcttggtttaggtaatattggtccattagcttctaaaccggtaatggaaggtaaaggcgttctgttcaaaaagttcgctggtgtcgatgtatttgatattgaaattgctgaaaacgatccagataaaatcgttgatattgttgcttcattagaaccaactttcggcggtattaaccttgaagatatcaaagcgcctgaatgtttctacattgaaaagaaacttcgtgaacgcatgaaaattcctgtgttccatgatgaccaacacggaacaagtattattgtaggttcagcattattaaatgctctacaaatcgttaataagaaaattgaagaaatcaaaatcgttgcttcaggtgcaggtgctgctgccctttcttgtttagatttactttgtgctttaggcgtaaataaagaaaatatcattgttgccgattctcgtggtcttcttacaacttcacgtgaaggcttggatgaatcgaaaaaacgttatgtacaagacattaaagcgactcaattacatgaagtaatggctggcgcggatatgttcttaggtctttcagctgctggtattctcaccaaagatatggtgaaacaaatggctgaaaatccgattatttttgcattagcaaacccagatccagaaattctgcctgaacatgcacatgaagtacgtccagatgtaatcatggcaactggtcgttcggactacccgaaccaagtaaacaatgctttatgtttcccttatatcttccgtggtgcacttgacgtaggtgctacaacaattaacgaagatatgaaaattgcatgtgtacacgcaattgcacgtatggctcacgtagaagctgacgcagctacttatggtgaaaaatctgcttcatttggccgtgactacttaattccacgcccacttgatcaacgtttgattttagaaattgcgcctgctgttgctaaagcagcaatggattcaggtgttgcaactcgtcctatcgaagatttctctgcatatcgtcaaaaactttctgagtttgtttataactcagcattcttgatgaaaccgatttttgctcaagcaaaaacagatcctaaacgtattgcatacgctgaaggtgaagatgagcgcgtattacgtgctgttcaaattgcagttgatgaagatttagctaaaccaatcttagttggtcgtacagcagtcattgaagcaaacatcaaaaaattaggcttacgtttacaacacggcgtaaatatcgagattgtagatcaagaacaaaatccgttatacgaagagttctggaaagactactatcaaaccatgcaacgcaaaggcatcactgttgaatatgctcaacgtgaagctcgccgtcgttcaacactcattgctgcacttctagttaagtttggcaaagcagatggtatgttatgtggtacttacagtagctataacattcaccttgacttcgtacgcaatgtaattggccttaaagaaggcatgaacaacttcttcacgcttaatgcattaatgcttgaagatcgcaacttgtttattgctgatacttatgtaaacactaatcctactgctgaacaacttgctgaaatgactattttagcggctgaagaagtacgtcgctttggtattacaccacgtgtagcgctactttctcattcaagctttggtagtgaccagacagattcaagcgctcaaaaaatgcgtgaagtttatcgtattttatctgagcaagctccagagcttgaagttgaaggtgaaatgcatggtgatgcagcattagacgaaaatattcgtcattttgcattccctggttctcgtttcaaaggttcagcgaacttgttgattatgccgaacctagatgcagcaaatatttcgttcaacttgttaaaagcaacttctggtaacaacgtaacaattggtccaattttgctaggtgctgctaaaccagttcatattttgactccgacagcaacgactcgccgtcttatcaatatgactgctttaactgttgctgaaattcaacagcaagaaaagtaa

SEQ ID NO: 488 - DNA, 1269 bp, Acinetobacter baumannii
catgattgcttgaagaatagaggttttttcatgcaagtgtatttagtaggcggtgctgttcgagattatttacttgggcatccctatcaagaaaaagactatgttgtggtcggtgcaacgccggaacacatgctcgcccaaggttttcaacctgtaggcaaagatttccctgtgtttcttcatcccgaaaccaaagaagaatacgcacttgcacgaaccgaacgaaagtctgggcagggatatcacgggtttcaattctttactgatacaaccgtaagtttagaagatgacttaattcgtcgagacttaaccattaacgcgattgcaatggatcaagacggtaaaatatatgatccatatggtggtcaaaacgacttagaaaataaaactctgcgccacgtttcagaagcttttgctgaagaccctctacgggtattgcgagtcgcgcgttttgcagcccgatatttcccatatggttttcaaattgcgccagagacattgcaacttatgcaaaccatggcagattcaggtgaacttgatgcactaacgccagagcgcgtctggaaagaaacttcacgcgctttaatggaaaatcatgccgatatttatttccaaactttgcgtgattgtggggctttaaaacatcttttccctgagattgatgctttattcggtgtgcctcaacgtcccgaatatcatcctgaagtggattgcggcattcatactttaatgtcattacagcaagcttgtaagtcgaactactcgcttgatgtacgtttcgctgttttagtgcatgatcttggtaaggccctcactccagccgaagaacttcctcgccatatcatgcatgaagaacgcgggattaagccagttacccaattatgtgaacgtttaagagttccgacacaaaccaaacaattagccttatctgtttgtaaagaacatttaaaatgtcatcagattatgtccttgaaacctggtactttatggcgtctattgcaacgcttagatgttttacgtcgtccagaaagagtggaagcttttgtacaagcctgcgagtgtgatgcaaaaggcagattaggactagaagaccgtccatatcctcaagctcaatacatgcgtgaagccatgcaaattgttcgctccattaaagttcaagatttaccagagaacattaagggtgctgaaattggtgaaatgcttattcaatatcgaattgaagctttagctgaatttaaaaatcagcatcaaagtcttagtcactcctaa

SEQ ID NO: 489 - DNA, 195 bp, Acinetobacter baumannii
ccagcctgctttaacatgaccacgatcttcactacgatgcaaataagcattcatgactcgatctcctcaattattatttatctcttgaggaatatgttaaacctgtggggtaaagctaaaaatagagtagatgcaacatattgttgcatttttaagatgattaagatttttataaatattcgttttaaattttag

SEQ ID NO: 490 - DNA, 1473 bp, Acinetobacter baumannii
ttagaggacgtatctgtgagcaaagacactatcatcgccctgcacgctgaacaccaaggccgttggaaaaaccgtgaagaaatcgcggaacgtatgattgcattaatcggtcaattataccgtgaaaaaaatattgtcgtatctgtttacggtcgctctttaattaaccgttctgttatccaaattttgaaaactcaccgtcgtacacgtgttgtagatgttgagctttctgtagtaaatactttccctattttagaagctttagcaaaagttgaaaatatcggttctgcagaagttgatatcggtaaacttgcagttgaatataaagaaaaaggcggtgatgttgacgcttttgttgctcaagctgttgagtcaattaaaggtagcgcaacttctgaacaacctaaagatgtagttctttacggttttggtcgtattggccgtatcttggctcgtttaatcattagccaatcaggtttaggtcgtggtttaagccttaaagcaattgttgttcgtaagtcttctgatggtgacttggctaaacgtgcttctttacttcgtcgtgactctattcacggtacttttgcaggtacaatttctgttgatgaagaaaacgaagcaattatcgctaacggtaacttcatcaaagtaatctatgcatctagcccaagcgaagtagactatactcaatacggtattgaaaacgcgcttttaatcgacaacactggtaaatggcgtgatgctgaaggcctaagccaacacttgaaatgcccaggtgttgcacgtgttgtattaactgcaccaagtaaaggcgaaatgaaaaacgttgtatttggtgtaaacaactctgacattttagatgaagacaaaatcatctctgctgcaagttgtacaacaaatgcgatcactccaatccttaaagtattggatgacaaatataaagttcttaatggtcacgttgagacagttcactcatttacaaatgaccagaacttgatcgataactaccacaaagctgatcgtcgtggtcgtgctgctacattgaatatggttattactgaaactggtgctgctaaagctgttgctaaagcattgcctgcgttaaaaggtaagttaactggtaactctgtacgtgttccaacaccaaacgtatctcttgcgattttaaacttaacgctcgataaagaagttgatcgtgaagaagtgaacgaatacattcgtcaaatttcaatcaattctaaccttcaaggtcaaatcggttataccaactctacagaagtggtatcaagtgactttatcggttctcgtactgctggtgtatatgatgctcaagcaacgattacttctggtaaccgcttaactgcatatgtttggtacgataacgaagtaggttatagctgccaagtattacgtattgctgagcaaatgtgtggcgtaagctataaaaaaatccctgcagaaactaacgcttaa

SEQ ID NO: 491 - DNA, 579 bp, Acinetobacter baumannii
caactaagcgttaacaggaaacaggatatgttaaagaaaggtgttttttatattggtgctgtacttatggtcggctgtacaactttaccagatcattcagctccaaaagagaaaacacctcctgtttctgaaaagaagaagtccgagtcctcatctggtgtaaaaattacaccttatgatcatccggaaattcaacgtaaaagtttacaagtgattgttcctcagcagaaaaagccgcaacgctttaatgatgatggaagccagttacccgcttttaaaactttaatgcaaaaaaccgagcaggcttacaaaaaccaacaatggtccgaggctgagcgctacgctcttcaagcacagcgtttagcgccacaggcagccgagacctatttatttctggcattaactgcaaatcataaacagcaatattctaacgctgagtctcttgcaagacgtggtttaagctttgcacagagtcaagccatgaaaaaacagctttggttggtcattttaaaagctggacaacaacgcaataatccaaaaactgttcaagaagcacaacaagcattgaaagctttctag

SEQ ID NO: 492 - DNA, 921 bp, Acinetobacter baumannii
aaaattttagtgagtagaaaaatgcccaaaccgattgtcgatgtcgcaatagctatcttaattcatcgtggaaaaatattagtgggatggcgtggtgaacagcagcatcaaggtggaaagcatgagtttcctggtggaaaggtagagcagggtgaaacgcctgaagaagcctgccgccgtgaaatttatgaagaagtcggtattggtttaaaagattggcatcaatttgattatattcaccatgaatatgatgacattatcgtcaaccttcatttgttccatagttatgtacctgatgagttattaaatcttattcatcaaccttggacatggtacacacgtgaacagctacttcacctaaacttcccgaaagctaataaagacattattaaaagattatattggcctcattttattaaaattagccatacacttacatctgtagcgaatagtaatgctttattgtattggcgtatagaagatgaatttggcccgcgagaagtagaacaattaacggccttagatgaagggcaacgatcaaatttaattataaatgtagatatttggcagcaattgaaccccgagttaaaaaaacagatcaagactgttcatttaaaacaatctcagctcatgagtttacataaaggtgacttagaggtaggaatacgttttatcgctgcttgtcacgatgcagtttctttacaacatgctcagcaaattggctgtgatgccgtttttgttagtcctgtaaaagtgacggctactcatccggacgttagtgcattaggatgggatcgttttgctgatttaatcgagaagtgccaaattcccgtatttgctttgggaggcatgagtcctgatgatttagccacagcacaacaacatggtgcatatggcttggcgggtattcgtaatttttaa

SEQ ID NO: 493 - DNA, 369 bp, Acinetobacter baumannii
acgatgttagtgagtgagattatttatgaggtccttaaagcgccttttaacgatagagttgggccgcatccattgccagaaggatttgataattcagcaacctatatcacctatcaagggattacaaacataccgttaaatacggttaaaggctggacaggtcacggccgagtaaggattcaaataaacgtctataaccatgaaaaattgcaagcggaaaaagatgctgaagcagtgaaatgggctatggaccaacaaaaatattcaaactgtgaaatcgcggaacaacgtgatggcggttttgatgaagaaacccaagtatggggacaggaaatcgatttttatttatggcaaaacgcctgcaattag

SEQ ID NO: 494 - DNA, 216 bp, Acinetobacter baumannii
ggaccgagcttttggcccagtgcctacgaaccgatatgcttaaataaaaccctgagagtatcggctctcattggctttcagtcaacgaaatatccagtgataacgacatttcgcagcgaaataatacataatttaaatctatcgataataatcttatacctaacttatggtaataaatgtgcttttaccaactttttaggtatagaacagtcttaa

SEQ ID NO: 495 - DNA, 219 bp, Acinetobacter baumannii
aataatggcttgcatatccggccctttaaacaattacgagtaaccaagaatgttaacagttggcctcgcactttaaaacctgaagtgaggcggaaagtggtgagaacgacaatttatattaaaaatagaatttttcagggattgattttgtcgaatagaacttgcggaaaattaagattaggcgtaattgtttttaagacattagagaatgttgattaa

SEQ ID NO: 496 - DNA, 699 bp, Acinetobacter baumannii
ggagatcgagtcatgaatgcttatttgcatcgtagtgaagatcgtggtcatgttaaagcaggctggttagagtcttatcatagcttttcgtttggtagctggtataaccctaaatatatgggggtaagtgcacttcgagtcattaatgatgaccgaatcgatgcccacaatggtttcggtactcactcgcatgacaatatggaaattttaacctgtgtgcttgatggtgcaatttcacaccgtgacaccatgggaaatgaaggccagattaaagcaggtgaatggcaacttatgagtgccggtacaggtgttgctcatagtgagattaataacaccgatacaccagtgcacttattacaaatctggattattcccgatgtaaaagaagccgagccaaattatcagcaaattagtttggacccacgtaatcaacctaacgaatggcatttgattgcaggccctgacgcaaatgcaccaatgcatatccgccaagatgcacaggtaaaatctgctgtacttgaaaaaggtcgtgaactgccagttgagacttcaaaacgagtaaattacgttcatgtaatttcaggtgaagttcgtattggtgagtacgaagtgaaagcgggtgatgctctggtctttgaagataatgccgtgattcatgcaaatgaagacagccaatttatctggtttgatttaccttaa

SEQ ID NO: 497 - DNA, 264 bp, Acinetobacter baumannii
attcacttggtacgtatttcgtgctttacctgcaagtgtttttttcctatgatgtgccccacacatgcgctcgtagctcagttggatagagtacaggtttccgaagcctggggtcgtgggttcgatccccgccgggcgcaccaatttatatataataacttcataaatttatcccaattttataaaattccgactattttacttggtttattaatcattatcgctcaaaatatacccctctttcataatgtgagaatttcatga

SEQ ID NO: 498 - DNA, 900 bp, Acinetobacter baumannii
gggcagacggtgaaccaactgcccttttttctaaaaatgtttcgctgtttacaaggatttgacatgactaaacgtacacctatttcttttgagttttttccgccaaaaactgatgccggtgctgaaaaacttcgtattgttcaccaagaattacagcaattaaatccagagtttttctcgattacttatggtgctggtggttctactcgtgaacgcacacttgctgctattgaagatttcaatggtaaaggcactcctgttgcccctcacctttcttgtattggtgatgataagacgcgtattgctgaactactcgatttatacaaagctcaaggcattgaccgtattgtcgctttacgtggcgacttaccatctggacaggttggtcttggcgaacttccttatgctcaagatttagtacgttttattcgtgagcactcaggcgaccactttcatattgaagttgcggcttatccagaaatgcatcctcaagccgaaagcctcgactcagatatccaacgttttattgaaaaagtacaagctggtgccaatgcgggaattactcaattcttctttaatccagactcatacttttattttatagagcgtttggaaaaagctggaattaacattccagtcgctcctggtatcatgcctattaccaatgcaagtaatttaattcgctttgcagatggtactggtgctgaaattcctcgctggattcgtaagcaattacaagcctatggcgatgacagtgaaagtattaaagcttttggtcatgaagttgttgttaagctatgcgaacgcctcattgcaggtggtgcaccaagcttacacttctactcaatgaaccaagtcgaaccaactcgtcagcttgttgttgaccttggtttaaattaa

SEQ ID NO: 499 - DNA, 777 bp, Acinetobacter baumannii
atggaacaggttgcaaaactagtgattcgcgatttacataagacattcggcgatcatgaggtacttaaaggaatatcacttgatgcaaatgctggtgatgtaattagtattattggttcatctggttcaggtaaaagtaccttgctgcgttgtatcaactttttagaacaaccgagcaatggcacgattaagctcaatggtgaaaaattacgcacggtctttgataaaaaaggcaatttaaaagtggttgaaccaaagcaactacaaaaaatgcgtacccagctgatgatggtatttcagcactttaatttatggtctcacatgacagtactggaaaatgtcattgaagggccaatccatgtacttggagtaaagcgttctgaggcggaagaacgtgcacgcaaatatctacgtaaagtgggattacctgaaagcgttgaaagtaaatatccggcatttttatctggtggtcagcaacaacgtgtagcgattgctcgtgctttggcgatggaaccggaagtgatgttatttgatgaaccaaccagtgcgcttgacccagagttggtaggtgaagtactaaaagtaatgcagggcttggctgaagaaggacgtaccatgattgtagtgacacatgaaatgggtttcgcgcgtcatgtatctaatcaggtgatttttttgcatcaaggaaaaattgaggaacagggccatcctgatgaagtactcaataacccgaaaagtgaacgtttaaagcaatttttgacaggcagtttaaaataa

SEQ ID NO: 500 - DNA, 750 bp, Acinetobacter baumannii
acgtcattattctgctggtgtgaggaagggacaattatgattgaaatccttcaacaatattggcaggcatacctttggaccgatggcctacaaatgaccggtgtggcgatgactgcttggttattggtgctatcgattggtattgggtttgtgcttgctgtgcctttgtcacttgcgcgagtatcagaaaatatctggttgcatggtccagtttggttgtttacctatgtttttcgtggcacaccactgtatatccaactactgattatttactcgggtatttacagctttgattatatccacgagcatcagacactcgatgcattctttcgagagggcataaattgcaccattttggcattcgcgctcaatactagtgcatatacgactgaaatcttcgctggagcaattcgttctattccacatggtgagattgaagctgcccaagcttttggtatgtcaaaatggaaactctacacacgtattatcattccgtcgatgttacgccgtgctttgccgttttacggcaatgaagtcattttaatgttgcatgccacaaccattgcatttacagcaacagttcccgacattttaaaaattgcgcgtgatgtgaatgcggcaacctatgacactttcagtgcttttggaattgctgcagtgttatatgcagtgttggcatttattttgatttggatatttcgtaagttggaaaaacgttggttggcatttttaaagccatcgaatcattag

SEQ ID NO: 501 - DNA, 1905 bp, Acinetobacter baumannii
ttgggattatttacattgaaagaagtaagccactatttaatcgaaaataaaaatatggcatggtccatcactatgtgtttggtcgctgtgcttttaactatttttattttaaatctaattttaggtttacttgttcatttctttgattatagcgagccgatttggtggcatgctttaagtccatattttattgctcttttgctttttattatggtttggtctgtggtgaccgaactttatattttgcgtaaaggtggccattcacttgccaagcagttgaaagctcgtcgtttggtaaaaggtgaaagtacaccagaagaacatgccgcattaaaaattacagaacatctggcacaaacattttccctgaacgttccaacactttatgttttacctgatgaagtaggtgttaatgcattaacggcaggttttcactcgaatgatattgtaattattttaacttggggtgccttacagaaccttgatgagctagagctatatggcttattgggtcatgaatttaaccagattttatcgggtgaagcagtagaaaatactaaactaaaaattttatatagtggtttgactacttttagtcagtgggggagtaagctcgccaaacaagggtttaagcgctacagtccgggttataagcataagttcgagactgtatttgtagccgtagggggtgtgatttggttggcgggaagtttaggtgttttaatcactcgttttattaaatatttaacattaagtggtcgtacatttcgcaatgaccaaaaaacgatgcggttattaaaaaatagcactaatacccaaactttattgcgtatttacgttcaccattctggttcgcagattcatagtgcttattctgaatcgattgcacatatgtgttttgcgaattcacttagcccgcaaagttggatgaatattcacccaagtattcgtgaacgtatttatgagcttaacccaactttattacaagatttgcaattagaaaatttaaagaaacttcgaaatcgtcctttatttagtttgttccatgtactagaagaatctgagactgaaatttatacgccgtggtcatctccacaacctttgcctttgttgcgtctttctccaatcagttttgctttgaatgatgcaattaaaccgttaagtagtgatatacgtcgtaataaaaagcggcctgaacttattcaacgtgcattacaaactgcgactggttcacgtgaggtgatggttgctattttaatgattcgtcaatatcgagaatttattccacaagatgcgccagtaagccatgcaattgtggatgccttacttaatcttgatgggcgtattcatattcagatatttcatgatgcatgtaaaaatattggtcatatgcctgccagtattgctcgtcaatttttgactaaactggcactaattattcaagaagatggggaaattggattacttgatgcacttctactcgagcgtgttaagtacgagttaaacttgatgccacttcatttgccgacagcatttgaagaggtaaaacctcaaattgttcgtttaattgatgcattgcttcatgtgcaacaaatcaatagtccgaatcagttagaggttcgtgaacgtatcttacgttctttgcttaatcctgatgaaatgcatatttatgatgaaatttcggatgaacctttagacttggcagaaattttaaatgatattgctgggttattgctgcgtgaccgcttaagtatattggcaattgctgaaatgtgcttgtggagtgatcgcattatcacccaagatgaacttgatgtgcttgaattgctctattggcgatttggttttgagtctgatgaaattgtagagcaaatgcagaagaaaaatagcgttatgattatttaa

SEQ ID NO: 502 - DNA, 1047 bp, Acinetobacter baumannii
tcatgtctattcatacacatcgataatctggaatttaaaaaagatatgttgtctcaatttgttaataaaactttaaaagtgcttgccttgtgtactggccttattagcacaagtcattttgctcaggccaatgattttgtaactcatcctaactatttaaattttaaacaaaaagccatgagcacttatggcttaagcggtgaacaggttgacgccgctatgaatggtgcaaaaaatttaccaaacattataaatattatgactcgccctggtgaaagtaagccttggtacgactatcgctctatgtttttagtcgaaggtactattcaacgtggtgtccgctttaaaaaccaatatgccgatgctctcaatcgtgctgaacaacaatttggtgtctctcaagcggttattctaggcattttaggtgttgaaacaggttatggagccaataaaggttcgtttattactcgtgatgcacttgcaacgttagcttttggctacccacgccgtgctgaatattttggcgatgagttagctgctctcattgcatggacttacaaagaaggttatccaaccaatagtattgtaggttcttatgcaggtgccattggcttcccgcagtttatgccaagcaacattagtaagtacggagtcgactttgatggtaatggtcatatcgacctacgaaactctgcagaagatgcgattggctcaatcgcaaattacttagcaaaacaaggctggcaacgcgatcaacctattggttttatggctcgttacacaggttcaaatccggaaagtatcattgctaaagatttgacccagcccactccgtatggtgcactaaaaaatcaagggatttcccctttaaatccgttagtcaaaattgatgacttagatatggtaaatgttattcaattacaagactataacggtccaatttactatttaacctatccgaactttcaagtaattacgacttataacaaaagccgaatgtatgcgactgccgtatggttgttaggtacagaagtagctagccgatag

SEQ ID NO: 503 - DNA, 750 bp, Acinetobacter baumannii
ttcataatatttgcaaattctgtcgttaatttacccgaacggcattgtaattcggacgtaagctttttattattgcccgcttgtttttcatcttgccttgggaatacaactttgagtgattttctaagtgaacatctgatctatcgtgatgatgattttatggtgattcataaaccttcggacatcttgagtgtgccagggaaaggtgatttacatgacagcgttttgacaaggctggtggcaattgaaccacgaactttgctcattcaccgccttgaccgtgatacttcgggtattttggtttttgggttatctaagcgtggacagagtgcgattgcacgccaatttcaagatcgtcaaacttcgaaaatatatgaagcgctagttgctggtcatttagagggtgaagggacagtggatatccctgtcgtctatgatccgagtcgaccacctttacatattgtcgatgcttctcataacaaacctgctttaacacattggcaggcaattgaacatttccagattcaaggacaaccggttacgcgtgtcaaattaacaccgattaccggacgttctcatcaactccgtgtacacatgcaatatctgggacatccgattgtaggtgatacattgtatgcaacaccggaacaattacttgttcctcgtctgtgcttgcatgctaaacagttaagctttaatcatcctgtcacaggggaatcattaacttttaactgtcctgtaccgttttaa

SEQ ID NO: 504 - DNA, 693 bp, Acinetobacter baumannii
gtcatgtctttttctggctatgggccactccttcttagcggaacatggatgaccatacagcttgcgctgttatcactcttgctttctgtcattattggcttaattggtgcgagttcaaaactctctaatattaaagccttacgttatgttgcaaccgcctataccacgctcatccgtagtgtgcctgacttagtgattatgctgctgttattttatagcttgcagttgggcttaaaccaaattactgaagcactgcaaatggatcaaattgatatcaacccatttgtggctggtgtgattactttagcgttcatttatggtgcatattttaccgagacctttcgtggtgcatttcaatcggttccaaggggacaaattgaagcagcaatggcctatgggatgacgccttggcaggtttttcaccgtgtattattccctcaaatgatgcgttttgcattgcccggcattggtaacaactggcaagttttgattaaggcgaccgcattggtttctattattggcctgactgatattgtaaaaattacgcaagatgcaggtagaagtaccatgcaactgttctttttcagcatcgtcgctgctgccatttatttggcaattaccacagtgtcgaacctgattttaatatggcttgaacgtcattattctgctggtgtgaggaagggacaattatga

SEQ ID NO: 505 - DNA, 1338 bp, Acinetobacter baumannii
gggcaacaattaaattatttgacagttgatagggaccaatatacatatatattcatacaattgatgatcggcatagtatacttcatccgcttgatcagctcatctttttatgcaggtgtcctcctctccatgaacaaaccgttgtcttcccgttttttatttaaatcattcggtatggttgccgtatgcatgagtttagctgcttgtggagataaagcctggtggtcaaataatgatgagcctgaattagaaagccagcaaatcaaacgtctcattccatctcgtgtgcatgaccgtgagtcatgggctaaagatattgatgacattatgaaagacttagacattcctaaaaccaaacaaaatgtctgtagtattgtggcggtcgttgatcaagaatccaattttgtcgccaatcctcaagtgccaggattaggacaaaaagcggttgaggaagtcagtacacgtttaaatgaaaaatttgaagataagcttggcaaaaccattggtggaacaattgcaggttactttgaagaagtactaagaacccaaccctctcctgacaataactatatgagtcagatgcgtaaagttaaaaccgagaaagaccttgatttactttaccgagaaattttcgactttatggccaaacactatcatgtaagtgctttgactggcgcagctaaattagttggacaagatattggcgaaaaaatgaatccgatcactacactgggttcaatgcaagttcatattaactatgccaaagcaaacaaacgctcgagtatgaatactgctgcactacgtgatgacttatataccgagtatggcggcctttattatggaattcaccgtttaatggtttatccggcagattatgataaagccatttatcgttttgcagattacaactctggtatgtactctagtcgtaatgcagcttttcaaaaaatgctaaaagaactcaccgacaaggatataagtcttgatggcgatctactcctttacacaaaagatggtgatccacgcgcaactcaaagcgagtcagaaaaagaactaattactgtatttgctagtaataatgttttagttacaccaagacagattcgtgatgatctaaaattagaaaaagagaaaaagtttgagagtactcaaacttatattgcgctgactaaactttataaatcaaaaactggcaaagagccgctctatgcaattatgccgcaagtggtgatttctgggcctaaactaagtcgtgactataatactaactggtatgcaacccgcgtaaacggacgatatgaaacatgtatgcaacgagcgaaacgaataagactataa

SEQ ID NO: 506 - DNA, 468 bp, Acinetobacter baumannii
atgaaaaaattaataattgatgcaaatttgcttctactgtatgtaattggtttaatcgacaatggcaactatattggcaggtctgaccgattagaaagatataataaaaaagattttgatttacttattaggcttctcataccatttaaggaaatctatgttactccatatatagctacagaggtttccaatcttattgacataaaagggaaagttaggaaccagatcttcgatatatatagtgctctattaaatggcgtacttttacaaattgactcaaattttaaagaagactcaaatttgcctttttttacaaaatttggcttaactgatgcctctcttactttcttagttaatgattattgtattttgactgatgatgaacgtttatgtagcgttttatatggtttaaaggcagacaatgtctaccaatttgaatttgtaaagcatttagatagtttattctga

SEQ ID NO: 507 - DNA, 1716 bp, Acinetobacter baumannii
attgaagaatttatgttgcattatcaaattgagttcgatgattacaaacaacaccttgttcacgtgacaattcgctttttagcgaatccaaatcaggaactatggttaccaacgtggattccgggcagttatctcattcgagagttttctaagcacatcgagacagtaaaggcctatgatgaagctggacgcatgctcaatattaaaaagactgaaaaaaatcgctggcgtttatttaacaccgatcacgagttaattactgttgaatatgatgtttatgcatatgatttatcagtacgtggcgcttatgtagatcaaacgcgtttatatattaaccctgcctgtgtgtgtttaggcttagaaggccaagaacaatctgcatgtgaattagaaatctttttgccggatgaattaaaacactttcagttagcaacaggattagcttcaaaaagtttagtaaaaggacgttttactttaaaagctgatcattatgatcaactcattgatagtccatttgaattagctgatcaaacgcgttttagcttcgaaacgcatggaattgaacatgagtttgtaatttcaggtactcacgctacgaatgttgatcgtttaaaaacggatattgaaaaaatttgtgcagccgaaattgatctgtttggttcagcaccgtttaaaaactataccttcatgaccatggcaacagggaatagttacggtgggctagagcattgcaatagcacaagtctgattactccacgagatgatttaccgaaatcgaatgaacctactgaaccttcaaaagattatcaacgtttcttaggtttatgcagtcatgaatattttcattcttggttagtaaagtttatccgcccagaaaattttgcgaactacaatctgcatcaagaaggctatacctcgctactgtggatttttgaagggtttacttcgtattacgatgatttaattttattacgtagtggcgtgatttcccaaaagtcttatttagatttgttgaagtcacagattgatcgctatttgcaaaacccaggacgttttgttcaaacagtagcagaatcaagttttgatgcttggattaaattttatcgtcaagatgaaaattcgaataatgcaggcacgagctattataacaaaggtgcattagttgccttatgtttggacttaggcttacgtttacgtggttctagccttgatgccttaatgcgtcgattgtatgaaaatacgcaaaacggtgttcaggttaatgagcgtacaatttttgatttatgcgaagagctaacaggcgatagttgggtagagcaaatcaatcatttgattaatactactgaagagttaccactcgatcagttattccctgagtttggtttaagttatacgcttaaaaatgataagactttagcttatggtttaaagctagctgataagcctgaaggtgtgttagtacaaaatgctcaccgtgagggagctggtgctaaagcgggtatttctgctaatgatgtcattattgcaattgatggactaaaagcgaccacaaaacttattgagaaatatgctaaacaaaagggtaattactcagtcttggctttccgccgtgatgagttattgtcgtttgaagttacaagtgacagcataaacttaactgaagttgaacttattattgaagatcaaagcaaagctgacaaatggttaaaagcctaa

SEQ ID NO: 508 - DNA, 1470 bp, Acinetobacter baumannii
aaaggatattctatgaaacggtcaaaaattgctttagctataacattatcaatttcagcattatttcttacagcgtgtaatgacgatgatgatgactacacagggatagacacaaataaagcttatgtctcagaaagtaattacgcaattgataaagttgataatgcttcatcaattaaagtcatgacttataacatggcaaatgttcaaggaaaaacagcaactgctacagcaatggtattgtttccaaaagcaacacaaccgaaagatggttatcgtgtagtagtatgggaacacggaactgttggggtgggtgatggttgtgctccaagcaaaaatgctattaatccgcggtttaaaatccttgctgagtctttattagcagcaggttatgtgattgtggcaccagattatgagggtttaggcaccccaggggtacatccgtacttaaacttatctagcgaagcaaaatcagcattagctgcagttaaagcagtaaaagagcattatggtgctcagttaaaaggcgattggatgtcaattggtcagtctcaaggtggacatgcctcattgggtactgctgagtttgctaataccgatgtaagttataagggtgctgtagctggagcacctgcttcaagcttaggaacaatcattcaaatttatattgatcctgaaatgaatcaagacagtaattttgcagttagtaagctagatcaggcaattagagcgcgtagacagattgatgcagcgattgctgcaggtcaaatgtctccaaatgatccactagcacttgctgtacctacaattgataaaaccgcagaaggatatgccgaattattagcatatgcagcattcgctagtgcgggaattaaagcacagcaaccagactatgacttgaaggcaatttttacatcggaagcagctgacattgcagaattggcctatggtcgtactggtgatgatggtgcttgtttaagttatcctgcgcctgatactgcaaacggcctgcaagagaaatttaaagcgggaatattagctttcttggctgaccctacacatcaaattactcagtacggtatcgatctgaataaatttaagacagatcaagttgttcaaaactttttgaaagcgactcaacctgcgacgaatgctacagccgagaaagttattaaaacaccagtatttattattcagggcgaaaaagatcaagcggtattgcctgtggtgacgcaaggcttatttgccaatatgaaagcgaatgctttgaagtttttccctcaagcaggctacgatcaaggttataagctaaccattgtaccgaatgcgacccatactcacgcaatcgtatgtcaaaatgccaatgctgtagatttcattcaagctaaaatgtcagcgggtacaggtattgtgttaactgatgcgcagaaagatgccagccaaagccctcactgtacaggtaaattttaa

SEQ ID NO: 509 - DNA, 1191 bp, Acinetobacter baumannii
tcttctcattcgagagattgtttgttagagcgcgtatttatgacatctggttttgaaaccttgaatttacatccgcaacttaaaaaggcgattgatgctttagggtttactcaaatgaccccaattcagcaaaaggttttaaaatatacattagccgggcatgatgcaattgggcgagcacagacaggaacaggtaagactgctgcctttctgattagtgtaattaatgatttgctcaataatccggttcaggagcaacgcttccgtggtgagcctcgtgctttaatcttagcacctactcgtgagttggcattgcagattgaaagtgatgcaaaatctctcacaaaattttctaatttacacctagtgacgctattaggtggtgttgatttcgataagcagaagaagcaacttgatgctaattttgtcgatattatggttgccacaccagggcgtttaattgattttgtagaacaaaaagaagtttggctcgatcaaattgaatttttagtgattgatgaagctgaccgtttattggatatgggctttattccttcggtaaaacgtattgtgcgttattcaccacgtaaggaacaacgtcaaaccttaatgttctctgcaacatttagttatgatgtcttgaacttggcaagacagtggttatttgaaccagtaactgttgaaattgaacctgaacaaaagaccaataatgatgtcgaacaacgtgtttacgttgtggctaaacaagataaatatcgtcttttacaagatattttacgtgaagagccaattgataaagttatgatctttgccaatcgccgtgatcaggtacgtcgtctttatgaccatttgaaaaaagatggatataaagtggggatgctatctggtgaaattgctcaagataaacgtttaaaaatgttagagcagtttaagcaaggcaaacataacatcatgattgcaacggatgttgctggtcgtggtattcatgtagacggtgtatcacatgtagtgaattttacattgcctgagcagtctgatgattatgtccatcgtattggtcgtacaggtcgtgcaggggcacaaggtgtaagtattagtttcttatctgaagatgatgctttctatttacccgaaattgaaaaagcaattggtaagaaattgcctctaacccgactagatggttattgctaa

SEQ ID NO: 510 - DNA, 975 bp, Acinetobacter baumannii
ctaaaaaattccaagaatatgcttcattttacctttttaggcacatcatcaggtgtacccacgctttcacgcaatgtttcaggattagctgttcgtaacagtaaaaataaggactggattttagttgatgctggtgaaggtacacagcatcgtattcagcaagctagactctcactacaaaacttaattgccatttgtattacacacgttcacggcgatcattgttatggtctagttggtttactggcaagtgcaggcatgaatgcacgcagcaaaccattaatcgtgattgcacccaaagaaattcaacaatggtttgaaatcactgctcaacttacagacttacatttgccttattcaataaaatttattgatgttaatgaagcaactcggccacagcagctcaccgatgaactctttattcaagcacatccactaagtcatcgtgttccgagttttgcatttagtatttatataaaatccacccagaagaagatagatattcaagttttaactcagcttggcgtatctaaaggcgatatttgggggcatttaaaacgaggctacgatgttgagtttgaggggcgaattttaaaatctcaagactttatcaaaattcaaaatcagcagattcatgcaattataggtggtgataatgatcggccagaattattagccgatgcttgtaaggatgctcaattacttattcatgaagcaacttatttgcaaacagtcttagataaagtaggtaaaggaccaatgcacagctcagcaaaaatggtggctgaatttgctgagcagcaatctctagacaatttaattctgacacactttagccctagacatcaggataaaactgggcagcaagctattaccgaagaagttcgccagttttataaaggtcatttttatttagcgaatgattttgatgaatttactttaaatgaaacaggacaacttttaaaaatcgagtaa

SEQ ID NO: 511 - DNA, 1488 bp, Acinetobacter baumannii
atacctgattcagggagatctgttatggttgaagttgagcttaagtttcagttacctgaatcgaagaaaaaaactgtccagcaatatttaaaaaaacataaagcacagcatattcatctacaggccaagtattacgatacaccagatcgcctacttgcaaaaaatggtatggccttacgcttacgcaaagaaaatgatctgtgggtacaaacctttaaagctgccggccaaagtcatttacatcgtgtcgaagaagaagtttttttaggaaaatgcgatcaagaacctgacttaaactttgagttatataaagacaataaagccgtcacagatttgattactcaagctttaggctctgaagtcgaaaagctaagcttacagtttgagactgatgtacaacgtacctatcatgtttttgaagcagatgacacggcaattgaagtctgtcttgatgacggcgccgtaaaaacagcaaccgcacaaagcaaaatttgcgaagttgagttcgaacttaaacaaggtgcagttaaaacacttattcaatttgctcagcaatggattaatcgttatgaactttggctagatgtgagaagtaaagccgagcgcggtaatttactcgcattggggcaagctgcttcaccggctgttcacgcaaaaaatctgaacttagataaagatatttcagcagaacaggcactcaaaaagattgtagaaaactgtttgggacaattcttgcctaacatggccgcaattgccgatggagttgccgaggctgagcacattcatcaggcacgcgtaagcttacgccgtttacgtagtgcactaaaacatttttcagcatggtcagacgagttaaaccctgtgtgggaagagcaaattgccgaactattccgtcagcttgggaacacgcgagacgaagatgccattcgtaccgaaattttacctatgattgtgcagcatggttcacctgagcttttacttccgatctctgaacagccattaaaagaccttgccacactgtttaaatcagcagacaccattaagcttatacttgccttattagcatttgcctattcagaagaagacgctcaaaacgccaaaggaaaattgaaaaaatatataggaaaaagcttagataagttacaccatcaagtggtgagtaatgccgatcattttactgagcttgaagtcaccgaacagcacagaacgcgcaagaaagccaaacagcttcgttactgcattgagtttatatcgagcttatatcctcgtaaaaatgttcagcagtttttaaaacaattacagcctgtgcaaaatactttagggctttataacgacttatttattgccgaagatctatttaataaagcgattgaacacgacccacatttttggtttgcattaggatgggttaaagccaaacaaccttatttacaaaatcagtctgccgaagctttgcaaaaatttaaacaggcaaaaacattttggtaa

SEQ ID NO: 512 - DNA, 594 bp, Acinetobacter baumannii
aggcgtagattagtgtcaaatatttcgctaattgtcggtttgggcaatcctggttcagaatatgcccaaacccgccataatgcaggtttctggttcgtcgaacagcttgcagataaatatggcattacattaaaaaatgatccaaaatttcacggaatcagtggtcgtggtaatatagaagggcacgatgttcgcttacttctacctatgacttatatgaatcgttccggacaaagtgttgttcctttctcaaagttctatcaaattgctcctgaagcaattctgattgctcatgatgaacttgatatgaaccctggtgtaattcgcctcaaaacaggcggtggacacggcggtcataacggtttacgtgatattgtcccgcatattggcccaaattttcatcgtttacgtattggtattggacatcctggctcaaaagaaagagtttctggacatgtgctcgggaaagcaccaagtagtgaacaaagcctgatggatggagcaattgatcatgctctctctaaagtaaaattacttgttcaagggcaagtaccacaggccatgaatcaaattaatgcgtataaaccagcttaa

SEQ ID NO: 513 - DNA, 219 bp, Acinetobacter baumannii
tttttactatcagtacctatccgcaaagatctagaacaatttactttatcactattatcattttcagttgccaataatgtaggttttatccatattccacgcactgcttggcaatatcttgcccatatcttagttggttttattttacaaaattttttattatttttgggcaggcccacgcattctggtgccagttcagaaatctctgcaggtgaataa

SEQ ID NO: 514 - DNA, 2157 bp, Acinetobacter baumannii
catcaaggattgttaaagaaaaataaatatggtgcgcggcatcgtataaacaggaaggtcaagatgactacacttaattatacggtaaggtttcaaaaaaccgttctggcaagtttaattggcttttgtataagccagccaagttttgctcttgaagaactttctgatgcaggtttaagtgaaactactggtgaaggtatcgctattttgcctcaaaatacttatatggtatttcgtggagctggagcgaatgaaaccaccaaccaaattttaaccgatcgcactaaagatacgggttatatcaattatgtacctgttggtccattaagtatgacttcggcagacaccaataaaaacggtacgattgattcgggtgaccgtgcagtgggtaaagctgatatttttctttatggccttgctttatccaaatctgataataataccaatacacgtatagctcctactgagactgcagcagcaatatcaagctggggtacagctgttaacccgtggatatttaaagttgcaactgaaaacttagtaccgaacttcagtacaacaaattgtactggagctactgatccaacttgtcaggtgacgtatttagctttagaagctcctttatatgagatggggactaaagatgctgcaggtctggatgcatataagcttaaattaggcttatggtcagatatttttgttcgtaatcctaataaaataaatggagcagcagatcaatttaactatggtgactctaatggtttaattggtacaagtactgatgcgagccgtgcaaatcgtttacgtttgcaaggtatttggaataattttagtttaaacggtagtcgtctacaggtatttcaaactttaggtggggcgacgactagtgggggcatgagtcctttttataataatacattggggattgctggagttatacgtttgaatagcggagacagcaaggatgttaaggctattactacaagttctttaaccgagggatctactacttctccgtggactcttattcatgcgggtgctaattcgacattaagtacaagcacaacaggtgattgtaataatggagggacaggaagttttggtacctcggcgggatgccgttattatgtagaaaaacgtacacgtacagatagtaaaaccgccacaaaaacgtgggatgcctcaggcttatcgaatgcaggagttttacgtttgagtacacgtgaaacgagcgatactggaaatcttattacacctgcaattaatggcggtgtagcaccgacttttgatgctaatgagggagtttacctttataacccaaatattaatcttgtattaggtactttataccagcctctggtgctaggttctgatggtaaaaactttagtttagaaattgcccgtattgcgaataaaccagaaatttataaacaaatttatactgactacagcggtgcagatacctcttataaaggctcaacttgtaatgtttatcaatgtggtagccaactaactttaggtggtaaaaattaccaaggctataatgcaacacacagtagtatttctattggtactgcctatagcgaggatggtggaaaaactctaagagcttcaaccgatgaaggagcagtgggtatttcgtttggtaagttaaattcaggtacgatttcacaaacaacttattcaaaccagatgactgaagtacattataaacaacgtggagtaaatactcagacgtgggttcagtcttatagttgtactctatttatttgtggcgctggtacaacaggttatctatatcagtgggaatataataatggttctacaccttgggcaattttagccccaacaacaaagcctgcagatgctacatgttctccaactattggttgtagtagtacttctggaactacacctatgtatggttctattgcaaaccgtgtttgggcgaactcatcagctgtttggttaacggcagcaaataacgaagtaaataatttaattggtgccaataatggaatgacaggtacaactttcccaacattaaatcaggcacctacacctgttataaactctagtccaataaataacatgggttcagctgttattgatggtgttttaattcagcatttaaaactgacaactaaaggtctctaa

SEQ ID NO: 515 - DNA, 1347 bp, Acinetobacter baumannii
attaaaaaatcgaggtactggatgacaaaatttaataataatcaatctgacaatttgttttctcaggtcttcggagtggctaaaaagctcagttctactggtttaaacatcttgcagcaaagtcaaattggtgaggtaagtaaattggttgagccactttcaaatggcaaaacagtagaaggtagtgccagaaataaaagtccgtttgaagtggagcagtatgaaagcccacaacaaatgttacgtgaacatttacctaaagttactcgtcaggtatttggacgccattttagaaaggtcaatggtatcgctacatttatttcacctgactggaatgaaaaaatatcaagctatttatttgattggttgaatgactttagttcgaaaagtacgttgactgaaaaaattttagaagaagcgggggctaaagacttatttgagcttacaaaagatacctcacgctcccaacgtttaagtcaggcacttattgaacaaaataaattgattgccagtattcaaggtgcaattacaggcgtatctggaatggttggagcagccgtagatattccagtttcattagtcctagttttgagaacaatttaccaaacaggtagatcacacggctttgatttaaccgaagcaactgaccaagacgttgttgaatttatttttaaagaagttgatatcagcttaattgcggaaaagcagactttactcttggcactaaaagccttacgaaatatgttggagactcaagacattcaacagttccagcaagtacttggctcttcaaatgatattgaaaccttaaaaagctggttagttgatgaaaatggtgagtttaaatggaactggttaaataaagttccgcaacttgctgtggtaggcaagtttactccagtagctggtgcagtgcttagtgctgtttatagttggaagttacaagaagatgtaggccataaggcacaagctattttcggtgcagcaagacattatttaaatgaacatccaaatgagcatttatcaccattacaggcgtactatgcggcggtaactctaattcaaaaagcgagtccacgtcttttaaatgtgggtgaaaatggtagtgtccatgctgcgcagcatcataaaattgaaaatcatgatgtaatttcaaaagtatctgttgtggtcaaatcaaatacttctgaaaaaagcgaagagaaagttcaagaaaatgttcaccaaggaattgagcatcttgcagagaaacatgtagttgaacatgaacatagtgaacaaaagccagcattagagcctgaaagtgaagaaaatgatggcgttatagaggggcaaaagtactcttaa

SEQ ID NO: 516 - DNA, 183 bp, Acinetobacter baumannii
caagttggatcagtagctccagtacaatttgttgtactgaagttcggtactaagttttcagttgcaactttaaatatccacgggttaacagctgtaccccagcttgatattgctgctgcagtctcagtaggagctatacgtgtattggtattattatcagatttggataaagcaaggccataa

SEQ ID NO: 517 - DNA, 1290 bp, Acinetobacter baumannii
tctgatatgtctttctttgcattgggtgtcaaccatcaaacagcttctgtagaactccgcgagcaaattgctttcaatgcagagcgattaagtaatttgcttgccgaacaacgtcatcacgagtctttaaaagacttagtggttgtctcaacgtgtaaccgtacagaagtctacgccatggcggaagatgccgaaagccttctgaaatggttagctgatgccaataatattgatgtaaagcagttaattcatcatgtttatcgttacgaaaatgctcaagccatcacacatttaatgcgtgtagcaagtggtttggactcactcatgttgggcgaaccgcaaattttagggcaggtgaaaagtgctctagcattgtctaaagaagcgcaaacagtttctccagaattaaatagtgtatttgagtacgctttttacgccgctaaacgtgtgcgctctgaaacagctgtaggtagtcatgccgtttcaatgggttatgcagttgcccagctcgctttacaggtttttagtaaacctgaaaaactaacggttatggtggttgctgctggcgaaatgaacagccttgttgccaagcatttagctgaaatgggcgtcgccaagatgattatttgtaatcgtagccgtgaacgtgccgatcaattggcccaagaaattgcacatcaagttgaagttgagattattgatttttcagatttggctgagaatctatatcgtgctgatgttgtttcaagttgtacgggtagtttgcatcaggttattgcttatgcagatgtcaaaactgcattaaaaaaacgccgttatcagcaaatgttaatggtcgatttagctgtaccgcgtgatattgaccctaaagtagagtcgcttgatggagtgtatttatacggcgtagatgatctacaaagtgtgattgatgaaaacttggctcaacgtcgtcaagcggctgttgaagctgaggtgatggttaatcagctagctacccagctaattacgcatcaaaaagtcaaagaggcgggcagtacaattcatgcttatcgccaacatagtgaagaaattagccagcgagagcttacccatgcattagaggctctgcatcatggtggaaatcctgagcaagtgttgcagcaatttgcccatcgtttgacgcaaaaactaatacatccgacctctatgttgttgcgtgaagctgcaaaagcagagagtccggactattttgaatggttacagcagcatttacaggatgtatttgatcatgagcgaaaacccaaacgttaa

SEQ ID NO: 518 - DNA, 273 bp, Acinetobacter baumannii
tacaaaatgtcaacgcggggaattgctaccgatgttgctcaattacgtcaggctttaacagcacaattgtaccagtctgtacaatggacacgtaccatgcagtctctacaagaccaaggtattcagtacattgttgagtgtggcccaggtacagtattgagtaatctcgcaaagcgtttaccaaatattgaaaaagctttttctattgatagtaagagcaaaatggaagatgccctaaatgctgttttagtggcagaaggaaaaattgcatga

SEQ ID NO: 519 - DNA, 579 bp, Acinetobacter baumannii
agagaaaggtcaagcacaaaaagaaagtgcaccaatcgatgtacggagtctattaccatgatgtggccgttttatttgatggcgctcgtggccatcgtttctacggttcgtgtagtgactaacacgaaccctgtacatgcattgcttagtctgattgtttcattgcttgctgttgctggtattttcatgatcgtaggtgcgccgtttgccggcgccctcgaaatcattgtttatgctggtgcgattatggtcttgttcgtattcgttgtgatgatgcttaacttagggcaacacacagttgaacaagagcgtaaatggctttcttcggatgcttgggcatatccagcactcatgagctttttacttggcttacttttagtttggatgcttggtggcgaatatacaaccatctctgcaccacttggagcacaagtaattggaccaaaagttgttggtcaagcgctctttacacactatttattgttggttgaagttgccgcgatgttattgctagcagcccttgttgcagcataccacttaggtaaacgtgaaccaggtgcagaagaggaaaaagaataa

SEQ ID NO: 520 - DNA, 327 bp, Acinetobacter baumannii
ccaagtttgttccgcaagctgtggttgaagcttttgaacgtaaacatcaacaaggttggtaacgtgtcgttatatatcactgatgaatgcataaactgcgatgtttgtgaaccagtttgccctaatgaagcgatctttatgggcgaagtgatttatgaaatcaatccggatttatgtacagagtgcgttggtcaccatgaccagccacagtgccaattattttgtccagtagactgtattccaaaagatccgcagcatgaggaaacggaagaacagttactcgacaaatataaaagattaattgctcaaaaaagcacaagcaattag

SEQ ID NO: 521 - DNA, 1026 bp, Acinetobacter baumannii
tcccgccatccgttggttcgaatccagccgcccctgccatttacttcattacataccaaccgccaagggtgcttcatgcccaatcttgtcgtttttagtggaaatgctcatccacagttcgctcaaaaagtcgtaagtcacttacatatccctctaggtgctgcatcagtcggtcagttctctgatggtgaaatttcagtagaaattactgaaaatgttcgtggtaaagacgtatttatcgttcagcctacttgtgctccaaccaatgacaaccttatggaaatcttggttatggcagatgctttgcgtcgtgcaagtgctggtcgtattactgctgttatcccttattttggttatgctcgccaagaccgtcgtccacgttctgcacgtgtgccgatcacagcgaaagttgttgcagacatgcttaccactgttggtattgaccgtgtcgtaatgattgacttacatgctgaccaaatccagggcttcttcgatattccagtcgacaacatctacggtactcctgctttgcttgctgacttacgtcaacaacaacatgacaaccttatggtggtttctcctgacgttggcggtgttgtacgtgctcgtgccgttgctaaacagatgggtgatatcgatttagcaatcatcgacaaacgtcgtcaaaaagccaatgagtcgcaagttatgcacttgattggtgacgtaaaagatcgtgattgcgttatcgtagacgacatggttgatacagctggtacattgtgtaaagcagctgatgcgcttaaacaattcggtgcacgtcgtgttgttgcttacgcaactcaccctgtactttcaggtaaagcaattgagaacttacgtaactctgttattgatgagttagttgtaactgacacaattcctctttctgaagaagcattaaacttaggtaaaattcgccaagtttctgttgctagcatggttgctgaaacgattcgtcgtattaataacgaagagtctatcagcgcgatgttcgatagtttataa

SEQ ID NO: 522 - DNA, 1380 bp, Acinetobacter baumannii
attatgcccccaaggatacggaggtcggtcatgcgacagtttacgtctcttcaggttgcgatattagcactcggaagtttatgcttttctacagcctatgctgattctactttagttccaatgtcagatgctgagctatcagctactcgtggtcaggcattaatgagtatgtcttatatcgcgcctaatgattcggcaaatctggaaaaattgcgtgatagtagtagtaatgtaggattttataaattaggtttagaggccgagttagaaattaatgccaatattcgtaagctccaactaggttgtggtggggtaaatggtgcaggcggctgtgatatagattttgataatgttagtttaagtggtgtagcagatacacgcgagggccgcgtagcaagcgatgcgaagctgacaaatccttttcttgaatttgccataaagaatccaaatagtgcttcgactcgtgaagtagctggtattcgcttgagtgctgaagcggttgaggggcttttaactattggtacagaaaactcagccacaccaaatggtattaatagtttaagtggttatatggtagtagcgccgcaagtaggtgaggcgactgttgatgctgcacgcatcacgcaaacgggtagccctgcttgtggtgtatatccatctcctgcgggttgtggtgttaatcaagcaattacaggtaaagctagaggcgagattgcattaggagctggattcaatcttgatttccagaccaagtcctatgatataacattgactcctacacaaaaagcacagttatcattaccacaatcagttgtatccggacaaaggatgagcagtgtaaatttattagcctctgctatagttaatggtattgatttgtcgggtacactggcagctgatgtcgatatccttgggggaattacgttaaatggtaatcttcgtgggaccattaataatttgccggtaacagtaccattgttagaaaatttaggttatatccataaaattaatttgagtggtagcccattatcattatcgatgcagggacaggatatacgttggcctggaacagtctcaacagcaatgcgtggttggtggctagagttatcaaatccaatcgatattggtcgaattgacccgactaatagtgtagttattaaaacagatactattagagatgcacttactgaggtgagtaaagaattaacccagaatccattaaattgtggtttcttggctgtcaattgtattggtggtgattttaatgttgggacaagggatttatcaaatgcaagaccagcattattagaattacagaatttacaattagctaatcagtcttttgctccaaactgctatggaagtttaaagttttgctaa

SEQ ID NO: 523 - DNA, 1248 bp, Acinetobacter baumannii
ttggtgcgccctgttttaaagataacatttaggaatgtagacatcatggctcgccaaaccccaattactcgttaccgtaacatcggtatctctgcgcacatcgacgcaggtaaaacaactacaactgaacgtattttgttctacacaggtgtatctcacaaaattggtgaagtacacgacggtgcagcaacaatggactggatggaacaagagcaagagcgtggtattacaattacctctgctgcaacaacttgtttctggtctggtatgggtaaccaattcccacaacaccgtatcaacgtaattgatacaccgggacacgttgacttcacaatcgaagttgagcgttctatgcgtgttcttgacggtgcttgcatggtttactgtgcagttggtggtgtacagcctcagtctgaaactgtatggcgtcaggctaacaaatataaagtgcctcgtttagcattcgtgaacaagatggaccgtactggtgcaaacttcttccgtgttgttgaacaaatgaaaacacgtcttggtgcgaatcctgtgccaatcgttgtgccaatcggtgctgaagacacattcactggtgtagttgaccttatcgaaatgaaggcaattatctgggatgaagcttctcaaggtatgaagtttgaatacggcgagattccagctgacctagttgatactgctcaagaatggcgtacaaacatggttgaagctgctgctgaagcttctgaagagttaatggacaaataccttgaagaaggtgatctttctaaagaagacatcatcgcaggtttacgtgctcgtacattagcttctgaaatccaagtaatgctttgtggttctgcattcaagaacaaaggtgttcaacgtatgttggacgctgtaattgaattcttaccatcacctacagaagttaaagcgatcgaaggtatccttgacgataaagacgaaactaaagcgtctcgtgaagcatctgacgaagctccgttctctgcgcttgcgttcaaaatcatgaacgacaaattcgtaggtaacttaacattcgtacgtgtttactctggtgttcttaaacaaggggatgctgtttataacccagttaaatctaagcgtgaacgtatcggtcgtatcgtgcaaatgcacgcaaacgaacgtcaagatattgatgaaatccgtgcaggtgatatcgcagcgtgtgtaggtcttaaagacgttactactggtgatacattatgtgatgagtaa

SEQ ID NO: 524 - DNA, 2460 bp, Acinetobacter baumannii
ccatccacgttgttaaaggttaatgtagatttcaaaggaactgaagtgatgaacaaaaataaagaaagtcacggctcaaagtttattttaaatacattaacagccagtatgttgttagtgagcggacaggtttttgctttagaagcgttaacagatgccgatttgagtgccgtgaatggccaagatggtatatcgatccagacgacttataatgaaattaatatagacaatgcctattgggacgatcatgcaggaacttcaaatagtgcagatcaggttttgagagcccaagctggtggaataaaagtacaaaagagtaatgcttccacacaaacattaggaacaaactaccgtttggatgtgggtagtaatccaacgacaggaaaaactggtctagatttctccttacagagtaatccttctcttattactgtgaatagttttagggtctgtaatagttcgtcaatttgctcacctacaatgggacaactggctattcagacttcttcacctttgagtttggcccttactacacaagatggcttatttaatgcaaatagccagtcaagcatgagacttggcctcaataatgcgaatatttatttaggacaagtagatgcacgtacgcaacttaaccaattaattttaaaaaactttaattttaattttgttggtaaaggcgctatgttaattgaccctaaccgaggtctggttttacaaactaatacagggaataatactgctgcggttgggcaaactccaaatagtacctatggctatgtcgattttaatcgtgtcgccgattctgcttctggtttaactgctggtacatatgtagacagtagtgggaaagtaaccaattcaggtctaaatattgaggtaatgcttagctcaaatgttgataagtcaaatccttatgccctagacacgacaaatagcccacagaattctaaaggcttgattcgtttaggtgctagcggccgtatggtcaatagttacttacaagtccgtggtatggatggctcttcagataaaacaacattaggtactgctaatacggcttcaggtacgggatcaagtaatagtattttaggtaactctggaattgcctttcgtatgaaaggggagttcactaaagataatgattcgatgttaggttcagatggtaaagcaactaccttggaaattggtggtgcaggtctgaatgcttatggttttgaattcggtaatttaacggggctgaactcggctacacgcggttattttgacagcggaaatatttatctaaatcttactgatacaaaaactttattaatgccaaataacgcaacgttaaatgcaattcgtttaggatccggcactttaacaactgctgccgattatcaacataatattcatcgtgatacggtgactaatccatttagcttaattcttgccatgcgtggagcagagtttcaggcattttcaagacgaggtcgttttaccaccagtgcaaatgtcgctgctgctaatcaatttgcagataatggtttaaataaccaatggggtttggcattacctttttataatttaaatgcgaatgccgctgtctatggtgtagatgcgcctgcaaatggtgcttattactatacaaaagatgccaacggtaaaccgattcaaaatttagttgcaacatctggtacaacttcacgtttaggttttggtatagctgtcggaacgacaggtcgagatgcaggcggtactaaaacaacttcaattttattaattgatggttctccaaatgctaataatgcgggcaaccctaccgattattatatggggttacgtaatattgatatgttcctcaaaggcaatggcactattggtttagaaaatggcagtttaaatatcggtttaaaagatatgttacttgctttatcaaccgaaattgcggcaggttatttaccgggagctaaatataaaacttgtccggcaaccgggtcttgtacttcgccaatcgataactttgccaaaaataatgatgtcttatttggtttaaaactacgtttaggcggtgatcttaatttatcgatagtgccgaatagttcaattgcagatggtagtgctttaactgtactaggtgattttacaatgcctgcgacagcaactggaaatactgtacaaattagtgacccgattgatggttctgcaattggttttgacaatattactggaaagctagcgtttaataccgctttagttgtgggcaaagataccgcaagtggtttaggtaaagttggcgtaaataccgcggtttattttaatcctgataagagtattgacggcgcattacgtgtgaaagatattaatttctatccaccttcaacaggtgcaggagcacgtttaggtgagcttgcaattacgggtggacgtctaaatagcagctttagcattgtgcctagaaatggcgcctttaactaa

SEQ ID NO: 525 - DNA, 1800 bp, Acinetobacter baumannii
gaagccaagccaatggctgaaactgacattgctatgccagaatcaacaccagttgattcacgcccagcatttgcaatcgtagaagagctcaaaaccaaatttggtgagaatttctatgtgcaggcgacttttgaagagtttccaacagtctgggttgagcgcgcacgcgtgcaagaagtcctcatgttcctgcgtaaagtggaacgtccttatgtaatgctgtttgacttatcagcgatggatgagcgtttacgtcaacatcgtgatggtttgccagcatctgacttcactgtgttctatcatttattatcgcttgagcgtaatagtgacattcgtatcaaggttgccttgaacgaaaacgatcttaacctcccgacagcgacaaatatctggccaaatgccaactggtatgaacgtgaagcttacgatatgttcggtatcaatttcgaagggcatccaatgcttcgtcgtatcttgttaccaacttattgggaaggtcacccgcttcgtaaagaatattcagcacgtgcgacagaatatacgccgtacatgcaagacaaagcgaagcaagatttcgaacaggaacacttacgctttgtaccagaagactggggtcttaagcgtggtaacgctgacgaagacttcatgttcttgaacttgggtcctaaccatccatctgcgcacggtgcattccgtattgtattgcagttagacggtgaagaagtgaaggactgtgttcctgatatcggttatcaccaccgcggtgtggaaaagatggctgagcgtcaaacatggcactctttcattccttatactgaccgtgttgactacttgggtggttgtgcgcaaaacatgccatatgtcatggctgttgaacagcttgctggaattaaagttcctgagcgtgcacaagtgattcgtgtcatgttgaacgaattgttccgtattaataaccacttactttactgtggtacggcaattcaggatgccggtggtatgacaccagtattctatatgttcgcagaccgtcaaaaagtatacgacatcgttgaagcaattacgggttaccgtatgcacccggcatggttccgtattggtggtacagcacatgaccttccaaacaactggcaaaaacttgttaaagaattgctagattggatgccaaaacgtttgaacgaatactacacagctgcattcaaaaactctgtgtttattggtcgtacacgtaatgttgctcaatacgatgccaaatctgcgcttgcatggggtgtaaccggtactggtttacgtgcaacaggtattgatttcgacgttcgtaaatatcgtccatacagtggctatgaaaacttcgacttcgaagttccggttgagtatgaaggcgatgcgtacgctcgtgtacttgttcacttccgtgaaattgaacaatcactcaaaattatcaaacagtgtttggataacatgccttctggtccatataaagcggatcacccattggctgttccaccaccaaaagataagacgttacaagatattgaaactttgattacgcacttcttgagcgtgtcatggggtcctgtcatgcctgctggtgaagcgtcattcatgactgaagttgtgaaaggtgcaagtacttattacttgacttcggataaggcaacgatgagttatcgtactcgtatccgtacaccgacgtttactcacttacagcaaattccttcagtgattaacggcagtttagtatctgacttaatcatttatctggcgaccattgacgtggttatggctgacgtggatcgctaa

SEQ ID NO: 526 - DNA, 297 bp, Acinetobacter baumannii
agttgcaagttaggggcgtcgccaagtggtaaggcagcgggttttgatcccgccatccgttggttcgaatccagccgcccctgccattttctacctgtaatgatgattgtattaggggcgtcgccaagtggtaaggcagcgggttttgatcccgccatccgttggttcgaatccagccgcccctgccatcttaatacagcatcgaatttaggggcgtcgccaagtggtaaggcagcgggttttgatcccgccatccgttggttcgaatccagccgcccctgccattctcttatttaa

SEQ ID NO: 527 - DNA, 654 bp, Acinetobacter baumannii
aaatcaggtacaattggcgggattaattttgtgtttggtgtatttgaaggccaatacatacattctttgttaaataataggcctgccaggagttatccccgcatgagtgccattactccatacgactgggcgattatcgccttcgtgatcggcgttacatttctttgcgtctttatgctcacagttcccttactcctcggggggaaatcgtggggacgtgctaagcaagagcagtttgaatcaggtgtcgtgagtgctggtggcgctcgcattcgcctgtctgcaaagttctatctagttgcaattttctttgttgttttcgacttagaggcactttacctctatgcatggtctacttcggtgcgtgaagtaggatggttgggttataccactgtcgtaatctttgtcgttgacctattaattgcgcttgtttatgccttctctgtaggtgctttaagttgggcaccggcagatcgccgtaaattagcaggtgagaaggttaaagtcggttcaccaacaatgaacattgctgaaattacacgctttaactctattgaagagctcgtaactgaccctacaggccagattccagcccaatcatcaggtcgtgttaagtcaaaaactacacctgcattgtcatctgaaaaggagtaa

SEQ ID NO: 528 - DNA, 795 bp, Acinetobacter baumannii
catgagcgcactatttcatgccacgttgaaatcatgtcaattgaaaaatttagcgtagaaaaagttttatctgttcatcgttggaccccaacacttttcagttttaccatgacgcgtccttcgcattttaaatttacggcagggcaatttgcgcgtattggtttaaaggtaggagatgagctggttgtccgtgcgtattcggtggtgtcttctccgtttgatgaaacgctagagtttttctcaattgtagtaccagacggtgccttcacttcgaatctacagcatttgaaagtcgatgatgagctatatttggaaaaaattccatatggttacctgacgttggcacgctatcaacagcctttaccgcatgatctgtggttactggcaacaggtacaggcttggctccatttttgtcgatgctacaagactttgaaacttggtctaattaccagaaaataaacttggtctacagtgttcgtactgcggctgagctggcttatgttgaccgtattcaagagattgctgaaacgtttggggaagggcatagcggttttaaatttattcctatcattacccgagatccatctgcgccgttgcatgagcgcttacctgtattaatcgaaaatggtgagctagaaaaagtagcaggcttagaactcagcccagcatcaagtcatgtcatgctttgtggaaacccacaaatggttgatgatacgaaagaggctctaaaacgccgtggtctcacaatgaatcgtcgtggtgaaggaaatattgcggtagaaaattactggtag

SEQ ID NO: 529 - DNA, 255 bp, Acinetobacter baumannii
tacatgacaaccatgttttgttgcattttattaatctttgaattttcaggtatttttattatctatttattgttcttaaatgtcataatctattcatatttcctatgtatgaatattaaacaaattatttctttactaaatttaaattcactcaagtgtttgttttttgagttatccacaaagttatctataagtgttttttcacagctttggtatgctatctcccgacaaatcatacagataaaaaattactaa

SEQ ID NO: 530 - DNA, 2715 bp, Acinetobacter baumannii
caacgtagaacaagcttaagggattcgactatggctacaattcatgtcgatggaaaatcgtacgaagtcaatggatcagaaaacttgctacaagcatgtttatcccttggcattgatattccgtatttttgttggcacccatccttaggttctgttggttcatgtcgtcaatgtgccgtaactcagtatgcaaatcctgaagatacgcgcggacgtcttgtgatgtcatgtatgacaccagcatctgacaatacctatatttcgattgaagacaaagaagcagtagatttccgtgaatctattgttgagttcttaatgaccaatcacccacacgactgtccagtgtgtgaagagggtggtcactgtcatttacaagatatgactgtaatgacaggtcacgaccgtcgtcgctatcgttttactaagcgtacacattacaaccaagaactaggctcattcattgcacatgaaatgaaccgttgtattgcttgttatcgttgtgttcgttactacaaagattatgcaggcggtacagactttggtgtatatgccaatgcatcacgtgtttactttggtcgtccagaatcaggtactttagagtctgaattctctggtaacttgactgaagtatgtccaactggtgtatttaccgataagactcattcagagcgctataaccgtaaatgggatatgcaatatgcaccaagcgtgtgtcatggctgttcttcaggttgtaacatctctccgggtgagcgttatggcgaaatccgtcgtgtagaaaaccgtttcaatggttcggttaaccaatacttcctttgtgacaaaggccgttttggcacaggttatgtaaaccgtgcagatcgtccacgtcaacctcagttccgtaatggcgaaacagtagctactgtttctgttgaccaagcgttggaccaaacaattgcgaaacttgaaggtaaaaaagttctaggtatcggttcgccacgtgcaagcttagaatcaaattacgcattgcgtgaactagtgggccaagcaaactactcaacaggtgttgcacaaaaagagcaaagtctcgttgaacttgctgcttcaatcatgcaaacagagggtatttacaacccgaacatgcgtgaaattgaaagctacgatgcagtattaattttgggtgaagatttaactcaaactgctccacgtatggcattgtcagttcgtcaagctgcaaaaaataaagctcgcgaaatggctgcaaaaacacgtacaccggactggttggctgagcctgtacaacgtattggtcaggaagcgaaatccccgatctatatcttggctgcaactcaaactcgtcttgcggatgttgcgactggtgaagttgttgcatcaccaaatgatattgcacgtttaggttttgcagttgctgcggcagttaaaggcgaaacagttaatggtttagatgacgatgcaaaagcatttgctcaaactattgccgacactttaaaagcagcaaacaaaccgttaattattgcgggtacgagcttgcaagatgcttcaattatggaagcagcagcagagttaacgcaaaaccttggctcaaaagctggtttaagccttgttgttcctgaagtgaactctatgggcttggcattatttggtggcttaagccttgaacaagcatttgctcaagactacgacacacttgttattgttgaaaatgacttattccgtcgtttaccggccgctcaagttaaagcagcacttgataaagctgaaacagtaatcgtgcttgaccacagtgaaactgaaactgtgaaacaggctgatattgtactttcagcagcaagctttgccgaaggtgatggtactgtcgtaagccaagaaggtcgtgcacaacgcttctaccaagtttacgatccaagctactacaaacctgaatacgcgattaaagaatcttggcgttggttgcatgccattgaaactggccttaaaggcaagccaattgattggacagtacttgacgacgtaatcgaaacaatcgtgaagaacgttccggtacttgaagcaattcaagacgttgcgccagacgctggctaccgtgtacatggtttgaaaattgctcgtgaaccacgtcgttattctggtcgtacagcgatgcgcgcgcctttatcggttcatgaacctaaacaaccgacagatccagactcagcgttaacattctctatggaaggttatgttggtccgcaaaaagcttcttcgcttgtaccatttgcgtgggcgccaggttggaactctccacaatcttggaacaaatatcaagatgaagtgggtggtcacttaaaaggtggtgattcaggcgttcgtttattcgaccgtttagcaaaacgtccagcacgtagctatgtcgctccaacagctgtagttgcaaatcctgaaagcttccgtcttgtaccaatgcaccatatctttggttctggtgaattcacaattaaaacacctgcaatggaaactcgtattcctgaagctgtgtttgctgtgggcgaacaagacgcaacacgtttgaatctacaagaaggccaacgtattacagtaaaagcaggcgaaacaactgtgagcttacctatacaagtaatcgaatatttacctacaggttatattggttacccagttggtttagctccgacagtatctttagctgaacctgtttcagtggcattaggagtgtaa

SEQ ID NO: 531 - DNA, 762 bp, Acinetobacter baumannii
aagaagacgacgaactggaataaatccgttttatttcagtaccagcctgtttttgcatcagtcctgaaatgttcaaccgtattcttacgagagcgtttcattatgtctagtttaattcaaccagaactttttttctcagccctctctcctgctgagcaacgcatccaacaagcattagaagatattcgtcaaggcaaacctgtcttggtgatggatgacttcgaccgtgaaaatgaagcagatttaattgttgcagcggaaaccctaactgttgagaccatggcacgtatgattcgtgatggctcaggtattgtatgtttatgccttactgaagagttagctgatcatcttgaacttccaccaatggtttctcaaaactcaagtcagtttcatactgcatttacagtgactattgaagctgctcaaggcgttaccactggcgtttctgctaaagaccgtgtaacaacgattaaaactgctattaaagatggtgctgttgcaagtgatcttaaccgtccaggccatgttttcccattacgcgcacgtaatggtggcgtgcttacccgtcgaggtcatacggaggggactattgatctagcaagattagctggtttaaaacctgctggagtattatgtgaattaaccaatccggatgggaaaatggcatcaggaattcaagttttagcatatgctcaaactcatcatttaaccttgattacaattgaagagcttgtacaatatcgtcaacaacacggtatttaa

SEQ ID NO: 532 - DNA, 1422 bp, Acinetobacter baumannii
gcggattttgcaatgtttgataccttaacagaacgactcacgcagagtttaagaaatgttactggctcagggcagctgaccgaagacaatattaaagataccttacgtgaagtacgtatggctcttcttgaagccgatgtcgcgttacctgtaactcgtgaatttatcgcgaaagttaaggaagaggcattgggccaagaagtgatgactcagttatctccaggccaggcatttgtaaaaattgtctatgatgaactcaccaagatgatgggtgaggccaatgaaacactggatttaagtgctaagcctccagttgtggtattacttgctggtttacaaggtgcaggtaaaacaactacagcagccaagctggcacgtttcttaaaagaacgtcaaaagaaaaaagtaatgaccgtttctgccgacgtttatcgtccggcagcgattaaacagttagaaactgtgtcagcagaagttggtgcaggctttattccatcagatccttctgaaaaaccaattgatattgttaaccgtgcaattgaacaggcaaaaatccagtttgctgatgtgttgattgtcgatacagcgggtcgtttacatgtcgatgaagacatgatggacgaaattaaagagttacatgcagcagttaagccgactgagaccttgtttgtggttgatgccatgacaggtcaggatgctgcaaatactgctaaagcatttaacgatgctttagcgcttacaggtgtgattcttactaaaactgatggtgatgcgcgtggtggtgcggcactttctgtgcgtgctattaccggtaagccaattaagttcttaggtatgggcgaaaagcttgatgctttagaaccattccatccggaccgtgttgctcaacgtattttaggtatgggtgacgtactttctttagtcgaagaagttgaacgtaaaatcgacaaagaaaaagccgagaaaatggcgaaaaaattgcaaaaaggtggcagcttcaactttgaagatatgctgatgcaatttgagcaaatgaagaagatgggcggcatgatgggcttcttagacaagttgccaggcatgagcagtgcaggaattcagcaagcaattgagcaggcaaatcctgaaaagcaggtcaagaaaatggaagctattatccagtcaatgaccatcaaggaacgccgtaatccagacctgatgaacccaagccgtaaaaaacgtattgcagctgggtgtggtatggatgtagctgaagtgaataaactcattaagcaacaagcacaaatggctaaaatgatgaagaagtttgcgaatccatctggtatgagcaaaatgatgcgctcattaggcaatatgcaaaaacaatttggcggtggtggcggtatgggaccgctgtttggtaacaacgaccaaaagaaataa

SEQ ID NO: 533 - DNA, 1095 bp, Acinetobacter baumannii
gctacaattgcgctattaaaccacttttatctaaatgatcaaatgacttcagcacaatcttcaaacacaaacttctctgaaacagacttcaatttactagaagattctgaggatgcagataaccatacttctgatacaactgcaacacgtttatcgttgcaagttcagttagatgaaagctacttagggcaacgtatcgaccaagtggcagccatggtgtggagtgagttttcacgcgaaaaacttaaacaatggatgaaagaaggtcatctgttggtaaatggtaacattgtcaaacctaaatatcgctgtgaaggtaatgaaacactaactttaaatgttgagcttgaagcacagaccaacagtcaaccagaaaatattccactcgatattgtttacgaagatgaagatattttagtcattaataaaccggtaggtatggtggttcatcctggcgcaggtaatacctcgggtactttggtcaatgctttgctttaccattcacctaagtcggccgagctttcacgtgctggtctagtacatcgtattgataaagataccagtggtttactagttgttgctaaaaatctcgaagcacaattttctttgagtaaacaattgggagataaatctgtttatcgtatttatgacttagtcacttatggcaatattattgcaggtggcacaatcgatgagccgattaaaagacatccggttgaccgtgtaaaaatggcaattttgccgggtgggcgtgatgctgtaacgcactataacgtgaaagagcgttttagagactttacccgtgtacaagcgcaacttgagactggccgtacccaccagattcgcgttcactttagttatattggacatggtttggtcggtgatcaagtttatatgaaccgtgtacgtattccggcaggagcatctgagttactcatcgaaactttacgcggttttaaacgccaagcacttcatgcagctaaattgggcttaaaacatcctcgtactggtgaagaaatgttatttgaagcaccatggcctgaagattttacgcagttggttaatgttttacgtacagaaaacgctgcatattaa

SEQ ID NO: 534 - DNA, 927 bp, Acinetobacter baumannii
aattggcatgcagattgctactttacgcttctttttcaaagaaacaggtggaaaatgcaatttaagtatagtttgggcgtaatcagtttatgtagcgctttatttttagttggatgtaatgatgacaactcatcagtttcacaaacaccaactgttcaggaacaaaaacagaagttacagccgattattattcagggtgctttacccgtagagtcggaaagaatggcttcgaagttagaaaataaaactgttgaaacaataggtggctggaccttttggaaaggaacctacaatggctatccaatgattatttctaaaacacgtatggggatgagtaactctgctgccgcaaccgctttggcaattgaacggtataaaccgattgcgattattaaccaaggaacagcaggggggcacgatcctgatctccatgtttatgatattgttttaggaaaatatgcaaccaatattggcgcttttagaacgcctaaacagccattaggtggcggttcaaactcacttacatgggttgaggctttcgacgttttaccaacaaaagaatctgacccagagcctattgcaattcgcaaatttgaaggtgaccaagagctattaatggcggcacataaagtacgttatgacaaaggtgaagtggttgaaggaacgattggctcggcagatgtgtggaataatgaacttgaccgaattcaatttttccatgagcgttatggtacctcagttgaagaaatggaagcggcttctgttgcgcaaatcgcaagccagtttaatgttccgtttttaggaattcgaattttatctaataatattacaaataacggggcttatgaccctggtacaggagaagcttgccaagactacgtgcttaacgtagctgaagaatatatgaaatctaaactaccaaaataa

SEQ ID NO: 535 - DNA, 1107 bp, Acinetobacter baumannii
catctgcatttgtgggctggtaacagcaatccaggtaaaaaagaaatggtcgatactggccctcaatctagtgaacaagcatattttgacaaggctcaaaaggctcttgatcgtggtcaatatcttgacgctaccaaatctttagaagcgattgatacttattatccaactggacaatacgcacaacaagcacaacttgaacttctctattcaaaatttaagcaaaaagattatgaaggtgcgattgcactcgcagaacgttttattcgtttaaatcctcagcatccaaatgtagattatgcttactacgtacgtggcgtatctaatatggagatgaactacgatagcttgttgcgttacacctctttgcaacaatctcaccgtgatgtgagttatttaaaagttgcatatcaaaactttgttgatcttatccgtcgcttcccaagtagccagtattctgtcgatgcagcacagcgtatgaagtttattggacaagagcttgctgaaagtgaaatgaatgcagcgcgttttaacgttaaacgtaaagcgtggattgccgcggctgaacgttcacaatgggtgattgaacactacccgcaaacacctcaagtaccagaagctttagcaactttggcatatagctatgaccaattaggtgataaggcaacttcgcaacaatacatcgaagttttaaaacttaattatccgagccttgtcaataaaaacggcactgtcaacatgcgtgctgcacgtaaagaaggtaactggatcaaccgtgcaaccttaggtattcttggtcgtgaatctaagtctgtaacaccagatacgactacttcttctgaagctgaaccaaaacgtagtctactaaaccgcgtaagctttggtttaattggtaactcgggtaaagaagaaactgaagaaacaactaacacacctgttgaagcaccaaaaagtgaacgtagttggactaatcgcttaagcttcggtttactagataaacctgagccaaaagcagcagaaggcgcaacaattgcaccagcaacgtcttcgagtgaagcaccgagtgcctcaccagcagataacgaagcagatgacgctgctcaataa

SEQ ID NO: 536 - DNA, 192 bp, Acinetobacter baumannii
tttctaacttatggatgtaatctagatattattaaaaaaatttactgtcaaactcaacagccaaattttattggacgacaaaatatgtcgcccattaaaattaaatttaaaatgttaaaaatattaaataagattaaacaaaatgaaccattaagctctacttatttggtggtgataatttacgagttttag

SEQ ID NO: 537 - DNA, 1380 bp, Acinetobacter baumannii
ggttttaattacatgaataaaatcattaaaaacggtatgtttttagggttgtcgactttgatttcaggttatggaactcttctccatgcggaagcaagtccaacaaatttacccgtagtttcacaaaaagcgctaaccattattgatgggcaaaccgagtggttaaataaggtctataaagacattcatgaacaccctgaacttgggtttatggaaaagcgtacttctgccattgttgccaaagagcttaagtcactaggttttgacgttaaaacgggaatagccaaaacaggcgtggtcggcattttaaaaaatggtgaagggccaacggttatgtaccgtgccgatatggatgccaacactgttgaagaggcaactggtctaccatacgcgagtaaagtgcgcgtaaaacttgatgatggaaccgaaacgcccgtagcacatatgtgtggtcatgatgcacatgtgacatggatgctcagcatggcaaaaacattagtcgctttaaaaaaggaatggagcggaactgttattttagtcgcgcagcctgctgaagagccaataacaggtgctaaagctatggtgactgacggtttatggacaaaatacaacttacccaaacctgattatttctttgcagtacataccacacctgcacctgtgggcgtagtcgtcaatgcaccgggaccacgtatggcaggaaccgatcagcttgatgttttatttaaaggtgtgggtggccatggctcattaccaatgctcaccaagaacccgattagcatggctgcaaacgcagtgactcaatatcaaaccattatgggtaatgcagttgatccgcaacaagcggcagtgttatcgattggctcaatccaagctggaaactcgaataacgtgattccttctacggcattggtcaaaatgaacttgcgctggtttgatccaaaagtacgcgagaccatgttaaataacattaagtctatgagtgaaggcgcggctcaaatgcaggggatggggaaagatcaattgccgacctttacttttaaaggttcaagcacaccagtaattaataataaagaattttcggcacgtttaaatgggcctttaaaagcattattaggagataaacatgttctaactgagtatcctgcggttatgggatcagaagatgttcatcatttgttaggcgaccaaaaagacattccttttaactttatgtttattggtgtggcagacccagttgtgtttgcaaatgcagtcaaacaaggcaaacctgtgccttatattccacatagtccaaactacattgttgacttaaaagctttgccagtgggtgctaaagtcactacagtttcgatgctagaactgcttactaaaaagtaa

SEQ ID NO: 538 - DNA, 357 bp, Acinetobacter baumannii
gttagaaattatatgaatactgataatttagatttaaaaaaagaatttttaaaactttttttagatttagtcttagcaaattttacagcaattgttgtctttgtattagtaggaaaacatttgtttaaatcctatagaattcttccagattttataccattgtttttgagttatagcttcactgtcggtatatcattaattggatttttatttttctactatatactttatgagctttatttaaaaagaatgatagtaattctaaatattggggaattttcaaataaattttatattttttcagctttgagttttgtaggttttattgtttttactttaatttctactgttgcttaa

SEQ ID NO: 539 - DNA, 594 bp, Acinetobacter baumannii
aattaccttttggatagaaaatacatggctattaagtctgatcgttggattcgcgagatgagcgaaaaacacggcatgattgaaccttatgcagagaatcaagtccgttttgataagaatggcgaaaaattgatttcctacggggtctctagctatggttatgacgtacgctgtgcccgcgaatttaaagttttcactaacgtacattctgcaattgttgatccaaaaaatttcgatgaaaaaagttttatcgatattgagtctgacgtttgtattattccgcctaactcatttgctctagcgcgtacaattgaatatttccgtattccacgtaatgttttgactgtgtgccttggtaaatcaacttatgcacgttgcggtattattgtaaatgtcactcctttagagccagaatgggaagggcacgttactttagaattttctaataccacgaacttgcctgcgcgtatttatgcgggtgaaggtgtagcacaaatgctatttttcgaaagtgatgaagtatgcgaaacctcttataaagatcgtggtggtaaataccaaggccaaactggggttacacttcctaagacataa

SEQ ID NO: 540 - DNA, 1059 bp, Acinetobacter baumannii
cggatgacctatatttataaaaatcctgccggaatgaccgatagcgaaaaaaccgaacatattaaaaagatagtgactgctgagggcgttgcgctgcgtaagcgttatcctattttgaaccatcaaaatgccattggggcgatgattctatttatatctttggtcggcatgatagcgactgccgtgctctatataaatcatcaactttcagcttggtttgcaattccaattattgctttttttgcatcgctcacccatgagttagagcatgacctgattcactggatgtattttagaaagaaaccatgggcacatcatttaatgatgggcttagtctggttagctcgaccaagtaccattaacccgtggaagcgtcgtgagctgcattttaaccatcataaaaactcaggcaccgaagttgatttagaagaaagagctttaactaatggagagcagtggagcatacgtcgactcatcgcgattggtgataacggcttggcagtcttgttccgtattatttctgcaagcaattggacggttagaaaagtaatttttaaacgtgcatttatggcttattttccgttaggaattattcattggtcgctgtggtatatctttttaggttttcatgcagtagatgctgttttaagttgggcgaatgcaccgattgcttggtcagctaccactttaaatattatgcatgtggttaatattttgactgttgtttgggttgcaccgaatgtactgcgtaccttctgcttgcactttgtgactagcaatatgcattactacggcgatgtcgaattgggtaatgtcattcaacaaactcaggtattaaaaccttggtggatgatgccgttccaactgttttgctttaactttggttcaacgcatgccatccaccattttgtggtgaaagaaccattctacattcgccaaatgacggcaccggttgcccataaagtcatgcgtgatatgggagtacggtttaacgatgttggaacctttaaaagagcaaatcgttggaacataaatgatttatcagagtcaaaaagttaa

SEQ ID NO: 541 - DNA, 216 bp, Acinetobacter baumannii
aatctaaactaccaaaataacaatttaattttaggcaagaagatgaattcttatagagcgtcttcttgttttttatggcctgttctatttttccagtttcgaatgaccatccaacgccagaaaacctcagtcactatatatagtatggttgcaaatacaaacgcttcgacaatgagacctgatattaaaattttagcgaggctcaaatcgatatga

SEQ ID NO: 542 - DNA, 2853 bp, Acinetobacter baumannii
caatggagctatgctggcatgagcgtaattacttcgactcccggtcaaattcaggtgattaaacgcaccggagatgttgctgcatttgatgcagagaaaatttctgttgcgattggtaaagcttttcttgctgtggaaggtcaacaaagtgcggattcgagccgtattcacgaccgtattacccaactgacggaaatggtactgaacactttcactcgccgtttaccttctggcggtaccattcatattgaagagattcaagatcaagttgaacttgcactgatgcgtactggggagcacaaagtcgctcgtgcttacgttatctatcgcgatcaacgcgcaagtgcccgtaaagacacaaattctaatcatcaccctaccttgcaagttaccgatgcaaacggtcagcttcaaccacttgatttaagtgcactgcaagcaactgtaaatcgagctgctgaaggcttagaaggtattgatgttcaagcaattatcgatgaaaccgttaaaaacttatataacggcgtaaaagaaagcgatattgctaccaccatgatgatggcaacacgtacacgtatcgaacaagaacctaactatacatacgtaactgcacgtttgcttcgtgatgagttggtaagcactggcttagcattcttaggtttaccggccgatacagctgaaaacaatgcacttgaagcattcttgaaaaaaggtgtagagcttgatttgctttcaccggacttgcttaagttcgatctagaaaaactagcagcggcaattcaaccggaacgttctaaccagtttacctatttaggtttacagactctatttgaccgttacttcatccattcaaatggcgttcgctttgaattaccacaattattcttcatgcgtgtgtcaatgggtcttgcccttaatgagcaagacaaagaagagcgtgcaatcgagttctataacttgttgtctagctttgactacatggcatctacgcctaccctgtttaactcaggtacattacgtccacagctttcaagctgttacttaacaacgattggcgatgacctttatgacatttatggtgcaatgcgtgacaacgcgatgctctctaaatgggcaggtggtttaggtaatgactggacacctgtacgtgccttgaactcttatattaaaggtacaaacggtaaatctcagggtgttgttccgttccttaaagttgcgaacgatacagccgttgcggtaaaccaaggtggtaagcgtaaaggtgcggtatgtgcgtacttagaaacttggcacttagacatcgaagaattcttagaacttcgtaaaaacacaggtgatgaccgtcgtcgtactcacgacatgaacactgcaaactgggtccctgacctatttatgcaacgtgtgtttgaagatggcgaatggacactattcactccgtctgaaactccagacctacacgatttaactggtgctgagtttgctgaacgctatgcatactatgagtctgttgcgaaagaacagaacatgttgcacaagaaagtacgtgcgaaagacttatggcgcaaaatgctttctatgttgttcgaaactggtcacccttggatcacgtttaaagatgtttgtaacttacgttcaccacaacaacacgttggcgtagttcactcatctaacctatgtactgaaattacgttaaacaccaaccaagacgaaattgcagtatgtaacttaggttcgatcaaccttgttcaacacgttaaaggtggcgtattagaccgtgagaagttagcgcgtactgttaaaacagcagttcgtatgctcgataatgttatcgacattaactactacgctgtaccacaagcgaagaactctaacttgaaacaccgccctgttggtatgggtatcatgggcttccaagatgcactttacgaaatgggtatggcttacggttctgatgaagctgtgaactttgctgacgagtcaatggaagtgattagctactatgcaatccaaacttcaagtgacttggctgttgaacgtggtgcttactcaacatttaaaggttcattgtgggatcaaggcatccttccaatcgactctttagaaattgttgcgaaatctcgtccagaacgtatgtttgaagttgaccgcactcaacgtttagattgggacagtttacgtgccaaagttcaaaaagacggtatgcgtaactcaaacgtaatggcgattgctccaactgcaaccatttcgaacatttgcggtgtttctcagtctattgagccaacattccaaaacttatatgtgaaatctaacttgtctggtgagttcactgtaattaacccttaccttgttcgcgcattaaaagaacgtggtctttgggacacagtgatggttaatgacctcaaacactttgaaggttcagtacaaaaaattgctcgtattcctgaagaattaaaagcaatctttgcaactgcttttgaagttgagccacgctggattgttgatgctgcatcacgccgtcaaaaatggattgatcaagcacagtctcttaacctttacatctctggtgcaaacggtaagaaacttgacatcacttataagatggcatggttacgtggtcttaagacgacttattacctccgtgcattaggcgcaacatctgctgaaaaatctacaattaacacaggtgcgttaaacgcggttaaacctgcaactgtagaagcagcagcacctgcggcagctccagtcgtagaagcgaagaagcctgaagcagttgaagaagacggcttcactcaagcagctccggttcctatggcttgttcaatcgacaacccagattgcgaagcttgccaataa

SEQ ID NO: 543 - DNA, 300 bp, Acinetobacter baumannii
aaatttttatattcaattaaactagtggcaaatcaaacgccacaagcaatgaggagaattcctgtgagcgatatcgaacaacgcgttaaacaagcggttgcagaacaacttggtcttaaagctgaagagattaaaaacgaagcatctttcatggatgacttgggtgctgactctttagatttagttgaacttgttatgtctttcgaaaatgacttcgacatcactatccctgatgaagattcaaatgaaatcactacagttcaatctgcaattgactatgtaactaaaaaacttggttaa

SEQ ID NO: 544 - DNA, 852 bp, Acinetobacter baumannii
tccttattatataaatctatgattcgagtaccttctccagctaagctcaacctgtttttgcatatcacaggacgtcgtgaaaatggttaccatgaactacaaaccattttccaacttattgatttatatgactggatgacatttacgcctatatctgaagatgagattcagattgaaggtttaggtgaggttcaacttgagcaaaatctgatttatcgggcggcacagatattacgccctcacgctcaaaatccttgcggactccatataaaaattgaaaaaaatattccgatgggtgctggtttaggtggcggttcttccaatgcagcaacgacgcttattgtcttaaatcaattatggcaatgtggtctaactgaagaacaattagctcagttcggtgtcaagcttggtgccgatgttccaatttttatttatgggttaaatgcatgggctgaagggattggtgaacatttatcattcatagacttagatcaaaaacaattcattgttttaaaacctgattgttttatcagcactcaactgcttttttcacaaaaaacattgacaagagattctaagcccactacattttgcgcctatcagttagaaccttctaatttcggaaataactttgagcctttggctagagagttataccctgaagttgaagaagcaatgcaatatctcgaccaatttggtcatgcaaagcttacaggtacaggtgcttgtgtttttgctgaggtaaccgatgaaatgaatgttgatgacattcttaaacatgcaccatgtaaagcttacttggtacatagtttaaaagaatctcctttacgtcattttaaagttgcaagttag

SEQ ID NO: 545 - DNA, 1080 bp, Acinetobacter baumannii
acaaaagattttttagttttgaatcttttatactgttcagaggaatatgaatcacaagttataggacataacatgccacagacagcaacggcactggctagctgggtgaaagcgattcaaaaagcgctcgaaaaagccggtgttgatagtcaacctttattagaacaagcaggtttagatattcaggctctgagtaatcctgatgcacgatattcattaaaacaaacagcaaatttatggaaattagcagttcagaaaactcaagattcatgttttggccttaaagttgccagccaagtcaatcaaaatacttttcatgtgttagggcattcactgattaccagcaccaccctaaaagagatgtttctaagaattattcgttattttcgtgtggttacggatattccagagctagagttttatgggcaaggaaataatcattatttcgttattcatgttcccgacgaagttcagcccgagtcaatagatgcatttatttccgtttttattcgctcaagtcgtgccttacaaggctctgttttttcacccttacgcattgaacttagacgctcagagccagaagatctagaaacttttcagagtattttaaaagccccgattgtgtttaatgcacccaaagatatgattgtgtttgatacggcaacgatagaacaaccactagaaggtgcaaatccgactctcacccaagaatatgatgaaattattaatcgttatctggtacggctcgataaagaaaatatattggcacgagtgaaagtaaaattaatcgaaaaattatctacaggtgatttccaacaacaagacgttgcgaaaagtctgggcttaagcatacgaagcctgcaacgcaaactttctgccgaaaacacctcttatagtgaattgctggatcagactaggcatgagctcgccttatcgtatattaaaaactcaagccataatattactgagattgcttatattcttggctttaccgatgtcagtagttttacccgcgcgtttcgccgctggaccgatttatcacctatccattatcgagaaaaatatctggcttgctcttaa

SEQ ID NO: 546 - DNA, 417 bp, Acinetobacter baumannii
gatcttcatcttagatctactcaggagacgctagccatgctatctcgtttattaaaatgcaaaattcaccgtgcagttgtaacccatgctgaacttcactatgaaggttcttgtgcaattgatggcgtattgatggacttagctggtattcgtgaatacgaagaaatccacgtttggaacgtaactaatggcaagcgcttcacaacttacgcaattcgtggtgaagataactctggcattatttcagtaaatggcggcgctgctcaccaagcagatgtaggcgatttagttattattgctacttttggtgatttcacagaagctgaagcaaatgcccataaaccacgcttggtatatgcaaacccagataatacagtcaatcacacagcgaactgtattccggtgcaagttgcctaa

SEQ ID NO: 547 - DNA, 699 bp, Acinetobacter baumannii
tttatgaatctcgaagaggcagaaagtctttctgagcaaattgtcaaatatattagcgaacagattattagtggcgaattggttgaaggcgaacgcatacaagagcttcgtatcgctaaagaacttgacgtaagtaggggatcagttcgtgaggcgctattattactcgagcgtacgcatctcattgaaatttttccgcgtcgtggtgcaattgtttcggaaatgtcggcacaacaggtcaaagcgttgtttgatacaaatatgatgttattggggcatattgtacaacgcataagcgaaacatggcgtgcccatgaagctgatcaattacagcttttgctagaacagcttcttgagcatgtaaaagcaggcgatatcgaaaaattctacgatgctattttccaatatcttgctgaacaacaagatatggtcggtaatccttatttaatgaaattttataaagaattattaccatcattacgtcgtagttattttttgacactaaatacctctaaacgggaactgcaagaagcgtttgcattatttaaactcgtgactgatgcaattttgatccgaaaatcacaacaagccgctttatttatggaagatttttgtcgacacttacgtaaccttgtgttggaatcgctaacacgaatgaaacagattgaattggcttgggcgagacgctcacgccgctag

SEQ ID NO: 548 - DNA, 1020 bp, Acinetobacter baumannii
ttcatgaatcaagaaattatacgtcaaacgccactttgggctgagaactggccaattgcttacgctgttgttcaagcagttgtaattttgcttgttgttgttcttgttgctgcgttgatgtctttcattgagcgtcgtttgcttgcttggtggcaagaccgttatggtccaaaccgtgttggtcctggtggtatgttccagatcgttgccgacatgcttaagatcatgttcaaagaagattggacaccaaaatttgctgataaattaactttccgtttagctccggcagttgcgatggcaactgcggtgctttcgttcatggttattcctgtaagccctgcattgggtgttgcggacatgagcatcggtttgttgttctttatggcaatggctggtattgcggtttatgcagtgttattcggtggttggtcatcaaataacaaatattcattactcggtggtttgcgttcagctgctcaaacaatttcttatgaagtgttcttgggtatctcgctaatgggtgtggttgcaatcgctggttcatttaaccttcgtgaaattgttgaagctcaacgtgatgtttggttcatcattccacagttcttaggtttcttgattttcgttgttgcaggtgttgcggtaactcaccgtcacccatttgaccaacctgaagcagaacaagaattggccgaaggttaccatgttgaatatggcggtatgaaatggggtatgttcttcgttgctgaatatgtaaacgttgtacttatctctgcattgatcgtgactttattctttggtggctggttagctccattcaatttagaaattccatttgttccaccagtgttctggtttgtgattaaaacagcattcttcgtaatgatgtttgtattggcacgtggttctttaatgcgtccacgttatgaccaagtcatgaacttcggttggaaaatttgtttgccgctggcgttggttaacctattggtaactggtgctgtgattctgatgaatcaggcctaa

SEQ ID NO: 549 - DNA, 1722 bp, Acinetobacter baumannii
aaattgcgtcaaatgaatagccgtattaattttaacggtgcttcgataagacagtattctaccacattcttattgttaggtagcatgtcctcatatgtctatgcacgtccagtgcaagagacctatgccgtgcattcatttgatcaagctttacagcagagtatggttgctgaatttgccttagcttatgacgatattcccacagcactgcacaattacacagtgcttgcgataaaaagcaactcaacaacaattaaacagcgtgcattagacgttgcacttgaatataacgacttacaagctgccctaaatattgcaacacattgggttgttcaagagcctaaagatgtccctgctttattttatttatcgcatattgcgctaaaaacacatgaatatcagcttgctgccgagactttagataaaattttaaaaatagatccaactgccgatcttgaacaaattttggcaagcattgcacctgaaaatgcacaggatcgagaagttttattaaccgctttacgttctagtgcagagaaagacaacccatccatcttagcgcttattgccaacctagaagcacaaaatggtcagttagaaccagccttaagtaccattaatcgcgcactacgccgtcgccctaaagtgaccagctttatcttaatgaaagccaatttactaatcgcactcagtgatcaggaaggcgctttaaaatggtatgcaaaatcaagccgtaaatataagaaaaacctagatattcgcctagccgaagtacgttacctcatccagattaatcaaccccagcttgctcttgaaaaattagagaaaattattgaaagcaatcctcatgctgaagaggctttatttattgctggtttaaccagtattgaccttaagcaatatgacaaagcagaacaatatctggttgatttacgcaactctgcaaaatatcaaaatgaggcgtattactacttagcgattaatgctgaaagaaaacaacattatgaaactgctaaagcttactaccgtttagtcgatggtagtttgtatattgtttcaagacgcaatctcattgcgatctatgataaacaagaaaacttacacgacgctttacgctttttaacccaagagcgagtcaattatcctcagcatgcaagctttctttaccaagctcaagctgaaattttaaagaagatgggcaataaaaaagctgcattaaatttattagatgaagcgatcaaaaacttaccagatgatccggagctcatctatgcagaagttttattattagacccttatactgaccgcgataaactcgataaaacactcaaacaattattgcagttagaacccaatagcccaacgtatctaaacgcctatgcttatacattagctttgcaaaatcgtaggcttaaggaagcacgtcaatatgctgaacaggctttagaatatgcccctgaacaagcttctattctggatacgctaggctatatcgcatttttacaaaatgattatgaagcggctgcggaagctttaggcaaagcatatgaactaagtcataacataaatattggcattcgttacgctaaggcactttatatgcaaggatcattaactcagttcagtgccgtgttacaacaactgaaacaaaagcacgcaaatgatccacaattacaacaacttgatgcgttaattttacctacatctgcaaaaaagagttaa

SEQ ID NO: 550 - DNA, 1053 bp, Acinetobacter baumannii
tttcggagtcatagaatggaaatcaatacgattattggcatcgttgttgccattattatcatgctaattggcttaagaatgattttaaaaaagccgaaccatgctgaaccctcgctagacagtgatttgcatattaatcctgaaagtaatcaaccggttatccctcgtcatgtacgagatcaacttgaacagccagaagttactgttgcgtcagcagccgttgctgaacgagtggaaccaactttaagcgagccagcacagtcagaagaaaagggaacaaaagaactagaacaggcttcacaaactcaaacagtccagacacaagtacccgttgaaaatacgccagtagaagtagaagaagttaaagctgaagaaaatactgttagcccaactgtaagtgaaaatagttcagttgagttagttgataccgtttctgctgaaccagaagttgttagctcatcagaaccaaaagttgcagaagggcaaccgaaaactgagccggaattaagcttaaatccaaatatcgaaactgctgaaattgctgagtttgaaggtgaaagcaacattcttgatgtacatttacatgagcagcagcgttttgatgacgaaagtgcgttagcaatggctgagcagattatcgcattaaatgtatatccaaatccgcgccgtgcgttatcgggtgataaagcactgaaagtgcttttaaaatatggtctacgttacggtgaaatgtcttgtttccaccgctatgaaaataccgatgagccaagtgcattgatgttctctgtattgcgtatgactgataatggtcctgctggtttcgatttagaaactttatcgactgagcaagttcaaggtttagcatttttccttgcacttccaaacagcaaggcagttaccggttttgacatgatgaccagtattgcaggccttattgctcgtgaaattgatggtaaggtttatgatgaaaataaccttgaatttacgccacagttaaaagaacattggcgccatcatgtgattgattatcgtccagcacaggcaacagcctag

SEQ ID NO: 551 - DNA, 1407 bp, Acinetobacter baumannii
aaaaatatccaggatggatctatgaattttgttgtgaataaaaaaatatttatcttaggaatagcatcgatttgcacaagcacattacatgctgctgcatttgataaaacagggcagtctgtagcggcatttttacaaccgggcaactattttgaagcaagtttaggaataacagatgccgatttaagtggtgtagagtcgggtaccaatccttcacatcattcaatttcagatatcgccaataccgattatcggcctacggcagcgttaaaactacagttggcaccgcagtattcatttggtctgttatatgatcagccttttggtgctgacacggaatattcaggtgtaaatggcttcgttgcaacgccaaaagataccgttatgttacctggaattacaaccatagggcttgccagcgctacattgggccatgctcctacaggaaatgcaaaatcagaatttgatatacaaaatttaagcttcattttgggttaccaacccacaaaaaactggaatctttatgcggggccagtctatcaaacttttaaaagtcaggttgaattaaggggtaatgtatttagtctctataatggatatgactttcatactaaaactgtcagtgatttagggtggttagcaggacttgcttaccaaattccagaaaaagctgtgaaagtctcattaacctaccgttcagccattacccataaagtaaacgcgactgaaaacgctcctttaattgatatgttaagcactcaacaaggtcgtgatttagttaatcagcatctagattacatgatttctattggtcagatgactccacaaaagaaagcttacttaaatcagattattgctaatttgccagaacaagaagatacaggtacaacaaaatttaaatctcctgattcagtgaatttggagttccagactggactgcgtcagggaacgttactatttggtagtttacgctgggtaaattggagtgatcttgctttgcaaccttatcgctttggtgagatctcaaaagttgttggcgtactatcaacgccaagccgcccggaaggttttaatttggttcgttattatgacgaccaatggtctttaaatttgggtttaggacaacgtttttcgccaaaatggctaggttctgtgtcagttggatgggactcaggagcaggagataaagtgtcaacgggtggcccaactaagggatattacaacttgggcgtgggtgctcaatatagcccgacatcgcaatactttatttctggcggtgtgaagtattactggttaggcgatgcaaaagctcagtttggcgcacaggcgggtagtgactattatgtaggtgagtttaaggataaccactcagtcagctatggcttaaaaattggatataaattttaa

SEQ ID NO: 552 - DNA, 876 bp, Acinetobacter baumannii
gtgaaaacccaaaaaggatttcttatgtctgctaaacgtcttgaacaagtagctttagccacaaaaactgcatttgtgtttccaggtcaaggttcacaaaaagttggtatgctcgctgaactcgcagaacagtttagtggagttgggcaaacttttgccgaagcttcagacgcgctaggatttgatctttggcacattgcacaaagtggtgaaggtttggaccaaacagaaaatacccagcctgtattattaactgccagtattgctttatggcgtttatggttagatttaggtggtttagcccctaaataccttgcaggtcactctttaggtgaatacagcgctttagttgcagcaggttcaatgagtttggcggatgcagttaagttagttaatttgcgtggaaaactcatgcaaaatgctgttcctcaaggggaaggcgctatggctgctattcttggtttagctgatgataaagtagttgaattgtgccagagcgtatctgcattaggccaaggttcagttgaagcagcaaactataattcacaaggtcaagttgtgattgctggtagtactgcatctgtacagcaagttatggcattggcaaaagaacaatctgctaaagcaattgctttaccggtttctgttccatcacattgttcattgatgaagccggcagcagaaaaatttgcagaagctttggaacaaactgccattgagctacctaccattcctgtaatacaaaatgtcaacgcggggaattgctaccgatgttgctcaattacgtcaggctttaacagcacaattgtaccagtctgtacaatggacacgtaccatgcagtctctacaagaccaaggtattcagtacattgttga

SEQ ID NO: 553 - DNA, 240 bp, Acinetobacter baumannii
ttgaagcgtcttagtcttttggatgattttccaatcaaaagtaatcatctatgtcttgtagagggggtttcaccgcttataatcggtttatttgatagttttcgcacttgtaatgatttttttcattttctgatttttaatattatttgcacaattgctcaatcggtcaaattaaacaccttacttttttataatattaatcggttttttattgtattcatcttcccctctgaattatga

SEQ ID NO: 554 - DNA, 657 bp, Acinetobacter baumannii
atgagtggccagatctattttgtgagtgggattgataccgaaattggtaaaacctacgcgacaggtttcttagcaaaattatggactgagcagggtaaaaaagtaattactcaaaaacttattcaaacaggtaatgctgatatctcagaggatatccagaagcatcgtgaaattatggggcaaggttggtttcaggaagatcatgacaagctgactatgccggaaatctttagttatcctgcttcacctcatttagcaacgcgtcttgataaccgagagatcgattttcaaaaaattgagaatgcgactcaaacattggctgagcgttttgaaattgtattgttagaaggtgcaggtggcttaatggtacccttaaccaccagtttacttactattgattacattgctcagcatcagtttcctgttattttggtgacgtctggtcgtttggggagtattaaccatacattgcttagtctcgaggcgcttaagtcacgtggtctgaaactaaaagctttggtttacaacctaaaagatgaatcaaaagatccattaatctctcaagatacttcaaattatttgaaggactatttagccattcatttccctgaagctgaatggattgaattagcaaaaatgaatgaattaaaaaattag

SEQ ID NO: 555 - DNA, 612 bp, Acinetobacter baumannii
ttttacctacatctgcaaaaaagagttaaatttatgagcaaacttgcccaactgtgcacagcgatctgtggatcaagtgttttatttttaaccggttgtcagcattttactcaacctaaagctgcagttacccaccaagtacaagacgaaaaacacttcaatttacaaggtaaaattggagtacgcaccccccagcaaactggtagtgcattctttacatggattcaacagcaagacaatttcgatatcgaattaagcggtattttaggtgttggaaaaacacaaatacagggtaaacctggtgaagttactctaaacagtgctaaaactggactgattacggctccatctcctgaagaacttctagagcgtgcaactggctggcaagcaccaattactcatttaaccagttggattttagcgaaacctgcaactttaaatgctcaaattagtaaagataatgcaaatcgtgtgagccaactcatcgaagatggctggacagttaattttagttatgatggtgaacaaactctaccaaataaactggttttaaagcaggctcttgctgaagataaagaaaaccgtattacaatggtgatccaaaaccgctaa

SEQ ID NO: 556 - DNA, 477 bp, Acinetobacter baumannii
aaaatgggtctttttgattttgtaaaaggtattggtaagaaaaataccgcgccagcagaaccacaagcagctccagcaacaccagcagaaccttctgcacaagaaattgcgaataaattattgggattgattaaaagcttaggccttggggtggaaggcttatctgtaacatataatggctcaactgacactgctattattaaagggcaagtccaaagccaagcagataaagaaaaaatcattcttattgtgggtaatgtagatcatgtggcacaagtagatgaccagatgactgttgcaactcctgagccagaaagcaaattttatacagtgaaatctggtgataatctttcaaaaattgctaaagagttttatggtgatgccaatcaatatcaaaaaatctttgaagcgaataaaccaatgctgaaagatccagatgagatttttccaggacaagttttacgtattcctcaataa

SEQ ID NO: 557 - DNA, 621 bp, Acinetobacter baumannii
aatatgctgcatttacatgtacatcctgaaaatccacagcaacgcctcattgaacaagcggttgagcgtattcgtgccggagatgttgtggtctaccctaccgatgctgcctatgcaatcggatgccagattggtaataaaaatgcgatggaacggattgcccagattcgtggtttaggtcctaaacatcaatatgcaattatgtgttgcgatttatcagatatcgcgacttatgccaaagttgataatgcgacgtaccgtttattaaaggcaaatacaccagccatcactactttcattttaccggcaaccagcgaagttccacgcagattaatgcatcctaaaaagaaaacgattggtctacgtattccgagtaatccaatttgtcaggctttattaaaagagctgggtgaacctttactcaccagtacattaattttaccggggcaagaagacccattagatgatccttacgatattgaaaatcaattagctaagcgtattgatgtctttattgatggcggttttggtactttaacaaccacgagtattgttgatttatcaggtgagcatcctgaaattattcgtcgtggtgtcggtgatgtaagtgcttttgaataa

SEQ ID NO: 558 - DNA, 855 bp, Acinetobacter baumannii
attatttgttttattggaaataatatggcagaacctataacttatgtaacaagttttctagtaaaaataataactattatattaggtccttttttaaggaagcctattgatataattagtaaatttttatatttggaggcctataaaatttcaacattttacagtttgtattttgatgtgaaaagaatgtttcctcatagtttagggggagttatagattataatataaattggagtgaaatatatcttaagaaaaaacaggctaattgtactcttcgtataagagcaaagggtaatctatcttatagtaaaataactttttgtgttactgcttctttagagagtttaaaatatcagtctgttgtagaggtttatgatgtatctactacaccttgtattatagctttaccaagtattccacttagaagtatagaaattaaaggtaatagaatatatgagccttataatagtatctcggttgaaataaaagaaatatttgatagtaataataatattatagatattagagggaagtggaaagatattctacatccaatagataatctagataagattattaaggaaaaagaaagtgatgtatatagatgggggcaatggtggaatttagatttcttagaatctgaaaaagaagaaatctcaagatttttccaagcttatagtgtgaatgcaaaattttgggggtcaaaaacaaggtatttttggcaacctgtcgcttggttcatgagtgtaccatttattctaaatatttatttctggattaggaatataatctgggctaatcaattaaataaagctttagagaagcatttaaatgattatgattatgagagttaa

SEQ ID NO: 559 - DNA, 495 bp, Acinetobacter baumannii
cggatgtctaaaacgcgtgtaatttatcctggaacatttgaccctatcacgaatgggcacgttgatttagttactagagcatcaagaatgtttgatgaagttgtagtagcgattgcaattggacatcataaaaaccctttgttcagcttagaagaaagagttgcactggcgcaatcatcattaggccatctatcaaatgttgagtttgtaggttttgatggtttgttggttaacttttttaaagaacaaaaggccacagcagtacttcgtggtttaagagcagtttctgactttgaatatgaatttcaactggccaatatgaaccgtcagcttgatccacatttcgaggcggtgtttttaacaccttctgaacagtattcttttatttcttcgacattaattcgagaaattgctcgtttaaaaggagatgtaaccaagtttgttccgcaagctgtggttgaagcttttgaacgtaaacatcaacaaggttggtaa

SEQ ID NO: 560 - DNA, 1272 bp, Acinetobacter baumannii
aggcttgctaaagaccaaactgataaagcgattaatttatctgtagaaatctatttctggcaagtaaatgaaaaagaagaaataggaagcgctcaaatgaagtcggtactttgtcatcaagcaaaattacaagtggtggaccaaccgaacttaacgcctgcaaaaggacaggtgttattagaagtggtgcgatgtgggatttgtggttctgatttgcatatgcagcaccactgcgaccacatgcatgatttggctgcacgtgtcgggtttaatggtttagcgaaatccacagacccgtttgtactaggacatgagttctgtggcaaggttttagactacggccccaaaacacgtcataaatttaaagccgatacactcgtttgcgcaatgcctcttttaaatgtagatcagcatggttatttatctacagggctttctccaaatgcttcgggtggttatgccgagcaagtattggctcaatcaagcttgatatttgaagtacccaacggtctagatgcggatagtgctgccatgactgaacctatggcggttgcattgcatgccgttcgccgtagtcgtgtgaaaactggtgaacctgctattgtgattggctgcggtcctgttgggctaggtgtcatattaatgcttaaagcagctggggttaaaactgtagttgccagcgacttttcgccaaaccgccgtaagcttgccgagcaatgtggtgccgatattgtggtagaccctaaagagacatcaccatttgccaactggaaagaatttggtttgcttggcaatgtatcagatgcaattaacatgggtatggggctgtttgataagttgcaagcgactcgcttaccgtggtggcatggatggcgcatgattgataagttaggtgctctgccaaaacgtcctgttatttttgagtgtgtgggcgtaccgggtgttttgcagcaaattattgaaggtgcacctttgttttctcgaattgttggggtaggcgtgtgcatgcaaagtgacaaaatagaacccgcacttgcaattaataaagagttagaaattcagtttgtgttgggctatacaccgcttgagtttagagatgcactacacatgattgcagaagggaaagtgaactgttcaccactgattacgggtgttgttggcctagaaggtgtaactaatgcatttgaagcgttacgtgatcctgaacagcatgccaaaatcttgattgacccgaagcgtagtggttcagatattcaattaatgagtcattaa

SEQ ID NO: 561 - DNA, 1671 bp, Acinetobacter baumannii
acttcctataaggttggtcgagtgtttaaacacagtatattcctgcgaatatatgcggggctggtaattcttgttgttttggtagctgtttttgggtatttactggtacaaattatcaactaccaacgcgcacaagaataccgagaatctttaactgatggtatttcttatgtcattagtgaaggagtcgctcgacaacctgggaagcagcaaaaaatagattggatttctgacgcatctgatttgctcgaacttccaatttattataccgatgcaagtaaggttgagctgtctcggaccgagaaaaagcggatcgaagcacaaaaatctgtagttcgttacgatgcaagcaatagcatcgcatatgtcattattggcttgcgtgacgacccacaacattacctatctataaaagtcgacaaaatcactgaacgccaaatgaaggctcttcctatttttgtgctcgactatttaatgttttatccggggcaggaacaagaatatcttgccaagattcaaaagcatttctcatatccgatcaatattcaaaacattcaagatgtaaatctggactctgaacagattggacgtttgcgccaagaccaaagtgtcatgttgtacaaagatagcgcaacagtgcgcggtacaaccatttcgattgtgtctccaataccgaatcatcctgcgcaggtgttagtgctgggtccggttccaatgtttaactggatgcctttacagctttcggcgggtattaccttatttagcttattcttattaagtctaggtgtttacggtttgattttgccgttagagcgcaaaatccgacaggtgcgttatgcattaaaccgtatgaaatcgggtgatttgtcattacgtgttcctattgagggaagcgatgaaatggcaaacttggcttcaagttataacaatatgtctgaccatattcagcgcttgattgaggctcaacgtgagttaatgagagcagtatctcatgaactcagaacacctgtggcacgtattcgctttggtacagaaatgttagccgaagaagatgattacaatcatcgtatgcatcaggtcgacatgattgataaagatattgaggcactcaataccttaattgatgaaatcatgacttatgcaaaactagagcagggtacaccttcattagactttgcagaaattgtactctttgaagtgttggatcaggttgcagttgaaactgaggctttaaaaacacagaaagaaattgaacttattccaccgcctttatatgtgaaagtagatgcagagcgtcgttaccttcaccgtgtcgtgcaaaatctggtaggtaatgcagttcgttattgtgataacaaagttcggattacgggcggtattcataatgatggcatggcttttgtctgtgtcgaagacgacggaccgggtattcctgagcaagaccgcaagcgtgtatttgaagcctttgcccgtttagatgatagccgtacacgtgcatctggcggttatggtttgggtctctctatcgtaagtcgtattgcttactggtttggtggggaaattaaggtagatgaaagtccaagtttgggaggcgcacgctttattatgacttggccagcacatcgctttaaacaaccgccattaaagaccaataaaaaagcacctgcataa

SEQ ID NO: 562 - DNA, 1134 bp, Acinetobacter baumannii
ttgcggtataaatctatccatgctctgaagcgctccagttattcacttttgataagaccaacaggcacaaaactgataaggctggaaagttcaaaaagagcaaaaagattttttaggtttatctcagaaattagggtactgatcacaatgagtaaagaatttacatttacgattaagagtatttgtttcgatgagaactatcgtccagcagacaatacgcgtattacaaccaactttgctaacttggcgagagggatgagccgcgaagaaaatttgcgcaacaccttacggatgatcgacaatcgtttcaatgccttagctcattgggacaaccctaagggcgaccgctatggcgttgaacttgaaatcatttcagttgaaatgaacattgatgccgaaaaccgtactagcgggcttcctttaatcgaaatattgaaaaccaatattgttgataaaaagaccaatgaacgcattgaaggtattgtaggcaacaacttctcttcttatgtacgtgactatgactttagcgtgctgttgttagaccacaacaaaaacaagtctacgtttagcacgccagaaaagtttggtgaactgcacggcaacttgtttaagagctttattaactctgagacttataaagccaactttaaaaaggcaccagtcatttgcttaagcgtttcaacaagtaaggtgtatcaccgtactgaaaacgaacatcctgttttgggtgttgaatacaagcaagaagactattcattaaccgatgaatatttccaaaaaatgggcttaaaagttcgctatttcatgccgccgcatagcgttgcgccgttagcgttctactttactggcgatttgttgagtgattacaccaaccttgagttgattagtaccattagtacgatggaaaccttccaaaagatttaccgtcctgaaatttacaatgcaaattcagtggctggaaagtcttatcaaccaagcttgaagcatcaagattattcacttactcgaattgtgtatgaccgtgaagaacgtagccgtttggctattgagcaggggaagtttgttgaagagcaatttatcaaaccataccaagcgattcttgagcagtggtctgcgaattacgctcctaattaa

SEQ ID NO: 563 - DNA, 1611 bp, Acinetobacter baumannii
tggggaaataaaatggaaaacaatttaattttacccgcgctgatccttgttccgttcattgcaggttttacttgttggttagtcgataaactcgacaaaactttgccacgctggatcgccttaattggtatgctcatcacgttgggcttaggtcttgcactttggcaaagtggtacttatagctacgagttaggctcaaaagtcccaacttggacagctgagttttacttaccgtggattcaatctctcggtattggcattcacctagcagtggatggcttgtctttactcatggtgttattaacagctttacttggtgtacttgctgttggttgttcatggggtgagatccaaaagaatgttggtttcttccacttaaacttgttatggagtttagggggcgttatcggcgtgttcttggcaattgatttgttcctattcttcttcttctgggagatgatgcttgtaccaatctacttcttgattgcgttatggggtcataagggttcaaacggtcgttcacgtgtttacgctgcaaccaagttcttcttatatacgcaaatcgctggtttagtaatgttaatcggtatccttggccttgtggtttatggttacatgatgactggtatgatcggttttgattacaactatttattagctgtagcgaatcgtttacctgctggcttcgcgtatggtttcatgatctgcttctttattggttttgcagtgaagttaccagttttcccattgcatggctggttaccggatgcccatgctcaagcacctacagcgggttctgtagacttggctggtatcttgattaaaacagcagcgtacggtttgcttcgttttgtaattccattcttcccggcagcttctgcacagtttgcagatattgcaattattttcggtttgattggtattttctacggcgcgtggtgtgcttaccagcaaactgatatgaaacgtttacttgcgtatacgtcgatttcacatatgggcttcgttttacttgctatttatgcaggtaatattttgaccttccaaggtctaatgatcatgatgttggcacatggtttgtcatcagctgcattgttcattatgtctggtcaaatctacgagcgcttacatacacgtgatttacgtttgatgggtggtcttcgtggtcagctccagtatttaccgttcttcttaatgttcttcgtcgcagctcttgttggtgtgccaggtttaggtaactttattggtgaattcctgattttgatgggttcatttaataaatatcctgtattcacgatcattgcttctatcagccttgtatttgcaggtttgtatggtttgatcttgattcaccgtgctttgtttggtgaaccaaactctgaacaaaagcaacactacactagtccattaaaagacttatctgctcgtgaagttagtattttgatgatttgtgcgattggtctcgtttggcttggtatctatccacaaacattcttggatgtatctcattcaagcatgcagtggttggtcaatagttatgtaccagtacaagaagtcgttgaaactgttcagcaaacagctactcaacttgaccatgtggagatccaataa

SEQ ID NO: 564 - DNA, 750 bp, Acinetobacter baumannii
gatacatgtaatgagatttataggggcaatgatatgagccaagaagaaaagttaccaaagattctgatcgttgaagacgacgagcgtttagcgcgattaactcaagaatatttaatccgtaacggtttggaagttggtgtagaaaccgatggtaaccgtgcaattcgtcgtattattagtgagcaaccggatcttgtggtcttggatgtcatgttgccgggtgcagatggtttaaccgtttgtcgtgaagttcgcccacactatcatcaaccaatcttaatgttgactgcacgtactgaagatatggatcaggtacttggtctggaaatgggtgcagacgattatgtcgcgaaaccagttcaaccacgtgtattattagcgcgtattcgtgctttgttacgccgtaccgataaaactgttgaagatgaagttgctcaacgtattgagtttgacgaccttgtcatcgacaatggtggccgttcggtaacgttgaacggtgagcttgttgactttacaagtgctgaatatgacttgttatggttgcttgcatcaaacgctggccgtattttatcgcgtgaagatatcttcgaacgtttacgtggtatcgaatacgatggtcaagaccgttcaattgacgtacgtatttcacgtattcgtccaaaaattggcgatgatcctgaaaatccaaaacgtattaaaactgtacgtagcaaaggttacttgtttgttaaagaaaccaatggattgtaa

SEQ ID NO: 565 - DNA, 741 bp, Acinetobacter baumannii
gaggagggtaacgcgatgaaaaaaataactgctttactctttgctctttgtgcaactgtgactcatgcagagttacagaccttggataatgatgcattacaggcaattaatggccaagctggtgctgatttatcactcatgcttaatttaaaccagaccagtaacggtatatttgataatggcagtggtggagtttgtgaaaacgtagagttctgtcacattggtttagcaattaacaaacgttttgtgcaagcagacacgactaagccaagtggttgggctgaaaatagtgatagcggtaataaactttggttagtatttaaaggcgtacaaggcactttaaatattcaaaaaatgggtttagatggtgctgatttaaagtatcttgataaaagtaatactgaaattataaaaccggctattcaacttagttttagtgcagcacagccaattttaattcgtaattttggttttaatgctctgtcaattgagcaagataactttacgagctcaacaacaacgcaaggctcgagtgcaaatatgtatgattatgcatatttcaaaaaaccaacctatgcagcgactgctaatagtgcgaaccagcaagtagctactgcgaccccatcggcgtatgactatggtcgtgaaacaggttttatgggcttaatgatgaatggcaacttagcaattcaaggaaaagtcatggtctttagctgtgatggtagccatccacgttgttaa

SEQ ID NO: 566 - DNA, 882 bp, Acinetobacter baumannii
atattgatcaaaaaatatgggcaggcaaatatgagcaatcaaagtataatatctgatgggagagaaatagatacatattttgttacacccaatgatattataaataccttacctacagataaaaattattgtttatttctggatattgatggaacattagctccatttcaaattcatcctgaacatagttttattccaaatactaccttagaagttataaaaaaaattattgaattaaatataccggtgattgctgtaacaggacgtgatgttgaaacagcaagtaagctacttcagtctattgaattacctatagcgggcttacatggtttagatatttattttgattctgatacttatattcgcccagatttaagcgatattaattttcaaaaattaaaagaagatattataaattcttgtgaaaaatatcccgatttattaattgaggataaaggacattctattgctttacattatcgaaaaaacccggaattagaaaataatgcaatttatattatgcaacagattaaatatttttatcctcaattaaaattaaatagaggaaaatttgtcgttgaattattacctaagcaggcagataaaggcaaagcaatacaaacaatattaaatcaccttaatttaccgttaacccatcccatatttataggagatgatttaacggatgaaacaggtttcacttttattaatcaacagtttggcacttcaattaaagtaggttctggtgaaacagaggctcaatatagattaaaagatattaatagtgtttctaattttctttttttcttcctagaaaaaataaaaaagttatacgtcaaaaatagtcaagatcagaatggagaacaaatatgtctaaattaa

SEQ ID NO: 567 - DNA, 924 bp, Acinetobacter baumannii
aaaagctacaatgtgatcaatcattatttttctcaatttctaatgtttgatcacattgcccaacctatctcctatcagcacattcaactatccttccctgttcatctcgacattaaacgtttagatttagttcatcctcaaatttcgggtaataagtttttcaaattaaaatacaatttgcttgctgcaaaagaacaaggtttatcaagcattttgacttttggtggggcttactcaaatcatattgctgcaacagcttatgcagctcatctttttggtttaaaaagtataggaattattcgtggtgaagagttagctagtaaaccacttaatcccaccttggcaaaagctcaaagtttaggaatgcagctacattttatctctcgccatgaatatcgcttacgagatgatgcaaattaccttcaacaattacagcaacaatttccgcagacctatatcattcccgaaggtggtaccaatgaactggcagttcaaggttgtcaggaaatcctcagccaatatgatttagagcaatatgatgtgatttgctgtgcagtcggaactggcggaacgatttcaggtctgattgaaagaagtgcagcacatcagaaagtcttaggattttcggctttaaaaggtgatttcttgcaacaagcgattaggcaatggactaaaaaacaaaattggtctttgacagatgtatactgctggggcggttatgcgaaaacctcacctgaactattcgcatttattgaaaattttgaagagcaatatacggtcccccttgaaccgatctataccggaaaaatgatgtttggtctgtttgatcttataaaaaacaattattttccagcgaatacacgcattttggcaattcattccggtggtttacaagccgatattagaaataaacctcacacataa

SEQ ID NO: 568 - DNA, 1689 bp, Acinetobacter baumannii
ggacataacaatatgaatgaattttttaatgggcctcgcggcgctcagtttgatgcgatgtattactgggatcagtttcatcctattttagctgcaattgtcatcttactggtaggctggatcatcgctttattggtggcggcaggtgtaaaaaaacttctgcaaaaagtaaataccaatgcgaaattatcttcagcgactggacgtacacccaatatagaaggtctgatctccaaagtcgtattctggtttattctgattctcgccgttgttgctgctttaaatgtgctcaacattagtggagtgagcggtccatttagcaacatggttaatcaggtactcgtctatataccaaatatcattgctgctgtagtggtgggctttattggctggatcgttgctcgattggtgcgggcgggggtgaccaatgttttatcccgaactcaacttgatgataagttaagcagcgaagtgggtgtagggggaattagccagaatattggtgaaattctttactggcttgtattgttacttttccttccgattgttctttcaatcttaggattaacaggcttactgattccagttcaaaatatggtaaatgatgctgtagcattcttaccaaatatctttattgctggcgttatcgtttttgttggttatatcttggcaaaaattgtacgcggtattgttgaaggattaattaatagcttaggtgtgcaatctcaagcggaaaaaattggtcttttcaaaaattcaaatgtaggcaaatttttaggttcatttgtttttgccatcattattattacgacattgattgtagcatttgaagctttaggtattgagactatttctcagccagcaacagcaatgctcaatgaaattttacaagctattccaaacattattgctgctggtttaattttactggttgcttatattgtttcacgttttgttggtcgcttggttgccgagttaattgcaggaactggtgttgatgaaattcctgcaaaattagatgtacaacgctttttaggtcaaactaaagtttctaatgccgttggttggctaatcgtgttctttaccatgttgtttgcagtttctgaagctgctgaccgtcttggtttcgatcagattagtggtctaatcgcaatgtttatccatttcggtgcaaacattctattgggcgctgtaatcttggtgattggtttctggcttgcaaatgttgtggcgaacgttgttcaacgcggtgaatataatagttcgcgttggttaggtagtttggttcgtgtcttgattattggtttagtccttgcacttggtttaagggcgatgggtattgccgattcgatcgtaaaccttgcgttcggcttaacgctaggcgcagttgcagttgctttcgctcttgcatttggtttgggtggtcgtcaaccagcagaaagacttttatctgatttactggataaagctaagaaagaggcaaatcaaccaaatcctttatatcaaccgcctactaataataagacaacaggtagttcgtctacggtttcaactccgtcaacgactacaactgcaccatcaacaacagtttcatctgatgcaaaaccagctgattctgcacaagtaaatccatcacaaccaccagtaaataaaccgtttggttctactggcgaaaatgatgaaatttag

SEQ ID NO: 569 - DNA, 900 bp, Acinetobacter baumannii
ggctttttaaacatgcggatgacattacgccagttggctgtttttgtagcagtcgcccaagaaggaaccgttactaaagccagtgatgcggtcagactgacgcaaagtgcagcaagtatggctttagccgatttagaagacggcttaggtgctcctttatttgatcgtttaggtaagcgcttgcagctaaatgatcttggacgttttctgcttcctcaagcattagaaattttaggccgctgtgaagcctttgaacaagcagccaagggtgagttacagagtattgaccttcgtatcggggctactttaaccatcagtgattatctcatgccagatttaatggctaacttcttacaacgtcatccacaagcgcatttacaacttcaagttggtaacacacgccaaatgattgaagctgtaaatcagtttcagcttgatttagctttaattgaagggtcttgtcacttacctcaactccaatgtattcactggcgtgacgatgagctagcagtgtgctgctcacctgaccatccgttaacacgtttaaatcgcccacttacccctcaagattttcatgacgtagaatggatattacgtgaagaaggttcaggtactcgtgaagtctttgataatgcaattttgcaagatttaccagatgcaaacatacgtttgacgcttggacataatgaagcgatcttaaagatagtggctggcggtttaggaatgtcgtgtatttcaaagttagcgattgaacctttaagtgaaaaaggtcaacttgttattttagatactccattttggcaacttacccgccctctttatatgctagtgcaccgccaaaaatatcaaggtccgggccttaaagcatttttaaaattttgcgatgaagatcaggcttaa

SEQ ID NO: 570 - DNA, 675 bp, Acinetobacter baumannii
atggctataaaacatattttgattgatttagatggaaccttaacagaccctaaagttggtatccatacatcaattcgttatgcaatggataagttaggttatccattagctgccgatttaaatattgattggacgattggcccacctttaaaagcgtcattagcaaaattattagctactcaagatgatgcactagctgagcaagctttacttgcttaccgtgagcgtttctcggtgattggtttatttgaaaatgaagtatatccatctgttgcggaaacacttaaggccttaaaagcagaagggtatcgtttgttcgttgctactgctaaaccaacgatttatgcaaaacgaattttagatcattttgatttaagccaatattttgtacaaatttacggtagtgaattaacgggtgagcggaccaataaagctgagcttatccattatattcttgaacgtgagcaattaaacccagaagaatgcctgatggtgggtgatcgtcaatatgatgttttaggcgcccgccataatggtattgaagcggtagcggtgacttatggttatgggacaccagaagaacttactcaagcacaacctaaagcaaagattacaaaattttctgaacttttagattatgttgaagaacaggccgcacaaaagaaagtttcttaa

SEQ ID NO: 571 - DNA, 195 bp, Acinetobacter baumannii
tttagtataaaatttagccactttaattataacgttttagaatttaacttctcgatattcagaatcttcgctaaagtccgatttgtaatacaatatgttttagcccttactttttataaaataggctataataagcccccttgttttaaagctactcaattttatgatgtatcgtcagcaaagcgtaactcttga

SEQ ID NO: 572 - DNA, 246 bp, Acinetobacter baumannii
atgtgggtaaaggttgagtcattgaagtatatggatgccaaatatgttccaaatcaaaattatcggtcatcctctatacccttttacagcaatcaaatctttcatttagcacatgttaaacctgttaagaatgaaagaaaattgcgagatcaatcaaagcttatgaactttgctgatgaattgttaaaaattggcagatttcttcaattgtcctctctacctgtaagtagggaaaagcatgagtag

SEQ ID NO: 573 - DNA, 1248 bp, Acinetobacter baumannii
agaagatcaaatcaagcagaggatgcgatgaatcacatggtgacaacaaaaaaagcaaaagttcaatttaactggcaagacccatttttaattgagcaacagcttagcccagatgagcgcatgattcgtgatacggctcatgcttattgtcaagaacgtttgcaaccccgtgtacttgaacaattccgtcatgaaacaacagatccatctattttccgtgaaatgggagagcttggcttacttggcccaaccattcctgagcaatatggcggcgcgggtttgaactatgtgagttatggtttggttgcgcgtgaaattgaatatgtcgactcgggctaccgctctatggcgagcgtgcaaagctcattagtcatggttccgattcatgaatttggtactgaagagcaaaagcagaagtacttacctaaactggctactggtgaatacattggttgttttggtttgaccgaacctgaccatggttcagatccgggcagtatgattacccgtgctaaaaaagttgaaggtggttaccgtttaagtggcgccaaaatgtggattaccaacagtccaattgcagatgtatttgtggtttgggcaaaagaagtttctgctgaaggcaatgtcggtgatattcgcggcttcattttagaaaagggctgggaaggcctatctgcgccagctattcatggcaaggtcggtttacgtgcctcgattacgggtgaaatcgtgatggataacgtttttgtacctgaagaaaatgcattccctgaaattcgaggcttaaaaggcccatttacctgtttgaacagtgctcgttatggcattgcatggggggcgatgggggctgccgagttctgttggcatacagcacatcaatacaccatggaccgtaaacaatttggtcgcccgctggctgcaaatcagctgattcaaaagaaactggcagatatgcaaactgaaattgctttgggtttacaggcagctttacgttttggccgtatgaaagatgaaggtattgcatcggttgaaggtacatccttaattaagcgtaacaactgtggaaaggcgcttgatattgcccgcatggcacgtgacatgatgggtggaaacggcattagtgacgagtttggcgtagcacgtcatttggtcaatcttgaagtcgtgaatacctatgaaggcacacatgacgttcatgccttgattttaggtcgtgcacaaacaggcattgccgcatttagtaactaa

SEQ ID NO: 574 - DNA, 1128 bp, Acinetobacter baumannii
tggagtaaaaacatgagtgcagttgaaaaattacctgaagatttttgcgcaaacccagatgttgcatggactttccctaaagttttctatacttcatctcaagtttttgagcacgagaaagaggtaatctttgctaaaagttggatttgcgttgcacatggtagtgagttggctcagccaaatgactatattacccgtaaagtaattggtgaaaatattgtcatcattcgtggtaaagatagcgttttacgagctttttataatgtatgtccgcaccgtggtcatgaacttttaagcggtagtggtaaagcaaaaaatgtaattacctgcccatatcatgcatggacatttaagttagatggaagcttggcattggcacgtaactgtgaccacgttgaatctttcgataaagaaaactcaagcatggtgcctttaaaagttgaggaatatgcgggatttgttttcattaatatggatgaaaatgcgacttgcgtagaagaccagctcccgggctttgctgaacgtttaaatcaagcatgtggtgtgattaaagatttaaaattggcagcacgctttgtgacagaaacaccagcaaactggaaagtgattgttgataactacatggaatgctaccactgtggacctgcacatccaggctttgctgactctgtacaagtcgataaatactggcatacaacacatcaaaactggacattgcaatatggctttgcacgttcatctgagaagtcattcaaacttgatccatcagtaacagatcctgagtttcatggtttctggacttggccttgcaccatgttcaacgtaccaccaggcagcaacttcatgacagttatttatgaattccctgttgatgcagaaacaactttgcagcattacgatatttacttcactaacgaagaactgactcaagatcaaaaagatttgattgagtggtatcgcaatgtattccgcccggaagatttgaacttggtagagagcgtacaacgtggtttgaaatcacgtggttatcgtggtcaaggccgtatcatgaccgacaagcaacgttctggtatcagtgagcatggtattgcttacttccaacatcttgtggcgcagtaccatcaataa

SEQ ID NO: 575 - DNA, 195 bp, Acinetobacter baumannii
tttaaaaaaaagcattatcaagaaaaaaaatactctttatttagtttggattttttttacactttagtcgttaagcaatttattaaaagtcacaattcctttagaatgcttctcactatctgctgttcttctgctacagctcttattgacttgaaaaacaggtctcatgcttttgaaaattcgcgtggcttataa

SEQ ID NO: 576 - DNA, 243 bp, Acinetobacter baumannii
aagaggggaaagaagatgcatgatttttcaaaaccgcctcatgtgacgagtccggaagagactgcaaaaaaaagaagattgccagtttatattttaattattgttgggctttttcttctcgcacttgtggtttatatggttgctgatcacagcaaaacgccaaaagaggaagccgcttttcaacatgagaccataccacaagtcattagtggtacttctgatttgaagacctatgaagggtaa

SEQ ID NO: 577 - DNA, 1794 bp, Acinetobacter baumannii
aacaggtgtttcatgcagataagagattattatccttttaggaatactttatttattcagcatctccatattttcagttatgtatttatggcgctcagtattttgtacttaattgctgctaattggttgatgcttccagatagcattcaactcattattccacctgttatattacttatgacagcttgggtgagtatcaaaaagactttaagtgagggagtaaggcaaactttacatggcatctgcggcttaatggtcggtttgagtttggctgtaattgggcaagtttatcaaaccggtgcagacagttatttacttttcttgatttggactttgcttttattgccgtggctatatcgaccaaatattggaatctttgctttaatttgtatcacaagccaacttacactttttttattttttagacagactttttgggcagagaagtttccctatctttatctttttgctctaaatctattaagtcttgtgcagttttggatctgtcaaaagaaatatacggctttacgttttatttttattgcttggtttgctgttatttcaataacaggaatgattcaattcctatcaagtgaaaatttaccttatctgatctcggctttttttctaggaatcatcgctttttattatttttttaataaagatgatcagttgtgtgccagtttaatggctgctgttcttggtgtgacggctactatatggcttgtggatggtattaatcaactatttaaagattctaatgagttcatctttttattgatcgcggggattatttttacttggtttgcactcatcagttatttcttaatcaagattttccgtcaaagccgtttttatatcattcctttggcaattggtgcttggcttgctggtctagcgcttggagcatttactttggtgttttgggagactatttccttaattattggaatcatctttgttgctgtagctataactttactaacaaaatcgcaaagctatttcatccggcagtttgcatattgtttatttgtgagtggacagactgcttttttattccatcttggttctgaaacagatcaaattttatgggtattaattgcccagatctttattttatgtatcagttatttccttaagcctcattggttctttattttaattcaaatgcttgcaacttatggtatagcagtaatctatctactacaaatggatcattcattatggtccttaaactctactcagacttatttaaatttagtcttacttaactatttggtttttagctcggtactactgataggaagtaaagcggtcgtatcgtataagcggagtatcttcttatgtacgctcgttgtaatttgggtgagttcattctttgatacctttataggattagcacttgttgattcggctgatcagtcactatggttcctttatgcattgccgtgcgtatggttattatgctttagttttttctatctctatcggcaacttcacggtataactttttttgcctttttagtttttggcatattacttattgcactcggctattttgaagtattcatcttatttgttattttgacatgggctttaaaaaataaagatcgcattgtttatggggttacgctcgtagtatttgcctttgtgctttggcaactttattacagtttacaattaagttttttagctaaaagtgcctcaatcttggtgtcaggcattatattgctggctctatatgggctacttatgaaagaagctaaaattaattttattgaggggggaaagtaa

SEQ ID NO: 578 - DNA, 300 bp, Acinetobacter baumannii
aaaatcatgaagcaagagttttatacgggaagggtaaaacaatataacgccgataaaggatttggttttatttcgacgactgaaggagatattttctttcatatttctgatttccctgcatccgaaggtgaaccgaaaagaaatgaaaaagtgagatttcttgctgcagataatcgaggaaaatttaaagctattaagattgagcgtatcgatcctaatcctgcgaagactaagaaaactaaaattgctgatcacaataaagcgatcacaagtgagttattgtctaatttccgacgctaa

SEQ ID NO: 579 - DNA, 801 bp, Acinetobacter baumannii
ggcaccatgaaaaagtcccctatctttataaccatttgcctagctggtgcaggcttaggatctacatttgccaatgcagatacgctcgaagtaattagctcaggcggtttctattcatctatggaaaaactcattccaatatttgaaaagcaaactggtcacacggttcacctctcatctggttcgtctatgggtgaatcaccgactgcaattccaaatcgactcaatcgtggtgaacgttttgacattgttgtgttggctgctcctgaactaagcaaactcgcagaaaaaggttatgttgacccaaattcacaaagcgctttggtgaattcaagcattggcatggctgtgcctaaaggtgcaccaaagccagacattagctctgcggcaaaatttgaaaaagttttattaaatgccaagcacataggctattctgcaagtgcgagtggtacacatcttgaaaaagatgttttcccaagctttccacctgtcgaatacaaagtaatttcgagtaaagcagaaaaagtggtaggcgaccgcgttgcaaaacgtattgccgaaggccagtttgatattggtttccagcaaattagtgaaatcaaaccttttaccggcaaatatggtcaagttgagttagttggtccaatccctgcgccttaccaaaaggttaccgtgtttgctgctggtattggtaaaaactcggaacatgcaaaagtcgcaaaagaacttattcaatttgtgaaatcgcctcaagcaacacaaattattgaagaacagggtcttgagcaggttaaacaataa

SEQ ID NO: 580 - DNA, 960 bp, Acinetobacter baumannii
agcgacatgaaaaataaaaatatagggtgctggctgttacttgccggtagttcaagtgtttgcgcgatgcaacctttggatgatcaaagtcttgcagctgcgacgggtcaaaatggtctaactttaggtattcaggccgatcaagttaaatttaaacaagtcgccttgattgatacgaacggtattgcatctacgtcttacaacagtaaagcaggtcttgtcattgcaggaaactctactaatccggttcctggcatagagtttattaaagctgctgtatctacaaatccttcttttaatattgcaatcgataccgatgctggtggtggaaatccttttttaaatttagctgtcacgatggggagtgacgtaaatggtattcggcttttaccattttcagtttatttagctccaagtacatctttatctagcccatccgattatgcattaacaagttatgcaccaaaatcaatttttagttcgggcacaacggtgaataccggggtaaaagagctgattcgttctactggtaatcttgatattaactttgtacaaaccaataagcctcgtttaaatattcaattgggacatgctgcccagtcggttatggttaaatttggaggagctattcaatcgatttgttctgctgcatctggttgcccgattactttagtttccgataacacgggtgctacatttgggtttaaatttgcaggtacgaatgcgtcaaccggttttgttcttgatggattttatgctggggttgacccgacaggacttacctttggaaatataggtgtatctagtaaatttgatgcatcacttaacaatgtgactttaggaaatttaggtacacaaagtacaacaacctttaataatttacccaatgggtctatggggagttttggagttacgggtgcttcggtgaccgactttaaaatgaaagtaagtggcttttaa

SEQ ID NO: 581 - DNA, 684 bp, Acinetobacter baumannii
gtcgggatgaaatatactctgacccgcgcgaatccggatgctgatcaatatccattgcaagatcgtcaaattgtgacagatccacttgaagaggaagtgaataaaaacgtattcatgactcgtttagaggatgtcttgcatacagcagtaaactggggacgtaaaaactctttgtggccatttaactttggtacatcatgttgttacgttgaatatgcaacgaccttaacaggcgtgcatgacttgtcccgtttcggtgcagaggttattcgtgcttcacctcgtcaggctgacttgatgattgttgcaggtacctgctttgtaaaaatggctccggttatccaacgtttgtatgaacaaatgttagaacctaaatgggttatttcaatgggtgcttgtgcaaactctggaggtatgtacgacatctattcagtagtacaaggtgtagacaaaattattcctgttgacgtgtacgtcccaggttgtccgcctcgtcctgaagcattaatccaagcattaatgcttttacaagaccagattcaattagagcgacgcccgctttctgccgtgattggtgatgatcttcagccagtgtataagccaaagatgatgccagaacgtgatcgtaagaatgcgcagcgtattgccgttaaaaacttacgctctatggatgagattaaataa

SEQ ID NO: 582 - DNA, 480 bp, Acinetobacter baumannii
attatggcgaaagcaacagtagtaaagaaacataatggcggaaccattgcacaaaacaaacgtgcccgtcatgattattttatcgaagaaaaatttgaagctggcatgtctttactaggctgggaagtaaaatctttacgtgccggtcgtatgagtttgacagaaagttatgtcatttttaaaaatggtgaagcattcttatttggtgctcagattcaaccactcctttctgcatctacacatattgtgccggaagctacacgtacacgaaaattattattatctcgtcgtgaacttgaaaagcttatgggtgcggtcaaccaaaaaggttattcgtgcgttccattagcatgttactggaaaggtcatctggttaagcttgaaattgcactcgtgaaaggtaaacaacttcacgataaacgagcgactgaaaaagaacgtgactggcaacgtgataaagcacgtatatttcataagtaa

SEQ ID NO: 583 - DNA, 435 bp, Acinetobacter baumannii
agaatagagaatagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagtacagagaacagacaacagagaacagtgtcttaa

SEQ ID NO: 584 - DNA, 447 bp, Acinetobacter baumannii
agaatagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagtacagagaacagacaacagagaacagtgtcttaacggctggatagagcattcg

SEQ ID NO: 585 - DNA, 432 bp, Acinetobacter baumannii
agaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagaacagagtacagagaacagacaacagagaacagtgtcttaacggctggatag

SEQ ID NO: 586 - DNA, 1422 bp, Acinetobacter baumannii
gaaagggagaaatccatgcatgatgtaattgtgattggtggtgggaatgccgcactgtgtgccgcgctcacagcaaaagaaagtggtgcttctgtgttggtaatagaggcagcgcccaaagagtggcgtggtggtaactcacaacacactcgtaaccttcgctgcatgcatgatgctcctcaagacgtattggtcgatgcttacccagaagaagaatattggcaagacctacttaaagtgactgcgggcaaaaccaatgaacatttagctcgtctcgtcattcgtagcacggcgacctgccgtgactggatgcgtaaacatggggtgaattttcagcctccgttatcgggtgctttgcatgttgcacgcaccaatgccttttttatgggtggaggtaaagctctcattaatgcgtattaccgaagtgctcaagagcttggcattgagattttatacaacacaaaaattaaagatctaaagttaaaccaaggatattttgaagctgcaattgcggaagatggccgtgtgtttaaggcgaaaagctgtgtattggccgcaggtggttttgaatcaaatctcgaatggttaagagaagcatggggacaaaatgaaaacggcgaatggcctgccgataatttcattatccgtggaacccgctttaatcagggcaacttactcaaatttatgatagatcaaggcgccgatattattggtgacccatcacaatcgcactgtgtcgccgtagatgcacgcgcacccttatatgacggtggtatttgtactcgtattgactgcgtttctttgggaattgtggtcaataacaaagctgaacgtttttatgatgaaggcgaagacttctggccaaaacgttatgcgatttggggccgccttgttgctaaacaatcccagcaaattgcttattcgattattgattcaaaagccattggtcgttttatgccacctgtatttgctggcgtaaaagcaaatagcattcaagagttagccgaaaaaatcgggctagatgcaaaaaccttatgccacaccgtagaagaatttaatcaagcctgcgtacaaggcacctttaaccacacggttttagatgactgcaccacccaaaatattgttcccaacaaaacccattgggctgttcctctcgatcaaccacccttctatgcctatgcccttaaacccggcattacctttacctatttaggtttaaaagttgaagacgatgctgctgtgcgttttaacaataagccaagccacaacctatttgtcgcaggtgaaatgatggcaggtaatgtacttggtcagggttataccgcaggcgttggtatgtcgatcggaacgacgtttggtcgaattgccggaaaaaatgccgcccactatgcactttcacaaggagttgaacatgaatgctag

SEQ ID NO: 587 - DNA, 3258 bp, Acinetobacter baumannii
tttgtggggaaagacatgacatataaagcaagttttacagggtgggaaaatcttaaaattgaagatttattggtggcttatagaaaggcaaaagctgattgtttttttgagaatactttccccacagcagtaaaatttgccgaatatgagcaaaatttattgactaatcttaaaagttttttaaaaaaattacggaatgaaaatgggtttattgagaatagtaagttattaggaaattatcgagtagttcctaaaaagttatcgatagatagaaaaaatatagaaggctatgcaggacatatacatttttctgatcccaaaaaaaatttaaataaactttttagtgaaaatgtagtagaaccttcatttcgccttattggagacttcccagtagagactcatcttatatctgccttatggataaatatgattggagagcaatttgatgaaagactaggtgaatcttgttacgcggcaagactaaaacgtattaaaaataatgaagattttactttagatactagaaagccttttcatcttagcgcaatagggtctttttcaccatattttcaaccatatcaaaagtggcgaaatgatgggttaaacgcaattcgtgatgagttggaaaaagatagaagtgttatagctgtctctttagatttaaagagttattatcactatattgatcctaaaattattgtttcaaataaattacatgaatcttttaatattatacttaatcatcatgaacttttatttactaagcaattagctatttttttagaaaaatgggggaatggtgcagttgaatactctaaaaatatttcatttgaatgtgaaataccgggtggtttggcgataggattaactgccagtagaattatttctaatatgattttacaccgttgggataaattaattaaagaaaaagttactcctattcattatggtcgttatgtggatgatatgtttttagtattaaaagatactggaaatatagaaaatagtgatcaattaatggagtttttacgagagagaattggtggtgatgttctgacccaagataataatgattctaaaaaatggtatattaatttacctaattccttagaagataaaacttcaattcaattacaagctgacaaacaaaagctatttcttttagatggtcaattagggctagatttattagatagtattgaaaaagatatttatgagctttcaagcgaacatcgtttaatgccatctcctgatcagttagatcagtctacagctgctaaagtgctttctgctgctggaagtgtgggcgaaaatgcagatacattacgtcgtgctgatggattaactataagaagattaagttgggctttacaattaagacatgttgagacacttgcaagagatttacctcccaaagtgtggcaaaaacaaagaaatgagttttatcaatttgctcataatcatattctaagaccggatagtatttttgagcattttacttatttaccgcgattacttggttttgctatcagtttaaatgaatggcatcaagcagaattaattgtattaagatcttataactcattagatattcttaaagctgaaattttcaatcaagatagatcaggtccgtatggcgaaattaatggagctaaatgtattcttcatgaagaaatttggcaagaaatcaaatattcactgacagtcctttttatagatgctgccactaaatattacgatccaaatgctctttttggagaggaagaaccaaagcaaaaaagtttggaagagattttcttccgtggtttatttggtagtatcgattcaattagtgactttttaaatactgatttaagtattactaattttaaagaaaaagctttattagtggtaaaatctgacttaggtaaaaatccttataagcaaattttaaaattagatatatgtgataagttaattgatataaatcatagagtggcaaatgaagaactttttgatgaatttcaaaaatctgatttagttttttctcagtttttaagagattttctgaaatcatcatttaaggaaaggtttaagaaaataaaggatgaggataaatataattttgagctttttttaccatatttatttcctactagaccttattcacctgcagagatttctgaactggcaccagaatgcgtgggcctgcccaaaaataataaaaaattttgtaaaataaaaccaactaagatatgggcaagatattgccaagcagtgcgtggaatatggataaaacctacattattggcaactgaaaatgataatagtgataaagtaaattgttctagatctttgcggataggtactgatagtaaaaatcaggtaatagttgcgttaacaaatttaaaaacatctgagcaagattgggcttattcagcggttaataaacctaacttaagtttagagcgatatcaaagaattgctgatttagtaaatgatattttacgattaaaacctaggccagattatgtatttttccccgagttatctattcctttagagtgggttgatagtattgcatctaggctttgtaatgctggaataagtattattgctggaacagaatatagacatactgcaaatgataagctaattagcgaagctttattaatattatctgataaccggctagggtattatacattttctaaaatttggcaacctaaacttgaacctgcagtgggcgaagataaagagttgataagtgtatatggtaaatcttgggattttactagaacaaaatacaagaataaaaaaggtcaattaaaagttttaaaaaaaccaatatatatacataataattttcattttggagttatggtttgttctgaattgcaaaatagcaaatcaagaataagtttccaaggaaaagttgatgctctttcagtacttagttggaaccaagatttagaaacattctctacattaatagaatctgcagctcttgatgttcatgcttacacaattcttgttaacaatagaaaatatggagatagtcgaattcgagtacctgctaaacaatctttcaatcgtgatttagcacgagtcagaggtggagaaaatgattttgttgtagcagctattcttgatattaatgaattaagagcttttcagagtcgagcaaaaagatggactcaagatggtgataaatttaagcctctaccagaaggttttgtgatatctaaaactcgtaaattatcaccaccaaataagtag

SEQ ID NO: 588 - DNA, 1338 bp, Acinetobacter baumannii
catcttcgtttagagatgtcgaacatagatatatacaacgaagagagaacaacaatgtctatccttagttgggacgattttgaagatgattcgcaaaaaccggctgcacctgaacacaagtctgcgcccgtcaacccggaaaaaacgcctgattcgcagaatgtatctgctgcgcagccatcatcgcagagcgtggcagctccacaatccactggaacccattccgtgcgatcaacaaatccaaccgattcaatggctcgagcatctgaagccttagaacatttggatgttgctcctggccttgaagagttagaaatgggcgcgcaacgcgttcaggttgacgacaaagccatgattaactgtcgcgctgacttgaaccagcttgttccatttaaatatgagtgggcttggcaaaaatatctagatggttgtgcaaaccactggatgcctcaagaagtgaacatgaaccacgatatcgcactttggaagtctgaaaatggcttaactgaagatgaacgtacgatcgttatgcgttctttaggtttcttctcgactgcggactctttggttgcgaacaacctagtattggcaatttaccgtcacatcacgaaccctgaatgccgtcagtacattttgcgtcaagcgtttgaagaagcaattcacactcacgcttaccaatactgtatcgaatctttaggtatggacgaaggcgaagtcttcaacatgtaccgcgagattccatcggttgcacgtaaagcagcttggggcttgaaatacactcaatcgttaagtgaccctactttccacacaggtacgcctgaaaacgaccaacgtttacttcgtaacttgatcgcgttctactgtgttcttgaaggaatcttcttctactgtggctttactcaaattttgagtatgggtcgccgtaacaagatgaatggtgttgctgagcagttccaatacatcttgcgtgatgagtctatgcacttgaactttggtatcgacatgattaaccaaatcaagattgagaaccctcacctttggactgccgagttccaacaagaagtaattcaaatgattcttgaaggtacgatgcttgaaatcgaatatgcacgtgacacaatgccacgtggtgtattgggtatgaatgcaagcatgatggaagaatatttgaaattcatctgtaaccgtcgtttatctcagttaggtttaccagagcaatttgctggtgtaactaacccatttgcgtggatgtcggagatgatggacttacgtaaagagaagaacttctttgaaactcgcgtaactgactaccaaactggtggtgcgttaagctggtaa

SEQ ID NO: 589 - DNA, 666 bp, Acinetobacter baumannii
gcaatgcacctgttgcagccgcaacctgaagttaacacttcattactcgtttgcacccattcaacccaccagaaccctcttttacctgacgtggtgcaactctcaccatggccaagctcaaaattagagtctgagcaagttgattggcttattttacactttaatcactggttttcccaccataatgtgacattagttcgtggagaatttgaaccagaatatttcccagcgaatgagcatgagccagcgaaaattcaatttgctcatggttttttcaatagtgctcttcacgaaattagccattggacgattgcaggtgcaaaacgtcgtctattacccgatttaggttattggtatgcgccagatggcagaactaaagaacagcaagatttatttgaacaagtagaaatcaaacctcaagccattgaatggttatttgcacagtcttttggcagaaaattcagagtctcgctagataaccttacgggcgatggtggagatggcagaaagtttaaagataatgtttatgcccaagttcaacgttacttttctggtgaagcaaagctgcctgccgatgcagcaagattcattgaatgtatttgccaatgtacgcgagcaggtgcagcattacaattaaatgaatttaaacgtgaactccttgattaa

SEQ ID NO: 590 - DNA, 822 bp, Acinetobacter baumannii
aaaaggtttgacatgattagcctccccttggtttacacaattttggcactcatcgcatataccacttctttctggtatctgttcatacgtttaatgtcaaaacgtgaaccaaacccatggttatttgcttttgttacgaccttagcactgctgttacatggcacagttttatgtcatgccatgctgaccccatcaggaattaactacgatgtttttaatctggtgtcttttacatcaggacttatgttgttgttaagcttagtttttagtactttccgtccgattgtaccgttaaacttgctcggtattcctgtagcggcgattggtcttattttaggttttgcatttagccgtcccgatcagtttattgaacagcattcattaggtttagatactcatattattctttcactttctgcttatgctgttttactgatggcaaccatacatgcgatcttgatatggttccaaaaccgtgaactcaaaaagaaacaaaaaaaacgtatttgggtcaatttacttccatccattcaggccatggagtctttattatttgacctcatcattactggttttattttattaaccattgctctcgcgtttggtttcttaacagttgatagcttctttgcccagcatctcgctcataaaaccgtatttagtattatttcatggtttatttatggctctttattgattggccactataaacttggctggcgcggacaaaaagcgattcgttttaccttaattggttttgcattattagcgatcggttttattggcagtaaatttgtgcttgagatgatattgggtcgataa

SEQ ID NO: 591 - DNA, 840 bp, Acinetobacter baumannii
atccatgttgaatatgagcagagtggtaaaacatttatggagttaatcatatatttactcattggcgcaattgctggttttactgccggactgtttggagttggtggtggactaattattgtaccaatcctctatgtcgtttttacccagttgcactatgatcccgcggtaatcatgcatattgcagtcggaacctccctagcaaccattattgtgacttcctttagttcagtttcggctcatcataaaaaaggtgcagtcctctggcctgtttttcgtaatttagcaccgggactagtgattggttcctttttaggtgcaggtattgccgaccttttgtctggacagcatttacagcttcttattggtgtctttgctgttgtgatggcttatcggatgttcaaaggagcccatgttgtggttgacccaacacgtcagcttccttcaacccctatgcaatttatggcaggtggtggcattggtattgcctctgcaatttttggtattggtggtgggagcttaaccgttccatatttaaaccgtcatggcgtagtcatgcaaaaagcagttgcgacctctgctgcttgtggtttacctattgctattgcaggtgcaattggttttatgtggtttggtgctaaagagcacatttctgtacctaatacgattggatatatccatatctacgcttttattggtattagtgtcatgagttttgtcactgctaaacttggggctaaggttgcccacgcattgtcaccacaaatgctaaaaaaatgctttgcttgcttgttaatcgtggtcggcagttactttatttataaaggttttatgaattaa

SEQ ID NO: 592 - DNA, 564 bp, Acinetobacter baumannii
taccttcctgatggagttgggtggtatagcaaacacacaggaaaaggtacggttcaatttaggaataatgtcatggttcaagcaacagactttagaaatgcaatgtctttactcacaagtgcggttagtgttgtgaccacggcaggcatgtctggccgttttggatttactgcctctgctgtttgtagtgtgactgacacaccgccgacattattggtctgtatgaaccaggctgcgagttcacatgcacatttcctagataacaaaatcttaaccgtgaatgtgttaggcgcgcaccacgaacatatttcaaaagcattttcatctaagctcccaccagaagaacgctttaaacatggcgaatggattgagttagaaacaggtgcgcctgtgttggaagatgctttggtgagcttcgattgcgagattgagcaaattcaacaagtcggcacacacacgatttttatatgtccgattgtggcgattaaacaaagccaacatgaccaaagtttggtttactttaaccgtgcttatcaccaagtggggcagacagagacggtctaa

SEQ ID NO: 593 - DNA, 768 bp, Acinetobacter baumannii
agcattggtgagtttcctgtgagtttgaataaaaatttggttgcccaacgttttgctaaagcagggcaaagctattcaaagcatgcaattgtccaaaaacaaatttgccaaaacttaacgaacttactaaagcaattttgtccaagcacgatgtcacgtgtctttgaaattggttgtggttctggcaatttaactcgtctgcttgttgaatcttttcaaattgaagatttagttttaaatgatttgtatgcagaggtgcaacagcactttaatcatgaagaacatgtgaaatggttaattggagacgttgaaaccttagaattccctcagcagctcgatatgattgtttccggttcagctttgcaatggatgcaagatttaccacggctacttcaacattgctatgctgctttaaatgagcaaggctggctatgcttttcaacatttggtcctaaaaacctcattgaaattaaagagctaaccggacaaggtttaaattattggaatcttgaaaattggaacagtgccttaactcaggctggttttgagattttgcatttggcacagtcagaaactcagctttatttcgatttgcctaaagccgtgttgcagcatttaaaagcaacaggtgtaacagcaactgctcagcatcgttggactaagcaaactttacagcagttttatcaagattatgaccggtttaagcacgccgaggggtactccctaacatatcacccgatttattgtattgcccggagaatgaagtaa

SEQ ID NO: 594 - DNA, 1284 bp, Acinetobacter baumannii
aggatgaccgataattttgatttggaacatatttggcatccatatacttcaatgactcaacctttacccacatttaaagtgaagcgtgcctatggggcaacgattgaactcgatgatggtagaactttaattgatggcatgtcatcttggtggtgtgcaattcatggctataaccaccctgaacttaatcaggcagtgaccgaccaactacaaaatatgtctcatatcatgtttggcggtttaactcatgatcctgctattgaacttggcaaaattcttttaaaaattacaccgccgagtctcgataaaattttttatgcagactcaggttcggttgccgttgaagttgctttgaaaatggctgtgcaattctggacagcacaaggccagccacaaaaaacaaattttattactacacgttctggttatcacggtgatacatggaatgcgatgtctgtttgtgatccagtgacaggcatgcatcagatttttggtaccagcttaccgaaccgtctttttgtagcagcaccgcaaactaaatttcatgaagagtggaaccaagaagatattgccgagctagagcaagctattcagcaaaatcatgaaaacctggctgcacttattattgagccgattgtccaaggtgcagggggcatgcgcttttatcatcctgaatatttacgtcaggctaaagcactttgtgaacaatatcatctgttattaatttttgatgaaattgccactggttttggtcgtacaggtaagctttttgcttgggaacatgctcaagtcgagccggatattatgtgcctaggtaaagggttaacaggcggttatatgactttgtctgcgaccttaacgacaaagcatgtagcagaaaccattagtcgcggtgaggctggggtatttatgcacggcccaacttttatggccaatccactcgcttgtgctgttgctttaaaaagtacgcaattattaattgagcaagattggcaggccaatgttaagcgaattgagcaacagcttagccaatatctagcacctttaaggcagcttgattatgttgccgatgtaagagtgctcggtgcaattggtgtagtggaactcacctttaatgtcgatatgaaaactttacagcaacaatttgtagagcgtggaatctggattcgtccttttggaaaattagtttatgtcatgccgccttatgtcatcactcaacaagagttaagtgacttgctcgaacagttggttgaagtagttaaaacgatgcagggggcacattaa

SEQ ID NO: 595 - DNA, 1455 bp, Acinetobacter baumannii
tcaagatcagaatggagaacaaatatgtctaaattaatcgtgttatcgaatcgaattagtatgccatcgggtaaggcttcagcaggtggccttgcagtagctgtacaagacgcattaaatgatagtaacggcatttggttaggctggaatggtcagcaaattaccgatactgaagcgcctgaattcgatcaggcatattctcatgggatcgactatattacctgccctcttacacatcagcaatatgcacagtactactgtggttttgccaataaagtattatggcctgccatgcatgatcgggatgacctgatcgaatataatgcagaagaatataatacctaccaaaaggtcaatcgtttatttgctgaaaaattacaacagattgctcagcctgatgatctgatttgggtgcatgactatcactttttcagcgtagctcgtcattgccgtgaattaggtatgcaaaataaaatcggtttctttttgcatattcctttcgcaagcttaaatatctggcgcaagatcccagttgcactacagttggtccaagatctttgccaatatgatgtgattggtttacaaactcaaaccgatcagaacacctgtatgcaaacctgtatgggcttacttgaagctcaaaaaatactaagcgacagaatcagttataagaaacgtcaaatcttgattaagtcctatcctatcggtgttcagccagagcttattcagcgccaagcacaacaggcctttcataccccatacgtatttaactttgaagatataccacgtcaaaaaacaattattggggttgaccggattgattattcaaaaggtttacttgagcgtttcaatgcatttgcaaccttccttgaaactaatcctgaatatcatggattggtacgtcaccttcaagttgcaacgccttcacgtacagatattccggcctatcaacgcttataccaacgctttaaggccaaattagaactgattaatgaagagtttgctcatgaagattggcgacctatcgattgttgcttcgacacagttcaacatgacagcttgatgcatatttatcgtcgttctgacatttgctggattagctcattacgtgatggtatgaatttggtcgcaaaagaatatattgcagctcaagatccagagaacccaggtgtgctgattttatctaaatatgccggtgcagctgaacaaatgactcaagcattgattgttgatccattagatagagcagccatgatggattctttaaaaacggctctagagatgtcaaaagctgaacgtattaatcgttatgaacagttaatagaaggtttggcagctactgacctgagcgattggcgaaataatttcttgaaggatttagaaaattctccgacattcacaaagtctaagttgtccttacaagaaaagtatcaacccacttaccatgttttataa

SEQ ID NO: 596 - DNA, 1161 bp, Acinetobacter baumannii
tatatgtcagatgatcaaaataaaccggaacaaacccctgctcaaacatctaataatgagccaacgcctgcacctgcacctgcacctgcacctgcacctgcacctgcacctgcacctgcaagtaaactgattccgacaaaacgctcaaccctattatggatgttgggtgtgcttattatcggtattttagtgattttgtgggcatggagaattgggccttttgccacaagtgtgcagcaaactgacaatagttatgtcaaaggtaaaactaccattttatcgtcgcaaattaatggctatgttaaagatgtattagtgaaagactttgaccatgttaaaaagggtcaagtattaatgcatattgatgccaccacttatgaccaaaaagtagcacaagcggcttcgggggtagaacaggccaaaaatactttagccaatcaaactcagtcaattgctcaaaaacaagcagatatcgtggctgcgcaggctaaagtagaacaagttagggctcaatatgagctttctttagcacagcttagacgctatcaacagttaggaaatagcggagcagcttctaaatctgagcaagataaagccgctgctgatgccgagaataatcttgcagcacttaaacaggcagaggctaatgttctagttgccaaagaagcacttaaaacagctcaagtcgcagaagctggcttagaagcacaagtttccagtgctaaagcacagttagatcaagcacaaaccaccaaagactatagtgttattgttgctccaatggatggacaacttggtgaagtaaaccctcgcgttgggcaatatgtggccgcaggatcacagttactctatctgattccacagcaaacttgggtgattgccaactttaaagaaacccaaattgccaacatgcgaattggacaaaaagcgtggtttacagtcgatgcaatgaaacataaaaaatttacaggtcatgttgaacaaatctctccagccgcgggttccgagttcagtgtactaaaaccggataatgcgacaggaaactttaccaaagtcgttcaacgaattgccgtgcgtattaccattgacccaaatcaggaaggaatagaacacttacgccctggtatgtcagtgattacttctgtcgacacaagctcttaa

SEQ ID NO: 597 - DNA, 1017 bp, Acinetobacter baumannii
tcaacaacagaactatcactccaatggacacggatcgtgaataatctacctaacctatcggatttaaaggttttttgcacagtcgccaaactaaaaagttttgtcgaatctgctgaggaactcgggacatcgccagcttttattagcaagcgaattaatattttagaaaacacgttgagctgcaaactttttcaccgcagtacacgtcacgttagcctgacagaagatggcaaactcatacttgagagagtttcaaatattcttgaagaatttgatgaagtctgcgaactggtcaataacccgctcagtacgcctacgggtcgtatggatattattagtagctttggttttggcagaaaacatgtcgcaccaattttgtctaaattaatgatgttgtatccaaaactacagattcattttgataccatcgacaataccaaagacctgattcaacacagtattgatttagacattagaattggtaatgaaattgcacccaatatgattgcgaagaagctggcttctaattttcgtattttgtgcgcgtcaccgagttatttacttaaacacggcgtacctgacagtattgaagatttgcaaacacatgactgtttaacaattagtgaacgcgaccaatcctcggttttatggaaatttaggcatgcttccgaagatgtctcagtgcatatcaaaccccgctttgtttcaaataacggtgaaattattcatcaacttgccatagaaggtcacggtattattttccgttcgatttgggatgttgcagatgaattgattaccggccaacttcagcatattttgcctgagtactggcaagatgcagatgtctgggcagtttatccatcacgactcaaaagctcctccaaactgcaaacctgtattttgtttattcaaaacgaattgctcaatcgtttacagcatgtgcaaaacctaagccgtggacaactcatttcaccagccgtcaagcgagagccaccgcctgaaaaagtctttctataa

SEQ ID NO: 598 - DNA, 1518 bp, Acinetobacter baumannii
ccatgtggagatccaataatcatgaacttcacagtatcattttctacgcttatgcctttagcaccggtgatgattgttgctttgacagcagtcgttgtcatgctgttaatttcaattaagcgtaaccataatttaatcgcaacaacctctgttgtcggtttaaaccttgctgcactttatatcttgttagaattatttggcggtaaatttgtgccggcaaatgtgatgggcatgtttatggttgatccatttaccatgttctatcaattcatgattttagttgcatcattggcttgctgtactttgtctcatgcatatattgagacttataaagacaaccgcgaagaactctatcttctgttacttgcttctgtagcaggtgcaatgttgatggttgcaagttcacactatgcatcattcttcattagccttgagttaatgtcgattcctgtatacggcttacttgcttatacatatcaacgtagtcagtcgcttgaagcagggattaagtatcttgtgctttctgcaacagcttctgcaatgttgttgatgggtatggcgtatatctacgcttatactggttcactttcattctatgattctgtacaagctttatttggcgcaatcaaacagccaatggtgttattaggtttagcactcattatttttgctgttgcattcaaattgtcgcttgcaccgtttcataaatggacaccagatgtatatgcaggtgcaccagctccaatggcaacgttcttggcgactgctgctaaagttgcaacaattggtttgttcgtacgttatttgcttgcttctggcgcaatcatggtgaactcgctagtgactgttttgacaatcattgccgtattgtcaattttagtcggtaacttgcttgctgttcgtcaggtcaacttaaagcgtattttgggttattcatctattgctcactttggttatttgttaattgctttaatcagcatgacatatgcaagcttgggcagcgtaactgtgtatgtggtgacttatgtattaacgactattggtgcttttggtgcagtagcgttaatgtctagcccatataacaacgtagatgaagcgcaaagccttgcagactaccgtggtttgttctggcgccgtccagtacttacagcaacattaacagtcatgatgttatctttggctggtattccattaacagcaggcttcattggtaagttcttggttgttatggctgctgtaacaactcaacactggttcttagctgcaatgattattgtgggtagtggtattggtttgtattactacttacgtgtgatggttgttatgtatatgactccacctgaaactcctcgtattgatgctgatgcacattggggacaaaaagtgggtggtttaatggtattggctgctgctgcattagttattattttgggtgtttatccagatccaatgattaatttggcattaaaagcagaaattttatctccattacatttcatgctttctcagcaacaataa

SEQ ID NO: 599 - DNA, 786 bp, Acinetobacter baumannii
attgaaaaggaaataaccgtgcgtccaaccgtactttgtttctcgggtttagacccttcaggtggtgcaggtttacaagccgatattgaagcgattggacaaagtggtgcacatgcagcaattgcatgtacagccctcaccattcagaattctcaacaagtatttggctttgaagcaacctcaaaagaactattattagcccaagcaaatgctgttgtaggcgatttacccattaaatgtgttaagtctggcatgctaggcactaccgataatattgcggctctagccgaatttttacgtgctcatcctgactatcaatatgtacttgatcctgttttagttgcaaacagtggcggttcgttgggagaccaagcaactttagttaaagcatttgtggagcttattcctctagcgacactcattactccaaatacagttgaattgcgcgctttaacaggcgttaccgacttagatcaagcaacccaaaagttatttgaaatgggtgccaaggccgtattggtgaaaggtggacatgaagacacacctgactttattaaaaatagtttatatattgatggcgagcttgcagcaagtagtacatgtccgcgccttgaaggtgaatatcatggctcaggttgttcattagcgagttttattgcaggtcgtttagctctaggtgactctttaaaaattgcagttcaacatgcagaaacatggttatttggtgtgttaaaaaatgctgaaacacctgtactcaatggacaaaagattccaaaacggttttaa

SEQ ID NO: 600 - DNA, 1350 bp, Acinetobacter baumannii
ctcatttgggaaaatgaggaactaaagatgaacaatgacgttcaagtaatatcgaaagagttaaaaactacatttccaagtaaccttggaacatatgaaaagattggacctcaaacatggaaatgggcgttgttatttgcctattttgcgatggtggtcgatggcattgatattatgctgttgtcttatagcttgaccagtttaaaggcagagtttggtttaagtacctttcaagcgggtgccttaggcagtgcttctttggcgggtatgggtattggcggtattttgggtggctgggcatgtgacaagtttggtcgtgtaagaaccattgccaactcggtgactttcttttctgtagcgacttgtttgttaggctttatgcaaagcttcgagcaatttatggctttacgttttataggtgctttaggaatcggagcactctatatggcgtgtaataccttaatggctgaatatgtgccaaccacttaccgtacaacggtcttgggcacgttacagacgggccagactgtaggttatattgctgcaacgttattagctggcgcaattattccagattatggctggcgcgttttattcttcctgaccgtagtacctgctttcgttaatattttcctgcaacgatttgtgccggagccaaaatcttggcagctcaccaaaattgaaagcttacaaggcaacagacagcctaaagaaagagtgatggctgaaaagccaaaaagtagcagtatctacaaacaaatctttaataactttaagcaccgtaaaatgtttttgttgtggatgacgacagcattcttcttacagtttggttattacggcattaacaactggatgccaagttatttagaaacagaagtgcatatgaactttaaaaacttaaccagttatatggtgggttcatatacagcaatgattctaggaaaaattttagcagggtatcttgctgacaaatttaaccgccgtgctgtttttgtgtttggaacaatagccagcgcagtgttcttgccaatcattattttcttcaatactcctgacaatattttgtatttattgatcacttttggcttcttatatggcattccatatggtgtaaacgcgacctatatggctgaaagtttttcaaccgacgtgcgcggaacagccattggtggtgcttataacattggtcgtgtcggggcagcgattgcaccagccaccattggattcttggcatcgggcggtacgtttactatggcctttattgtgatgggcgctgcatattttgttgcgggtgtattgccgggcttatttattaaagatcgtcagtacgatccacaaagacaatcataa

SEQ ID NO: 601 - DNA, 561 bp, Acinetobacter baumannii
gacagcagggagtacaaaatgtataaaattctagctggagttgggtcaatcgttcggacgttattcatggtatttacccatggtttccgtaaacgtgacacaattctttatccagaagtaccagcagaggaaattgtaccacctcgctatcgtggtcgtattatcttgacacgtgacccggatggggaagagcgttgtgtggcatgtaacctttgtgcggttgcatgtccggttggctgtatttcactgcaaaaagctgaaaaagaagacggacgttggtatccggaatttttccgtatcaacttctctcgttgtatcttctgcggtatgtgtgaagaagcatgtccaactacagcgattcagctaactccagatttcgagttgggcgaatacgtacgtcaagacctcgtatatgagaaagaaaacttgctcatttcaggtccaggtaaatacccagactacaacttctaccgtgtaactggtatggcaattaacggtaaagagaaaggtcaagcacaaaaagaaagtgcaccaatcgatgtacggagtctattaccatga

SEQ ID NO: 602 - DNA, 1626 bp, Acinetobacter baumannii
atgaaaagttttaaagttgcccttgctcagttttctccgcatattggcaatattgactcaaacacccaaaagatgattgagcaagcaaatcaggcgaaaaaacaagacgctgacctgattatttttcctgagctttctgtgattggttatccagctgaagacttattgttacgtccaaatttaaataagcggatgcaaaaggcttttgctcaacttagtgaagttaaagatattgtgatggttttcggcttcgtaaaccagacagaagatggccaacgttataattcagctgctgtcatgaaagacggtcaggttttaggagtcttcaataaacataacttgccaaactatggcgtttttgatgaaaaacgttatttccaaaaaggccatcagcacttggtgtttgagtacttaggtcataagtttggtgtactcatctgtgaagatatctggtcaatcaatacagtaaaacaattaagccaattaaatgttgatactgtacttgtgcttaattcatcgccatatgaagtgggtaaaccacagcatcgtaaacagacattaagtgagcttgcaaagcagcttcatttaaatattgtttatgttaaccaagttggtggacaagatgatttaatttttgatggtacaagttttgtcagcaatcaaaatggtgaaattgctttacaagcacctagctttaaagaagatctctatattgctgaatttgaccgcgatacaaaattatataaagttgtcgagtctgctcctgcactagaaacttttgcagagatctatcaaggtctagtcatggcaacacgtgactatgtagaacgctcaggttttcctggagtaattttaggtctttctggtggtattgactctgcccttacgcttgctatcgcagttgatgcaatcggtgcagagagagttcaagctgtgatgatgccatatacctacacttctcaaattagtgtagaagatgcagcggaacaagctcgccgtatgggcgtgactttcggtattgccgaaattcattcaatcgtaaatagcttcatgcaaactttgtatccgttctttggtaattcaccagccgatgcaactgaagaaaatttacaagcgcgcgctcgtggcacattgcttatgggcttatctaacaagtttggtaatttagtcctttctacaggtaataaatctgaactttcagttggctattgcacactttacggtgacatggtgggtggctttgctgttctcaaagatgtttataaaacaatcgtgtttgaattagcaaaataccgtaatagcttaagtgaaactccggttattcctgagcgtgtaattactcgcccaccttcagcagaactgcgtccagatcaaaaagaccaagactctttaccagcgtatgatgtattggatgctatcctttatgcatacattgaggaagatttaggtcaggcagacattattgccaaaggttttgataaagaagttgttgaaaaagtcatccgtttagttgatcgtaatgaatataaacgtcgtcaaggtgcgattggcccgagaattacttctcgtgcatttagtcgcgaacgacgttatccgattgtcaacggttggacagcgaatgactga

SEQ ID NO: 603 - DNA, 1263 bp, Acinetobacter baumannii
ggcaagggtttttctatggggaatcggttggtatggatcgccaatggttttatggtgagcttcgcgtatatgttattttccaaacctgctgttttagatacagctactctcttaagtacacaacgattagcaactcgtcttagcttttttagcttgggctttgcgatatctgcatgggcaccacttattccgtatgctcagcaacgtttaaacctaaatcatgcaaattttggtttattgctgctttgtatgggaatcggctcaatgattgctatgcctgcgactggggcattagttaagcgttggggatgtcgtccattaattgctgtggcgaccatactcttgatggtattactaccaagtttaacgatctggcatagtcttgtatctatggctgtagcgttattcatttttggtacggcagcaggtagtcttggcgttgctattaatttacaagcagttgtggtggaaaagcacagcttacgtgcgctcatgtctagttttcatggtatgtgtagccttggcggtttaatcggtgccatgcttgtcactgcactattagcaattggcctttcaccactcatgagtacattgtctgtagtcatggttttattggtggtgagctttgttgccattccatctgccttaacaacatttgagcaagatgaacaaggtgcagcggaaataactgacgcgcctaaaaaatcttcacgtccgaatggtacgatccttttgattgggatgatgtgttttattgcctttttgtcagaaggtgcggcaatggactggggtggtatttatttaactagtaaataccagcttaatcctgcctttgctgggctggcttatactttcttcgcgcttagtatgacaagtggtcgttttgcagggcatatcttgttaaaacagtggggtgagaaaactattgtgacctatagtgcaattgtcgctgctcttgctatggtcactattgtgatggcacctgtttggcaagttgtcgtattgggttatgcgcttttaggtttaggctgttctaatattgtcccagtcatgttctctcgtgtcggacgccaaaatgatatgcctaaagcagcggcactgtctttagtgtcaacgattgcttatacaggttcattaagtggcccggccttaattggtttgattggccagtggactagcctaaccactgtcttatcaggagtggcggttttattaaccatgattgctatactcaatcgctttactcttgtgaaggcaaagtaa

SEQ ID NO: 604 - DNA, 978 bp, Acinetobacter baumannii
cgctgtttttgttttgctcaggtgactcagactgtgaaactcatactcgctccaatggaaggtttaactgacccgatcatgcgggatacactcacatctgttggtcacttcgactggtgtgtaaccgagtttattcgcgttacagacagtattttgccagaccatatttactatagtttttgtcctgaacttaaaaatgatggtaaaacagctgctggaacacctgtacacgtccagttcttaggcaataatccagagatgcttgcagcaaatgcggcaaaagtcgttgagctgggtgctcctgcaattgaccttaattttggttgtcctgcaaaaaccgttaatcgacatcgaggtggttcggtacttcttgatgaaccagacgtagtacatatgctgattaaagcagtccgtgatgcagtacctgcgcacatccctgtttcagcaaaaatgcgtttaggttatctagatgaaaaccacaccatggaaaacgcccatgctgttgaagatgcgggtgcaagctggttaactgtacatgctcgtactaaagcagatggttatacgccaccagcttattgggaaaaaattctgcctattaaagaagctttaaaaattaatgtgattgctaacggcgaaatctggaccaatgctgatgctagagcttgccagcaacaatctggctgtgaagatttaatgattggccgtggtgcagtgactactccagatttaacacaatgtattcgccaaaatatggatgaagcactgtttacttgggaacaactggttgacttacaaatacgttttttaaatggtcaagcaaaaacagaaattgggatggttggccgttataagcagtggttaggtatgatgacaaaagcctatcctcaagcgaaagaattatgggaccaagtgaaacgcattaaagctttagatgaaattgttcagcagttagagcaaaccggttcttctcgtatttaa

SEQ ID NO: 605 - DNA, 390 bp, Acinetobacter baumannii
cgggagaattgccatatggcaacaacgaatcagttgatccgtaagggtcgtacgactttggttgaaaaatccaaagttcctgcgttgaaggcttgtccacaacgtcgtggtgtttgtacacgtgtttatacaactacacctaaaaaacctaactcagctatgcgtaaggtttgccgtgttcgcttaacttcaggttttgaagtatctagctatatcggtggtgaaggccataacttacaagagcacagtgttgttcttatccgtggtggtcgtgttaaagacttaccgggtgtacgttaccataccgttcgtggttctttagactgtgctggtgttaaagatcgtaaccaatcacgttctaaatacggtgctaaacgtcctaagaagtaa

SEQ ID NO: 606 - DNA, 192 bp, Acinetobacter baumannii
ttgcccggttgtaaaaatgccgctacagactgccctgttttatcaaatgcagcagcatgtaatgtgcttgtgcaaatcgatgctattcctaagataaatatttttttattcacaacaaaattcatagatccatcctggatatttttttattttgattcctcactttatgtagatttgatcgattatgcttag

SEQ ID NO: 607 - DNA, 789 bp, Acinetobacter baumannii
ctccataaatgttttaccactctgctcatattcaacatggatttagagactcgccaactacaacaacttttaagcgcaaaaaaccagcttccagaagtggttttattaaaagcaaccacaacttcgaccaatgatgatattcgtgaaattgcccaaaaaggcattacaacaggcttggtttgcagtgctcaacaaactcaagggcgaggtcaacatcaacggcaatggatttcacctgaaggaaacatttatttaagcacattggtgcaaactcgaacacccttagatggtcgcttcgcacttgaagttgcgttaaatattttgcaaattccacagttacagcctttgagcctacaagtgaaatggccaaatgatttgtatagtacacaaggaaaatggggcggaattttggttgaacctctttcccaacatcaggcgattgtgggtgtaggtattaatttaaaaacaccaccagtgactgagagtgatcaaccgatcacgtctctagaagatttaggcctagagcaaatgagtcgtcttgagttaatttcagagctttatgttgcaattcaaaatgcagcccgctggtttgaacatggttgttataaccttgcaggacgttttaaccaccatgctgcatggcttaatcagttagttcagttcgaacatagtcaaggactggtatatggccgtttcgttggtatctctaatgaaggtgcggtgattattgaaactcctgaaccacagcagttttatcaaggtcgtctaagaccacaaaccactcagtaa

SEQ ID NO: 608 - DNA, 366 bp, Acinetobacter baumannii
ggagaaaaatgcatgaatctagaatatacgcataaaccagactattacttgtttgcacaattactggtgcgacatatagaaagctatattcataaacacccagatgcagataatgccatttttgacttgcgagatgtctatgaaatttttaggcaagatttcgcatcaaccacaacaaatctagaaggcattttacatattgcagactcatatagagttgagactttgaatggggatcagcctcttattcaaaaatatcaaattgatgctaaaaataattcgctcttgattgactttaatacagatgcactcaatagcctgagaagtggcaaacctattttggaacctgatgcaactcagttataa

SEQ ID NO: 609 - DNA, 297 bp, Acinetobacter baumannii
ataagagaatggcaggggcggctggattcgaaccaacggatggcgggatcaaaacccgctgccttaccacttggcgacgcccctaaattcgatgctgtattaagatggcaggggcggctggattcgaaccaacggatggcgggatcaaaacccgctgccttaccacttggcgacgcccctaatacaatcatcattacaggtagaaaatggcaggggcggctggattcgaaccaacggatggcgggatcaaaacccgctgccttaccacttggcgacgcccctaacttgcaactttaa

SEQ ID NO: 610 - DNA, 1185 bp, Acinetobacter baumannii
ttaaaacgatgcagggggcacattaagatgtcattgctcgatcattttgctacagagttagatgagttaaaacgacaaggtaatttcagacaatttacccaaaatgtgcagcatggccgttttattacgattcaaaataaaacgatgctcaacttagcttcaaatgactatcttgggttggcagctgatattgatcttcgccaagaatttttagattgctatccattagaacgcagctattttagttcttcatcttcacgtttattaacgggcaattttgatgaatatgaacagttggaaaatagcctaagccaagcatttggtggtcgggcggctctattattcaatagtggctaccatatgaatattggtattttgcccgctgttgctgatagtaaaactttaattctggcagataagttagttcatgccagtatgattgatgggatccgtttgtctggtgcccagtatgtgcggtatcgacataatgatttacagcatttagagcaacttctacaaaagtatcatgatgatgaccagattgaacgaatcattgtggtcacggaaagtatttttagtatggatggcgatgaaacagatttaaccgctttagtccagcttaaaaaacgctttgctaaaaccatgttatatgtcgatgaagcgcattcaattggcgtacgtggacagcagggtttagggtgtgccgaacaatataatgtaattcaggaaattgattttctagttggtaccttgggtaaagcgctagcagcagtcggtggttatattatttgccatccaattattaaagattatctcattaataaaatgcgtccgcttatttttagtaccgctcaacctccgattgttatggcatgggcaaattttatttttcaaaaagtattaatggctcaatctcaacgtgaacatttaaaaaatattagccaatatcttcaacaagcagtggtgcaaaaggggtatgtgagtccatcgaccagccatattattccagtgattgtgggagaaagtcaggctactatcgataaggcgaaacaggttcaggaaagcggtttttatgccatgcctgtacgtccaccaacagtacctaaaaatagttcgcgtttgcgcatttccttaacatcaatggttgagcaacatgaacttgaagcattggtgagtttcctgtga

SEQ ID NO: 611 - DNA, 816 bp, Acinetobacter baumannii
aaattcgcgtggcttataatcgtaatgaaccaatcacttcatcaatccatggaagacgttccacacatccgtgttttagatgagtggcacgatacgattcctgaggatctttatattcctccagctgcctttgagattttgctcgaacagtttgaaggaccactcgactttttaatttatctgattcaaaaaaacggttttgatctcatccagcttgatattgctcctattgcaactcaatatttggcttatatggatagtatgaaatccttaaacattgagctgactgccgactatatggtcatggctgctttattggctgatttgaaatctcgcttacttttacctaagcctactgtcgtaagcatcgaaaaagatcctaaacaagatcttattgatcgactcgaaacttatttacgcattaaacaagccgctgaacgtttaggccaaatgccagttcttgaccgtgatacattcagtgccaatgtaagcttaggtcatattgcacctgtttatgaaggttatgatgtttcagcattacacgatgctttgttctgtgtatttaaccgtccggaacctgtaacacacacaattgcgcaagagcctgtactgttagaagaacgtattgcttatattgaagagaaattagagtcaggcgacgtgttaagttttaaagaattacttaatccccaacaaggccgtatgggaatggttgtaacttttatggctgttttagaattgacccgacaacaaaagattaagattattgctacaggagttgaagctccactagctattcaagggtcttcaatatga

SEQ ID NO: 612 - DNA, 360 bp, Acinetobacter baumannii
gctacaactcggcccagtcatggagtggttatgtctagaacctatactttttttattcatttaagagctttgcctgcttggttggctttagctcgtgaaaagcgcgctgagtttagtacacagaagcttgaacctatttttgagaagtacccgtctgtaaaagttcggtggtatgacgttgaagcgtttagcactaaagcgagtgatattgctgtgtttgagacggcatctctgcaagattattattttgtgattgatgcgatacgagactctgagttttgcacaatgccctactttgagtttgtagagattattcccgcaattgaagatggatatgtagagtatgaaagttctttatag

SEQ ID NO: 613 - DNA, 546 bp, Acinetobacter baumannii
ggccagcgtcgtgtacatgacacttgtacaaactgctggatcatcctgaagtgtcatattattaggtgtattaaaatgccaagacgtcgcgtagtcgctgctcgtgagatccttccagatcctaaatttagcagccaaacaatcgctaaattcatgaaccacgtaatgcaagatggtaaaaaatctattgctgaaagtatcgtttacggtgctttagaacgcgttcaagaaaaaaacaaagtagacccagttgaatttttcgagactactcttgaaaaagttcgtcctatggtcgaagtaaaagcacgccgtgttggtggtgctacttatcaagtacctatggaagtacgcccatcccgtcgtactgccttagcaatgcgttggttagtagatgctgctgctaagcgttctgaaaaaactatggctttacgtcttgctggcgagttgcttgatgcagctgaaggcaaaggtgctgcgatcaaaaaacgtgaagacgtgcaccgtatggcagaagctaacaaagccttctctcactaccgtttctaa

SEQ ID NO: 614 - DNA, 192 bp, Acinetobacter baumannii
aaaattctccgacattcacaaagtctaagttgtccttacaagaaaagtatcaacccacttaccatgttttataataatttaagcttatggaacatcgaggatgtttttctcgatgttccgcggctggtaagcaagcttagattactttgccttcacaagagtaaagcgattgagtatagcaatcatggttaa

SEQ ID NO: 615 - DNA, 1377 bp, Acinetobacter baumannii
atcagtttacgtccaaaccttgaagatcgtgaatgtttccattttgttaggccaaggaggtctccaatggatgtcgttaataaccgtagggctacttttaaaaaaatattaaatgtaacgagtggcaactttttagaacagtacgatttttttctttttggtttctatgccacctatatcgcagcaaagtttttccattctgataatgaatatgtctctttaatgatgacatttaccgtgtttgctgcgggttttcttatgcgtcctctcggcgctattttcttgggtgcctatgtcgacaaagtcggtcgccgtaaaggtttaattgtgactttaagtcttatggcaattggcaccatcttaattacctttgtgccgggttatgaaaccattggtattatcgcgccaattttggtggtaattggccgtctattacaaggcttctcggcaggcgttgaatctggcggtgtttcaatttacctcgctgaaattgcaaccgataaaaaccgtggctttattactagctggcagtctggtagccaacaaattgcggttgtatttgcggccttacttggttactggctcaacaccattttaactcatgctcaagtaggtgaatggggctggcgtattccgttcttaattggctgtttaattattcctttaatcttcttgttccgtcgtactttagaggaaactgaagactttaaagcgcaaaaaactcatccatcttcaaaagaaattttcagcacacttgtaagcaactggcgcattgtacttgccggcatgatgatgagtgccatgaccactactacgttctactttattacggtttacaccaccgtgtatgcgaaacgtactttagaaatgtcggtcacagacagccttttagcaaccgtgtttgtaggtttatcgaatttcttctggttaccaatgggtggcttgctttcagacaaaattggccgtcgtccagtattagtgggtattacgactcttgcgatctttaccagctatccggttttaagctggttggtgagcgacattagcttctcaaacctacttattacccttgcttacttctcgttcttctttggtatgtacaacggcactatggtggcaacgcttgccgaagtgatgccaaaacgtgtacgtaccgttggcttctctttagcatttagtcttgcagccgcgatttttggtggtatgactccaatggcttgtaccttccttgtcgaaaatacaggtaatgcaagcacaccagcattctggctcatgctcgctgcggtatgtagtctcatctcaagcttgtatttatgtcgtggttctaaacagaaagatcctgacgcaattgctgaacctgcaaagattagcgcttaa

SEQ ID NO: 616 - DNA, 1389 bp, Acinetobacter baumannii
agatactcacggtttagtagaagtgacatcaatcaaacagttattggagaagtatgtatgaatactgaaccaaaaccaatttatggcgacggtaatccggaaactcatccactgacttggcgtttaagcaaacaagaatcggtacgtagtgctgacgattacgaagcacttgaaggttatgccggctttaaaaaagcattaggtatgaaacctgctgaagtgcttgaagtcattaaagctgcaactgtaaaaggtcgtggtggtgcaggcttccctgcagggatcaaatggtctcttatggcgccaaatgatggcggtccacgttacttgatctgtaacgccgatgagatggaaccaggtacctttaaagaccgtttgttgatggaaaaacttcctcaccaattgatcgaaggtatgttgattgcaggttataccctagaagcaactcagggttatatctttattcgtggtgaatatattgaggctgcacaatacctaaatgaagcgcttgagcaaatccgcgctaaaggttacttaggtgacaacattttaggttctggctggaactttgagttacacgtgcacactggtgcaggtcgttatatttgtggtgaagaaactgcattgattaactcacttgaaggtcgccgtgctaacccacgtactaaaccaccgttcccgcaagttgctggtgcatggggtcgcccaacgattgtgaacaacgttgagacttataacaacttgccagcaatcatgcttcgtggtccagaatggtatatcggtttatcagcaggtaaatcaaaagatccgggcacaaagatttatggtgcatcaggtaaagtaaaattccctggtctttgggaactaccatttggtacgactgcacgtgaagtaatcgaagaacatgctggtggtatgcgtgatggcttgaagcttaaagcatggttaccaggcggtgcgtctactgactttttaccggcagacaccattgatttaccaatggatgctgaaaccattatgaaagcaggttctcgtttaggaacatgtttattaatggtggtagacgagacccaatgtatggtgtcgttgacccgtaatctggaagaattctttgcgcgtgaatcatgtggctggtgtacaccttgccgtgatggtttgccatgggctgttaaagcgcttaaagcacttgagacaggtgaaggtaagaaagaagatatcgaccacttacaagaacttactcgtaaattgtggattggtaaaactttctgtgcccacgcaccaggtgcgatggagccgcttatgggcgcactcaaacatttccgtagcgagtttgaagcgaaagtgactgatcgtcctgtcgtgcaaactagcaacgtagaacaagcttaa

SEQ ID NO: 617 - DNA, 588 bp, Acinetobacter baumannii
gcccctacgctctactatcctatgattatggcaaagcaattttttcaatcttggcttccttctccagagaaagtttcaaatatgaaatttttaaggattttcgggcaaaaaacccttaatcctgtgctttggtatgtcaaccgtaaatctattacccgtgccatttttgtagggacttttttcggtttactgcctataccctttcatagtgtatttattgttatggcagttttactgtttgaagttaatttacctattagcttaatgcttgcttggcttagcaatcctcttacattagcacctattttgtatattggtttctggtttggtgcacatatttatcatgtgcatatgataaataagaaaatgcttttaggggtgcttcaccagatttcacgttggattacgcattttggtcatggtcatatcgatttgagcctcgctaaaattttaatatcaggtctcattgtcgaagcgtttgtatttgcaaccatactatatatagtgactgaggttttctggcgttggatggtcattcgaaactggaaaaatagaacaggccataaaaaacaagaagacgctctataa

SEQ ID NO: 618 - DNA, 3456 bp, Acinetobacter baumannii
ggcattatgcgtttaagcagtttaaaactttccggctttaaatcttttgcagatagtacaactttaaattttaaggcgaaccgcacagcagtggttggtccaaatggttgtggcaaatccaatgttattgatgcaatccgctgggtgatgggggagtcaaacgctcgtcagctacgtggtggtagcatgcaagatgttatttttaccggaacatccaagcgtaagcctgttggggttgccagtgtagaactgcgttttgacaatacctatggcaaattaggtggagcttataatgcttataatgagctcgcagttcgtcgtcaggtaactcgcgaaggtaaatctgagtatttcttaaatggtacacgttgtcgccgccgtgatattactgacattttcttgggaacagggttagggccacgctcttacgcagtcattgaacaaggcatgatcaaccgcttggttgatgccaagcctgaagaaatgcgtattttcattgaagaagcggcaggtgtttcacgctatcaagcgcgtcgacgcgaaaccttgcaacatcttgaacatacggagcaaaacctttcacgcttggaagatattgcgcttgagttaaaatcgcagcttaaaacgcttaaacgccagtcagaagcagcagttcaatataaaacattagaaagccagattcgtacactcaaaattgaaattttgtcttttcaggcagagaaaagtgtacgtctacaagaagaatataccgttcaaatgaatgaactgggggaaacttttaaattagttcgttcagaattaagtacgattgaacatgatttagaatctaccagtgctttatttcagagacttattcagcaatcttcaccgttacaacaagaatggcaacaagctgaaaagaaactgtctgaactgaaaatgactctagagcaaaaacaaagtttatttcagcaaaatagtacaactctcgttcagttagaacagcaaaaagcccaaactaaagaacgtttacagctttctgaattgcaactcgaaacactgaatagccagttagaagagcaaaccgaagctttaactgcaattgagcatacagcagctgaagcagagcaaagttttgccggtttacaatcacagcaacggcaagcgcagcaacaatttgagcaagtaaaagctcaggttgaaaaacaacaacagcaaaaaatgcaaatgtctgctcaaatcgagcaattaggcaaaaatgttcagcgcattgaacagcaaaaagaaacgctgcaacatcaagcaaaccagatccaatcgcaagtacacgaagatgaacaaggcgagcttgagcaattacagcagcagctttgtcgtgaaatctcaacgctagaagctgaaattgagcagtatgtgcagcgtattgaacaagctcaacaagcgcatcaggtaaataaaaaccagcagcaaacgttaaaaacagaaatacaggttttattatcagagcagaaaaacttaagccagcttgttgctaaacaaagtccaaagcaaaaccaagatacgctacgtttaatgcaggctctagagttaacagagcagggcaaaccacacgcacaaattattgaaaagtttttagcaaaatggttacaggcacatattgttgaaactgaacaagcctttcaggaaggaattgctcgccagttaaagccttcagagcaatcaagcaaatttaaggggaacctgacttgcttgaatgattggattgcatcgccacagctatcaatattctcgaatgtagcgattgcacaagatttatctcatgctttaaatgaacaaaagcaactgcaatatggccagtctattttgactttagatggttatcatgtcgggcaagattgggtaattgctcttatgtatgatgacgaaagtcaaagtgcgcaaggtatgctcagtcatcgtattcgtctagacgaaattgaacaagttcttcaaaagcagcaaccagaattacaagcattagatcaaattatagttcagcaaaaagatgagctaggacagttacaagttgacctacagcaaaaacaacaagtcattaaacaaaaacaaaaagacttgcaacagcttgatgtacaaattgccaagcaacaaaccgcagcacaagcatttttattgcaaaaacagcaattgaaagatcaactcgctcaattagatacgcagcttgaagaagatgcgatgcaaaaagatgatcttgaaattgatttgcatgcattggcaatgaagctcgaaactattttacctgactataaaactttgcaatttcaggtagaagaattaacagagcagcttgaggaacagcaacaagtcttacaacagcaacaacaagaacgtgagattttacgacgtaatagtacgcagacaactcaacaaattgagctgcttgaaaaagatatttcgttcttgcagagccaatatcaacaaattacagcgcaaatggaacaggcgaaaaagtttgttgaccctattcagttagagttgccaaaccttgagtcagagtttcaacaacagtttgctcaaaccgaaaagctgcaaaagacatggaatgaatggcagattgagcttaatagtgtccaagagaagcaacaaacgcttacagatcaacgccatcaataccaacagcaagatgaaaagcttagagagcagcttgaagccaaacgtttagcatggcaagccgccaagtcggaccgtgagcactatcaagaacagctcaaagagttaaatgccgagcttcaaacgggcttgaaaatagatttaactgaacaccagcaaaaactagaaaaagtacagaaacagtttgaaaaaatcggtgcagttaacttagctgcttcacaagagtttgaagaagtttctcagcgttttgatgagttgagccaccagattcaagacttggaaaatacggtaactcagttaaaagatgcgatgaagagcattgaccaagaaacccgtaagttgtttatgtcgacttttgatcagattaatcaagagttacaaaatctatttccaaaagtttttaatggtggtgaagccagtttaagtcttgaggatgattggcaatctggggttaagctcatggcgagaccaccgggtaagaaaaacagttctctagcattactttccggtggagaaaaagcgttaacagcgttagcattagtatttgctattttcaggttaaatccggcaccgttttgtgtactcgatgaagtggacgctccactcgacgatgcgaatgtacagagatattgtaatttggtaaaagagctttctgaacatgtacaattcatttacattacacataataagctggcgatgaccatggcaactgacttgttgggtgtaaccatgcctgaaccgggtacatcaaaattagtcactgtcaatttagaacaggcaaaagaatacgggttagtttcggagtcatag

SEQ ID NO: 619 - DNA, 999 bp, Acinetobacter baumannii
aaaaaccagctagagggaacggtaatgacgacatatgaacaggctacttatgccttaagtgaagaaatgcaaagccttgtgtattggagcagcatttattcaccagcagatgcagatattgactcagtccgtgcggcatatgatgccatgtgccgacactacactttgccacgtgatgacaagttagatgtagaagatagagtgattgcaaatgaagagcaacctgtgcctgttcgtgtgtatttaccaaaaacaaatcggcctgggtctggttggccatgtgtgttgtatctacatggtggtggttggatggtgggtggactcgattcacatgagtttattaccagttatttgtgtaaggacttaaatgcggttgttattggtgtggattaccgcttggcaccagagcatcgctttccagcagcctttgaagattgtttagcagtgtatcactggcttaaacagcatggttcagcttggcaaatcgatagtgaaaatattgtgctagcaggcgatagcgcgggtggtaatttagcagctgcccttgcagtggaactacaacatagtggtttacaagctcaagggctggcattggtttatccatgtttaacgacagcatttgatactccatccgcacaaaagcacgcccatgcgccgttgttaacgacagaagatatgcatttttatttaaaggaatatgctccgaactcacaagattggcaggatttacgtctagctcctttattggcgacggacttttcagatatgcctacaagttttgtggctgttgcagaatatgaccctttaagtgatgacggttatctctttacccaaaaactggaacaagcaggcatccctaacgagtttcatttaggtaaaggtttattacatggcagtttacgtctgatgcgtgactgtccggaagttcaacatttatatcaaaacatgctaagtgcaatacaccgcatgttgagcagtaccgaaaagacatcaatttaa

SEQ ID NO: 620 - DNA, 627 bp, Acinetobacter baumannii
agctccactagctattcaagggtcttcaatatgagcagttttgaacaaaataataatgatttgtcattagccgatattcatcatgaagttttattacagcttgaagccattatttttgctagtgaagcgcctgtctcaattgcccgtttaaaagaagcatttaataatcaatataacaaacaacagcttcgtcagcttttacaacagcttgcccttttacaacatggccgttccattgagttgattgaaactgcgcagggctttcgttttcaggtaagatccaaatatcgcaatatcattgcgcagatttggccagagcgaccaacaaaactgtcgccatcattactagaaacgttggctgtcattgcgtatcatcaaccggtcacacgtgctgatattgaacaaattcgtggtgtatctaataatagtcagattctcagaacgctatttgactggaactggattaaagaagccggttttagagatttacccggaagacctgcgttgctaattacaacgcctcaatttctgaatgcttttggtctagcctctctaggccaattgcctcccctgcagaacgccaaggaagcatttatggctctcgatgcaaatgcaccgaagtcataa

SEQ ID NO: 621 - DNA, 1065 bp, Acinetobacter baumannii
tcaacatataggtcatttattatgaaaaagttattaccgacttcaactgctggcagcttaccaaaaccatcttggcttgcagaacctgaaaagctttggtcgccgtggaaactcgaaaacgaaggcttaattgaaggtaaaaaagacgcgttacgtttagcacttcacgagcaaaaacttgctggcattgatattgtcagcgatggcgaacaaacccgccaacactttgtgaccacgtttattgaacacttaaatggcgtagattttgagaagcgcgaaacagttcgtattcgtgaccgttacgacgcaagcgtaccgtctgtagttggtgcggtgtctcgtcaaaagcctgtatttgttgaagatgcaaagtttttacgtcagcaaactgatcaaccaattaaatgggcattacctggcccaatgactatgattgatacgctttatgatggtcactacaagagccgtgaaaagcttgcttgggaatttgccaaaatcttgaaccaagaagctaaagagttagaagctgctggtgtagatatcattcagtttgacgaacctgcatttaacgtattctttgacgaagtaaatgactggggtattgcgactttagagcgtgcaattgaaggcctaaaatgtgaaactgcggtgcacatttgctatggttacggtattaaagccaatactgactggaaaaagacactcggttcggaatggcgccagtacgaagaagctttcccgaaacttcaaacttctaacattgatatcatctcgttagaatgtcacaactctcgtgtgccaatcgacttgcttgaacttattcgtggtaaaaaagtgatggtgggtgcgattgatgttgcaacgaaccagattgaaacaccggaagaagtggctaacacactacgtaaagcgcttcagtttgtagactctgacaagctttacccgtgcacaaactgcggtatggcgccactttctcgtgaagtggcacgcggcaagctaaatgccttaagtgcaggtgcagaaatcgttcgccgagaactgacgggttatgatctcactgcttaa

SEQ ID NO: 622 - DNA, 750 bp, Acinetobacter baumannii
tcaggtatttttcccatgaaaagtttatggcttgatatcggaaacacccgtttaaaatactggattactgaaaatcagcaaattattgaacatgcagctgagttacatttgcagtctcctgccgatttattactgggattaatccaacactttaaacatcaaggcttgcatcgtattgggatttcttcggttctcgataccgaaaataatcagcgtattcagcaaattctaaaatggctagaaattcctgttgtttttgccaaagtgcatgctgaatatgcaggtttacaatgtggctatgaagttccaagtcagctcgggattgaccgctggctacaggtactcgctgttgctgaggaaaaagaaaactattgcattattggttgtggaacagcgcttaccattgatttaaccaaaggcaaacagcatttaggcggttatattctgccaaacctttatttacagcgtgatgcactgattcaaaataccaaaggcattaaaattcccgattcggcttttgataatctaaatccaggcaataacaccgtagatgcagtacatcatggtattttactgggcctcattagtacgattgaaagcattatgcaacaatcacctaaaaaactactcctcacaggtggcgatgctcctctttttgcaaaatttctacagaagtaccaacctactgttgaaacagatcttttgcttaaagggttacaacaatatattgcccattatcctaaagactag

SEQ ID NO: 623 - DNA, 834 bp, Acinetobacter baumannii
gccgtttggctaaagaagacctttcattccggtgttcacactgatgaagaatctggtcagacaattattgctggtatgggtgagcttcaccttgacatcatcgttgaccgtatgaagcgtgaattcggtgttgaagcgaatatcggtaaaccaatggttgcttatcgtgaaacgattaagaaaactgttgagcaagaaggtaaattcgtacgtcaaacaggtggtaaaggtaaattcggtcacgtatatgttcgtttagaaccgcttgacgttgaagctgctggtaaagaatacgaattcgctgaagaagttgttggtggtgtagtacctaaagaattcttcggtgcagttgacaaaggtattcaagaacgtatgaagaatggtgtcttggctggttacccagttgtaggcgttaaagctgttctttttgacggttcttaccacgatgtcgactctgacgaattgtcgttcaaaatggctggttcttacgcattccgtgatggtttcatgaaagcagatcctgttcttcttgaacctatcatgaaagttgaagttgagactccagaagattacatgggcgatatcatgggtgacttaaaccgtcgtcgtggtatggttcaaggtatggacgatcttcctggtggaacaaaagcaattaaagcagaagttccacttgctgagatgtttggttacgcgactcaaatgcgttctatgtctcaaggtcgtgcgacatactcaatggaatttgctaaatatgctgaaactccacgtaacgtggctgaaggcatcatcgctaaattccaagctggcggtaaaaaaggtgacgacgagtaa

SEQ ID NO: 624 - DNA, 2088 bp, Acinetobacter baumannii
tcgcagctcagggtggagaaatttccacccttttttatggtgaataaaataatggcaataacttccgtgatcgaacagatgcgtcagcttattcaactgattgcaaagcataaccatgcctactatgtcatggatcagccgacaatctcggacagtgaatatgatcatttatttcatcagttaaaagctttagaagaacaatatccggagtttgtacaagccgactcaccaacaacgaaagtaggtggtcaagcgctttcaaaatttgagagtgtgacacatgtggtgccaatgctttcacttggtaatgtatttaaccaagaagatttatttgcatttgcacgccgtgtagaagagcgacttccgaaccagaaagtacaatatgaagttgagttaaaactcgatggccttgcaatttcactatggtatgaaaatggtgtactcgttcgcggtgtaacccgtggggatggcgaaacgggtgaagatattactcaaaatgttaaaaccattcgtaacttacctaaagttctgcattcagaaaaatatgaaatacctcgtctacttgaagtacgtggcgaagtattgatgccaaagtctggttttgaaaagctcaatgctgaccaagaagcaaagggagaaaaaaccttcgctaaccctcgaaatgcagccgctggaagtttaagacaacttgatccaaatattgctgctgctcgacctttggcattttatgcgtatgggattgcacagtgtgaaccaaatcatggcctaacaaccatgcatgatagcttgcaatggttaacggaacttgggttccaaattgctgagcgtcagtacttgtgtaattcaattcaagaagtacagcagcgttatgagcaaattcagcaagaacgtccaaacttgcaagttgaaattgatggcatggtggtgaaggttgatgacctaaaacagcaacagcagcttggtttcttaagtcgtgaaccacgctgggcaactgcttataaattcccggcacaagctgcattaactacagttgagcagattgactggcaagtagggcgtacagggactttgacccctgtagcacgcttaaaccctgtttttgtgggtggtgtgactgtttctaatgtaacgttgcataatattggggaaattcatcgtctcgatgtacgcattggcgatacggtaagtgtatatcgtacgggtgacgtgatccctaaagtagaaaaagtttggccggagttccgtcctgctgaagcagaagttgttcatttaccagagtcctgcccagtatgtgcttcgcctgtagtgatgcctgaaggtgaggctctcgcacgttgttcaggcggtttatattgtgccgcacagcgtattgaagccattcgtcactttgtatcgcgtaaagcgatggatatcgagggtttgggagatcgttgggtagaatctttattacgtctcgatttacttaaagatgttgctgatatttaccatttgcatgagcacagagaaactctgttgggcatcgaaaaaatgggagaaaagtcagtacagaacttaatagatgcgattgaagcaagtaagaaaacaacactagcacgttttatttatgcattaggtattcgtggagtaggtgaaacaacggctagaatgttagcaaatacattccagacgcttgaggctcttaaagctgcgaatgtagaagctttaaagaaaaccccagacgtaggggatattacagcagagtggattgctgactttttcttggcaccgcataacattgaagtactcgatcgtttaattgccgcaggaattcattgggatgcgccaacagcaccaacgcgtcagcctttaaatggtgaaagctgggtacttacaggtacattagagcaaatgacccgtgatcaggccactcaaatgttacaagcattaggtgcacgagtaagtgggagtgtttctagcaaaacgaaatgtgtagttgctggtgagaaggcgggttcaaaattagaaaaagctgcaaagttaggtattcctgtcatgaatgaaacagatttcttatcactcatggcaggctatgggcaaactttgagctaa

SEQ ID NO: 625 - DNA, 1239 bp, Acinetobacter baumannii
agagtcaacagacaaacaggctctgcgaaattaaaaacaataaaaatcttgatgcttgtatcttacacagagtgcgttgtcttcttaggccagaacaatgtcatcaaaattaaaacttatacaaatatagtaagttcaaaaaactcaactcaacgcttttcacaaaaacatagcaaatccaaacttttatcagcagtcctaaacaggcatgatgaattaatagcaacagataagaagaaatttatgattactaaaacgctcccgctgacagatatacaccgccatcttgatggcaacatccgcattcaaactattttagaattggggcaacaataccatttagatttgccagcttatgacattgaatctttacgaccacacgtacaagtaatggataaccaacctgacttattaagttttttatctaagctcgattggggcgtaaaagtattagcaagtttagatgcctgcaaacgcattgcttttgaaaacatgcaagatgcagcacagcaaggcctagactatgtagaactgcgtttttcaccgggttatatgggcatgacacatcaactcccacttgaaggcgtggttgaagctgtgattgctggagtaaaagaaggtagtcaagcttacggagtaaaagcgaatttaatcggcattatgagtcgtacttttggtcaagaagcctgcgaaaaagaattaaatgccctacttgcccataaaaatgatattaaagcgttggatcttgctggagatgagcttggttttccgggcaatttatttattgaccacttcaaaaaagcacgtaatgcaggttggcacattacggtacatgcaggtgaagctgctggcccagaaagtatttggcaagccattgaagaattaggtgctgaacgaattggacatggtgttaaagcagttcaagatttaaaacttttagattatttagcaaaacaccagattggtattgaatcttgcctgacttcgaacattcaaaccaacacagtaccctcactagcacaacatccattaaagacttttttagagcatggcgttcttgcaacgattaatacggatgacccagcagtagaaggtattgagatacagcatgaatatttaactgctgcccctttagcaggattaagccctgagcaaatttatacagctcaagaaaatggacttaaaatcgcatttttatcagaacaagaaaaagatgagttaagacagaaatatcaatag

SEQ ID NO: 626 - DNA, 336 bp, Acinetobacter baumannii
accaggtgcagaagaggaaaaagaataatgggccagatccctttagaacatggtttgattgttgcgaccattctttttgcactcggtttttacggtgtaatggtgcgacgcaacctactatttatgttaatgagccttgagatcatgatgaatgctgcagcgttagcattcgttcttgcgggtagcgtatgggcacaaccagatggacaagtcatgttcattctgattttaacccttgctgcggcagaggcgtgtatcggtcttgcgattgtccttcagttctatcatcgcttccatcatttggatgtggatgctgctagtgagatgcgcggatga

SEQ ID NO: 627 - DNA, 462 bp, Acinetobacter baumannii
gctataataagcccccttgttttaaagctactcaattttatgatgtatcgtcagcaaagcgtaactcttgatctcgacactgacgtcacacatcaatgttatttgcatcagacaagagatgaccatctcattggtattattgaatttaataaaccaagttatgaactcaaatggggtgatcttgaatatttccgtcgccgcaccgaagagttctcggtcatgccatttcctgaatgcattaatgcgatgattgttgatattcgtaatatcaatgtatttctggacaatgaagttccaattttaccgtggcgtttactcgaagaagattgtcctgttcgcctagttgttcctcaagaccgccttgaacactatgcgggattatttgaaccaacatggctttcaacagatgtcgacagtgcgattgcagagatccgtgagtttatggatatgtttgtccattaa

SEQ ID NO: 628 - DNA, 195 bp, Acinetobacter baumannii
aaacaaataagtgaggaaaatacgatgaaaaaacctggtcgttttttagcacctgttgtaattgctgggattaccgttggttttttagcaagtgcttataaatttgtatttagcaaatctgaatcatcaaaacagacaacaagccataagcatgattctgaaaaatcatccaatgattcaaaagcatcaaattag

SEQ ID NO: 629 - DNA, 672 bp, Acinetobacter baumannii
gatgtgccaagcaccgtcttacggctttgctgtgcctttttttctcccagaaagggcacaggctttttatcccatttagaaacaacaagaatttataacggtaaaactatgccaactttagaaatatcttccaaaaaattacaggtggtgcaaactgccatccaactctttactacgcatggatttcataatgcaggcgtagacctgattatcaaagaagccaaaataccgaaagccacattttacaactacttccattccaaagaacgcctaattgaaatgtgcatcgcctttcaaaaaagcctactcaaagaagaagtgctctcgattatttactcaagccgttactacacccaaaaagataaactcaaagaaattattgttttacataccaacttaaacagtctgtaccatttgctgcttaaagcagtttttgaaataaaacggttgtatccgcaggcctaccgtatggcagttgaataccgaaaatggctacatcgggaactttttgacctgatttttagctgtgaaactcgtgcttttaattttgatgcagacatggttttaaacctgatcgatggtttgctactacaggttttaagctcaaatagtgtggatgaacgggatgtggtgttggagaggttttgggggaggggagtacataagagatag

SEQ ID NO: 630 - DNA, 189 bp, Acinetobacter baumannii
agtgcagcaaggtttaaaccgacaacagaggttgttgcgattaaattatggttacgcttaattgaaattaacagcatgacaacgactgctgtcaaagcaacaatcatcaccggtgctaaaggcataagcgtagaaaatgatactgtgaagttcatgattattggatctccacatggtcaagttgagtag

SEQ ID NO: 631 - DNA, 864 bp, Acinetobacter baumannii
agcatgaaaagtctggcttttattcatcgtaacgatactcgctttgcggtcggtgatttttatccagttctttctgttttttcctaccatgagttaggcaataccctctcacccttcttactactcgaccatttaggtcccggaaaaattgcaccttctatgaaacgtagaggagttaatgatcatccccatcgtggattcgaaacggtaacacttgtttatgcaggtgaactggaacataaagattcatctggtggaggtggatttataagtgctggcgatgtgcaatggatgaccgcagcctctggtgtgattcatcgggaattgtttagtgaagagtattctcgatctggtggtccctttgaaatgattcaactttgggtcaatttaccagcagcaaataaaatgaattctccgcgctatcaaagtttaaagaaagctgaaataccgatggtgaaactggaaaatgaagctggatttgtacgtattattgcagggcagtttaagcatgttatgggccctgcacttactcacactcctattaccgtattagatgtagagctccaggcaggtcaacaagctgccttccctgctcaatctggtgaaacagctttagtttatttacgttcaggtcgggcacaatttcaaaaagatgaagacgttttagaggaacaaggcctagcagtcatgtcaaaccaaggagagtatttctctattactgccctgcaaagctgcaaattacttattttgactggacaacccatcacagaaccgattaatggtcatggtccatttgtaatgaatacttatgatgagattttacaagcctatgatgatattaaaaatggaagatttgccaagtaa

SEQ ID NO: 632 - DNA, 318 bp, Acinetobacter baumannii
tctttaatgaggatttatctcatggcaaacttcgtattaaacgctcaagcgcgtgctgaagacaaacaagggaaaggtgcgagccgccgccttcgtcgcgaatctttagttccagctatcatctacggtggtaacgctgagcctgtagcagttactttagaacttcgtgagcttgtaaaagctttagaaagcaacgctttctttgaagaagttgttgaaatcaaagtaggtgacaaagttgaaaacgttaaaatccaagcgttacaacgtcacccagctaaaaacactcctatgcacgctgacttcaaacgcgcataa

SEQ ID NO: 633 - DNA, 522 bp, Acinetobacter baumannii
ttaacgatgaggataacaacgatgactactgaaaataaattagatgaattaaaggcaaaagcggctgatgcaaaagtacaaggtgaaaaagctttggacgatttaaaagaaaatgtaaaagagaaacaaactgcgggtaaagaagcagttgcagataaagtagatgagctaaagaccaaagcggccgatgcaaaagtacaaggtgaaaaagccttggaagatttaaaggaaaatgtaaaagaaaaacaagctgctgcaaaagaggcagttgaagataaagctagtgatttgaaaggcaaacttgatgatgctcagcatagcctgcaagacaagtttgatcatttacgtactgaagcagcgcacaaacttgatgatgctaaagccaaagctgcagaattaaaggaagaggcggctacaaaatttgatgagttaaaaactcaagcaactgcgaaatttgatgagttgaagaaaacagctaccgaaaaacttaataaattgaaaaatcatgattctgctgaataa

SEQ ID NO: 634 - DNA, 1251 bp, Acinetobacter baumannii
tctgtttttggagtaaacaatatgtcttggctttcttcattaaaatccgttttttcacccgcacaagaagtgaaagaagaggaaatccaaaccgtactccaaaattatttattgccagattcaaaagatgctttaaaagagcgcattagtcagcttcaagtgcaaggtcgtgttttacaactcaccattaatactttcccagacgaaaaagaatacttgcagcaaattcatgatgatttagctggcgctttgcaaaagtgcggtattgaagaacttaatttacatgtagttcaacaaaagcgccctacacaagagagttcgggtcaaggttgttcatctaaagcaccgaaagagaattcgaatttacctcctgtgcttgatgcttcacctaagtctgaaccggatccaaataacccaccaattcagaaagcagcgccgcaacaaagagatgtgccacttcatcctcgaatcaagaatgttattttagtttcatcaggtaaaggtggtgttggtaaatcgacaactacggtcaatttggcgcttgccttacaaaaaatgggacttaaggttggggtattagatgctgatatctatggaccaagtatcccgaccatgctaggtaatgctggtaaaactcctctaattgaaagtgaaaattttgtgcctttagatgcttacggtatggcagtactttctattggacatttaacaggtgataacaacacacctgttgcatggcgtggaccgaaggctacaggcgctctaatgcaattatttaaccaaacgctttggccagatttagatgtactcatgattgatatgccgccgggtacaggcgatattcagctgacacttgctcagcgtattccagtgactggctcaatcattgtgacgaccccacaaaatgttgctttacttgatgcgactaaaggcattgaattatttaataaagttggtattcctgtattaggtgtcgttgagaacatgtcgacccacatttgttcaaactgtgggcatgaagagcaaatttttggtatcggtggtggtgataagctttccgagcaatatcatattccattgctaggtcgtttgcctttaaatgctcaaatacgtgagcatgctgatcaaggtaaaccgagtgtgattgcaatggatgatgcagctgatagttatatcgatattgcgaaagcggtgtggcaacagattgagagagttcctcagcgtgcacgagatgacaaacgaatcttttga

SEQ ID NO: 635 - DNA, 789 bp, Acinetobacter baumannii
gagcaaaatggaagatgccctaaatgctgttttagtggcagaaggaaaaattgcatgacacaagaacgcaaagttgcattagtaacgggcgcgagtcggggcattggcgctgcaattgcccagcaacttattcaagacggttattttgtcgtaggtactgcgacttctgaatctggtgcacaaaagctaactgatagctttggtgaacaaggtgcaggtttggctctcgatgtgcgtaatctcgatgagattgaagcagtcgtgtctcatattgaacagaactatggtcctgtacttgttctcgttaacaatgcaggtattacgaaagacaatttgttgcttcgtatgtcggaagatgattgggatgacatccttaatatccaccttaaagccgtttatcgtttatctaaacgtgtgcttaagggtatgacgaaagcacgttttggtcgcattattaatatcagttctgttgtagctcactttgcaaacccaggccaagcaaactattctgctgctaaagcaggtattgaagcatttagccgtagtcttgcaaaagaaatgggtagtcgccaaatcactgtaaacagtgtggcgccaggttttattgcgacagaaatgacagatgcacttagtgaagacattcgcaaaaaaatgagtgatcaagtggctttaaatcgcttaggcgagccacaagatatcgcaaatgcggtgagtttccttgcaagtgataaagcaggttacattaccggtacggtattacatgtaaatggtggtttatacatggcctaa

SEQ ID NO: 636 - DNA, 471 bp, Acinetobacter baumannii
tcccgcgtaggattatcgatggatgcaccttctgatgcctttttgtgggtaaaagcattacatattattgctgtggtttgttggttcgctgctttgttctacttaccacgtctttatgtttaccatgcaatgagtgatgatgctacaagccatcaacgctttgaagtaatggaacgtaagttgtatcgaggtattatgtggccatctatgattgccacattaattactgctcactttctcgtagattggggtgatgcaactagacattaccatgaagccacttggttttatctaaaagttggattagtggctttattagtgatctaccatttagtttgtggttactatcgcaaaaagcttattggaaatgctcactacaaatcacataagttctggcgtttcttcaatgaaatgccaaccttaattttatttgctgttgtgattttagttgttgtaaaacctcagttttaa

SEQ ID NO: 637 - DNA, 1248 bp, Acinetobacter baumannii
aaagataagggtatcgttatgggtgcattacaaggaattcgggttttagatttaagtcgtgtgcttgcggggccttggtgtgggcaaatcttggcagaccttggcgcggaagtgattaaaattgaacgtcctcgagtcggtgatgacacccgtatgtggggaccaccatggatgcccgatcaagacggaaacatgactcgtgaatctggctattttcagtgtaccaaccgcaataaatattcggttgcggtagacataaccacacccgaaggtcaggccttaatttatgaaattgccaagactgccgatgtcgtgattgaaaattataagacagggtctttggctaaatatggtttggactacgcgtcattaagtgagttgaacccgaacattgtttattgctcgattaccggttttgggcaagatggcccacgtgcagaagaacccggttatgattttattattcagggtatgtctggcttaatgagcattactggcgagcctgatgatgtggcaggtggtggtgcgcaaaaggttggtgtggctgtggtagatattcaaactggattgtattccaccattgccattcaagcggcactgattgcacgctcacacacaggacgcggtcagtatattgatatgtcactccttgatgtgcaggtcgcggcactggcaaatcagggaatgaattatttagcttcaggtaaagcgccacaacgcatgggtaatcaacacccaagtattgtgccgtatcaaacttttaaggctaaagataaagaatttattattgcttgtggcaacgacaaacagtttaaagatttgtgtattgcaattggttatccagagttgctcgaaaatgaaaagtttgtgcgcaaccaagaccgcgtaaaatatcgaaatgaactgatacctttattgtcggaacactttttgcgaaaaactgctaaagaatgggttgatatgattcatgccttaaaagtacccgtaggtgttatcaattctattgaagatgctttggctgaaacacaaatcgtccatcgcaatttggtagtgaatattcctcatcgtttaaatgaaaacttccaaaccattggctcaccaatcaaactgtctgatactcccgttgaatatcatcatgcgccgccagagcttggtgaacatactgctcaaatcttatcgagatttaaaacagcagaagagcttgctgcattaaaagagaaaggcattattgatggaaaaattgcttaa

SEQ ID NO: 638 - DNA, 2928 bp, Acinetobacter baumannii
attatgtttattaaaagtattttatcttcgattactagtattatcccacttcctgaaaatagtaacacaagcagtaatttaggtaacggctctggtgacggcctacttaatggaatatcttccggaaatggtgaacacaactatggtattggcaatggtattgccgatgacgcaagcattaccgccccaattaccattcccctcaacctctctggtaactcaattacactcataggcaattcatcttcaagttcggtgaatagctctccaaccaccacttcaaataacgttaatgacaacgacgtaacgaataatggtaacggctccaccattagtagtggtacaggcaatggctctggtgacgggcttttaaatggcgccgcttctggtaatggtgaacacaactatggaatcggtaatggtattgccgatgacgcaagcattactgccccactttcaattccaattaaccttgcgggtaactctattaccctaattggtgactcatcttctagttcggtcaacaactctgcaaccaatacatcaaataccgtgaatgataacgacaccacctataacggcaatggctcaggtgctggtaatggttcgggcgatggcttgttaaatggaattggctctggcaatggcgagcaaaactacggtatcggaaatgggattgcggatgacgcaagtattacagccccaattacgcttcctattaacttgtctggtaactcaattactctaattggcaattcatctgcaagttctgttaattcctcgccaactacaacgtcaaatactgtgaatgacaacgacaccacctataacggcaatggtactggtgatagcggcgtgagcgctctgggcggttctggcaatggttcaggtgacggcgcaggtaatggtatcgcttctggcaatggtgaacataactatggtattggcaatggtaacggcgacgatgttgatattactgctccgattaccggcgttctaaacatttcaggaaactcatttactctcattggtaattcttcatcaagttcagtcaatactgcgccaaccaccacatcaaatacggtgaacgacaatgacaccattgataatggtaatagcggcggcacaggtagtggttcaggcaatggctctggtgatggtttacttaatggcgctgcttctggcaatggcgaacataactacggcattggcaacggaaatggtgatgatgtagatattacctcaccaattacaggtatttttaatttctctggtaactctttctcactcattggcaattcatcttctagttcaattaatactgccccaactacaacgaccaatacagttaatgacaatgacgtgactgataatggaaatgatggaggcggccttgtgggtggaagttctggaaatggctctggtgatggcctgttaaacggcgctgcttctggcaatggcgaacacaactacggtattggtaacggaaacggtgatgatgcagatttcacgttccctctgactggtgtacttaacttttccggcaactcgctttcaggctttggcagttcatctagtgactcggtaaatgttgcccctaccacagcaactaataccgtcaatgataatgacactattgataatgccaacacaggtagccttggtgacggttcaggcaatggctctggcgatggaattttaaatggtgcagcgtctggtaatggtgagcataactatggcattggtaacggaaacggtgatgatgcagactttacacttccatttactggcggcttaaatattctgggcaatgctttatcaggtatcggcggctcttcgaccgactctattaatatttcaccgacaactacttcaaacacagtcaatgacaatgacactaccaacaacggcaacacttcaggtggtgtgattggttctggtgactcaggcaacggctctggtgatggcttattaaatggtatttcatcaggtaacggtgaacataattatggcattggcaacggtaatggcgatgatgttgacgttgtggcccctatcacgacaccaattaatgtattaggcaattctttctcatttattggtggtgaaggtacaggcgatatcttaggtccgattacaggcgttattggtggtattggcggtgatggagatatcttaagcccgattactggaatcatcggtggtattggtggtgatggagatattttaagcccgattaccggcattatcggtggcattggcggcatcggtggggatctgggcgataacccactcacaggtattattcaaagcggtattgacgttctacaaaatttagaaagtctaaaaacaggtttgattaatacaggtattgatacgattgccggaacaattattggtgtgttccctgatgcagagcaccctgtcggtgattttgcagaccttggaaaactacttttcgagacttcacgcgatagtgttaacggtacgcttgaggctatttctgaccttgcaggcgctgaccttgatggcgcaagtggctcgattactggtgtaattgacacccttattaccaatggttcaacggcatctaccattattcagcatattgtaggtgatgaccttgtgactgaaaacggtggcctattgggttcaatcaccacgattattggtggtgttgacagcggcgacggtggtttactgggtggcctagatggcttaattagcattaactatggcgactcagacaatagtaattctgtagacgtagaagatattttaggaaatatcctcggctcgataggttcaaatcaaggtattgctgttggtgaacctgatccaacgggcggtagtttgattcatacgatttcacttaacacagtgaatcagctaactgaccaacttttacatgctttaccgactgtctaa

SEQ ID NO: 639 - DNA, 2163 bp, Acinetobacter baumannii
atacctcttatatttagtcaaagattattaatctttgcttatcttcctgcatcagttaaaatcttccaccttataaatacgaatgagagaatgagatccgtgcgtaaaattttagtcaccaatgccctcccttatgccaatggtccaattcatatgggtcatttactcggttatatccaggcagacatctgggttcgtgccatgcgggcaatgggtcatgacgtgacttatgtatgtgcggatgatgctcacggtacagcaattatgctacgtgccgaagcaaatggtattagcccagaagagcaaatcgcgaatgttcaaaaagaacacatccgtgattttgatggttttggcgtacatttcgatcattatgattcaactcatagtgatgctaacaaagctcgttcaacagatatctatattaaaaaccgtgaagccggaaatattgcagttcgacctgtaactcaattatttgatccggaaaaaggtatgttcttgtctgaccgtttcattaagggtacttgcccaaaatgtaagtcagaagatcaatacggcgactcatgtgaagtgtgcggtacaacttataatgcgactgagttactcaacccgcgttcgactttaagtggtgcaacaccagttgaaaaatcatcagatcactatttcttcaagcttccaaactttgctgaatatttgcaaaaatggacccgcgatgaaggtcgcttacctctttcaattgctaacaaattggatgaatggtttgaagcaggtttagcagactgggatatttctcgtgatgctccttattttggttttgaaattccggatgcgccaaataaatatttctatgtgtgggtagatgccccaatcggttatatgtctagttttgaaaactacatcaaaactaagcgcccagacttgaactttgatgatttctggaagaaagatagtcaaaatgaggtttaccactttattggtaaagacattgtttacttccatgctttattctggcctgcgatgcttgaaggggcgaactaccgcactccaacaggcttattcgtaaatggtttcttgactgtaaatggacaaaaaatgtctaagtctcgcggtactttcattaaagccgagacgtacttacaacatctaaacccagagtatttacgctattactttgcttctaaactttcagataaagttgaagactctgacttgaaccttgatgactttgtgcagaaagtaaattcagatttagtcggtaaagtagttaatattgctagtcgctgtgctaagttcattaacagcagctttaacaatacgctatcaagtacatgtgctgaatctgacttagtacaaagctttattgatgctggtgattcaattgctgctgcatatgaagcgcgtgaattctctacggcgatccgtgaaattatggcgcttgctgaccgcgcaaaccaatatattgatgagaaaaaaccttgggctcttgctaaacaagaaggtcaagaacaacaagttcttgatgtatgctctgtcggtatcaacttattccgtcaattagcagtgtacttagctccagttctgccaactttagctcagcaagttcaagatttcttaaaacttgaaagcttcgatttcgagtcacgtaaacaaattcttgtaagccatgagattgcacagttccaacctcttatgcagcgtgttgatccaaaagctgttgcagccatggttgatgcttctaaagagtctttaggtgctcctgctccacaagcgactaaagcagcgaaaaaagagaaatctgccgagaaaaaagcagcccctactccagcagttggtgaagctgaaattattggtattgaagacttcttaaaagttgacttacgtgttgctcaggtcgttgaggcaggtacagttgagggttcagataaattacttcaactgacgttagacgtaggtgaagctgaaccacgtaatgtatttagtggtattcgtagtcaatatgcgccagaagacctaaaaggaaaattggtcgttatggtggctaaccttgcaccacgtaaaatgcgttttggtatttcaaacggtatggtacttgctgccggaaatggtgaaggtattttcattatttcaccagatagcggtgcaaaacctggcgataaagtttcttaa

SEQ ID NO: 640 - DNA, 1122 bp, Acinetobacter baumannii
aggaagcttatggcaaaaagatataaagttgccacgattgcaggcgatggcattggtttagaagttctaccagaaggtattaaggttgtaaaggcagcagcagagaagtacggcattgatcttcagttagatgctttcgattgggcaagctgcgattactaccttaagcacggcaaaatgatgccagatgactggtttgaaactttgcagggctacgatgcaatttattttggcgctgtaggctggccagataaagtgcctgaccatatttcactttggggttcgctgctccagttccgtcgtggttttgaccaatatgtgaatttacgtccagtgcgcttaatgccgggtgtgaaatgtccattggtaggtaaaaaaccgggcgatatcgacttctacgtggttcgtgaaaatagtgaaggtgaatactcagcgattggcggtaaagcttttgaaggtacagaccgcgagtttgttttacaagaagccgtatttacacgtcatggcgtagaccgaattttgcgttatgcatttgagtttgcaaatcagcgagatgcgaaaaaaattaccgcagcgaccaagtcaaatggcattgcagtgagcatgccgtactgggatgagcgcgttgatgcgatggcaaaacagtatccacaaattcaagctgataaacagcatgttgatattttagcggctcgttttgttttacaacctgaacgctttgatgtggttgtggcatcaaatttatttggcgatattctttccgatttaggtcctgcatgtacgggaaccattggtttagcggcatcggcaaatttaaacccagaaagaaaatttccatcactgtttgaacctgtccatggttcagcaccagatatttacggtaaacaaattgccaacccaatcgctgcgatctggtcgggtgccatgatgttcgaattctttggtgaagaagacgagcgctgtatccaagcgggtcaagatattatgcaggcgattgagaatgtattaattaatggcccaaaaacggccgatatcggcggtcaggcaaagacttatgaggtaggagatgcaattgcatcatgtgtagcccaaactaaaatggacgtattcgctatggaataa

SEQ ID NO: 641 - DNA, 1461 bp, Acinetobacter baumannii
gaagacgatatgtcgagtttacaaagtactgaactatttcagcaacaagcctatattaatgggcaatggctagctgcacagtcgaatgcgactgttccggtgagtaacccagctacaggcgaagaaattggcacaattcctaatatgggagcggcagaggcaacccaagcagttgaggctgcctatacggctttacaaagttggaaagctttaacggcacaaaaccgtgctgatatcttattggcttggcataaactggttctcgatcataccgatgaacttgctttaatcatgaccattgagcaaggcaagcctttagcagaagcaaaaggcgaggttcgctatgctgcatcatttattcaatggtttgccgaagaaggcaagcgtatttatggtgatgtgattccaaccgtaaataaccagcagcgctttattatcagtaaagaacctgtgggtgtggtggctgcgattacaccgtggaatttcccaattgccatgattacccgtaaagcagcgccagctttagcagcgggttgtacggtcgtgattaagccagccaatgaaacaccttactgtgcattagcgattgcaaagcttgcagaaaaggcaggtataccagctggtgtgattaatgttgttactggtaaatctcaagaaattggctcggtatttacttcacatgaaaaagtgaagaagttaacttttactggttcaacgccagtgggacgcttactgatgcagcagtgttcaagcaccattaaaaaattggcgcttgagttgggcggaaatgctcctctgattgtgtttgatgatgccgatttagataaagctgtacaaggcgcgatttttgccaagttccgtaatgcaggccagacctgtgtttgtgctaaccgcatttatgtacatgacaatatttatcaagcttttgccgagaagtttgtacaagaagtacaaaagtttaaagtcggtaatggtttggaagatggcgtacaaattggcccattaattaatgaaaaggcagttttgaaagcacagcagttaattgatgatgcagtgagcaaaggcgctaagattgcctgtggtggtaagcagcatgctttaggacaaaccttttacgaaccatcagttttaactaacgttgaccgtacaatggaaattgtccaagaagaaatttttggtccagttgcgccgctcattcgctttacagatgaagcagatgtggttgctcaagcaaatgacactatctttggtttggctgcgtatgtttatagcgaaaatatttcacgtttatggcgagtgtcagaacagcttgaatatggaatggtcggtatgaatgccactgcaatttcaaatgaagttgtaccatttggcggtgtgaaacaatcaggtgttgggcgtgaaggctcaaaatatggtcttgaagaattcatgaccattaaatacatgtgtttagggctttaa

SEQ ID NO: 642 - DNA, 318 bp, Acinetobacter baumannii
agccaactctttgtagtctggctttatttttgcgcaaaatatatacaaattgaaatatcttttttagcacttaaatatttaaaaagtggtaacttaattaataaaacaaaaagaaatgaggatcacgttatgaaaaaactaatggtgagcatttcggttgtttttttcatcttaactacaggatgtgagatgagaacaacaagtaaacagcaaccttcaaatgaacgggcgatgagtattgctggttctccagtttatgaaaaagactacaaaattcccgatttacaagccaataatcatgagcaatctaattattaa

SEQ ID NO: 643 - DNA, 1698 bp, Acinetobacter baumannii
aatggacgtattcgctatggaataacgccatccaaaaatggatgtatggatatggataatcaaaacacaaaaatttatacggataaatttcttgccgtaaccagcttactgtttgtatttatttcagttgctggtttggcgatttattcgcaagaatcgataaagattgctgcaacgtggatgcagtggacgacatcggtatttacaaccccagtattactgtttgcttttttagccattatttttacttttggtctagcttttagtaaatacggcaaaatcaaattaggtgaaggaaagcctcaatacaccacgatgtcatggatttttatgttcatcttgtcgggtatcgggtcttctacattgtactggggctttttggactgggcctactattatcaaactccgggtttgagcttaccgcctgagtcagcagaagcattgaaatatagcgtggcttactcgttttttcactctggcttaagtgcttgggcaatttatgctttggcatcaatttctttgtgctacagctatcatgtgagaaaaaataaaggcttaagtttggcttctgtgattgaggctgtgacaggctttaaatcaaccggcgtggttggtcgtttagtcgacttaatgttcttgctttgcatgttcggtgcattgacgatttcattggtactcactgccgtgacatttaccaatattttgtctcagctcacaggtattccaaatacctttatgaccaaggtcatcattattttggcagtttcagttctgttcgcactcagttcatatgtaggtatggacaagggcatgcaacgtttaagccatatggtgtgcttgggtgtagtgttatttgcaatttatgtactttgctttggtccgacccaattcattttgaataattcattaatgagtttcgggttaatggcaactaactttgttgatatgagtttgtttaccgacccaatgggtgatggcaagtttactcgtgaatggactgttttctactggttatggtggatttcatatgcaccgggtgtggcactctttgtaacgcgtgtttctaaaggtcgtaccattaaagaagtgatctttgccatggtcattggtggcagtgtcgggctttggttcatctttggagtatttgaaaattacagcgtttatagctttattcatggagctgtaaatgtgccacaaatcttgagccaacaaggtggtgaggttgcgattggtcaattgcttagtctgttacctgccggaaaactcatgatgtggattttcctcggcattatggtggtgttcttggcagcacacatggatgcagtagggtatgcggtttcagcaacatgtacacgcggtttaagtgaagggcaagatccatcgccaaatgcacgtctgttctggtgtgtcatgctgaccttagttccaattgccatgatctttagtaaagcaccattagacaccatgaaaacggcaactattgtgacggctttaccattcatcgtgattattctgattcaaacctatggcttagtgaaatggcttatacaggattatgccaaagtcccatcacatttaattgagcaacaaggttatgatgatcaggaaattggtttaaaccagactcaagatgaacaggcaaaacggatgcagcttgagcttgcaagctcaatcaaactggatagaaaaaccagctag

SEQ ID NO: 644 - DNA, 195 bp, Acinetobacter baumannii
ggagccatcatggccgttcagcaaaaccgtaaaagtcgctctcgccgtgacatgcgccgttcacatgacgctttaaccgagaatgcattaacagtagaccaagcaactggtgaaactcatcgtcgtcaccacgtgactaaagacggtttctaccgtggtcgccaattattcgctaaagcagctgatgctgaataa

SEQ ID NO: 645 - DNA, 1137 bp, Acinetobacter baumannii
ttgatcgtaatgaatataaacgtcgtcaaggtgcgattggcccgagaattacttctcgtgcatttagtcgcgaacgacgttatccgattgtcaacggttggacagcgaatgactgagcagaaaaactcatcaaaaactacagcacttgctcaagcacttttgcttgagcaggtggaatttttcaaaaaacaattatctatagaaaactcacctatttatttccggcaatttattcagctttttatgcaacatgccgacgaaattaaactttatgaagttgtggatttagaacaattacaagccgttgtgaaacgctatgcttttgaaatgcagcttggtgcaggcttgcttgagtttattggggaaattgcacagcgtatttatttatctgccatgaaatctccagttcagctacaagacttggtatccgatcaccagtttgaaatgtggctttccaagtttttggaaatggagcatattccacattatctcaatcagtttttaagaactagcccatctgtccaacagctttgccaatatattgctacttcaaccttagaacaaaaattaccaaaatttctcacagcatctagagtggatgattaccattttgaatggcaacataaactcaaaaaattctcttttttacagcaacaacgtcttgagcataagcttgaaacgtggattgccagctttattcatgaacaactgacagaattaagccttttatcggctgaagatttagaaagcttagtacgtcatatctgggaagatattagacataaaaaaatctatgagtttatgaaacagctcactcctctcgatgttgaggagttctttgttttaatttatgaatactggaaagaattaagacagtcacaatttatgcaaggtcttattttgtatggtgtcgaagttttttatgatttttataaagaccaaagtttatttgaagtattaagtgcaattggtttatccgaaactgacttacaaactgaagctttacgtttttatccaaaagttatggatgcctttaatgaacacggtattttggaaccgttacttcaagcgctcttagctcctttttatcaaagttcaaaaacactcgatataattgaaaaacattttagtgagtaa

SEQ ID NO: 646 - DNA, 1254 bp, Acinetobacter baumannii
tggcaggtaatgtacttggtcagggttataccgcaggcgttggtatgtcgatcggaacgacgtttggtcgaattgccggaaaaaatgccgcccactatgcactttcacaaggagttgaacatgaatgctagtaccaaagccctaattccagttgttcagctctcagaccacgagcaagaagtccaaagagccctacagatttgtaatgcttgtcgttactgtgagtcattttgtgctgtatttgctgccatgactaaacgtcttgagtttaaccaagccgatattcattacctcgcaaacctctgtcataactgtggtgcatgtttacacgcttgccaatatgccccgccacatgagtttggtgtaaatattccaaaagcgatggcgcaagtacgtttagaaacttaccaagagtttgcgacccctcagcctttaggccgactttataagtctgttgggattccttttgtttcggcgttatcagctattttctttttatgcatgttagctgtggtctggtacaaaggcaccgacctgtttgcaggctatcaaggtaatttctatgcgattttcccgcataactttttagcgctactgtttggagcgacctttacagttgcgattgttttgctcggcattggaattagcaaattctggcgacaaacctcaaaagtcattcatagcaaagttaagaaaccagacctagttcaagccacccaaaatgtattaacacttaaatatttagatggcggtcatggtaaaggctgtaatgaacaagatgaccgttatacacaaatccgccgtgtgttccatcacctgacgttttatggctttatgctttgctttgcagctacgggtgtagcgactttatatcactattttcttgacctacatgcgccttaccctatctttagcttgcctgtgattttgggtactttgggtgggattggcttagtgattggaccatcgggcttgctctatttaaatcttaaacgtcacccattacatggtgaccgtgagcaaaaacctgtagatcgaggctttattttccttttaattttagtcagtgcttcaggcttagctctcatggcatttcgtaataccccttacatggcacttttactgattttccatttagctacggtaatgaccttctttattaccatgccttttggaaagttcgcacatggtttttaccgcagtgcttctttactcaaattcgccatcgaagagcgtatttccaagaagtcataa

SEQ ID NO: 647 - DNA, 603 bp, Acinetobacter baumannii
ggtcattcaatgatttcatggctttttattggcttggttgccactattttacttactcctggcccaacaaatactttacttgcatcatcaggagtacaagtaggcctcaaaaaatctgctaaattaattccggcagaagttctagggtatgtgatttcgatttcagcttggggaatgttaatcgggaaagtttctgcaacgcttcctttattacctcctatacttaaattgctcagtgcttgttatattatttttttagcaattaaattatggcacacggcaaatcaacagcttgaactagatcagccaactattcgcccacgtgaattattttgtgcaactttactaaatcctaaggcattactttttgcttcagcgattttccctgttgcagcgtggactaattttcatatttatctcattcatatgctggcttatttagctttaattaccccgattgccttattctggatttttttagggtcagtcttggctgcaaataaagtacgttggttaaatcaatcaaatttacaaagaacagcttcgttggttttagttagtttctcaattccaattagctattctgctttattaaatctttaa

SEQ ID NO: 648 - DNA, 219 bp, Acinetobacter baumannii
tcaatcccaataatttattcgcaatttcttgtgcagaaggttctgctggtgttgctggagctgcttgtggttctgctggcgcggtatttttcttaccaataccttttacaaaatcaaaaagacccattttttagtcctcatattattgtttatagtaaagtcattaaactgacccttattgttatacttgaaaaaagagacacctctgctatcaattga

SEQ ID NO: 649 - DNA, 633 bp, Acinetobacter baumannii
gtcaatacaatgtttgagtcccttattcctcttttttcaattgcgatggcattgatgcttggagcaataagtcctgggccaagctttatttatgtagcgcaaaattcaatatctaaatcacgtaaacatggcttatttacggctttaggaacgggcacaggtgcagctctttttggctttttagcggttatggggttacaggcagttttattggcagtgccttcagcttatctaattttaaaaattggtggtgggctgtatttgctttggcttgcttttaaaattattaaacatgccaaagaaccaattgctatggaaaatgatgccaaatcgaagatgacttataaacaagcctaccgatatggtttgattactcagttaagtaatccaaaaattgctgttgtactagcgagtgtttttactgctttactgccaaaagaaattccaaattattactacgtcgcattaccgctcatttgttttatgattgatgcaggttggtactcatgtgtagcaatgcttttatcttcagagaagcctcgaaaaatgtatttaaaagcaaaaacgggtgttgaccgagtggctggaagcattgttagtgtattgggcttaaagttaatcttcttcaaatga

SEQ ID NO: 650 - DNA, 1869 bp, Acinetobacter baumannii
attatggcaattccacagcatacgattgatcagatcttagatcgcacagatattgtcgatctgattggtcaacgtgtgaaactgaaaaaaaccggacgaacttattctggttgttgcccttttcatcaagagaaaacgccttctttccatgtttaccgcgataaacagtattatcactgctttggctgtcaggcgaacggaaatgctattcgcttcctaatggacattgataaccgaaactttattgatgtaatgaaggaattatcgggtaatacgggagtcgaattaccaaaagataatactgataataaaaaactgtcttatacacgccaagttacaaaaccatcaacaccgcccaaaacggttgctgaaccgactactcaagcacctatagaagatcagtacaatacgtttgaacccgtatattttgatgatccctttgcccagtttgaacagccatttagctttgatgggccagtacaagaaggtaatttgtatgaccttctagaaaatgttgcccagttttatgaacatcaattaccgactagtcaaaaagctaaaaattactttaagcaacgcggtttaagtgaccagactattcagttctggcgtttaggttatgctcctgaagactggcagcatctggaaaaagctttcccttatgatattgagggcttaaagcaacttggtctcatccgttcaagtgacagtggtcgtgactttgaccttttacgtgatcgtgttatttttccaattcgggaccctaaaggccgtgtagttggctttggtggtcgtgcgctcaatgatgaaattaagcctaaatacatcaactcgcccgattcggaagtattccataaaaatcaattactgtatgggctatatgaaggccgaaaattaaaagcaaatgactggttaatggtcgaaggatatatggatgtcattgctttacagcaatatggcattactggtgcagttgcgactttaggaacggcaagtaataccgaacaccttaatatcttatttaaacaaaataaccggattacgattgcttttgacggtgatgctgcaggtcaaaaggccgcacgccgaactttagaaattgcattacctttactcaatgatggtcgcgagctcaaattctttgtattgccaaatgaccatgaccctgactctttaatccgccgtgaaggggtggaaaatttccaaaagcttctacagcaagctcctttactttctgactttgtttttgctcatcttactgggcaacatgacattagtacgcccgaaggtaaaagtcttgttatgggcgaattaagagaattgaccgagttattgccaaaacaagggtcttttcgctatctactaacccaatctttccgtgaaaaattaggcttaggtaagcgcttcactccacaaattagccacgatgcatccctatcttttaatattcaaacgaaagatgaagactttgcaattgcaattttgatgcaccatccgtttctttatattcattttgaaggattacgggcttatattccgcaagatgagttgttggctaaaatattagcaattttaaaccgtatatttgacgaattgcctgatgaccaagaactagctacctactatgttttaggtgcttgtagcacttattgccatgaaattgcagatattatgcaaaggaccaatattcaagccttaactcaagcaccggaagtagcagataaactcgcaaaagaatatgctttaggcttacaagaaagatatttacgtcaaaaactaaaatctaaaatctcattagttgagtcaagaaacttaagacaacaactcaatgaacttaccaaacaaattagcttaagacttctttcttaa

SEQ ID NO: 651 - DNA, 588 bp, Acinetobacter baumannii
acctcccaaatcagtgacatgagtaaacgtcaaaaaattgcagcccataatcgggatgaattactcaatgcagccgaggaatgctttcgtattcatggtattaatgtccctctacaagtcgtgattgaccatgcaggtgtaggtagagcgacgttctatcgcaacttttgtgaccgaaaggctttaattagcgcccttttagagcgtgcaattacacagctagagcaaaaagcagctcattttcaacaattcgaagatggtttatttcgtttaattgaaggacatattgcacaacttcccaagctcgcaattttgcaagatttttggagagtgattgatcgacaagatccaattatgctaaaaatttatgaacggcggaataatgcacttaagccactgattgaaaatgcaatagaacaaaaactgtgccgagctgatctaactgctgatgactatgcaatggtcacagcaatgttgggttcttcatttcaaggacatgaacctgaagaacagacccgcttagcgaaacgagcaattgaattactatttcatggtattcaagtacaaaaaattcgagggatagaatga

SEQ ID NO: 652 - DNA, 591 bp, Acinetobacter baumannii
aatgataaaatagaaaaaatcgctcaaaatattaagcttatgtctttgcctgaaaaacatctttctattgtctatcacagtccctatggtcacactgcaaaggtagcgtctgctatcgcaagtggcgccgaagtgatgggcgtcaaagtacatgtgatgaatattgagcatattgattgggatgttttagatgcctcacagggcattatttttggttccccaacttatatgggaagcgtaactgccgattttaaaaagtttatggatagtacatccaaacgttggaaaaatcgtttatggcagggtaagttagcagcgggttttgcaaattcgggcggtttaagtggtgataaactggcggttctgcaacaacttaacatttttgcgatgcagcacggcatgttgtggtcaggtttacctttaatgacaacaggccatactgaaaccgatttaaaccgtttatcgagctgtttagggttgatgactcaatcagataatgcacctgttgaaattacaccgccgcaaggtgatttagatactgctaaatggtttggtgaatatattgctgggcttttatatagattaaattag

SEQ ID NO: 653 - DNA, 1242 bp, Acinetobacter baumannii
tatatgccctttttaattttcacgactaatcgagaacttcttatgtctaacagtcatgtcgatgtcattgtcttaggtgcaggtgcttctggactcatgttggctgcacatgctgctaaacggggacgttcggtcttaattttagaaaaagccaataaaattggtaaaaagattttaatgtcagggggtggtaagtgtaactttaccaacctttatgtagagcctgacaactatatttctcataatccgtactttgtcatttctgccctatcacgctatagcaattgggactttattggtctggtctgtgattatggaattgcctatgaagaacgtaaacacgggcaattatttacgctaaacggcgctaaagaaattttagagatgttggtaagtgagtgtaacaaaacaaacaaggtcgaaatccagacccattgtgaggttggacaagtcgatccattagaacaaggtggtttttcagtacacaccaatcagggccgttttagctgtgaatcattagtggtggctacaggtggattatccatcccaactttaggtggctctggttttggctatgaattggcacaaaaatttggacatacagttttcccaacccgtgctggtttagtaccatttactttttcagatcatattaaagaagttactacacgcctaagtggtaatgctttagatgtgactctaactaactcgaagaatagctttactgaagcattattatttacgcatcgtggtttgagtggtccaagttctttacagctttcaaactattggaatacaggtgaaagttttaaaattgactttttcccgagccaagatttagcaacttatttaaaagataaaaagaaagcccaacctaaagttttactgcgtactcttctaaacgaatttacggcaaaaagtattgtacaagaattacaacaacttatatggccagagcagagcgagacaccaattggtaatatcagtgatgcacagctagatcatattgccgagcagctacatggttttactgttaaaccatcaggcacagaaggatatcgtactgctgaagttaccttaggtggaattgatacaactgaagtttcatctaaaacactcgaaagcaaaaagcagaaaggactattctttattggagaagtacttgatgtgactggccacttaggaggctataacttccaatgggcttggtcttcggcttatgcagcagcacaatatgtttaa

SEQ ID NO: 654 - DNA, 585 bp, Acinetobacter baumannii
atttgtagaattgccgccttaattatgtcagcaaatacctttccggcacagattgagccgtttaaatgggctgaacaaggctttacatggtcaggtcaactgccattgtctcgctttgctcgtattgctcgtgaagctgttgggtcaattgataaccaattgatcaacatagactgtaagctatcaatggatgcctatcatcgcattgtgtggttagatggtcacatggaaacaaaagttccaatggagtgccaacgttgtttggaacctgttgaaatgccaattgtttctgactttcatattgcacttgtagatgatgagtcactgatagagcgcttggatgaggatgctgatttcatcgttttaggtgaaagtgagtcttcgacaaaaggtgattttgatacacctgcctcgatcaacttactcgcattactagaagatgaactgttattgttgatgcctttatctcccaagcatgatgcttgtgaacataaacatcaacctaccattcagaacgttgtcgaagagaaacgggataatccgtttgatgttttggcaggtttgaagggtaaacttaactcataa

SEQ ID NO: 655 - DNA, 882 bp, Acinetobacter baumannii
gtttttggaatgattgaaagaatatcgctgaattcactaaaatttttctactttgtggcgaagtatggcagcgtgactttagctgcaaagaaattatttgtgacgcaaagtgcggtcagtaaacagatttataacttagaagaagccttaaatacggctttgttcgaccgaaaaaataaaacacttgtgatgactaagcagggtgagattttattgagttgttgccatcaagtttttggtcaactcgatgaatgtttaatacaactcagccaacccaaaaccgaaaacaagcaactggttttgtcgtgtgaaccgactctttctatgaaatggctcataccacgattatcaaaatttaaaaagctcggtcatgattttgaggttgtgctactcacagcaggcggcgtggtcgactttgaaaaagataatattgatatcgcgatacgccgaaacgactttgattggggagagcatatttatagcgaaaagattgccgatgaatatatcgctctagttcaagcaaccaagccatcggaaaccaacgacttactcatttcgacctctagaccgaattttttcaaaaatatcactcgcattgctgagttaaagcagagcttaaaaggctacaccaaaattgaactcgagcatttttatttatgtttagaaggctgcttggctggactcggcgcgacagtcatctcaatttatatgattgaaaaagagcttgagtggaaggtactgcaaaaaaattcaccagtcgttcaagatggttcagcctattttctactttctcatagtacttttgaggaggatccacgcaaaaccatatttttagaatggctaaaagcagagatgaatgagagtcaacataaattgctctag

SEQ ID NO: 656 - DNA, 1431 bp, Acinetobacter baumannii
gggcagctgatgccatactcacttcgtgaattttcattttctacctccctgaaattttttctcttatttaccatcattattacgttatgttgctttattggaattgcatctcgtcctcttagttttcttgcttttttctggcctgctaactcggtatttctaggcctattgcttcgatttccacaaacacgccaaataggtagttttgctggtgcttttaccggttacatggttgccgatttagttaatggcacacctctttttctcacccttattttaacgatatccaactacctgtatgtagtaacgactttagcactcgcaatattgtttaatcgccatataaaagcagcttatcaaggctattcttatttactcttattcgcactatgcgggattggcagcataaccggtgctttttttgcagcaacttttgtgcctatgtttaacaccaaatttatgattggtagtttttgggccgaatttggttattgggttacatcagagcttcaaaatgccttattgttgctgcccattattttaaatatccctccttaccttaaaataaaaacccaccttaagggtaatcgtatatatatcaaagcgattgattttttgcctttattcgctgttttaatttcgataggagtaagttattacgactcgggtccaggttccctactctaccccatcgccgcattaatctggtgcgctatccgctataaaccgattattgttgctctcattacatcctttaccagtgcatatattatttatcatgtctcagggcattatttattactgtatccgcaagactatttaagcaataacatttctatacgtatagggctgatcatgatgacggttgcgccacttactgtttccagtattagcgcactccattctgaattaattcagaagttacaacatgcaattgcccatgatgaactcacctcaagtttaactcgacgccaatttttacagtcagtccgcttactccaagaaaaagtacaaaaggaaaataagacctctgcattttttatgttggacgtcgatcattttaaaaaagtgaatgatagttatggccacttaattggggatagagccttacagacctgtgtaacgaccatacaaaatattttacatcctcatgacttactaggacgttttggtggagaagaattcgcaatttttattccggataccaccagagaggctgcctttgaactcgcggaaagaatacgcattcaaattagtcagcaaccgatttatgtatatggcaaattacccatctttgtgcaggtaagtattggtattagcttatattctccaagctatcaccgttctattgaaagtttgtttaaagaagcagacgatgcactctatcaagcaaagcgccaagggcgtaatagagtttttatttctttgtaa

SEQ ID NO: 657 - DNA, 516 bp, Acinetobacter baumannii
cgcaaaatgatgattctgactgataaaaaaccacgtgtgaatgttgaagggattttgactgctgaagaaatccacgaaattgaacatcacattggtcactatccatacccacgtgcagcttctttagatgcattaaagtgcgtacagcgccgtaatggctgggtagatgatgctcaaatgaacgccatcgcacaattattaacgatcagtgttgcagatttggaaggtgtagcaacgttctacaatcgtatctatcgccaacctgtaggtcgtcacgtaattttgctttgtgactcaattgcttgcttcttgatgggtgctgaaacacttgctgaagcattccaacgcgaattaggtattcagtttggtcaaacgacacaagatggtcgttttacgctgcttccaatttgctgtctaggcaactgtgacaaaggcccaacgttaatgattgatgaagatactcacggtttagtagaagtgacatcaatcaaacagttattggagaagtatgtatga

SEQ ID NO: 658 - DNA, 621 bp, Acinetobacter baumannii
gggaacaagataatggcagagtttattgcggttattttaattacgattttggcggtggttagccccggagcagacttcgcgattgtgactaaaaatagttacttgtacggtcgaaaaataggtgtgtttacttcacttggaatatcgcttggcgtgttggtgcatgtgacttatacgttagtcgccgttacctttgtgatgacttatacgccgcaaattttgaatattgtgaagtatattggcgcgctttacctgatctatattggctataaaacttttactcaaaaaccagttttagactctgctgcattaaccgctataggtacttttcaagccataaaatacggcttttttaccaatgccctcaacccgaaaaccacgctatttgtgattagtacctatacacaaattgtgagcttaactacgcctaaaaccgttcttttggcttatggcttctttatgtcttttgcccattttgtatggttttcactggtagctatgcttttctcttcaatgctgttgagacaaaaaatgttagccaagcaagtacagattaataaggtgattggttcactcttatgtgtcttaggcgtgattctgctttttactaagtttcagtag

SEQ ID NO: 659 - DNA, 1899 bp, Acinetobacter baumannii
gatgcgcggatgagttatttatatctaacagtattatttccgctaatcggttttattttattggcggctgggcgtgataagctctctgaaaatgttgcagcaattattggtgtaggttctgtaggtttatctgcattatttgcattgattgctggtatggcatttaccagtagcggccagcaagtttttgttcaaaatctttggacgtggtttaatgttggtggtttcgcgcctggcattagcttacatttagatggcttatctttactcatgatgggcatgatcacgggtgttggtttcctaatccacatctttgcatcatggtacatgcgtggtgaagaagggtatgcgcgcttcttctcttacttcaacctgttcgttgcaagcatgcttttgcttgtgttgggtgacaacttagcgttgttattcttaggttgggaaggcgtaggtctatgctcttacttgctgattggtttctattatgcaaaccctgcaaatggttgggcagcgatcaaagcatttacagttacccgtgtaggtgacgtattcttacttatcgctttattcttgctttaccaacaatttggtacgcttaatactcagtatatcgttgaacacgcagcagaagtaatgacgaagagttcgtcacttaccatctggactgcattaatgttgttcttgggtgctgctggtaaatctgcacaaattccattgcaaacatggttagcagatgcgatggcaggtcctacacctgtttctgcattaatccacgcagcaacaatggtaacagctggtgtgtacttgtgctgtcgtctattcagcgtatttgaacttgcacctgaagtgatgcaattcatttcggtaactggtgctgtaactttattagttgcaggctttgctgctctcgtacaaacagacatcaaacgtattttagcttactcaactatgagtcagcttggttatatgtttatggctgtaggtgctgaagcgtatcaagctggcttgttccacatgttggctcacgcattcttcaaagcattattattcttgtcttctggtgcagttattcttgcttaccatcacgaacaaaatattttcaaaatgggcggtttgttctacaaaaacaaattcttatttgcatgttttgcgattggtggcggtgcattagcagctatcccattcttaacaatcggcttcttctctaaagacgcgattctcggtgaggtttgggtacaaggtcaatcgattgctttatataacagcttatattgggctggtgtagcaggtgcattcctgacttcaatctataccttccgcttaatctgggttgtattcttcggtaaagaaaatacacattaccatgagattaaaggtgctacttactgggctccattaggtatcttggctgtattgtctacttttgttggtgctgcattaaaagctccagtagcaaatattttgaatacagcaaaaattcctgaattccatgttgctgaacaatttgttgaaggcatgcatggggcagagcatttagcagtaggtatcgcgcttgttggtttagctgttggtattggtctatttgcatttgcttacggtgcagtaaaatcatttgcaaaaacaagtcttggtgctggcttagctcatatttgtcgtactgcatttggtttcgatgcgttgtatgacatcgtttttgttaaaccttatttattcttcgccaaactatttggtcgtgatccgattgacagcttatggcttgttcttcctgcgcttgttaaaggcggaaacagtttcacaagctcacgtcaaacaggttcattgcgtgaatacgcatcaagcatgtcactcggtgtagtggtgttattgatgatcttgatcgttattcaggtagtggggaaataa

SEQ ID NO: 660 - DNA, 531 bp, Acinetobacter baumannii
ctattttttgttttgcaatcatttttaagtttgcccataatagactcatacgataggagatttattatgcgtggcaatccagaagtcatagactatttaaatatgctcattggcggagagttggctgcccgtgatcaatatttaatccattctcgtatgtatgaagattggggcttaaacaagatttatgaacgtattgaccatgagatgcaagaagaagcgtctcacgccgatgcgattattcgtcgtgtattatttttaggtgccaaaccaaacatgcatcgtgaagatatcaatgttggtacagacgttgtatcttgcttaaaagctgatttagcacttgaatatcatgtgcgtgaaaaattagcgacaggtattaaactttgtgaagaaaaaggcgactacatcagtcgtgacatgttacgtcaacaattatcagatactgaagaagaccatacttattggcttgaaaaacagttgcgtttaattgaactgattggcctacaaaattatatccagtctcaaatttaa

SEQ ID NO: 661 - DNA, 645 bp, Acinetobacter baumannii
gtaacatctgtggccattcaagaaattcgtcacccacttattcgtcataaattaggtttattacgtcgtgctgacatcagtaccaagaatttccgtgagcttgctcaggaagtgactatgttattgacatatgaagcgacgaaagacttaccagttgtggattgtgagattgaaggttgggctggcaatgttactactcagcgtatcgcgggtaaaaaaataacgattgtaccgattttgcgtgcaggtatcggtatgcttgatggtgtgcttaacctaattccaagtgcaaaagtaagtgtgttagggcttgagcgtgatgaagcaactctagaagtacgtacttactataaaaagttagtacctgatgtcgctaaccgtattgccatgattattgatccaatgttggcaacaggtaattctttagttgctgctattgatgtattaaaggcaagtggatgtaaagatatccgtgttatggtgttagttgcagcacctgaaggaatcgcgaaagtagaggcagcacatcctgatattcagctttatactgcatctattgacaatggcttaaatgaacatggttatattgttccaggtttaggcgatgctggtgacaagatttttggtagtgttcaaaaagactaa

SEQ ID NO: 662 - DNA, 300 bp, Acinetobacter baumannii
ataatacctgtgagtgggttatcgcccagatccccaccgatgccgccaatgccaccgataatgccggtaatcgggcttaaaatatctccatcaccaccaataccaccgatgattccagtaatcgggcttaagatatctccatcaccgccaataccaccaataacgcctgtaatcggacctaagatatcgcctgtaccttcaccaccaataaatgagaaagaattgcctaatacattaattggtgtcgtgataggggccacaacgtcaacatcatcgccattaccgttgccaatgccataa

SEQ ID NO: 663 - DNA, 936 bp, Acinetobacter baumannii
ggttgtgctgtcatgagtgaaaaattgcaaaaagtattagcgcgaatcggattaggttctcgccgatatatggaagaggttattgccgcaggacgcgtgagtgtgaacggccgcgttgcccaagttggcgagcgcattgaaccaggcgatgaattacgcattgatggccgtaaagttcagttccagatcgaagatgaaattcgtcgtcgtgtactgatttattataaaccagagggtgaaatctgttcacgtaatgaccctgaaaagcgtccaaccgtatttgatcatttgccacaaattgcaaatgaccgttgggtaatggtaggccgtctagatattaacagtacaggtttattactttttacaaacgatggcgagcttgctaaccgcttaatgcacccatctaatgaaattgaacgtgaatacgctgtacgtgtaatgggtgaagtaacaccacaattacgtcaaaacatggtcaacggtgtagagcttgaagatggccctgccaaattcgaatctttctctgaaattggtggtgaaggtattaaccgctggtatcaagttgtagtgaaagaaggccgtaaccgtgaagtacgccgtatttttgaatcacaaggccttaaagtaagccgcttattgcgtactcgctacggtactgtcattttaccacgcgaattacgtactggtcgctggatggaactcgacaaaactgacatcgacaacttggcaaaatctgttgagttaaaaccacgtcaaggtacaggcttatttggtatggcaaaacgtcgcaccgaacgtatgacagaaaagccaatggcagcacgccgtggtggttacttacgtcagcaacgtcgtgatgatgaaaaagaagcgccagctaacacaggtaatcagcgcaaatcgactggttttaaccgtggatttaaaaagttctaa

SEQ ID NO: 664 - DNA, 1230 bp, Acinetobacter baumannii
atgaaacgtgttgtaatcactggtatgggtattaactcatgtatcggtaactctttagaagaagttactcattcacttaaaaatggaatctccgggacacgttttaacccaacttatgctgaactcaattttaaaagtcatgtcagcgctgcggcagaacaagattttgacaatattgatcgtaaattaaaacggttcatgggcgtatgtgcaatgtacgcttataactctgctgttgcagctgttgaacatgctggcttaaaagcagaagatttagcagataatccacgttatggtattgctggtggttcaggcggtggttcaactgcttctgttgtagaaatgactgagcttttagaaactaaaggtgctcgtaaagttggtcctttctttgttccacgtaacatgacaaatacaatcactgcaaacgtgggtgtagcatttaaacttcaaggtattgctcactcaattgcaagtgcttgtgcaacttctgcagacgcaattggttatgcatataaccttatcgctctaggcaaacaagatcttatgctcgctggtggtggtgaagaagatcactggtctcaaagcttattgtttgatgcaatgggtgctttgtgttctaaatacaacgacacacctgaaacagcgtctcgtccatattctaaagaccgtgacggtttcgttattgctggcggtggcggtttcgttgttcttgaatctcttgaacatgctcaagcacgtggtgcaaatattcttgctgaagttgttgcttatgctgcaaacagtgacggtgctgacatggtagctccaagtggtgaaggtgcaactcgctgtatcttgatggctcttgaagaagcgaaacaacacggcgtagataaaattgactatgtaaatacgcatggtacttctacaccagcaggtgacgtgactgagcttaaagcaatggaacgtgctttcggtgaaggtaaagttccaccacttagttcaactaaatctatgactggtcacagcttaggtgctgctggtgttcatgaagcaatttactctgtattaatgcttcaaaatgactttatcgcgccaaacatcaacgtgactgagcttgatgaaggtactgaaggctttgatattgtgcttgaaaaacgtgatacaaaattgaatactgtaatgagtaacagttttggctttggcggtgttaacgcttgcctaattttcaagaagtgggatgcataa

SEQ ID NO: 665 - DNA, 849 bp, Acinetobacter baumannii
aacatcctcgtactggtgaagaaatgttatttgaagcaccatggcctgaagattttacgcagttggttaatgttttacgtacagaaaacgctgcatattaaggactggtatatggaatttgttcaaggtttacctcaaggcgtattcgtagggcagacacgagttcaacaccctttggcattgccaacagagctaacagagctaacaggttttaatcttgctttgcacgttaaagacgaagctcagcgtgtccagcagcatcggatgatgctgttagatgaatttgctcagtttggggttaaaaaaatgacatggatgacccaaacacatagcacgatttgccatacagtaaatgaacaaattccctttacagctttaattggcgacggcttgattacgcaaacccaaggtcatgcgttaatgatgatgacagccgattgtttacctgtcgtgcttggtaatgctgaaggtacagaaattgctaacttacatgcagggtggcgaggtttaccgggaggtattattgaaaatacagttgctgcaatgcagagccctccaacatgggcatggttgggtgcagcgattagtcaaccttgctttgaaattggagcacaggtaaaaactgctttttgtagtaaatatcctgaattggaaactgcatttattgatggggcagccccaaataaatttcatgctgatttgtatgcaattgctcgttttatcttacagagcctaggagttgaaaaagttttagggggagatcagtgttcataccaacagcaagatgaatatttttcttatcgccgtgatgctaaaactggccgtatggcaacttttgtttttatgtag

SEQ ID NO: 666 - DNA, 210 bp, Acinetobacter baumannii
ctattgtcagtttgctgcacacttgtggcaaaaggcccaattctccatgcccacaaaatcactaaaataccgataataagcacacccaacatccataatagggttgagcgttttgtcggaatcagtttacttgcaggtgcaggtgcaggtgcaggtgcaggtgcaggtgcaggtgcaggtgcaggcgttggctcattattagatgtttga

SEQ ID NO: 667 - DNA, 594 bp, Acinetobacter baumannii
ttaaacacagtttgtaaagaccgacttcatagttctggcattgtttgtctaagccaatttcttcatgttcttataacacttaacaaggatgttgaagacatgaaaaggtcattattatttttaggaattctaagtttaactgctggagcacaagtctctgcagctgatttgagttggggtgatccaactttagattcgggtcaatttaaagtgtctggcgcagtacgttctcgttatttacataaagattatgtggtcggggcgaatgaaggttcccaaaatgatgactggcgacttactgatattaaattagtgttgggttatgaaaacccaaactggattgcaggagcagatgctcgctgttatcaatatgatcgcttgtgtgatgcgatttttctaaaaaaagcttgggtagggtataagttatctgaccaacaaagagtcacggcaggtttgcagcctgttgattttggctttggtgaattttggggaagtagttattacgaaacgcttttaaataccgttggtttagaagatattgataatctggggattaaatataaatttgcagatgacaaatacaatttaacttag

SEQ ID NO: 668 - DNA, 573 bp, Acinetobacter baumannii
ggggggaaagtaatgaaaaagcatttctctcttatgcttgcagtagtcactgtattatttcttgcaggtttagtcatgaaaaatgaatggcacttgcatcaaagtaaaagtatttttattaagctgaaaccagttgatcctcgttctattttacaaggagactacatggcgctggcttatgaattaaatttacaatctctcaaagctctgacaggaagtgaaagtgaagctttagatcaggtgatttttaatcatgcttctgttccagcaaaagttattttagattcacgaaatcgagtgatccgtacggttttagaccctaaatctttatctaacgagcagaatttaattttaaaaaatccggacaatcactatcaatctttgtacccagcttctcgcagtttcttatttgccgaaggcttagctcattgctatgaaaaagcgaaatatgctgaatttaaggtaaatacaaaaggagaggcgattttatttgatttacgtggagaagagctacagcctctaaattgtaaacagcaacagagctggtggaagggaactgtcagaagtttataa

SEQ ID NO: 669 - DNA, 957 bp, Acinetobacter baumannii
ttaacaaaggtcaaagtagaatttgccgtggaacttaaacaattaaagtattttattgcagtgatcgagtcaggaagcttgggtaaagctgcaaaaaatctcgatattggaacgtctgcattaagtcagcaaatttcaaaattagagagcgagctttctattcgccttttacagcgtaccgctttgggtacggttcccacccctgcgggcttagctttttttcaacaggttcaactggcacttagacacctagaccatgctgtagactctgcgcactcctcacgtttaagtggtcacgtcaccgtcggtttttcaccgagtgttgcggctgttataggcacgcattttttaaatctcatgagaaaccgttatccagacattaaagtccgtttaatcgaaggcttatcgggtgacttaaaagctttagttaatgcaagacagctcgatgtggctatcatctttagtgatgatgtcgacccacagtgggccatacaacctttagttaaagagcaaatgtttttaatctcgcctaaagaagtgctgagtcagtacgaccttgaaagctgtatcgacactcaaaccattactcattcgcagcttaaagaacttcccctgattttaccgagccaacgacatggactgcgcttgttgcttgaacagaaaattcatcaacttagagtggcctatgaaattgatgggttgcatttgttaatggaaagcattagccaactcgaaatggcaaccattcaacctgcgggtgcatcgttaaactcacggcaagacctgtgtttactgcgcgttgtagaacctgctattgagcgtattaactatttaattagtctctctgaagaagagctctcacctgccaccttagccacaaaagtggtgattcgtgcctgtgtggcaaacttgattaatgaaaagcgctggcccggtgcggaactcataaacacttaa

SEQ ID NO: 670 - DNA, 960 bp, Acinetobacter baumannii
aaggatttatttatgcgaagaagtatcccgtccattcagggtctaatttgctttgaaagtgcagcgaaacatctaagttatacctatgctgcgcaagagttatgtattacccaaagtgcagtctcgcgccaaattcagcagttagaagatttcttgggtgttgaactctttatacgtactcggcatggcgttgaactcaccattgcaggtcagcagtattttaaaagcattaaaccctatttgttagggctagagaaatgtacagccgatgtgatttctcataaaggtttaggtggaacattaaagttaggcgtggtgcctacctttgcaacgcgctggctgttacccaagctccatcttttaaatcaaaaacaccctgaaattacagtacatttagaaaccagtaccaaaccctttttatttaatgacaatatttttgacgctgcgattttcgcaggtacgcagcagcaaattgaccattggcccggcatacaagcacattatttaatggatgaagaaattgtacctgtgtgctcaccaaggctaatcgaaaagtattttccagatgcggtcatgattaatgaaaatacctatgatttaagcccagaagatctgctgaaaatccccctacttcaacaaaccactcggccaagcatttggcaagaatggtttctcactcatcacatgcagcaccctaagccttttgatggacagcgccatgagttattttcaatgcttgcggttgctgccagtcatgacatgggaatggctctaattccgcaaatgttgattgagtctgaactacaaaaaaaagaactagtgattgtttccaataaaaaactaaaaggcagccgaaagtactatctcattcactcaagccaagacatctcaccgactattcaaaaatttgttgagtggatttaccaagaactagaacaactaaagagcaatacaaattag

SEQ ID NO: 671 - DNA, 561 bp, Acinetobacter baumannii
atgaacttatttactagcaaaactatgttcactctcaacgcttttaaacttgtcatatatcgacaatttattattttcaccctttttatatttcgtcacttaaaaagctatccaattcgatttcttacacctgaagaaaaagctttagcacaaagggtgtttgggagtttgctagattgtgaacgtcctaaaattattgctactcgttacttaccgtggcaagcgcatggaattttgatggctccaaatgggaatatatacgtcaatctttctgactacagcagtaattacgcgctagagtctaaattcatacaagggatttttattcatgagctagctcatgttatgcaataccaacgaggtattcatgtattactaaaaggtgcgttattacaatccgcctactatctgagctttaaatattacaatccttataaatatacttatcatcctcagaaagcgtttagttcttacaatattgagcagcaaggagaaattgctagagatatctgttcaggtaaactgccaaatatcatttgcttacctcgacttgatttgtaa

SEQ ID NO: 672 - DNA, 183 bp, Acinetobacter baumannii
atttcatcattttcgccagtagaaccaaacggtttatttactggtggttgtgatggatttacttgtgcagaatcagctggttttgcatcagatgaaactgttgttgatggtgcagttgtagtcgttgacggagttgaaaccgtagacgaactacctgttgtcttattattagtaggcggttga

SEQ ID NO: 673 - DNA, 945 bp, Acinetobacter baumannii
gcgaatacatttattatggaaatcaagcaaataaagtattttttgacggtcgttgaatcaggcagtattggaaaagctgcccaaaaactcgatgtgggtgcttcagcgattagtcagcaaattagtaagctcgagcaagagttaagcattcgcttattacagcgtaatgcttttggtgtgactccaactcctgctggccttgcctttttaaagcactctcaacttattttgcgtcaagtgaacttcgcggtagatgctgcacattcagcacggctttccggtcatgtcagccttggttttccaccgaccattaccgctttaattggcatccctttaatgaaactaatgtctgaacgttatccagatattcgtttagagattgtggaaaccctgtcggggaacctgattcagtcgattaattcgcgtcagcttgatatcgccattatttttaccaatgaaattgataaacagtggtcaattcaacccttggtgcgcgagcaaatgtatttaatggcacgcaaagaagtgctcgaaaaatacggacttagcgaatgtattaaaagtggaattattcagtcgcagcaaattggcgatattcctttagtgttgccacgtcagcgtcatagcttaagaaaactgcttgagcacaagattggacagctcaatgtcgtctatgaaattgatggcttgcatttgcttatggacagtctgattcatcttgaccttgcgagtgttcgtcccggaagtgcttgcttacaagagtataaacacaagctgcaattgcttaaggttgtcgaccctgaagttgaacgaattaactatttggtgagccttgccgaagaagaattatcacctgccgcacttgctgccaagtcagccattaaggcatgtgtgaaagaattgattcaaaatcagatttggccatgttctgaaattattttataa

SEQ ID NO: 674 - DNA, 618 bp, Acinetobacter baumannii
atactcgcattccggcccatgtcagaaacacttccagacccacgcaaacgcccacgtcaagcacgctcagtggctacctttgaagcaattttagaagcggctgctcgcattttagagtctttaggctttgctggatttaacacaaatgccgtggctgaacttgctggcgtaagtattggtagcctatatcaatactttccatctaaagatgccttaatcattgagttaattcgacgtgaacgcgccaagctttcaactcatattgttgaagctatacagcaaaatgacgccgcagacttaaaagaaaaactaaaactcatcatacaggctgctgtgcaacatcaattgagccgcccacagttggcacgaaccttagaatttgcttctgaacttattggaaaaaacagtgaggaaagtgagcatcagcacgagcttgaaaccataatttctgatctgtttatatgttctggtatttcacatccgcagacagccgcacaagatgtaattgctttaagtaaaggaataattaacgcagcaggcatagcaggggaaagcaatttaaatgatttacagcagcgagttgaaaaagctgtatttggttatttagatctggattaa

SEQ ID NO: 675 - DNA, 708 bp, Acinetobacter baumannii
caaatacaatttaacttaggattcgatccaactgatggaggaaattataaggggacatcaaaagactcaagccgatatagtggtaatttcgttgaagctgatgatttaactacaggaaccaatattgaagaaaaaaatatgtggattgcgcgggcctctagaaaatttgagcttgataaagctcaaaaattttcgaccgagttaggtggttcagtttggtattcagatttagaaaataaaagaacagatgaagatggacaccgcaaatcatggaatgtatttgctcaaacgcaatatcaagcatggcaatggatgttcttagcaggtaagcaagatgtcactaatggcgataatttattgccaaatagctcaaccattggagcatttgattacccgtatcaagttgctaacaaaggaaaatatctggtcaatgaaattaactatacctttgctcagccattccacaaacttgaaaatattaagccctatatctctcatagccgctttttcaaagatgaggatggatataaagactctgagcgtttaattgcaggcgtttattttaattacaaagccattggtattcagggtgaatatattatgagtaaaaacgatccaatggtaggtggtggggcgaatggccttgcacaaggtagcagtaatgattgggataaactgttttatctttcaattggatattatttctaa

SEQ ID NO: 676 - DNA, 1689 bp, Acinetobacter baumannii
attactatttcatggtattcaagtacaaaaaattcgagggatagaatgagtaaaacgcctcgttatttagaaacgccacctgattggacaccagaagaacaaccgactttacctggttcgccagcagcgattgcgcattctgtacctaagcgatttctttatttttttattggtctgtttgtcgctatttcagcaagctcaagtaatggtttcattacggcaaatttacccttaattcaaggtgagtatggcctgacgccttctgaagccgcttggcttcctgctgcttatgtaatggccaatgtcagttcgaatctgattttgtttaaagctaggcaacaatatggtctgagagtcttttcagaaataggacttgttatttttattgccgtgctggttttgcacatttttgtgcatacctatgaaatggccttgttcgctcgggttgtggcaggtttagctggtgcaccactcagctctttaggtatgtattacaccatgcaagcttttaaaaaagccgacatggcaaaaggtatatatattgcctttggttttcagcagttaggtgtaccgctcgcctggattatttccccttttctagtgagcacagatagttggtctgttctttacacctttgaactcggcttagcgctttgttgtttagcaatggtggtttctttgaaattaccacgtagcttacgaatctatgttttcgaaaaacaggatttcttcacctttgctttactggcgccaggttttgcatgtctatgtattgtgctgacacaaggcccaatcttgtggtggtttaacagtgaatggcttgcttatgtattaattgcaggttttagcttagttgttttaggtttgctctatgaacattatcgtgccaatccattaattatgacacgttggttaggcgcctcctcaaccctacgctttatctttggtgcttttgccattcgtcttttaatgtcagaacaaagctatgcagccgttaacttcctaaaaactatgggaatgggtccagaccaatttgttccactctatgtggtcatattggtggggattttaagcggaactctatttagtgcgcttactttctcgcgtgaacgaattatttttcacttactttttgcagagtttttgattctcattgcctgtggattagattatcaccttacgagcgatgtacggccttcaaacttctttgcaagccagtttttagtaggctttgccggcggcctgtttatcggtcctttacttctaattggatttgcacaaactttggctaaaggtccttcgtatgtagtgacttttattgtcttattctctgcaacccaaacatttggtggccttgttggctcatctttcttctcgacctatcaacaacatcgtacacaaaactatcaagtcgagattattaaagatttggaacaagccgacccattagttgctcaaaggctttctacctatcaacgtagtgcagccatcacaacaaatgaccccgcattacaaacagctcagtctatgcgctcacttaatcaagtggttactcgtgaagctcaggtccgtgcctacaatgatgtgattgcattaaacggtatttttgccgtcgccttactcttatggggcggatttaatattgcacgtagtaaatacctacaacgcagaggaattagccgcccttaa

SEQ ID NO: 677 - DNA, 771 bp, Acinetobacter baumannii
tatataatttccataaatttgtctttgagcgtgcatatgaagttacaaaataaaattttattgattacaggttggggagtaggaatagaacctttgcacgcgttaaaattaggtttaacgaaagctgggtatgacacgcaacttattaatatttttaatgttttaagttgtgactttcacgagcagcttgattttttaactgatattgatgtggttgtaggttggtctttaggtggacagttagcaacatatctggttgactttttttataaacaaacgggccaaactaaaacgttaattacgcttgcctctaatccttgttttgtagctaatacctcgtggcatactgctatgcctgctgatgtatttagtcaatttaaagcttcctttttacagaatccccaagctactttaaaacgtttttattatttaattacacttggctcatctcaggcaaaacaagattggcttagcgtacaaaacatagcaaatccgcccacaaatgaactgttattagaaggtttgcaaatgcttgagcagctaaatttggtagataacttgaaaacctattcaggtcgacagcttcacctgtttgctgagcaagataatgtcattccttgcaaaattatggaaaattttaaagatatagcgacagaaaacatgggttataagctattaaaagatgctactcatgcttttccctacttacaggtagagaggacaattgaagaaatctgccaatttttaacaattcatcagcaaagttcataa

SEQ ID NO: 678 - DNA, 192 bp, Acinetobacter baumannii
atgatgatttcagaaaatctcttaaaaactgagaaaaaactaaatcagatttttgaaattcatcaaaaagttcttcatttgccactctatgatttatatcaattaacttatcacatatatctaattttaaaatttgcttataaggatttttacctaagtcagattttaccactaataaagctttttctttaa

SEQ ID NO: 679 - DNA, 972 bp, Acinetobacter baumannii
aagaaggattctaatatggcgagtcattatgaaatgttcccagcggttgttactcgtgtggaacagctaacccctttaatcaaacggtttacgttcaaacgtcaagatgggcagaactttcctcgatttagtgggggaagccatattattgtcaaaatgaatgaacaactttccaatgcctactcattgatgagctgtacgcaagatttatcaacttaccaagtctgcgttcgtaaggatgtggaaggtaagggcggatcagttttcatgcatgatcagtgcaatgaaggctgtgaaatccagatttcagaaccaaaaaatttatttccattagctgaaacaggcaataaacatatcttgatagctggtggtattggtattacaccattcttacctcaaatggatgagctggcagcacgtggtgctgactttgagctacattatgcttaccgttcacctgaacacgcggctttacttgatgaattaaagcagaaacatgcagagcacgtatttagttatgttgactcagaaggcagcatgcttaacttagacgaattaatttcatcgcaaccaaaaggcacacatgtatatgtatgtggacctaaacctatgattgatgcggtgattgattgttgtaacaagcaccgttaccgcgatgaatacattcattgggaacaatttgcctcaacagttcctgaagatggtgaagcatttacggtggtacttgccaaatctaatcaggaaattgaagtacaaagtaaccagactattttacaagccatcgagacattaaatattgatgtggaatgtctatgccgagaaggggtttgtggtacatgtgaaacagctattttagaaggtgaagcagaacacttcgatcaatacttaagtgatgccgaaaaagcttcacaaaagagcatgatgatttgtgtatcaagagcaaaaggcaaaaaattggtattagatctttaa

SEQ ID NO: 680 - DNA, 396 bp, Acinetobacter baumannii
ccgggaggttctacaatgagcttatctcaaaaagaaattgcggtacgttttttagagcttgctgctgctggcgaggtcgatgaagcctacggcaattataccgctccaaactttaagcatcacaatccttattatgctggtgataagacttctttgaaggaagggatgcgtgaaagtgcaattgaaactccaaacaaagttcttgaagttcaacatgtcattgaggatggggctttagttgcagtacattcgaaactggaaatgcaaatgaatgacaagctaacaattttagctgtggttcatatatgccgttttgaaaatggaaaaattgcggagttttgggatattgggcaaatacagcccgatccactcgttaatgaaaatggtatgttttaa

SEQ ID NO: 681 - DNA, 780 bp, Acinetobacter baumannii
ttccataactccagtgaaggaaacgcgatgagaatctccgatcaagtggtcatgaaattgcaggcattaattgaagagcgtcacatgaaaaaaggtgatcgtttgcctgccgagcgccagcttgcaactagcttaggggtttctcgtccgtctttgcgtgaagcaattcaacagctcaatagtcaaggtgtactgattagccgccgtggcgatggaacttatattcagcaattacctgaacaatggccacagcaactgattgtgaacccgattagtaacctgattgaagaagatccgttataccgttttgatgtgcaagaggcgcgtttggtacttgaaggggggactgcatggtatgccgcgttacgttcgaccccagaagatcgcgccaaaattcatcattattttaatgaaattagccgccaccaaaatgcgggtgactcagcacaggctgcggtcgcggatgctgaattccacttagcgattgctgaagcatctcacaatgtggtgctgattcaaatgatgcgaagtctatttgatttgctgcaatacaacgtcttgttagggcgtaaaaaagtttataacgaccccgtaaatggtgacttgctcagcgagcagcattttcaggtgatggatgctattgatcgtaaagaccccgaggccgcacgccaagctgtctgcggtcatattgaatttgtgattaatcatgtgcgttctctggatgaagatgaagctcgccagaaacgtgcaaaccgtttaaatagagttgattcaaaatga

SEQ ID NO: 682 - DNA, 474 bp, Acinetobacter baumannii
aattccagattatgtgggtgcccgcttagaagcaccagttcttccagatcaaatgagagcatcaaaatgacagcagtaattgcgagcagtaaagcaaagcctcttgcagaacaatggaaaggtgaaattaccagcggccgtcatcaatacttttgtgatgagcctgaaaagctagaagggcatgaccaagggcctgcaccttatgatttgcttaccggaagtctggcagcatgtacacttattactttaagaatgtatgcaaaacataagggttatgattttggtgagtactcggttgaaattgattttcataccaatcgagagcatgaagaacatattgagcgtcgtattgtttttaaagaacttccaaacgaagaacttcagcaaaaaatcttaaccatatgcagtaaaaccccagtcactaaaactttgttacgtagtttagacattcatactgtgcttgttacagcataa

SEQ ID NO: 683 - DNA, 1701 bp, Acinetobacter baumannii
gcaatgatatcaggtcacccaagtaaacatcccctttatatcccttatgcaggctatacacttttagagttaccccttttgaataaagggtccgctttcactcaagaagaaagaagtaactttaacttacacgggttacttccacatattattgaaactatcgaagagcaaagccaacgctcttatcagcaatattgtgctttcaatgatgatattaataagcacatctatttacgtaatatccaagatactaacgaaactctgttctaccacttaattgaaaatcatcttgaagagatgatgccaattatttacacgccaactgtgggtgaggcatgtcaacgtttctctgatatctatcgccgtcatcgtggtgtttttatttcatatccagatcgtgatgtgattgatgatattttgcaaaacgttaataaaaataatgtcaaagtcatcgtgattacggatggtgaacgtattttaggtcttggtgaccaaggcattggtggcatgggtattccaattgggaaactttcgctgtataccgcatgtggtggtattagccctgcttacacattgccaatcacaatcgatgtagggacgaataaccctcaattattaaatgacccgatctacatgggatggcgtcaaccacgtattagtggtgatgagtattatgactttgtagatatggtgattgaagctgtaaagcgtcgttggccaaaagcgctcatccagtttgaagatttcgcacaaaagaatgcgatgccacttttagaaaaatatcgcgataaaatttgttgtttcaatgatgatattcaaggaacagcagcggtttctgttggtagtttaattgctgcaagccgtgcagcaggtaaacaattaaaagaccaaacaattgctttcttaggtgcaggttcggctggttgtggtattgcagagcaaatcgttgcacaaatggtttcagaaggtctaaccgatgctgaagcacgtgctcgtgtttacatggtagatcgttttggtttgatcactgaaaatcagccaaacctattagacttccaacgtaagttagctcaaaaagctgaagtagtagaccaatggggcaatattgaagaagtgatttcacttcttgatgttgttaaaaatgccaagcctacagtattaatcggtgtttctggtcagccgggcctatttaccgaagaaattattaagaccatggctgccaattgtgaacgaccaattgtgatgccgttatctaacccgacttcacgtgtagaagcagtaccggcggatattgtggaatggactgaaggtaaagcattaattgcaacgggtagcccatttgcacctgtaaatcattacggcaagctttataatatttcacagtgcaataactcatatatcttccctggtattggtttgggtgtagtagcatcaggtgctaaacgcgttacagaaaacatgcttatggcatcaagtagtgctttggcagactgttcaccgttgctgaaagatccacaagctgacttattgccacctttaggcgaaattcaacaagtgtctaaagtaattgcatttgaagtggcaaaagctgcaatggcagatggtgtggctgtaactattagtgatgatttgcttaagcagaagattgatcaatcgttctggaaaccagaataccgtaaatataaacgtattcctttctaa

SEQ ID NO: 684 - DNA, 450 bp, Acinetobacter baumannii
aagcgatcatcagctaaacttgtcaagcatttatgctgtgagtggataaaaatgagccaaactagtcgcttgattgaccgacgattagcaaaagctttggtcttcttacaagcatgcatgatccctgtttccgcacttgtggcgtggagcataaaagacatgacagcagcattaagtgcggcacttggtgcattggtctgctggcttgctacgagctattttgcgtggcaatccttcagaactgcaggtgcgagagcatctaaacaagtgctgtctaacatgtataggggcatgttaggcaaatttgcaatcatgatcgttggatttattttgattttgagcaatgttaaacctttatcaccgttagcattgctgtttggttttattctcgttcaagcgatgtcgtgggttgctcctttttgggtgtcacgtctacaaaaacgggtatag

SEQ ID NO: 685 - DNA, 798 bp, Acinetobacter baumannii
caaagtacatcagcactacagcacagcttattgatgtctgatgtagcaaacgtacaggtttatgtttgcccaattttacgggtaccagacaaccatctcatattgagtcattatctcagctttctcaatgcggcagaaaagctgagatatgatcaatatcattctcatgctgcacgacttttcttaatttctcgtgtgttaatgaagtctgttttatcagataagttgggtatcttgccccatgaggtcatcattcaattacaacctaacggcaaaccttttgtacgaggcaataagactatttattttaatcttagtcactcagcggactttatcgtctttgctgtgacagaaaaaggagaaataggggtcgatgttgaaagaatggaccatgagttcgaatggaggcgtgtcgatagcgtgttagcgccaagtgaaattgaatggattcagcaaaatgaatggactaatccaactagtgtatatcaacgtttttttcaaatatggaccttaaaagaatcctatattaaatgtactggtgaaggaatgagccgtcatttaaagaagctcaactttcatgtatcacctgaacatatacaattctgcgatttaaccaataatgatgttcaaagaaccgagcagtatcattttaaaagttatatctataattatagttttatcttttccctatgtttacagcagagtcattgcctagaaagttttaatatagattgttttcaattattaccctatatatctacacatcgaataactctagaaccttgcgaacataactaa

SEQ ID NO: 686 - DNA, 1269 bp, Acinetobacter baumannii
ttgttaagatctatttttgtcgtttttatagagataagaatggaacgagttgtcatcacaggtatgggaattaattcttgtattggaaatacattagagaaagtaaccgaatccttaaaagcaggccgctctggcattcgctataacgaagtctatgcaaaactaaactttcgaagtcatgtgagcgccactgccgaaatgaattttgaaaatattaatcctgagctaaaaaaacacatgggcgtctgcgcgatgtatgcctataactcggcactcgatgcgctacaacatgccaagcttgatgtaactgacattgccaacaacccaaaatatggcgtgattgggggaacaggcggcacctcaacagcatctatcatcgacatgttgcataccctaaaagaaaaaggtgtcagcgaagtatcacccgatttagcaccacgctacctcaccagcaccattagctctaacttatcacgcgctttcaatctaaaaggcgtatcacaatcggttgcgagtgcctgtgcgacttcagccgacgcaatcggctatgcatatcaccttattgccgctggcaaacaggatctcatgctggcgggcggtggcgaagaagaccattggtcccaaaccgcaatattcgatgcgatgggcgccttatgctctaaatataacgatgcaccagaaacggcttcacgcccatattcagtagataacgatggctttgtgattgctggcggcggtggcatggtggttttagagtctttaagtcatgcccaaaaacgcggagcaaaaattttagcagaagtggttgggtacgctgccaatagtgatggtgttgatatggtggctccaagtggcgagggggcgactcgttgcatcaaactggcactcgcagaagccaagcaaaacggctctgacaccatcgactatatcaacacacatggcacttcaacgccggcaggggacattcccgaactattggcgatagagcgagctttttgtagtgaaaaagtcccgccgctcagttcgaccaagtcgatgactggacacagtttgggggcagcaggggtacacgaagctatttattctattttaatgctgcaaaatagctttatcgcgccgagcattaatattaccgaactgcgcgaagaagctaaaaagttcgatattgttcaaacaagccgagaaaccgaactaaaaacagtgatgagtaatagctttggttttggtggcgtaaatacttgtctggtttttagaaagtgggaagagtaa

SEQ ID NO: 687 - DNA, 414 bp, Acinetobacter baumannii
tgtgtgctgtcactgcccgtgttcaatttattaatcaggtataaggaaatccgaatgtctaattcagatatacaaaagattaacactaacgaagtcatgagcgccgtgactgtttttaacaaagtggtttatttgtcaggtcaggtgcctaaaaataccgagcaagatgtggcaggccaaacccgtgaaattcttgcaacaattgatgaacttttggcattagccaataccgataaatctcgcttgctctctgcgcagctctatttgaaaaatctttctgacttttcaaccgtaaatgcaatttgggttgactggttaaaagggtgtgttgctccatcgcgtgccacaattcaggccgatttggtcaatccagattggttaattgaaattgccgtgacggcagcacaaaagtaa

SEQ ID NO: 688 - DNA, 1800 bp, Acinetobacter baumannii
aaatccatgtcacttacgtccaatttgcggcagtttcaatctgctgctcgtctggagcaaattttaggctccgtacatgataccaataatgatttttcttggtccgcagctatcgagcgtgatgagaaagagcaatatccacagcgagctgttgattttctgaatgcggtgggtatgaaccgtttctatgtgccttcagagcttggaggccgtatggaaattggtgaagagttgttatatctgcatcgcgtgttggcacgacgcgatctgaccatcaattcgacctatagcacgaatgcttggtctgtgatcgtatggatcggtggtaatgcgaatcaatgtcaaaacatcgctaaccgaattttgagtggggctgctccagcgctggcttatagtgagaaagcgcatggtgcggacctgttatctagtgaagtgactgcgcagccttccgacagtaagtacgtcttaaatggtgagaaatggtcgatcaatcgcgccactctaggtgactctttaagtctaatcgctaaaacatcgaatgatcgtggaccacgtagcctgagtgcattctggctcgataagcgtcatatggcatctaaaggaacgtatagcctgaaccgtcttccaacagtaggtatgcgtggtctagatatcagcggtattggttttaataacgctgaaattcataaagatgccctgatcggtgaagaaggccaggggttagagcttgggcttaagacgctacaggtaacacgtgcatattgcagtagtttctctctaggcgctggcgatacgatgctacgcatcgcaaccgagttcgcgattgaacgcgagttatataacaaaaaagtaatcagcataccgttggtacgtgagcaactcgctacagcttatgcctaccttttagcagcggaggtgttatcacttgttggtgcgcgagggttacacgtttgtatcaatcaattcagtacatggtcaccaatcgtcaaggtactggtgcctgaatatgtagagtcgcttgccaaaatcacatcctcagtgcttgggtcacgttttttcttaagaaatgcatatgcagatggaatgtttcagaaagcattcagggaccatctgattgtcagtgtgtttgacggtagtagcaccgtctgcctagacagtctgagttttcagctcaaatctgccaataaagggcgcagcaaaaaagccgaccatctcaatcaagctgaagcgaaagcacgctatcgccagttatatgacttacaggtagagacaggtgctattgatttccgtgagcttgagattttcaaccgagatggtgacttggtgatggagtcactcgaaacaatcatcgaaatgctcaacgactctaatgtcacagttgggttgtctgctgagacgctagctacgctacatgagcgagcaaaccagcttcttgttgaacagcgttcattggatcaaaaaattcaggactacttttcaaattctgagcaaagcaaggagtttgaaacgatgcgcttcagtctcgcccgtgactacgccgagttattcgctcgtattgctgtgttgggtttctgggtttttaaccgccatggtttaaggcctgctttacaggatggtgcatggctgatcattttcttaaatgctgctgaagggcagacagctcctcctatgacgtcactacgtgaaagcacattggcagatctgctggaccgaatttcaaccaatcacatgttatctgtcatcgattttgcactggcaccgcgtgatgccaaaccggttaaaaaggagattaccccatga

SEQ ID NO: 689 - DNA, 342 bp, Acinetobacter baumannii
tgcaagtcgttaccgctacgtcctacggtacaaagtgctgtgttgcctgcaacttgtccacttagtgcaactgatttttttggtttgaagcctgttgttgtttcatttgagctcataagattgtcctttcctatctatctgaatttatttattaagcacgacggagtcgtaccattttcacttcttatttcaggattaaccttcggttcgacctacttttgttttggcaaaagtaggcaaaaccattgtcatctgcaaaactcgtccacaaccatcgaatatcctatctatcgcagaaccaattttaaaaaatgtagtcctgcctcaaacagttgcagatga

SEQ ID NO: 690 - DNA, 1374 bp, Acinetobacter baumannii
ataatgactactttaacctgttttaaagcctatgatatccgaggcaaactcggcaccgaattgaatgaagaaatcgcctataaaattggccgcgcgtacggacaaatctataaaccaaagaccgtggttataggttgtgatattcgcttaagcagtgaggatttaaaacaagcaaccatccgcggcctaaatgaggcgggtgtaaatgtgcttgatttaggcatgacgggaactgaagaagtttacttcgcagctttccatttagacgtacaaggtggtatagaagtaactgcgagtcataacccaatggactataacggtatgaaattggttcgagaaaacgctcgtccaattagtgccgatactggtttaaaagaaattcaggctttagcagaaaccaataactttgaagaagttagtcaaaaaggtacaactcaaagctataacattttgcctgagttcgttgaccatctactgacttatattgaaccagcaaaaattcgcccactgaagttagtggtaaatgctggtaatggtgcggctggtcatgtgattgatgccattgaagaaaaatttaaagcgcttaatgtaccggttgaatttattaaaattcatcatgaagcagatggcactttcccaaatggcatccctaacccaattttaattgaaaaccgtgacagtacccgaaatgctgttcttgagcataaagcagatatgggtattgcatgggacggcgactttgaccgctgtttcttgttcgatgaaaaaggtcagtttattgaaggctattatattgttggtttattggctcaagctttcttaatcaaacagtcaggcgaaaaaattgtgcatgacccacgtttagtgtggaacacatttgatatcgtcgacgaatataaaggtgttgctgtacagtcaaaatcggggcatgcatttattaaagatgttatgcgtgaacacaatgccgtatacggcggtgaaatgagtgcccaccactatttccgtgattttgcttactgtgacagtggtatgattccttggttactcaccattgctctactctctgaaacaggacaatctctctcaacactcgttgaaaatatgattgccaagttcccttgtagtggtgaaatcaactttaaagtagccgatacgcaaactacgattcaaaagattttcgacttctatgccgatcaaaatccacaaattgaccgtaccgatggtgtaagcctcgactttggcgcatggcgttttaatgtccgtgcttcaaatactgaaccgttattacgtctcaatattgaaagccgtgcagaccgccaggctcagccaatgcagtattatgtagatgagttgacgggtttaattcagtcttag

SEQ ID NO: 691 - DNA, 828 bp, Acinetobacter baumannii
tttcgcagcacaacacagcattatagaaatttcggggaaatgccagcagtgccgcacagctcgttaaatcctgtattgattcaacttgaacaggtctctgttcatcgtgatcaacgggatatattaaaaaaagttgattttgctctgcatgaaaatgaaattgtgaccttaattggtcccaatggcgcaggtaaatcaactttaattaaagttctacttggtattttaaagccaagtagtggacgcgtcataagcaataaaaaactaaaaatggcttatgtgcctcagaaatttaatccatctcatagtcttcctttacgggtacaagatttattagatcttgaaaagtgtagccctgcctttcgtcaggaaattattcaagacaccggtattgccaaactacaacaatcaaaagttcagcaactttctggtggagagcgccaacgtgtactgctcgcacgtgctttacttagaaagccagatatcctcgttcttgatgaacccatgcaaggcttagatattcaatcagaagctgagctttatgaatatgtacgtagtctgccggagcgttatggttgtgctattttaattgtttcccatgatttacagtgggtcatgcagggaactcaacgcgttgtctgtttaaacaagcatatatgctgtagcggcttaccagaaagtattcagcagcatcctgaataccaagcaatattcggtactcagcgagttttctatcaacatcatcatgatcactgtgcgcatggtgacgctgctcacccctgccctcacaatagcagacctcacattcacccggaaccggaagcttaa

SEQ ID NO: 692 - DNA, 336 bp, Acinetobacter baumannii
aaactatcaactttaatagagagtttatgtatgaaacagcatcaatatcacgttacggtacaacatttaaaagatgccaaaggggaagtttctacctatacgaaaaggctcgagttctatactggtaatcatgacgatatttttgagattgttgaaaagttaaagaacgcagaattttttgatgatcaaaccacaaagtcttttgcagtcggtctaaagttatttagtgaagtcatgttagagaatcgagaccatccattgtttcaagaattcttgccacagtttggacaatttatgaaaaatttaaaacaacaagttaagacccaatcaccttaa

SEQ ID NO: 693 - DNA, 1389 bp, Acinetobacter baumannii
aaagacaaaacaagaaaatctaaaaaggacattatgatgcaaacaatacatggaaacggttcacatcctaaaaagtcgtcacatcgattagcgggcatctctagcatggtcggcactacgattgagtggtatgacttttttgtttatggcgcagcagcagccctcatttttaacaagctatttttcccaaatctggacccacttacaggtgtgcttgcagcatttgcaacctatgctgttgggtttattggccgtccacttggtggtttagtctttggtcatttcggtgacaagattggccgtaagtcaatgttattgctaacgctgatgctcatgggaattccaaccgtactgattggcctcttaccgacttacgaatcaattggatattgggctgcaattggcttggtgatcttgcgatttattcaaggtatggccatgggcggtgagtggggcggtgccgtgcttatggcagtagaacatgcacccgaaggtggtaaagggttttggggaagtttgcctcaagccagtaccggtgggggcttaatgctcgcctcaatcgcactaggactggtgtcgttattacctgagcaagcattgtttagctggggctggcgtttaccatttcttgccagcattattttactggcagtgggttggtatattcgtgtaaaagtgcctgagtcaccagactttgaaaaagtaaaacaacagtccgaagaagtcaaagttccggcttttcaggtttttaaaaatcatccaaagcaactcatcaccattattttggcgagagctgctgaaaatgcatggttctatattgcttcaacttttacgctagcttacaccaccacacaattaggtattccacgacaagacattttgtttgctaccatttgcggtgcagccgtgattttatttatgacgccgttatgcggacatttgtccgataaagtcggtcaacgcaatatgtttatgtttggactatgtgtattggcactttattcttatccattttttagcatgctcaataccaaagatccggtactggtctggacggcaattgttttggcaattggtgtagtgttcccgattatgtatgcgccacaagctcagctttttgcgcgtcaatttcctgctgaaattcgttatagcggtatttcgatttcggtacagttggcaggtgttttgggtggtggtttagcccctatgattgccactaaactgctcagtattgggcaaggcaatccatatttaattatgttttatatcggaagtatggctgtagttgcgattatatcgacatcatttatgccgcgcgattggagctataaaaaggatgagacttattataagaaagcaaacctaaatctaaaaaccaagattgattga

SEQ ID NO: 694 - DNA, 1902 bp, Acinetobacter baumannii
ttctcggaaacttcaagaaagaaattaaatgaaagcgttaaatgcactcccctaactcataggaaatttgctatatttgacgtttttctgcgacatctattttcgattgatatgaatacggcaatacaagcagctctcgaccatgcagtgcaaacccttcagcaagaaggtgtgcttccttcggattggaataattcaagcaatttaacgcgcaccaaagaccgaagccatggcgactttgcttctaatattgccatgatcggctctaaagccgctggtatgaaaccacgcgatttagctgagaaaattctcgcagcgctaccagaagttgcagacatcagcaaagctgaaatcgcaggtcctggttttatcaatttctttttaaatgcagatcaacgttttgcaattcttgaccagattcaggctcaaaaagaaagctttggtcgtagccaatcaaatgcagctaaaaagattcaagttgaattcgtttctgcaaacccgacctctagcctacacgtaggtcatggccgcggggctgcttatggtatgactgttgcaaacttgcttgaagcgacaggtgctaaagttgatcgcgaatattatgtaaatgatgctggccgtcaaatggatattttggcgacttctacttatttacgttatttggaattacttggacaaaaccttgtattccctaaaaatgcatatcaaggcgattacgttaaagaaatcgcacaaggcatcattgataaagatggcgatgcttacgttcgtgaagttgcgaatgtttataaagatgtaccagaagacgtgcaatatgctgaagagctagatagcgaaggcaacaaagtcgtattatctggcgacaaagaaaaacacattgacggtcttattgccaattcacaacaattattaggtgaaggctaccgagtattccatcaagccgcactccatgccattttagatgatattaaagatgaccttgctgacttcggcgtaacctttaaccaatggtttagtgaagcatctcttagcgcaaaaattgacgaagcgttagaaacactgaatcaacgcggcttcttatatgaaaaagatggcaacatctggtttaaatcgactgaatttggtgatgaaaaagaccgtgttgtgaagcgccgtaatggtcaaacaacttactttgcatctgacattgcatatcacttaaacaaactacaacgtggttatactgaccttgttgatatttggggttctgaccaccacggttatatctctcgcgtaaaagctgcgattgatgcaatgggttatgactcgaaaaaattaactgttcttttagttcagttcgtaagcttatggcgtggtggtgagatggttcaaatgtcatctcgttcaggtcagttcgtgactttacgtgacttgcgtaaagaagtcggcaatgatgcagctcgtttctactacgtgatgcgtaaaagtgaacaacacattgactttgaccttgaccttgctgtttcacaaagtaaagacaatgcggtgtattatattcaatacgctcatgcacgtatttgccgtatgctagaaaaagcagcaagcactggcttacaatttgaagtaagtgctgctcgttcacatgctgcacgtttatcacttgatgcagaaactgaaattcttgctaaactggctgcatatccagacgttgtgttacgtgctgctaatgcatatgaaccacaccaagtaggtaactacttaaaagaattagctgcgctattccacggttggtacaatgaacacaaagttttaagtgatgatgctgaacttacacaagcacgcttattactttcaatcaatgtacagcaagtattgcgcaatggcttagaattactcggtgtttctgcacctgaagccatgtaa

SEQ ID NO: 695 - DNA, 519 bp, Acinetobacter baumannii
gaaggtagaacaactatggtgaccatagaacatgcttttctcataccggccaagattgacaaggttttcacttaccttgcaaacccggccaatgatgcaggttggcaattgtcgtgtaaacattctgaattgctagacagtactccgcgtgtgggtagtaagtacgaaattggttttagctttattgggcgtgaaatgtcctttaaaggtgaaattacacatctagtaccgaacgaattgtatgcgtttaaagtagtagaaggaccctttcactacaccggtacttaccgtttcaagccacatccggaaggtacgtggattgaatgggtgtttgaggcagaaccaggtagcttttttggtgtattgccgccagcgctgctaaaaaagatggtgctcgctcagttcaagaaagatgttgataatcttcaagcattggctcagaagggtgaagcctatgagtcggttggcaatgaaaataaactaactatcgagggcactgttgcaaatagtcggtggtga

SEQ ID NO: 696 - DNA, 1410 bp, Acinetobacter baumannii
attgaggagacagcaatgagtagcggtcgtatcattcagatcatcggcgcggttatcgacgtcgagtttgagcgcacaagcgttccaaagatctatgacgctctccaagttgacggtactgaaactactttagaagttcagcaacaacttggtgatggtgttgttcgtaccatcgcaatgggttctacagaaggtcttaaacgtggtcttactgtaactagcacaaacgcaccgatctctgttccagttggtacagccactcttggccgtatcatggacgttttaggtcgtcctatcgatgaagcaggtcctgttgcgactgaagaacgtttgccgattcaccgtcaagcgccttcttatgctgaacaagcagcttctactgaccttttagaaactggtattaaagtaattgacttactttgcccgtttgcgaaaggtggtaaagttggtttattcggtggtgctggtgttggtaaaaccgttaacatgatggaattgatcaacaacatcgcgaaagcacactcaggtttatctgtgtttgctggtgttggtgagcgtactcgtgaaggtaatgacttctatcacgaaatgaaagattctaacgttcttgacaaagtagcaatggtctacggtcagatgaacgagccaccaggtaaccgtttacgcgtagcgttaactggtttgactatggctgaatacttccgtgatgaaaaagacgaaaacggtaaaggtcgtgacgtattattattcgtcgacaacatctaccgttatacacttgcaggtactgaagtatcagcattgttaggtcgtatgccatctgcggtaggttaccaacctacacttgcagaagaaatgggtgttcttcaagagcgtattacatctactaaatctggttcgatcacttcgatccaagcagtatatgtacctgccgatgacttaacagacccatcgcctgcaactacatttgctcacttagacgcaacagtagtattgagccgtgacatcgcatcttctggtatctatccagcgatcgatccacttgactcaacttcacgtcagttagacccattagttgttggtcaagagcactatgaaattgcgcgcgcagtacaaaacgtattgcaacgctataaagagcttaaagacatcatcgcaatcttgggtatggatgagttggcagaagaagataaattggttgtttaccgtgcgcgtaaaatccaacgtttcttctctcaaccattccacgtagctgaagtatttactggtgctcctggtaaattagtaccacttaaagaaacgattcgtggctttaaaggtctattagctggtgaatacgatcacatcccagaacaagcgttctatatggttggtggtattgacgaagtgattgctaaagctgagaaactctaa

SEQ ID NO: 697 - DNA, 879 bp, Acinetobacter baumannii
tttatggctgctgaagaacatgccctcacttcgacagagtatatcaagcatcacttgaccaatatgacctatggcaaaatgccagatggtacatggaaattggctgagactgctgaagaagctcattcgatggggttcactgcaattcacttggattcaatgggttggtcaattggccttggtgtgattttctgtttgttattttggatagttgcgagagctgcaaatgctggcgttccaacaaaattccaatctgcaattgaaatgatcattgagtttgttgactcaagtgtccgtgatacttttcatggcaaatcacgtttaatcgctcctcttgcactcactattttcgtgtggattttcctcatgaacttaatggacttgatcccagttgactggattcctcaagttgctgcatttgtgggtgctaacgtatttggtatggaccctcaccacgtttacttcaagatcgttccatctacagatccaaacattacccttggtatgtctttatctgtgtttgtacttatcttgttctacagcatccgcgaaaagggtgttggcggtttcgtaggcgagttggcacttaacccatttaacccaagtaatccagttgcaaaagcgttgcttattccagtgaacttgattttggaattggtaacattccttgctcgtcctatttcattggctctccgactattcggtaacatgtatgccggtgagttgatctttatcctgatcgcattattgccgttctggattcaatgggcgttatctgtgccttgggcgatcttccacattcttgtaatcacgttgcaggcattcatctttatgatgcttaccatcgtttacttgagcatggcaagcgaaaaacattaa

SEQ ID NO: 698 - DNA, 396 bp, Acinetobacter baumannii
tttatggatgcacatttactcactaaaattatccatatgactgcggtagcagccgcacttatggtttttgtattacgcgcttctacactatttattggtgtacaaggtgaacaacctaacccagcagggcgtaaagttttagttgctttacagcatttgtcatttaccgtggttttcattaccggagcaattttactggtgatgaagaactttcaggtacagccatggttctacgctaaaattatcttatttttagtgctcttatcatctttaatgaaagcctttaaaaaggatgacactattttgctagctcagcgccgtgcgggtttggtcattagtgcaatcgcatttgttgccattattattttggtaatagtgaaacctgtttttgcttaa

SEQ ID NO: 699 - DNA, 216 bp, Acinetobacter baumannii
gttgatctttatcctgatcgcattattgccgttctggattcaatgggcgttatctgtgccttgggcgatcttccacattcttgtaatcacgttgcaggcattcatctttatgatgcttaccatcgtttacttgagcatggcaagcgaaaaacattaatggtattgcctaactgtcaaacgatggttgggctgaatttttttaatttaatttggtaa

SEQ ID NO: 700 - DNA, 612 bp, Acinetobacter baumannii
tgggcggcttacacacaatttttcgatgaagtatttccttcatttggtttttcaatcaatggcataagtgaggacgacagtatggccttattacctattttaagttttcctgatccccgtcttcgtaccattgctaagcccgttgaagaagttactgatgaaattcgtcaacttgcagcagatatgtttgaaaccatgtatgcggcaccaggtatcggtttagcagcttctcaggtcgatcgtcatattcagcttatcgtcatggatttgtctgaatctaaagatgaacctatggttttcattaaccccaaagtaactccgctgactgaagagacgcagccgtacgaagaaggctgtctatcagtgccacaaatatacgacaaagttgatcgcccgtcacgcgtgaaaattgaggcaattaaccttgaaggtcaagcatttgagatagaagctgacggacttctcgctgtttgtatccaacatgaaatggatcacttaaatggcaaattgtttgtggattatttgtcaccacttaagcgtcagcgtgcgcgtgaaaaagtcgaaaaaattgttcgccaacgcgaacgtgaaaaagttgcggtaaaacgttaa

SEQ ID NO: 701 - DNA, 603 bp, Acinetobacter baumannii
tgtggaaattatatgattgagagctggttttttgtattagcaatgttggctgttttacttattccgggcccgacaaacgcattacttgcaaccgccgctcactcacaaggtttatctaaaacattctggcttattccaatggaatggttgggctacgcttatggcattagtttttgggcggtgttcattcatttggcagatccggtttggcctgcactactgcttattttgcacatcactagcgtattatatgtattctggatggcatttcgcttatggaaaaccacgcatttacaacaatttagccaaaatcatcgtaatattcgcccacgtcaattattcttctcaactttaaaaaatcctaagtctttactttttgccgcaggtattttccccgctgaaacatggaattcgcctgaaaattttctcatggttctggctgcttttactttgattcttattccagcagcaagtttctggatgtttttcggacgtgctttattgacgggatcaatgaaaaaaataaaggccgatcatctatataaaggatcggccatgttacttattttatgtatgcttccggtggtattccgttttttctaa

SEQ ID NO: 702 - DNA, 276 bp, Acinetobacter baumannii
aaaggagattaccccatgaataaagataaagcttactggagcgcaatcattcgtacgctagtcgctaaagagatgcgcgtagagcctgagacgattgatccagatcaaaaatttaccagttatggtcttgattcgattgttgctttgtctgtgtctggggatttagaagatctgacgaaattagaacttgagccaacactattatgggattacccaacaatcaatgcgttggctgaatatcttgtttctgagttgcagcagggagttgcttcatga

SEQ ID NO: 703 - DNA, 432 bp, Acinetobacter baumannii
ggagatcatctcatggcgactatgcaatgtgatgtcgtaagtgttaaagagtcaatttactctggcgcagtgacgatgttaatcgcgaaaggtgcaggtggtgaacttggtattttgccagggcatgctccacttgtaaccttgcttcaaccgggcccgattcgtgttctgttggaaaatggtacagaagaaatcgtctatgtatctggcggtgttttagaagttcaacctcatgttgtgacggttcttgcagatactgcaatccgcgctgacaatttggatgaagctgcaattttagaagcacgtaaaaatgctgaacaattgcttgcaaaccaaaagagtgatttggactcagctgctgcgttggctgccttggcagaaaccgctgcacagcttgaaactatccgtaaaatcaaaaaccgcgctcaataa

SEQ ID NO: 704 - DNA, 696 bp, Acinetobacter baumannii
tgcacgcatcacctcaatacctttgatggtggcgtaagccgtcttcatggatttaaatcccagcgtggcgccgattatccgtttcagtttgccatgatcgcattcaatcacgttgttccggtacttaatctgtcggtgttcaacgtcagacgggcaccggccttcgcgtttgagcagagcaagcgcgcgaccataggcgggcgctttatccgtgttgatgaatcgcgggatctgccacttcttcacgttgttgaggattttacccagaaaccggtatgcagctttgctgttacgacgggaggagagataaaaatcgacagtgcggccccggctgtcgacggcccggtacagatacgcccagcggccattgaccttcacgtaggtttcatccatgtgccacgggcaaagatcggaagggttacgccagtaccagcgcagccgtttttccatttcaggcgcataacgctgaacccagcggtaaatcgtggagtgatcgacattcactccgcgttcagccagcatctcctgcagctcacggtaactgatgccgtatttgcagtaccagcgtacggcccacagaatgatgtcacgctgaaaatgccggcctttgaatgggttcatgtgcagctccatcagcaaaaggggatgataagtttatcaccaccgactatttgcaacagtgccctcgatagttag

SEQ ID NO: 705 - DNA, 339 bp, Acinetobacter baumannii
tatcgaagtcagttaagaccccaacaaaaattgcttttatttatgcaaatagaggcggcgcacgtccttgcgggagtaggaaaagtcgctgtagcgcaaagtaaacatgccggaaagcttgttgatacgcgactaagcgaacttgtatacgaacaagcacctcttttacgccgaattcaggtggtaaaaccaaattggcataaacggtacaatattgacactgatggttcgcatcatggtgatcatgatggtcaggtacttgcgcctgttcgatatgatgctggtgatgtgaatggtgcatggcatgtgacatggcttccgtctgtgcttttggtttaa

SEQ ID NO: 706 - DNA, 1731 bp, Acinetobacter baumannii
atggatgaccaaaaggaaaccatcatgcaaacattttctcctaaagcagtgatcgaacgtttacagaatattgtagggcgttcttatgttttgaccgatgatcaaagtacgcgtcagtaccgacaaggtcgtcgttttggtgaggggaaagtgcttgcggtggttgtaccagggaccttgctagagcaatggcaagtgttgcaggctgcaattgaggcagactgtattgtcattatgcaggcagcaaatacaggactcaccggtggttcaactccgtatggtgatgattatgaccgtcctgttttggtgatgagcacgcgccgattaaaggggattcaagttattcatgacggcaagcaagtcatttgtttaccgggtgcgaccttagataatttagagcaaattttaaaaggctataatcgtgagccacattcggtaattggttcatcttgtataggtgcatcggtactcggtggtgtctgtaataactctggcggtgccttggtacgccgcggtcctgcgtatactgaactggcgttatatgctcaggtcaatgctgctggtcaattagaactggttaatcatttaggggtgaatttaggctcgacacccgaagaaattttgactcgtttagagaagcagcaataccaagccgtagatattttagatgatagtgaaaagcaggcatcagatcatcgctatgcgcacgacgtgactcaggtcgatgaagatacgcctgctcgttttaatgcagacccgtcacgattgtttgaagcatcaggttcggcaggtaaagtctgtgtgtttgctgtacgccttgatacctatgaaaaagtagagagcagtgttttttatattggtagtaatgatgctgatgatttaacggccattcgtcgttacttactgacctctctgccaagcctaccgattgcaggcgaatatattcaccgtgacgcttacttgattggtgaaaagtacggaaaagacacgtttttatttattgaaaagtttggtacagccaatgttccaaaagcctttgcgatgaaagataaagtcgatggctttttagaaaaatttaaaattaaaggtttaacagaccagattttacaggcgattaccttctttttaccgagtcatttgccgaagcgtatgaccgaatatcgagaccgttatgagcaccatttggttttacgtgtcgaaaataattcgaaagcacagacagagcagtttttaaaagaatattttactgtgcatcagtcaggtaactatttcgtatgtagtgaagaggaaggccgaaaggcattcttacaccgttttgcgattgcaggagctgcaattcgttatcgcgatacacaccgtagtgaagttgaagatattgtagcgcttgatattgcgctacgtcgtaatgaccgcgaatgggtagagcaactgccagccgagatggaaaagaaaatcatccataaactctattatgggcatttcttttgtcatgttttccatcaggactatattcttaaaaagggccatgacccgttagaaatagaacatcaaatgtggaaattactcgatgcacgccgtgctgaatatccggcagagcataatgttgggcatctctatattgccaaacctgccttagccaatttctaccaaaaactcgacccaaccaacagctttaacgtaggtattggacatacctcgaaactgaaatattggggcaaggctaaatcgtaa

SEQ ID NO: 707 - DNA, 1005 bp, Acinetobacter baumannii
aaaatacttttctatgcattttctttattcaggttttatttgagactaacaaagaaatctttgaccaccaacgcaaattcatgcacgattgttgtgcaaatatgcacagggacaataacaaaaatgaaagtggattgggatcatctacagttttttctggttttagcacgcactaaaactctaaccaatgctgcacgtattatcggtgtcgagcacagtacggtggctagacggattcaggctctagaacttgctttgggtaccacgctatttaaacgtgaagcaacgggctatgagttaactctcgaagggatggcacttgtccctcgagttgaacaaatggaacaagctttcttacaaattgaaaaaccacatcaacctttgcaaggtcgtgtgcgaattggcacacctgagggttttggaactgcatttttagcccgcttactggctgagttctccatacagtatccactgcttaccatcgacctgatacccgtcccaaaaatgattaagctctcgcaccgtgaagcagatattgtggtgtcgattgaacgcccaacctcagggccttatatcattacgcgcttgtctgattactgtttaaaaatttacggtagccaaaactatctagcgcaaaacccaccaattcgccgtctggaagatttaacccagcaccgctttgtgaactatattgatgatctggtgtatagccccgagctgtattgtctagaacgcttacctttaaagcttaacgcgaactttcgcagtagcagcattttggcacaacaaattgcggtcagcgcaggcgcaggtcttgcaattttgcccaagtttttggcagatgataagcctgagctcgaagaggtgttagaacaacaagttcgttttacccataccttctggatgctgaccttcgttgatttacagcatgagccgcgcattaaactggtctgggattacttgcgtaaacaggccgataaataccaacatttactggttgattaa

SEQ ID NO: 708 - DNA, 2124 bp, Acinetobacter baumannii
aaaatgccacattctaaatttttactacaacctttatgggttgcgatgcttgctgtctctcattcgggtttagtgtttgccaaatcagaaaaaaatgatgccgataccaacacacttcactcattagcacctattgttgttacagcacagcaaggcaatgatgcaaatggtctgatcgtacacgcagatccaaagcaacctattcagccagtccctgccacagatggcgcagactatctgcaaagtattatgggttttaattcaattcaaagcggtggaacaaatggtgatgtgacattccgaggtatgtttggttcacgtattaaaattctaacggatggcacagagaacttgggtgcctgcccaaaccgaatggatgctccaacttcttatatttctccagaaagttatgaccggatttctgtgattaaggggccacaaacggttcaatatgccaatactggttcagctgcaacagttctatttgaacgtcagcctgaaaagcttacctctgaaaaaccttatcgcggtcaagcgagtgtcttgctaggttcatatgggcgtattgaccataatgttgaagcggctgttggcgatgagaaaaaatatatccgtttaaatgccaaccgttcagaatcgaatagttatcaagatggtgatggcaatacagttccatcagcatggaaaaagtggaatgttgatgtagcgcttggctttactccagatgaaaacacgtgggtcgaaatcacgggtgggaaatctgatggtgaatcgctttatgctggacgttcaatggatggttctcagtttgcgcgtgaaagtttagggcttcgttttgaaaagaaaaatatcactgatgtgatcaagaaaattgaagggcaggtgaactatagctataacgaccatattatggataactttagcttgcgtacaccaccattagttgaaatgaatcatggtggtatgaccatgctgatgccaaatgcaatggcaatgcaagtgacacgccgtacattaaactcacgtttggcaatgacttctgaatggaacaaattgagtttgatcacaggcattgattctcaattcaataaacatggcggtagcatgtcatcgccaacaatgccttcaatgaatattccatatcgtcaagatatgcgttttcaatcatacggtgcttttggtgagcttggttatcaatggagcaatctcaacaaactggtcacaggtgtgcgtttagatcgagtcacagttgaagatgaacgtgctgactctcaagcaaaaggctttaatactaagcttgaaaagactttaccaagtgcatttgttcgttgggaaaatcaacgtcctgacctcgacttcaaaagctatatcggtttgggttatgtagagcgtatgcctgattattgggagctcttctcgcctgagcatggtaatgctggcacaactaataccttcaatggtgtgaatcctgagaaaacactgcagttggatcttgggttccagcagcaacatggtgctttaaatatatgggcttctgcttatgcaggcttagtagatgactatattttgatgaattatcatgatcatagccatctgcatccaaacgaacatggtgggcatggtagtcatggtattacgcctggtgccaaaaatgtcgatgcaaccatcgctggtgcagaagcgggtattggataccaattcactgaccgtattcaggcagatttgagtgcgatgtatgcgtggggcaaaaacaccacagatgacaaacctctacctcaaatttcacctttagaaggtcgtttaaatattcgctatgtggctgacaaatataacttaggtctgttatggcgagctgttgctgagcaaaaccgtgtgagtctacatcaaggtaatatcgtgggatatgacctaaaaccaagtaaaggtttttcaacactttctttaaacggaagttataaccttcgtaaagatattgatgtctctgttggcattgataacgtattcgataagacctataccgaacacttaaataaagcgggtagtgcaggctttggatttgcgagcgaagagcagtttaacaatatcggaagaaattactgggttcgtatgagtatgaagttttaa

SEQ ID NO: 709 - DNA, 999 bp, Acinetobacter baumannii
atgcaattgcagatggcgatggtgaacttgccgagctgctcatgcatcgacatatcaatgcttcttacaaaattattgagcaaacactgctacaagcacaaggagaacataacaatggctaaacaatccgcaggtcagctatttcgcgatgccgtagcccaagaaaagccattacaagtggtgggaaccatcaatgccaatcatgcacttttggcaaaacgtgcaggttataaagcgatttacttatcaggtggtggtgtagcagctggttctttaggtttacctgatttgggaatcagtaaccttgatgatgtgttgacagacgtacgccgtattactgatgtatgtgatcttccattattggtcgatgcggacacaggttttggtgcttctgcatttaatattgcccgtactacgaaagcacttattaagtttggtgctgcggcaatgcacattgaagaccaagtgggtgcaaaacgttgtggtcaccgtccgaacaaagccattgtgactcaagaagaaatggttgaccgtattaaagctgcggttgatgcgcgtggtgatgacagcttcgtgattatggcgcgtaccgatgcgttagcggttgaaggcttacaagctgccattgaccgtgcgggtgcctacattgaggcaggcgcagacatgttgttccctgaagcaattaccgagcttgatatgtacaagcaatttgctcagaagacaggcgtaccaattttggcaaacattaccgagtttggttctacaccattgtttactactgaagagttagcatctgccgatgtaagccttgcgctttatccgctttctgctttccgtgccatgaacaaggcagccgaaactgtgtatgaaaccttgcgtaaagaaggcacgcaaaagaatgtggttgatattatgcaaacgcgtaaagagttatatgaacgcattaattactatgcgtttgaagactacttagacaacgcatttgctaaaaagaagtaa

SEQ ID NO: 710 - DNA, 882 bp, Acinetobacter baumannii
gttaaactgcatacagtaaaaaaatatgtagagggaaacatgctaactcgtgtggtgtttaaccaaaaaggcggtgtagggaaatcaagtattactgtaaatttggctgccattagtgccaaacatggcttaaggaccttggttatcgatcttgatcctcaagccaactcaagccaataccttttaggtgaagaagcaacatacgctgctgataaagcagttttagaaccaaatattgaaaacttctttgaagatgtgttgggaaataatcaacagaaaggtttaattgggaacgcactgggctcaattctaaaagctccacgcaacaaagatctcgacagttttgtacactctacatcctttgcaaaattagatgtgcttccggctagccctacgctcggtgctcttgaacatgcacttgaaagcaaacataaaatttataaattgcgtgactctattcaaagcttggttgggcgctatgaccgcatttatattgacacacctccagcctttaactttttcacattgtctgcattaattgcagcagataaggtcctgattcctttcgactgtgacgtcttttcaaagcgtgctttacaaacattgattgaaaatgttctcgaaacgcaagatgatcataatgatcgcttggaaattgaaggaattgtggtgaatcagttccagtcccaagcaaagctacctcgggaagtggttcagcagttaaaagatgaagggttaccagtgctcaatagcatgttaccgccttcgattttgatgaaagaatcacatcagaaaaatttacctttggctcacttagcgccagaacacaaattgactcagtcttatgaggcattgttcagcgaaattgaaccaaaacgataa

SEQ ID NO: 711 - DNA, 1278 bp, Acinetobacter baumannii
gaaatgacgcaaggtgcctattgggtatttgtctgctgcagtagctttatgctactgcagcatacttatgcagatgacagcgaaatgagttttgtgagccaaaactcagctagactcgatgtgtggtcatcagatcgtgatttaagttcgttaaaaaacattgggcaagcaagtttctggtccaatggtacactcaaatttaaccctgcatttaagctgcattacgacatagtggtttcagacgaaacagaccacactgtaaacccagatcaggtgagtaaggtaaatcgtaacttacgtgagttgtatgcctcttataactgggatcagacgttttatctcgacttaggacgccagattgtagtctgggggagagcagatggaattaacccaacggataacctatcgccccgtgactatacgcgtctagtaccagatgagacagatcaacgtctgggaaatgatgcaatcaaattgacgtatattcctgaatctggaaccaataaatggacggcattgtggtatccgcgtagtcgttcagatgtgattccattgcgtcagattgctggtgttcagtatgacatagaccgtaagagccgtcctgcatttgcaatgcgttgggattactccgtagatggcctagatgtaggggcatcgtatttctcaggtttagatcatatgcctgatctgtcagttctttcagcgtctccaacaggggaggtcacattgcaactgaaaaataaccctatgtccgtctatggagtagattttagttataaccataacgatcttgtgtggcgcggtgaagctgcatatacaaagactgactcaaatggcagcgaagatcttacccataagaaaaataatttaactgtagttatgggaccggaatggtcattaaaaaattctacgctgagtttagtaggcgtgtacaagcatacagaagactttaaatctgctgatagcctaacaaatccattagtgagagaagtctaccgttatcagcaaacaatcagtgaccagtatcaacagaatcagtatggagctatgctgcgttatgcgcttaacctattgaatgacaatttaaagttagagttcacaggattctattttgcaccagagcctaatgaattgttgagagtacgtattaactacagcctcaatgatcactggcagttaaatgcaggtggagatcgcttctggggcagaaatgatacggtactaggacaatttagagataacagtctggtgtatgcccaggttcgatataacttttaa

SEQ ID NO: 712 - DNA, 690 bp, Acinetobacter baumannii
acgtcaattaatttaataacgattgttataaaaatagatgtgatctttatgacaaataggcatgaaacagatcttgttaatgaggacacgttaaaaaagaagcgtggacgccctaaatgctttgatgagcagcaagtgttagagaaagctatgttacttttttgggaacatggctatgaagccacctctatcagtgacttaacacatgctttagaaattacagcgccgagcctatatagtgcttttggtgataaggcaggtttgttttacaaaagtatcgactattatctcgctcatgaagcatgccctattgaaacgatatttttagaagcaaaaactgcaaaaattgcttttgagttatatctttatgacaatgtaaaacgattggttcaacccaataagccagcaggttgtatgttggtagttgctgctatgaactgttctgatgccacacaagaggtacagcaaaatcttttagttaagcgaataaagaccaaagaaaaattattaaaacgtctcgaacaaggtgtagagcagggcgatttgcctattagtgcccctctacaagaaatgactgatttttatgcgactgttattcagggacttaccattcaggccagagatggtgcaagtaccgaacaattacataaagtggtagaacatgccatgaaagcttggacattattttaa

SEQ ID NO: 713 - DNA, 678 bp, Acinetobacter baumannii
acgagaactaaactcgaaataaaacaatcaaaatacagaggaataatccacgtgtttggcaaaacgcaacgcggtgtatctgaaagacctaacaagcctaaaaagcctttaattcctaaatggttagggacacttgtcgctattttagcggtcttatgtatcgcagtaatgctcatgctttggaaaccgtggcaacctgtttcctcaaaaaaccagattacttctgagcactataaagaagaagaaaccaataaagattatcgcttttatgatctattgcctcaacagcaggtcactcctattccggaacaggcaattccggaaagtaaaaatcagggtactgccatgattgtagaagcacctagtacagctcaacctgccgcttctgaacctgcaagtgtaagcactgacgacactactgactcaacagctgctatacctcaacaaccaaattatattttacaagttcgcagctatactgaccccgatcaagcagatgctcgacgtgcagaaatcattttaaatggcttatcggctgatgtaattaaaagctctgagaatggaaaaacttggtatcgtgttatttctggtccatatgacactcaagaagctgctctcgctgctcaacaaacattgcagcatagcggtattgactctattgtgattaaacgcagataa

SEQ ID NO: 714 - DNA, 279 bp, Acinetobacter baumannii
tttggtaataacctaacctctgaggaatttttcatggaactcactttaggtctagttgcaattgcatctgctatcttgatcgctttcggtgctttgggtactgcgattggttttggtcttttgggtggtcgctttttagaagctgttgctcgtcaaccagaattagctccacaacttcaaactcgtatgttcttaatcgcgggtcttcttgatgctgtgcctatgatcggtgttggtattggcttgttcttcatcttcgctaatccatttgtaggttaa

SEQ ID NO: 715 - DNA, 1038 bp, Acinetobacter baumannii
gagatcaataaaatgaatacagaaaatcacttaatgattgagcgacaaggtaagcttggcgtgatcaccttagatcgtgtgactcatctcaatgcattgtcgttagatatgattgaaggaattggcgcccaattggagttgtggcgaaatgatgctgctgttcaggcgatcttaattaaatcaaatagcccaaaagccttctgtgcaggtggcgatattcgctatctctatgacagttataaaaatggcacagccgattacaaaggctactttagtgcagaatataaaatgctcaatacactgcgcgaatatgaaaagccaatcatcgttgtgcttgatggctatgtattaggcggtggttttggcttggctcaggcgtgtcacattgtggtaagcagtgaaaagtccagatttgccatgcctgaaacagcgattggttttttcccggacgttggcgcaactcatttcctgtctcgtcttgatgatattggcgtttatatggcaattacgggtgagcagatcagcagtagcgatgcgctctatctcgacttaattgactaccatgtgccaagcgatcagttacaagctttacaagacgctctcgttgaagcgccaagtttaagcaaagagggaattgaacacatcattacccgatttattactcgtcctgctgaaagtgagctcaaacagttggcagaaggtatccgtaaacattttggatttcagcatttagatgagatcgaacaaagccttgaaaatgaacaggatgaaagcttaaagacttgggcgagtaaaatgcttagtattttgcagcagcgttcatttattgccaaacaaaccagcttgaaactgcaacatttaggccgtggactttcactacagcagtgtatgcagcttgagcgtgatttacaggatatctggtttgagcatggtgactttattgaaggcgttcgtgcgctcattgttgataaagataaacaaccacggtggcaagaacgtaatcctgagctggaacaaattttagaaaaactaagctaa

SEQ ID NO: 716 - DNA, 459 bp, Acinetobacter baumannii
gcattaaataaaggtggcaatatgtttaatccaaatgtggtggtcaaaaatatcgtgacgcaaccaggcgcagacagttttattagccttgttgctcgtcttcttatcgcttatatctttcttgctgctggttgggggaaaattaccggttatgcagcaactgcaggatatatggaagcaatgggtgttccaggtggacttctaccattagttattctggttgagttcggtggtggtttagcgttgttatttggtttccaagcacgtttcgcagcttttggtcttgggatctttagcatcttaactgcgttcttatttcaccaaggtggggctgatgcagcagcacaatataacaatggcatccactttatgaaaaatcttgcaatggcaggtggtttattcttcttgatgcttcacggtgctggacgtattagcctcgaccatgcaattgaaaaataa

SEQ ID NO: 717 - DNA, 633 bp, Acinetobacter baumannii
tttaaaaataagacttacataacaagacccgtgatgggcataaagaaggaaaccgttatggaaacaatattgggtttatgtattggtgtgggcctgagcgcggcctgcggttttcgggtgtttgtgccgctactggttatgagcattgccaccatgatgggatggttcgagccatcaaaaggctttgaatggttagctctaccatcggtgtgtttggctttaggtgtggcaacggtgtgtgaagtcgcagcctactatatcccgtgggtcgataatgccttagacacagtcgcaacccctgcggcgatgatcgcgggtacgttagcgacaatggcggttagcagtggagaaatgtctcagtttgccagttgggcagcagccattattgttggtggtggtacggcaggtgtggtgcaaatgagtaccgttgctgcacgtggtgtttcaactgcaaccacgggtggtttagggaactttatcgttgcgacaggggagtggattggagcaatcttactttcagtttcagctatgctggtgcctgcgcttgttgcaatagtggtactgattgcggttatttgggtggtgcgttggattcgccataaaaagcaagaacaggcgcataccccgctatag

SEQ ID NO: 718 - DNA, 1869 bp, Acinetobacter baumannii
tttatggataatctaaataacgcaaaaaaagataatttttcacggaagaccatattagtaacaggtgcagcaggttttattggcagcagattgatcgttgaacttttgcgtgaaggtcatcaggtgattgctgcgctgcgtaatgccgcaaccaagaaagataagctattaggtttcattgcaacagaaggactggtcgatccgtctatttcgttggtcgaatatgatttaagccgcgattttaagctggactctctattatcggacgcccagacaaaaatccatgtaatttatcatctcgcagcatcatttaattggggcattagcaaagctgaagctgagcgtaccaatattaagtcagggctggcgttaattgaatgggctgcaacattgaagcagcttgagcgatttatctggattggcgggtatcgtgtggctgcgccgccgcaagaatcggctgatgagttgtattgcaaacatggtggttatgaggcttcaaaaattctaggacatcaagctttcattgaggcctgtaagcgtttaaatgtgccatggactgcaataaatccagccacagtcattgatggtttttataattatggcgatatgcaatatatcggtattgctgacatgattgataagctctatcagggacgtttactggcattaccaggtggtcgtgacacattcctacctctatgcaatatgcagtatatcgtgagctttctgatccgaacgatgtcttatcctgagaccattgctcaggagtatatgctgcttgatcctgcgacacccaaatttcatcgcctagttcacctagctgctgagcatttgggagttagctcaccacatttacaaatacctaaagttttgctcgagaaattaccagaggtattacttgacggttctaaagagcaactttctttcatttctaccgagcactaccatgttgctggggcagaggcgatggcggcgaagatgggcatcgcagacctgatcagtatcatgccttatttttctcgctggattgatcgcttggtgtttacacgttttggtcgtatgcaagtaccaacacctaattcttttagctatcagaaccgctattggacagaaatttatactaaacagccagttggttcagaaaaagcttctgcattatttttacacggtattccatttgatagtgcatgttggtctccaatcatcaataaaattacttatgatcaggtcgctatgatggacttaccgggacttgggcgttcaggtagttatgaaatgatggaagataataaccatcaatttattgatactgcggcagagcttttggcaccaaatagtgtggtgattgcccactcattaggatgcctttttgcattaaatcttgcaaagaaatatccagataaagttgcacgccttatccttatatcgccttattttgttcaggcacaggctgcaaaaatgtttcagatacaagcgatatctaaactcattttccgttttgtgccgaaagatgtgattgctaaagatttacatccagaggggcaacaaaatctgtcagtgagatatgcgatggattcactacgccgcatgtcagtgtctaagcatattagtgagtacatgcaccacattaatttgccgcagcagcgcgcagcacagacagctttgctttctgagcttcgatctaaaatcgagattattgtgggagagaaagatccaattgttaccccaatcagtccagatatcccggtacatatcatcgctggtgcaggtcataatccacacgttacccatgtagaagcggtttatgattaccttacaccggttctgacaaagtacatcagcactacagcacagcttattgatgtctga

SEQ ID NO: 719 - DNA, 891 bp, Acinetobacter baumannii
ttagagggtaaatgtgtgatcaaaaaagcagttttacctgtagccggtttaggcacacgttttttaccagcaagtaagtcaattcctaaggaaatggtcacagtggttgaccgtcctgcaattgaatatgtagtacgcgaagctgtagaggctggaattgagcaaattattttagtcactcattcatctaaagcctcgatcgaaaattattttgatcgtaactttgagttggaaacgactctagaacaaaagaaaaaatttgacttacttgcagaaattactcaaattgtgcctgaacatgtaagtataatcagtgttaggcagcctcaacctttaggtttaggacacgctgttttatgtgcaaagagtatcgttggcgaagatgattttgcagtgctcttaccagatgtgctagtgaaagatagctctggacaaaatgatctatctcgtatgatttctcgctacaactcaagccaagctgctcaaatcatggttgaggcagtgccagatcatttagtagatcaatatggcattgttgatgtaaaacttagcccaaatgagggcgaaagtattgctatgcagggtattgttgaaaaaccccctgtaggtgctgcaccatcaaacttatctgtggttggccgctatgtgttacctgccaagattatgcaattacttgagaacacgccgaaaggtgcaggtaatgaaattcagttaactgatgcaattgcaatgcttcaagatacagatacagttgaagcttaccgtatgcaaggccaaacgtttgactgtggtagtaagcttggttatttaaaagctgtattacattatggcttagaacatccaaaattaggaatggaatttaaacagctgattcaagaacttaaattataa

SEQ ID NO: 720 - DNA, 909 bp, Acinetobacter baumannii
aatgctatcctctcacgctttgtggttgttgagcttctaatggccttctatagtccattacgatatcccggtggaaaagggaaactttcgtattatataaaagcacttattaaggaaaataatctttttgatgggcattatttagagccttatgctggtggggctggagtggctttagagttgctcatggaagagtatgtacgaaagattcatataaatgatattgatcctgctatttttagtttttggcattcagttctttatgagacagaggatctttgtcgactaattaatgatacacctgttgatatgacgacttggcatgagcaaaaagcagtattagccaatccagaccaacactcttctttgcaaataggtttcgcgacatttttccttaataggacgaatcgctctggaattttgaaggctggagtaattggaggtaaggagcagtcaggtcaatggaagttggatgttcgctaccaaaagaatgaacttttaaggcgaattaatgagatcgcaagctatcagtctagaattggactgtcgaatgttgatagtgctgagctaataaaaagtctacctcaaggacctcataataatactttggtttatcttgatcctccgtattatgctaaagggcaagacttatatagaaatttttacaatcatcaagatcatgttgaaatcatgagagcgcttaaaagctcatcgataaaaaattggattgtttcatacgataatgtcgatgctattcgagagatatacaaagattttagggtgctagaatattctttgcaatacactgctcagcagaagaaaattggtgaggaagtgatgatcttttccaatgatgtgttaattcctaatgttagacttggaaagtctattgatgtgtcggaagtttaa

SEQ ID NO: 721 - DNA, 396 bp, Acinetobacter baumannii
agcaacaacaaggacaatctaatgaaccgcgattacgaacaatttccagatgatgataacggcaatgtactttggcaaatggttgaagacggggatgatttaaccgagcttcatgaaattgaattttcaattgcatttcaagatcaacaaaatgcagagcaatgcgcgatgcatttactctatcaagagcaaaaaatttctcttttccaagatgattctgttgaaccgaatgaatggatcattaccatctttgtcacgatggaaccagagtattcagatattgttgatctggagcagtggttttcgacaatcgctgagcaatttaacggcgaatatgatgggtggggctgcatggcttatgtcttcgacgaagaagaagatgacattttacaataa

SEQ ID NO: 722 - DNA, 336 bp, Acinetobacter baumannii
ataactctaaaatttagggagaactatcctatgaagaaggcctataaaaatatagttttaaagtttaaaaaacttaaaaagcgtgaatttaaagaaatgcctgactatctattagttattttcggtgcttcagcctttttgatttcgagttattggggattcgttgtaaccgaagtgactccagactttattagagctgtgaacaagcaagcacatatagatatattgggtatctcactcggaactattttattagctttggccgcagaggtatggttttttggtgcaatagcttttcgctgtaataatcttctttatgaaagatggtttaagtaa

SEQ ID NO: 723 - DNA, 1455 bp, Acinetobacter baumannii
gcaaatataaaaaggacttctaatatgacaatggttcatcattcagatgaggcaagttcccctgatcatttacaacggaaattaagtaatcgccatttacagctcattgcaattggcggtgcaattggtacgggtctatttatgggctcgggcaaaaccatctccctcgcaggtccttcgattctcgttatttacatgttaattggcggtatgttctttttccttatgcgtgcattaggtgaattactgcttgctaatttacattacaagtcatttgttgatatggcatatgacttaatcggcccatgggctggctattatattggctggacctattggctaggctgggtattggtcggtattgccgatctatcagcagttattaattatttaagtttctggttgcccgagggtgccagtttctcaccaatgcaacaggccatgattagtgcgggctgtgtactattcgtgttaggacttaatttgcttacggtcaagttgtttggtgaagtagaattctggttcgcactcattaagattttggcaattattggcttaattggtgtgggtggctatatgattctcactcatttccaagctcctcatggtgacgttgtcagcatcagtaatgtctggtcgcatggtggtctgtttccaaaaggtgtaagtggatttttagccggattccagattgccgtatttgcctttattggtgttgagttgatcggtaccacagcggctgaaacgaaagatccgcaaactaacttaccaaaagcaattaacgcgattccggtacgtattattctgttttatgtgctggcactttttgtcgtgatgtcagtgacgccttggaatcatattcgtgcagataaaagcccgtttgttgaattgttcttaaatgcaggtattccgatttcagcaattatcatgaacttggttgtgctgtcttcggtcatgtcttcgatgaacagtggcgtgttttcaacgagccgtatgttgtttggtttatcaaaagatggtcaggcaccgagtgtcttgggacgtttatcaaaacgtgctgtaccgtcaaatggcttaatcttctcatgtattttcattatgggcggagcagtgcttcagtactttgttccaaacacaatggaagcatttactttggcaagttcgctctgtgtgattttattcattagcgtgtggattttaatcatggcatgttatttacgttatcgtaaaattcgcccagagttacatgcagcatctaccttcaaaatgccgggtggtgtgttgatggcttatgccgttattgcattcttcttgtttaccttggtgattttggcattagagccagataccttaaaagcgttatacgttagcccagtatggttagtagttttaagtgtgacctattatgcgttctataagccgcgtatgagaaaattaggtcaagaaattttttaa

SEQ ID NO: 724 - DNA, 1149 bp, Acinetobacter baumannii
agcagggtaaaggaaataataatgcaatttaccgaagaacaattactcattcgtgatatggcgaaaagtttcgcccaagaacaaatcaagcctaatgccagtgattgggatcgagatggaacttttccaaaagaaactctgactcaaatgggacaactcggttttatgggaatgcttgtttcagaggaatggggtggttcagacacgggtaacttagcctatgtactggcactcgaggaagttgcagcagcggatggtgcaacctcgaccattatgagtgtacataactcggttggttgtgtgcctattttaaaatttgggactgacgagcaaaaagagcgctttttaaaacctttggcacaaggtgaaatgataggagcttttgccttaaccgaaccgcatactggctcagatgcagcagccatcaagacccgtgcggtaaaagatggtgacgattacattttaaatggtgccaagcaatttattacctcgggtaataatgccggtgtcattatcgtatttgctgtgaccgatccgagcgcaggtaaaaaggggattagtgcatttttagtcccacgcgagacaccgggttatgaagtgattcgcgttgaagaaaaactgggtctgcatgcttcagatacgtgtcagattgctctgacagatgtacgcattcacaaaagcctcatgctaggcaaagagggcgaaggcttaaaaatcgctctcgccaatttagaaggtggacgtattggtattgctgcacaagcagtcggtctagcacgtgcggcgctcgaagaagcaactcgctatgccaaagagcgtattacttttggcaaaccaatttttgagcatcaaaccatcgcatttcgccttgctagcatggcaactgaaattgaagcagcgagacaattggttcactacgccgcacgtttaaaagaagcaggtcaaccatgtctcaatgaagcttcaatggccaaactatttgcttcagaaatgacggaacgtgtgtgctcaagtgccttacaagtgtttggtggctatggttatctcagagacttcccaattgaacgtatttaccgtgatgcgcgtatttgtcaaatttacgaaggcacaagtgatatccaacgtttagtgattgcacgtagtctataa

SEQ ID NO: 725 - DNA, 204 bp, Acinetobacter baumannii
ggcaaaaaccttagcaagtatgcatcaataattctggaatctaaaaaagcaaaaaatggaagcccgttatccagacttccattttcaactattaagaaccttattgagctgatgaactatgcatttcagcgtgattcatttgctcatgtgactccatcatctgcttctttttttgacttggcatgtagtcaggctcattgttga

SEQ ID NO: 726 - DNA, 282 bp, Acinetobacter baumannii
gtgccttttgaatttggagcgggaaacgagactcgaactcgcgaccccaaccttggcaaggttatgctctaccaactgagctattcccgcatgtatgagcagtttttactaaaactttctcaaaaaaaaccaatctggagcgggaaacgagactcgaactcgcgaccccaaccttggcaaggttatgctctaccaactgagctattcccgcgtgccgcttataatacattaagcaaaacaagggtcaacaactttatgcaaataattatgctgattgcataa

SEQ ID NO: 727 - DNA, 792 bp, Acinetobacter baumannii
gagatgtctgatttcattcagttagaatatctacaagaaaaattacagcaacttttagcgaaatcattatttgcaatctatctttatggttcagctgttgatggtggtttaggaccagaaagtgaccttgatgttctggtcgtggttactcaaccattaacatctgctttacgcgagcagcttgcacaagaattactaaaaatttcacagcctgttggggaattacaaagaccattagaagttactattttattaaaagatgagattcagtctggaaattatcctttaagttatgaaatgcagtttggtgaatggctacgtgaagaacttaaagaaggtggaacattaagttcgcagaaagacccagatattagtatattgcttagaaaagcgagatttcatcatacagttttatttggtccagctttggaccaatgggcacctgaaatttctgatcaagaactatggcaagcaatgtctgatacttatcccgaaattgtagctcattgggatgaggatgcagatgaaagaaatcagattttagctttatgccggatctattttagtttagtcatgaagggtatcgcttcaaaagacaatgcagctcgatgggttatgcctcagcttcctcctgagcagaaattcgtattgcagcggcttatacaggaatatagaggggaaatcggcaagcaaaattggcaagaggaacattatgctttgcagcctattgttaattttctgagttcaaaaattgaagagcagtttgagcagaaaagaaatttgatcacataa

SEQ ID NO: 728 - DNA, 189 bp, Acinetobacter baumannii
aaaagctatgacttgcttcatcaagccaatagtgtagatgaagccactttacagctatgtgataaacatttacttcaacgtgtgtgtacgctattggaaattaatcgcttgagcctttatctccataaaaaagcaaagcctatgacagcatcacagaagcagaatctcgtccaacataaacaaggctga

SEQ ID NO: 729 - DNA, 1227 bp, Acinetobacter baumannii
gtaagtaacgatatgcaaatgattagcccgactcgacttgcttcttttaatgacatgcaagacagtaatttctttactcagtttttaaatatctgttgtgaaaaaccagtacaaccaagctatacggaatatgtctctttacaacatgccctttatgaaggggatattgaaatggacaaggtgattgattgggttatgcaaaatcccaaagatcaccgaataatttttgagaagatattatttcaaggccgtgatgaactctctgagcttatacctactgagttagaaaatttctttaattacatcgaacaaaagcctgaatggttagatcagcgccaaatcgatgaggctgttaaatttacccatcgtttaggaataaataatggttttattcttagagatttatccttaatggcgggatatttatatccgggatttaatcaaccgctaattttaacgggtgcattaaagaaagaagcgggaacacgtttagcagaaaccacaaaatggtgggtagatattactgaaccccaagggctttctcgtttgagtgcaggttttacgtcaacgatttatgttcgctttattcatgcactcgttcgccggcaattaaaaaagtctgaccgttgggatagtgaggtttggggaattcctcttaatcaatttgatttagcaatgactaatttggcttttagcagtgtcgttttactcggtattagagctttaggtatatggccaacaaaacaagaggcaaagagttttttacatttctggcgttatgttggttggttaatgggtattgatgaaaaatggcttattcagtctgaacctgagggttggaggttactttactggatgcagtttgctcatcctcgctccgatcacagcagtattgaattaggattgagcttgtcgaaagaaccttttgagagaaaatatctgcatttacgctctttacagcagaaacttgcttatcgacaacatttagaacttacccaattttttattggtaagaaaagaatgaaactactcggattgcctcagcaatctgcctcatggtttgcttattatttacttgtgcgtaatttactactttataatggcgcaaagctttcaccaaaagttgaaaagtttttatctaaatcaggccgtaatatacaaaaacttggcttaacgctttatcagaatcaaggtaaggcaaaaaccttagcaagtatgcatcaataa

SEQ ID NO: 730 - DNA, 939 bp, Acinetobacter baumannii
ttgaggagagatcttctaatgactgctcaatctgtcattttgccattaccatcagatcatgcccgttttattgttcttcgtttaaaagatttaacaattgctgaattaaaagaacaactcgaagctttattcgaaacacgtgaccgtctcattactcaacattcagacgcacaaattaaaacagcagtcgcttttggtccagaactttggaagcagctttacagccaatctcctgctggttttaaacaacttgaaccagaaaatggcgcattcaatatgccagtcgtaccagctgatgtgcttattcacattgccagtatgcgttctgatatctgttttgctttaagccaagcattttttgaagggattaaagataaagttgaagttctggatgagcgtgtatgcttccgttatttcgatggtcgcgatattactggctttatagatggtactgaaaaccctcaatttccagatgaccgcgcagaaactgctctcctcccagaaagtgctggagtatttgcagatggtagtttcatatttgcgcagcgctatgcacatgacttggaaaaatggaaaaaacttaaagtcgatgcacaagaaaatgtcatgggccgcaccaagcttgaatctattgaattagatgatgatgttaaaccggaaaatgcccatgtcgctcgtactgtcgttgaagatgaggaaggtgaagaaatggaaatcctacgtcacagcttaccttatggtgacggtcgaggtgatcaaggtttatttttcattgcttacactaaagacctgagcattattgatgcgatgttaaagcgcatgtttggtacaagtggagatggcattcatgaccgcttactgcacttcgtgacaccacttgacggggcatattactttgcaccaagtgaagaactattagaagaaattttagaggcttaa

SEQ ID NO: 731 - DNA, 1155 bp, Acinetobacter baumannii
ttaatgctggatgtaccttttacaatgctcactcaactttcttcacaccactaccacacacttaaagtgtggtatttggtgcagcattctttagtcagctttaaaaaaattattgattattttggaaattgtgaaaaagccactcaacctgatggtttagcaaagtggtcctctctggggctacatgctaatcacttaaagcgtgtaaacgaatttcaaacgccccaaggtcaggcgcagtttgaacaacttgtacaacaagttcgtcagcatacggattttattttaacggcagatgactcaggctacccctctcaattacttccttatacagattatccacctattatttttgggaaaggtcaagcacaagctttattgcaacctcagattgcgattgtcggtagccgaaaaccaagcccacatggacgacaggtcgcttatgattttgcttactacttaagtgaaaagggctttttcattagtagtggtctggcttatggcattgatgaagccgctcatcaaggtgcatctactcatcaacgtaccattgcagtgacgggtacgggcttagacactacttatccagctcaaaataaaaaacttgcagaacatattttggctcaaaacggcgccattattactgagtttttaccgggtacaccgccattacaacagcattttccacgtagaaaccgaattgtcagcggtttgagtttaggcgttttggtggtagaagcgacattaaaaagtggctcactcatcacggccaataaagctgctgaacaaggtaaaaccgtattcgcgattccgggccatatttatagcgagtttcatcaaggatgccatcaacttatccgtgaaggtgcaattttaatcgaccatcctgaacagattattgaggatcttgctttaccaacccaatggcaaagtcagcaacaaaatcaaactgaagaagctaatacgaatactccagaaattcctgagcatttgattgacctttatcagtctttagactgggtgggacaaaatattgaccaacttgtagttcaccataatattccagtttctgaactgacctcttcactaatggaactagaactactcggtttatgtatgcaacaatcagggctgtatttacgttgtcgttcttag

SEQ ID NO: 732 - DNA, 723 bp, Acinetobacter baumannii
gagcaaatggaaagttggcaagaagatttattatcagcatttttggtggtaaaaaatgaataccagttatttgagatcgttaaatctaccgcatcaaggctcggatttgactattgcgcttatggtatgcaatcacccttatctattgctgaaccaaaaacaattatgttgaataattatccagaagcatggcagaaacgttatgtggaacggcaatatgtgaagatagatccaactgtgcagcattgtatggtatcacttcaacctcttgtttggtcgagtcaatctgcaaagacacaggcagaaaaagatttttgggaggaagcatgttcttatggtttaaatgtcggttgggctcagtcaagccgtgattttattgggacccgaggaatgctaacactggcaagatccaacgaccagttatcagaaaaagagcaaaaagcacaatatacgaatatgtactggttaactcaaacagtgcattccagcattgctaaaatagtaaatgatgtagagtttgctaaattcaatctttatttaacgaacagggaaaaagaggcgttacgttggactgccgaaggcaaaacgtcagcagaaatagctcagattcttggagtaactgaaagaaccgtaaatttccatctcagtaacgccatgcaaaagttaaatgtaaataataaaatttcagcagctattcgagctgtaatgctagggcttttgtag

SEQ ID NO: 733 - DNA, 813 bp, Acinetobacter baumannii
gccatgatggaatggttacaattattgttacccgcatggattatgggaaccttattagtctttttgactgcaccacttggttgtctcatgctatggagacgtatgtctttttttgcagacaccatggcacatggaaccttacttggtgtagcaattgctggtgctttaagccttcctctctggcttggcgtagcaggtactgcaattttattagtcgctattttgtgggcactacatgacaatcgtttaccaaacgatgctttgcttgccctatgctcagcaacattactatgtagtggcctcctgtttattcaacatgttccaagtttaagaccggagcttttaagttatttgtttggtgacttactaagtattgactggccagatctgcctatttttacattaattattgcagtatcactcgccattctttatcgctattggcagcctcaaattcaaattgccattgatccggatattgcgattagtgaaggtgtgaatgcgaaatggcagcgtctcatttttatgttactgctagccttatttaccgtattggctttacgtgcagtaggttcacttttaatgggtgctttactggttattccagcattgagcgctcgattactcgctcactcaccaaagcagatggttatttgggcctttgttttagctcaactcggtgtcagtgttggcctatggtcaagcgcagcacttaatatctcgactggcctcagtattgttttatgtatggctttaagttttgcacttatctttatggttcaaaaaatcaaaaatcaaactcaagcagcctaa

SEQ ID NO: 734 - DNA, 1233 bp, Acinetobacter baumannii
caaagtaaggatttctttatggaccaatctactacttctaaagcacgacccatgacttccacacaagggagctggtttgctattttggctgttgccatcgcagcctttgccttggtaacgagtgaatttttacctgttggtgtcttaaatagtgttgcagccgatttacacatttctgtaggtacagcaggtcttattattacagtacccggcattatggcagcgattgcagccccactattacccgtttcagtaaagcaacttgaccgccgttatgtgcttattttactgactgctattatggtgattgccaataccatcacggcttttgcagaaaactttcatgttctattgttgagccgtttaattttagggatttcaattggtggcttctgggcaacagcaattgccttaagcggtaagctcgcacctgcaaatttacctattgctaaagcaactgctgtagtaatggctggtgtaactttcgccactgtactaggtgtaccgattggaacatggttaagtgagttttacgggtggcgcagtgcctttggaattacagctgctatcggtcttgttgtattagtgcttcagcttattttcttaccaaaacttttaccagagtcagcaatacatattcgtgatttacctgcattattacgcacacctaaagcacgtagcggcatgcttattgttttattaattgggcttgctcacttctgtgcatatagttatttagcccctttctttaaaaatgtagccgggtttaatggcacaactattagctcattattattgctttacggaatagccggtatttttggaaatgcatttgcagggtacagtggtaatttaaatgttcggtataccttagctttcgttggaacatgttttgccattgtattctttggcttccccatctttgctatccatgagtttggtgccattgtccttacagcattatggggcttcgcatttggcgcattccctacctctgccaatatttggatgtttgtacacgcacctcatgctgtagaaaaaggtatgccgctttttgttggtatgttccaagtcatgattgctacaggatcattattaggtggttatgtagttgatcatttcaatgaaaatactttaatttatggggtattaagcttcgttgccttagctttaattagtacatttaccttagccaaaggtttaaacaatcccaaagcaacatgtgaaaattag

SEQ ID NO: 735 - DNA, 1176 bp, Acinetobacter baumannii
ataggaaaggacaatcttatgagctcaaatgaaacaacaacaggcttcaaaccaaaaaaatcagttgcactaagtggacaagttgcaggcaacacagcactttgtaccgtaggacgtagcggtaacgacttgcactatcgtggctatgacattcttgaccttgcggcaggtagcgagtttgaagaagttgctcacttgctcgtacatggcaaattaccaaacaaagctgaactcaaagcatataaagcaaaattaaaagcgcttcgtggcttaccagcagcacttaaaactgcacttgagcaattaccaccgtctgcacacccaatggacgtgatgcgtactggtgtttcagtgctaggttgtttaacgccagaacatgaagaccacaacgaagctggcgcaaaagacattgctgacaaattaatggcaagcttaggttcaatgctgctttattggtatcacttcagcaacaacggtcgtcgcattgaagttgaaactgatgacgactcaattgcagcgcatttcttgcacttacttcatggcgaaaaaccatgtgaagagtggattcaagcgatgcatacttcacttattttgtatgctgagcatgagttcaacgcgtctacatttacctcacgtgtggttgcaggtacaggttctgatatgtactcggcaattacaggcggtattggtgcacttcgcggacctaagcacggtggtgcaaacgaagttgcattcgtgattcaacaacgttacgacaatccagacgaagcagaagcggacatccgtaaacgtgttgaaaataaagaagtcgtaatcggatttggtcaccctgtatatacagtttctgacccacgtaacgaagtgatcaagaaagtggcgcatgacttagcagaagcgcaagagaacaccaaaatgtacctcatcgctgagcgtttggaagcagtaatgaaagaagtgaaaaacatgttcccgaacctcgactggttcagtgcggtgagttatcacttaatgggtgttccaactgcaatgttcacaccgttattcgtaattgcgcgtacagcaggttggtcagcacacgtaattgaacaacgccaagacggcaaaatcattcgtccaagcgcgaactacacaggccctgaaaacctcgaatttaaaccattggcggagcgtggttaa

SEQ ID NO: 736 - DNA, 567 bp, Acinetobacter baumannii
gtggaagcacttgtaatgaatattattgctggatttcaaaacaatttttcagaaggcctatataccaaatttaaaagttaccgctacagggtatttgttgaatatttgggttgggagttgaactgtccaaacaatgaagaactagatcaatttgataaagtcgatacagcttatgtcgtggctcaagacagagaatccaatatcattggttgtgccagactactacccaccacacaaccctatttactcggggaaatatttccccaacttctcaatggaatgcctattccctgctcaccagaaatttgggaattatcaaggttttcagccgtagattttgcaaatccgccttcctctaccagtcaggctgtgtcatcacctgtctcaattgcaattctgcaagaagcaatcaactttgcaagagaacaaggcgcaaaacaactcattacgacttctcctcttggagtagaacgtttattacgtgctgcgggttttcgtgcccatcgtgcaggtccaccaatgacgattgatggatattcgatgtttgcatgcttgattgatatctaa

SEQ ID NO: 737 - DNA, 723 bp, Acinetobacter baumannii
ttggttttttggaactttataatgaacaacaatattataatttttggttatggaacaggtatttccaaagccgtagcacataagtttggtaaagaaggctataaaatcgggttagtggcacgaaacgcccaaaaacttgaaaaggctattctagaacttaaagcacaaggcattgaagcttacgcttttgcatgtgatttagctgttcttgaagatataccaaatcttattaaacgtattaaagatcaattaggagagattaaaaatattcattggaatgctttccatgatattgaaggcaatattttagaaacccctccactagaacttaccaaaagctttcatattcgcgtgtcgagctatattgcgacggtacaggcttgtttaggtgatttagagaagaaccacggtagcattttatcgacaaatggaatttttgctttcgatgcagtgggcatcgacttggttgccaaagagtactcatcgttagcaactaccgctgccgctcagtataaaactaccaacttacttgctcacagtcttgctgacacaaatgtttatgtaagccaagtgattgtaaatggtttcgtagatggcagacctgaagccaaagataaaacctacgcggtacatccagaaacagttgcggagcagttctggtacttacaccaacataaacaagaaacagtttctctttgtggagaagccattcaagctgcttaa

SEQ ID NO: 738 - DNA, 948 bp, Acinetobacter baumannii
agtctcttttgtagttggtgtattactatgggtcaggtcatgaaatatcacaaatgggcatttatttttcccattctggcagtactgatttggtctttaaatattgtagtcacccgctatgtctcggactatatttctccggtaagtatcagcttttatcggtggttaatcgcttttattattttgactccatttatgtttttgtctgtttggagacaaagacgactagtaataccctatttacctaagcttgctgtgttaagtgcatttgggatggtgctttatcaaggcttggcttatacggctgcccattatactagtgcaaccaatatggggattgtgaatgcatttattcccatctttacgatctttgtttcgcttgccattttaaaagatgtgcctaatcgctttgcagtttttggcagtattttgtcttttgctggtctgctatacgttatgtcccaaggaaatattaataagcttttaagtggtggcgggcaccttggcgatgcattgatgattattgctgtgtttttttatgcattttatggagttttcttaaagaaatggcagctcccacttccaattatgacaagcttatacgttcagattggtttttccgtgctgttccatcttcctttaattttctggtttggtctggatgccttaaatgcacaaaatgcgccaagtgcaatttatgccggtgtatttgcttcactcattgcgccgctagtttggatgttagccgtacaacaacttgggccaaatagaaccagtatctttatgaatcttgtgccagtgttcaccgccattattgcaagtatctggttatctgaacaatggaccatatatcacaccttcggcggaattatgattctggtgggcattatcatggcacaaaagaaggttaattctaaaaaatcagatcttttgccagagcaaaattaa

SEQ ID NO: 739 - DNA, 1530 bp, Acinetobacter baumannii
gctaaaacttgtgagtttcatagaagtaaaaataatatgagtgagattaaactgatccctgttagtaaactactacttgatttggaaaatccaaggtttccagaagaggttactggacaacgagcagcaattaatttaatgctaaaaattcaggaagataaaattacaaatttggcaaaagatattgcagttaatggacttgacccatcagaaaatctaatggtttttgaaagtgatgatgagccgggcttttatgttgtggctgaagggaatagaagaacaactgctctcaaattgttagctaatccaaattccgctgatagtgagaagtttaaaaagatattcaataaaattaaagagtcagcaacaaattcaattagcaaggtaagttgcgttgtgtttgatgatgaaggatatgagcactgggtaaacttaaaacatacaggggataataaaggggttggcaggtcaagttggacaactccggaagctgatcgttatagagagaaacatggtaagacgtctattcaaaggcagttgtatgattttatggaacgacaagaagaagcatatgcagatatcttgatgaataaaaagtttgttcatgcaacgaacctaagccgtttatttggtgataagagaacaaaaagatgctttggtttaacgacaatggatggttatttgtatagtgcgttaccattcaatgagtttgtcagtaaattaaagaaaatacttgaagtaatgactgaggtatcagatggaaaaaatagtcctgacttcaatgtgaagagaatttataaaaaggaagatagggcagattttcttaatgagttgggatttgaccctgaacctcaattactacctcattcgtggaaacttgatgatcctaaagctgggtatgtcgataaagaccctcaacaagggaaagctgaagaagagttgccaaaaccgcaaggggaagtcgagaataaaggacaaaaaaataatgatgtaaaagatgatgaggttgatgagcctaataagccaaagataattaataagccgattccaaatacaaatcgtaatagcttagttccatccacattgaaattaaattttggtggagatatgaaatgttccaaaatcttttatgagttgaaaaataagttggggcacgatgaaacgccatattctttagctgtaatgctaagggtatttattgatttatctacgactgcatttatggagaagaagggtatcaaatatgtggatacaaaacagccgacaagaagtccaggattgcatgataaagtcgttgaatgttgtaagtatttaaaagagcaagggttgcttacacagccacaagtaaccgcgatatgtaccttttcaaaagataaattaaaggcggatggttcattacagcaatatgtccataatcaacacctgaagccttcgaaagacatcgttaacactgagtgggataattttcagccgttatttgagaaaatttggtcaactgagatgcaagttactaataaaggtggggcataa

SEQ ID NO: 740 - DNA, 1782 bp, Acinetobacter baumannii
tgcggtctgtggtttgaggaacaacatttgcacttaatttttaattggtcataccaattgtgtttaatgtttaaaattttaaggtacaaaaattcgccccggcatttcaaggagatgacaatgctcaatatgtggcaacaactttatgaccctttaaataatatttggctgtccagtgcggttgcattaatcccgattattttcttctttttagcattagcagtttttcgtttaaaaggtagtatcgcaggtacgggcacagtcattattgcattactaattgccctctttttctatcaaatgccgggtcaaatggcctttgcatccattatttacggtttcttctacggtctatggccaatttcatggatcattatcggggcagtttttctatacaagatttcggtaaaaacaggccagtttgaagttatccgctcaagcattctatctattaccgaagaccaacgtttgcaaatgttactcgttggttttgcatttggtactttccttgaaggagctgcgggttttggtgctcctgtcgcaattaccgctgccctacttgtcggtttagggtttaagccactttatgctgctggtttatgtttgatcgtaaatacagcaccagttgcattcggtgcaatgggtattccaattattgtggcggggcaggtgtcaggcgtagacactatggaaattagccagatggtgggtcgtcagttgccatttttaaccattattgtgctgttctggattatggcgattatggatggctggcgtggtgttaaggaaacttggcctgcggtattggtcggtggtggtgcttttgcgattgcccagtatctcacctctaactttattggccctgagttaccagacattaccgcagcaattgcttcattggtcagcctgacgttgttattccgtgtttggaaaccaaaacatattttccgttttgaacctgaagcgggtcagactttggctcagcaacctacaacagttcaacgttatagcattgggaaaattgcaaaggcatggtctccatttgctattttaacggtaatggtcacgatttggagcgttaagccatttaaagcattatttgcaaaagatggtgctcttgaacactggatttttaaacttgaagtgccgtatttacacaaattggtcgagaaaatgccaccgattgtgtccgagatgaaaccatacgaagcgatttataagtttgactggttctctgcaacaggtactgcaatttttattgctgcaatcatcacagttattttcttaaaaatgaaagcaagtgaggcagtaacaaccttcggtgaaacactcaatgagttgaaaacaccgatttactcaattggtatggtgttggcgtttgcttttattgcgaactattcaggtttatctgcaactttggctctggctctatcgcataccggtcatgcgtttactttcttctcgccatttttgggttggcttggtgtgttccttacaggttcagacacttcttcaaatgctttgttctcggcattacaggcaaccaccgctcagcagattggtattccagaagtattgttggtggctgcgaataccagcggtggtgtaaccggtaagatgatttctcctcagtcgattgccattgcttgtgcagcggtaggcttagttggaaaagaatctgacttgttccgtttcacggtaaaacatagcatcatattcactgtctttgttggcatcattatcacggttcaggcttatctggttccgtggatgattccataa

SEQ ID NO: 741 - DNA, 756 bp, Acinetobacter baumannii
ataatgcagtggcaaagtattttattagaaaagcgtaatggggttggactgattacattaaaccgccctcaagcactcaatgccttaaatagtgaattaattagtgaaattaatcaggcattagatcaactcgagaaagaccgcgaaattggctgtatcgtattggcaggctctgaaaaagcttttgccgcaggggccgacattaaagaaatggccgatttggcattccctgatatttatttagatgacttttttcatcttgcagaccgtattgcacagcgccgtaaacctttaattgctgcggtgagtggctatgcattgggtggtggctgtgaattagcactcatgtgtgactttatttattgtgctgataacgccaagtttggtttacccgaagtcactttaggggtaataccaggtattggtgggacacaacgattaacccatgccattggtaaagctaaagcaatggaaatgtgccttaccgctcgtcaaatgggtgcagtagaggcagaacaaagtggtttggttgcacgtgtgtttagtaaagaagaattacttgaacaaaccttgcaagccgctgaaaaaatcgcagcacggtctttaactgcaaatatgatgctcaaagaaaccattaaccgagcttttgaggtgaaccttaccgaaggtttacgttttgaacgtcgcatgttccactccatttttgcaactgcggaccaaaaagaaggcatgcaggcaaattttaaaaatcagtaa

SEQ ID NO: 742 - DNA, 1278 bp, Acinetobacter baumannii
agaatcaggtgtgcaatgaaaatcgcagtatttggaacgacgttacatgccggtgtaatggccgcattattggctgaatatggtaatcaaatttattggtgtacctgtgtaagttgtgaagaaaatatttctgtactttcgtatcaagatcaagaagtaaatcattatttaaacaaacagcgaaaagctggtttcttgaaagaaagccctttttctgaaattcctttagatatcgaagtttatttattttgttttagtcctacacaaattgaacttgctttaaaaactgttgaaaaactaagtgaacggccaattattcatcctaaattaatgattaatggctctacttttggtttacatggtacagagaaattaaaacagcacttgccgaaagatgaatgggtgtatttccctgatgtgattcaagaaggtaatgcaattaatagtgtactagatgtaaaacatgtcattgtaggtgtagagtctagggacgcaagtgaaattatgcaggaattgttgcgtccttttttccaatttagttatcaatacttatttatgccgattttagatgctgagtttaccaaacttagtatttcgggcatgttagctactcgtattagctatatgaatgatcttgcgatggtcgctgaaaaactcggtattgatattgcaaatgtaaagcatggtatcgctgctgatacacgtattggtgctgcatatttatcaccaggtgtgggatttggtggtgagaatttttcgcatgatatcttaacactttcaagcacagtgttagaaacgggaacaaaaagccgacttttggagcaagtctgggctattaatgagcaacagaaagaaattttgttccggaagttatggaattattatcactgtgacttgagtggtaaaactgttgcgatttggggagcttcttttaaagaaaatacttcaaatatacataactcacccattcatattttattggctgcgttatgggcgcaaggggtaaaagtacgtttacatgaccctcaggctctagatgagattgcctcaatatatggctctcgggaagatcttattttatgtagtgatcaatacgaggctgcacaaaatgctcatgctttatgtttagtaaccgcatggaaacaatattggagtcctgactttaagcgactacaacagttaatgaagcatcctttaattttagatgggcgtaatatttatgacccagcatatgtaaaggctagaggttttgcttacgaaggagttggacgcttatga

SEQ ID NO: 743 - DNA, 216 bp, Acinetobacter baumannii
ccttcggttcgacctacttttgttttggcaaaagtaggcaaaaccattgtcatctgcaaaactcgtccacaaccatcgaatatcctatctatcgcagaaccaattttaaaaaatgtagtcctgcctcaaacagttgcagatgacgcctccgagtatcagattccaattaatcaactttttaatttattacttctttttagcaaatgcgttgtctaa

SEQ ID NO: 744 - DNA, 1677 bp, Acinetobacter baumannii
caacaaatccggactgagggaaaagatatgatggattatcaaaatgctgtacaggctttcgatttggaaagcactgctaaacagatgttgtcaggttcactcgatgcactgaacgcatgttacgaatgttgtgatagacatgcagatagcgacaaaatcgcgctgtactggcaaggaaaagacggtcgcaaagaacaatataccttccgtgaactaaaagaatggtcgagtcagtttgctaactttttaaaatcacaaggtgtgaaagcgggagaccgtatttcaggcttattgccaagaacacctgaactgattgtgaccattttggcagcttggcgaattggtgcggtgtaccaacccctatttactgcctttggtcccaaagcgattgagcaccgtattcaacttgctcaaagtaagctggtggtgaccgatatgggcaaccgtagcaagctcgacgaaattgaaaagtgccctgcaattatgacagtggccgacgcacaaggtactccgcttaaagcaggtgattttaatttctggaatgaagtgaagcagcagtccgatcaatgtgatctggtgatgcgtagcatccaagatcctttcttgcttatgtttacttcaggcactacaggaccagcgaaaccattggaagtgccactaaaagcattgattgcttttggtcgatatatgcaagatgccattggtttaaccgaagaggattcattctggaatattgcagatccgggttgggcgtatgggttgtactatgcgattactggaccgttatttttaggccatgccactttgttctatgaaggcggttttagtaccgatagcctatgccaaattgtgaaagattataaagttaacaacttggcaggtgcaccaactgcttaccgcatgatgatggcagctgacccagcacaaatggcgccgttaaaaggacaattccgtgtggtgagtagtgcaggagagccgctaaatccggaagtaattcgttggtttaaacaagtccttgatgctccaatttatgaccactacgggcaaactgaagtaggcatggtggtgtgtaatcatcatggtttaaaacatgaaattcatgctggttcagcaggttttccaagtccgggctatcgtgttgcgattgttaatgaacaaggtgaagagcttccgccagacacaccgggaattttagcagtcgacattagccagtctccaatgatgtggtttggtggctataaagaaagtcgaaaatcgccatttgttggtcattattatttaacgggtgatactgccgaactccatgccgatggcagtatgagctttgtcggccgtagcgatgatgtgatcaccacatcaggctatcgtattggaccttttgatgtggaaagcgcactacttgaacacgacgctgtgattgaagccgcagtaataggcgtgcctgatccagatcgcactgaagtggttaaggcttttgtaattttagctgcgggcgtacaaccttcagatgcgcttgctgaagaactcagccagtttgttaaaagacgactttctgctcatgcttacccacgattagttgaatttgtgagtgaattacctaaaactccaagtggcaaaattcagcgctttttattgcgtaatcaagaaattgctaaaaaacaagctaaagcagggtaa

SEQ ID NO: 745 - DNA, 1179 bp, Acinetobacter baumannii
tatcagtaccgatggcctttcaattcagcgttattcacacgcacatgcggcttaacggacgttaggaaagtaatcatgcctcgtcctattaccgcagtgatccaccgtcaagccttacaaaataacttggcggtggtacgcaaagctatgccaaacagtaaggtctttgccgttgtcaaagccaatgcttatggacatggaattgaacgtgtctatgaagcatttaaagcagcagatggctttgccttacttgatcttgatgaagcaaaacgaattcgtgctctaggctggacaggcccgattttattgctcgaaggagttttttctcctcaagatttatttgattgtgtgcagtatcagcttagtttcaccattcatagtgaagcgcaaattgagtgggtagaaaagcatccttatcctgctcaatttgatgttttcttgaaaatgaacagtggtatgaaccgtcttggttttaaaccacagcattatgtgcaggcttgggaacgtttaaataatttggtaaatgtcgccaagattacccacatgatgcatttttcggatgcagatggtgatcgtttcggtcagcaaggtattgattatcaaattactgcctttgaagaaattgtgaaggatttaccgggtgaaagatcggtaagtaatagtgcggcaattctgcgttatcaagaccagctcaaatcagattatgtccgtagcggcatcatgctttatggcagctcgccagattacccaacccatagtattgcggattggggcttgcagccaaccatgagcttacgtagtgaaattatttccgttcagcatttggagccgaatgaaagtgtaggttatggctcaaactttgtcgcagagcaacccatgacgattgggattgtggcttgtggctatgccgatggttatcaacgtatttcgccaacaggtactccggttttagtggactcaatacgcacgcgtacagttggccgcgtcagtatggatatgttggcagtcgatttaacgggtattgagagtgccaaagttggtagtgaagtggtgctctggggtcagtcaagtacaggcgtcgttctatctatagatgatgttgcagtttcatccggtacggtgggttatgaactgatgtgtgctgtcactgcccgtgttcaatttattaatcaggtataa

SEQ ID NO: 746 - DNA, 615 bp, Acinetobacter baumannii
gtgttaaaacgtttacttgatatcattattgcttctgtagcattaattctactttcacctttatatttttatgttgcatataaagtgaaaaaaaacttaggttcgccagtattgttccgccaagttcgtcctggtttacatggtaagccgtttgaaatgattaagtttcggacaatgaaagatgcaacagacgcgcaaggtaatcctttaccagacagtgagcgcctaacgccatttggtaaaatgcttcgttctactagtctagatgaaatgcctgagctttggaatgtaatcaaaggtgatatgagtattgtaggtccaaggcctttattgatggagtacctgccactttataataaagaacaagcaaagcgtcatgatgtacgtccaggaatgactggtcacgctcaagtgaatggacgtaatgcaattggctgggaagaaaaatttaaacttgatacgtggtacgttgaaaatagatcactctggttagactttaaaataatgctgcaaaccgttaaaaaagtaattgctaaagatgatattaatgaagcgggtgaagcgacaatgagtaaatttacaggctcagaagagaaggaaatagagaaaaaatga

SEQ ID NO: 747 - DNA, 780 bp, Acinetobacter baumannii
agcgctatttttatttacgatgtgatcaaccaaaatcgtttatatactaatcttatgatcaattgcgagctggataatatggagaataaaaatcagtgtcgccaatgcgccgtatgtggaaagagctttcctttaaaagatttagtatcgggtgaagtcatccgtaacgtgattagtgatgaaattttaaaagactatccagtttggagctactcaagctttatttgtcgggccgatctggcagattatcgaattaaatatgtgcagtccttattacgctcggaaaagggtgagttatctaacctagaaaatgaagtgattggcagtatgcaacggcatgaactgattagccgaaatacagagtcagattttgatcaaaactggacgtttggagaaaaactggcagataaaatcgcatcatttggtgggagttgggcttttcttatttgttttgctttatttttaacggggtggattgttttaaatacggttgtgatggtggtccgtcccgtcgacccttatccttttattttgctgaatttagtgttgtcatgtttagccgcaattcaggcacctattattatgatgagtcaaaaccgtcaagaagcaaaagaccgtttgcgttcccaacatgactatcaaattaatttaaaagccgagcttgaaattcgtcatttacatgaaaaaatggaccatcttttatcgcatcagtgggaaaggcttgcacatattcaagaaattcagctcgatcttttagctgaaatgaataaaaaacgataa

SEQ ID NO: 748 - DNA, 2097 bp, Acinetobacter baumannii
ttatttatgcgacacaaattaggattgttgtcttcgttaggtctatcatttatatcgacactcacttggggagaagaaacgtcaacggtacttgagaccatacgtgttcaggctgaaagtacccgagaagatgtgagccaaaatagctcggcaactaaatttactcacgatgttttagatgttccttttaaccgtgcttatctttctaaacaaataatggaacagcaagacgtgcaacggattgatgacgcattaactttagtcagtggggtttttcatcaaaatagctttggtggtggtttttgggataactactcatttcgtggctttagtaccgaccccaatttaggtgcggctatgatccgtaacggtttgagtgttaaccgaggaattagcgctccaaaagatgtcgtaaatattgaatctttagagtttttaaaaggaccaatggcggcgctatatggtcgcggcgaaacaggaggtttgctgaacctcaacagtaaaaaaccacagtgggaaagcgaaagtgaacttaacctacgcgccaatacccaagaacaatatcgcataagtctggaacacaccgcgcctattaacgatgaactggcctatcgtttagcagtggctcacgaagataatcaaagctttcgcgatcatgttagcagtgaacgctggttcttttcaccacagctcacatggaaaatttcagaccaaacacaactcgactttgacagtgaatttacagagcataaaggaacctttgaccgcggtgtcagcacagtcaatcatcagtttgtgatggacccgaaaacctttacaggtgaacctgacgatggtgatttgaaaataaaagattacttttaccaattacgtcttagtcacgagtttaaccctgactggaaactaaatagtgcggtcagttataaagatgcacaaatggtcggctttgcaaccgaacctcggcgtatgcaagccgatggacgtactttagaacgtcaacgtcgctatcgtgattatacaagtgaagatgtgctggctcagacagagttacttggcaagattgatacttcgtgggctcgccatgaaattttactttcaaccgagcttggtcaactcgactataagcaaaaccagcttcgtcgcaatcacagcacaagctcaacaaacacaattgatatctaccaacctgaatacggcaaatatttaccgaacctcactccgtttaccgacaccaaagagcgccagcgttacttcgcgcttaatgtacaagatcagatctttttcaatgaccagtggagtgtgctatttggcaaccgttttgatcaggtcgaacaagactttaaaaatcatataaaacagaccgaagacaaccaaacacttcaccagaatagtccacgtttcggagtaaattttaaagcctctgagcaatgggcgttttatagcaactatggccgctcatttgccatgaatagtggtatgaaccgaaatggacagaccttcgctcctgaaaaaggcgaaagctatgaagtcggtaccaaatataaaataaacgaccaaagtgtgctgagcctcgctttgtttaaaatgaaaaaacgaaatgtactcacaactgacccaatcgacagtaactttcaaaccgccgcaggcgaagtgagtagtaaaggagttgaatttgacttaaatagccagatcaatgaccgctggttcgtcaatgccaactatagttacaccgatgctcaaattgaaaaagaccaagacctcgcgaaggatgcacgtctgagcaatgttccaaaacaccaaggctccgtaagcaccaattatgagattctacaagacggtgcaagaaaagcaggcgtaggtgccaatctcacttatgtgggtgagcgcagcgggcataacctagataatggctttaacttaccaagttatacgctggtcaatttaaatggctactatgcaccatctgaccgtttacgctatcagctgaatgtaaataacctatttgataagacctactatgtctcaagctatagcgatttatgggttcaaccgggtgaaccattgaacgcctcaatttcggcacagtggaagttttaa

SEQ ID NO: 749 - DNA, 1290 bp, Acinetobacter baumannii
actggtgtgcgtgagggaatggaaatgcgcgtaattgtactaggtagcggcgttattggagtggcaagtgcctattatctggctcgacaaggagccgaggttactgttctcgatcgccagtcaggtcctgctgaagaaacaagttttggtaatgcaggtcaaatttcgcctgggtattcgaccccttgggcagcaccaggaattccttttaaagctgtgaaatggatgttccaacaccatgcaccgcttgcgattaatttagatggcagtatgtggcaattacagtggatggcgcaaatgctgaaaaactgtaacccgcaaagttatgctgtgaacaaagaacgtatgatgcgtgtggctgaatacagccgtgactgcttacgtgaacttagaaaagacacgggtattcactacgaaaaccgcgccaaaggtactttgcagctattccgtaaagaagcacaaatggaagcggttcaacgcgacattagcgtgcttgaagagtgcggcgtaagctacgaattattaaatggcaacgagcttggtcgtgtagagccagctttggcaaatgcacaagataaactcgtgggtggtttacatttaccaaacgatgaaacaggtgactgctatttatttaccaatgctttagctcaaattgctaaagagttgggcgttaatttccagtttaaccagaacgtagaaaaattgattgtcgaaggcgatcaaattaaaggcgtacaggtcaatggtaaaattttaactgcagatcgttatgttctagcgtttggtagctattcacgtgatttcttgaaaccgcttgatctacagttacctgtatatcctgtaaaaggttactcgttgacgattcctattgttgacccagcttttgctccgcaatctacagtacttgatgaaacctacaaaattgcgattactcgttttgaccaacgtattcgcgtaggtggtatggctgagctaagtggctttaacttaggtctgaacgaagaccgccgtgcaaccttgcaaatggtgactcaagacttgttcccgggtggtgatatggaacaagcatctttctggacaggtttacgtccaatgacaccagacagtactccaattattggtgcgactcgctttaaaaatctgttcttgaatacaggtcatggcactttaggttggaccatggcgtgcggttcaggaaaattaatcagtgacatcgtattgaatcataagactgatatcagtaccgatggcctttcaattcagcgttattcacacgcacatgcggcttaa

SEQ ID NO: 750 - DNA, 216 bp, Acinetobacter baumannii
cctctccgtaggtcatatttttattgtgttcagttattagaaaatacttttctatgcattttctttattcaggttttatttgagactaacaaagaaatctttgaccaccaacgcaaattcatgcacgattgttgtgcaaatatgcacagggacaataacaaaaatgaaagtggattgggatcatctacagttttttctggttttagcacgcactaa

SEQ ID NO: 751 - DNA, 3018 bp, Acinetobacter baumannii
ctttgcaacagtgcccatccttatatcacctcgaccaagctgattgaaaagaaattcggctccaaatatatggttgtgatcggtattacaccgaagcagggtgatatttatcagccgcaggtgttggagaaagtcaaacgcattaccgaagaagttgataatgcaccgggcgtggtccgttccacgatgatgagtctggctgcacgtcaggcaaaaggtatcgaggcgaatgcagaagggttcgatgccaagaaactattgccgagtagttcagtcactcaagaagatatcgatcacctgaaaaaactgctggcactgaatccaacctatatgaattcagtggtatctaaagatcaacaaactgctgcgattttgcttgagcttgaggaaagtccagagggcttccagaaaatgatgggcccgattaataaaatcgtagaaagcgaacaatctaaagatatgaccatcagtgtcggtggcaatcctgtgtatctggataaagctgaagactactctaagcgtatcaatatcttgttcccgattgccgtattagtgattggtttattgcactttgaagcattccgcagcaagcaaggtttgattctgccgctcgttacagctttgttggcggtggcatggggtatgggcatgatgggcttgttcaaacagccaatggatatctttaactcgcctacgccaattctgattctggccatcgcggcagggcatgccgtgcagttgctcaagcgctactatgaagattttgatcgcctgattgctcaagggatggagcctaaagctgccaatagcgaagctgtagtgcagtctttggttcgtgttggtccggttatggtgttggctggtggtattgcagcagctggattcttctctctgttgactttcaacattccaacgattcgttcattcggtatttttacaggaattgggatcatcagtacgctggtgattgagatgacttttattccggcactccgctcaatgttgccaccaccttcggttgtgaaggtcaaacgcaaaggcttgccaatttgggattggattccaaaccgtattggtgatgtcattttgtcagttcgcccgcgaatgatgttaatgactgcgattgcggcaatgggcatcttacttgctatcggcacgagccgtattgtggtagacaatgatagccgtaatttcttctctcgcgacttaccaatgcaacaagacgacagattcttgaatcagtctctcggtggcacaaacagcctttacattatggttgataccaaagttcgtgatggtattgaaaaccctgaaatcctaaaagcgattgataatacagaaaagttcgcgaactcaattccagaggtcggtaaaaccatctctatcgtggactatatcaaacgaatgaatcaggcaatgaatgccgatcaaccacaggcatttcaggttccggcaaccaaagatgtcgttgctcagtatctgctgttgtattcaatgtctggtgagccgactgattttgattcatacattgataccactcagcgctatgccaagatcacgattcttctgaaaactggcagtaatcatcgcattaaagaaatccttgagtcgctaaaaacgtatatggcgggtcaattgggcgataaagctgtagtgagttttggtggtgatgtgacgcagaccattgccttaactgaaacgatggttcacggcaagctcatgaacattctacaaatttcatttgccgtattctttatttcagcattggttttccgttcgatttcagctggactgattgttctgactccacttctgttctcaattcttgccatctttggcgtgatgggctggctcgatattccgctcaatattccgaactctctcatctcggccatggctgtaggtattggtgcggattatgccatttacttcctctaccgcttgcgtgaaatcttgcgcgaagaaggcggcgatatcaaagacgctattcgtaaaactttaagtactgctggtaaggcttctctttttgtcgcgactgcggttgccggtgggtatggcgtattgtccttatcacaaggcttccacgtccatcaatggctcgcgatgtttattgtgattgcgatgcttttcagtgtatttgcaaccttaattatggtacctacaatgattctaatattaaaacctcgttttatcttttcttcaaagaagaagagcattcctgttgcacaaactgtggtgacaagccttttgttaggtacggcgcttacaatgtcgatgcctaaaacatctcatgcagatgaagttcaagatattgttaatcgtagtgatgatgcctctaagttcttgtcttcaacagctagcgccaaatttattttgacctctaaaaatggcgagcaacgtgtacgtttaactaaaaatatgaccaagcttgctggaaatactcagaacaacatgcgtttgactgagtttatctcgccagcagatgtccaaggaaccacgacgctgttaattgaaaatgcaaaaggcagcgatagtatgtttgtctatttgcctgcattgaaaaaagtacgccgtcttgcatcggcgaataaaggtgatgcttttattggtacggactttagctatggtgatgttcttggctataagctcagtgattggaagtatacgaaactggcagatagcaaatttaatggcaaagattgctacatgattgaagcaacgccaattaataatacggtgaaaagtgactttggttatagcaaacgtcgtatgtgcatactcaaagacaactttgttacagcaaccatcgacatttgggatacagcaggcaaaccattaaaacatattgaattcaccgatatccgtccttacggtaaagtgaaaccaagatggcaagccatgaaatctatggcgaagaatctgcaaactcaacatatgacacaagtgatcgtcaatgattttgcggcagaaaaaaccttgtccgataagcttttctcaccgcagagtcttgagaaatga

SEQ ID NO: 752 - DNA, 687 bp, Acinetobacter baumannii
atttacaggctcagaagagaaggaaatagagaaaaaatgacaatgattattggtgtttatggtgccagtggttttggtaaggaagttatgcctttagtgcgtcagcagtttccaacattaagtaaagaacaatttgcttttattgatgatggactatctggaacgactttaaatggatacccagtactatcctatctcgactttatcagtaaacctgctgatcataaggctgtgacaatcgctatagcaaatagtgtggttcgtgagaagttagttagccttttagaaaaagatggtgtacaacacctagctgttcaatctacaaatacagtaattcttgatgaggttgagataggtgaaggaagcttactttgtccctttacttgcttaacttctaatataaaaattggaaagtttttccacgctaatatttatagttatgtggctcatgattgtgtaataggagattatgttacattcgcgcctggcgctaagtgtaacggtaatattcatattgaagatcatgcctacattggcactggagcagttattaaacagggcacacctgataagcctttaataattggtaaaggtgctattgttggaatgggcgctgtagtaacgaaaagtgtgccagctggcgtaactgttgtaggtaatcctgcaagaattttagaaagaaagtaa

SEQ ID NO: 753 - DNA, 912 bp, Acinetobacter baumannii
tttacgttaaggggatcacggatgaatatcgcctttatcggtctagggaatatgggcggcagaatggcccaaaacctactaaaagccggactcaaagtttatggttacgatctcagtgaagttgctattcagcacttcgccgaggcaggtggcatagtctgcgacagcccacagaatgcagctaaacaagcagatgtggtcattaccatgttgcctgcggcgaagcatgttaaagaggtttacttgggtgaaaatggtgtcttggaagtgctaaaagcaggtagcttatgcattgatagcagcaccattgacccacaaaccattaaagacattgctgctgttgcacagagtaaaaatattaaaatttgtgatgcaccagtttctggtggaaccattggtgctcaagcaggaaccttaaccttcatggtcggtgccgatgaacaaacctttaatgaggtgaaacctgtgctcagtcatatgggcaaaaatattgtccattgtggtgatgtaggtgcgggtcaaattgccaaaatttgcaataacctgattttaggaatttcaatggctgcggtggccgaaggcatggcactcggtgtgaagctaggcatcgacccacaagcattggcaggtgtaattaatacttcaagtggccgttgctggagttcggatgtgtgtaacccatggccacatattaatgaaaatgcgcccgcatctcgaggctatcaagacggttttgcgacacagctaatgctaaaagatttaggactcgctgtagaagccgcaggccaagtgaaacagccggttttattaggtggcatggtacaacagctttatcagcaaatgtgtatgcgtggtaatgctcatctcgatttctcgagcattattcaacaatacctgccacaagaggcataa

SEQ ID NO: 754 - DNA, 1572 bp, Acinetobacter baumannii
actaataaaagattgaggaatagcgcaatgcaacaactgaatccatccgagatcagtgcgctcattaaacagcgtatcggagatctggacaccagcgcgaccgctaaaaacgaaggtaccattgttatggtatccgacggtatcgtgcgtattcacggtcttgctgatgcaatgtacggtgaaatgatcgaattcgacggcggcttatttggtatggcactgaacctagaacaggattcagtgggtgccgttgttttaggtaactacctaagccttcaagaaggtcaaaaagctcgttgtacaggtcgtgttttagaagttccagttggtcctgaacttcttggccgtgtagtagatgctttgggtaacccaattgatggtaaaggcccaattgatgcaaaattaactgatgctgttgaaaaagtagcaccaggtgtaatttggcgtcaatctgtagaccaacctgttcaaactggttataaatcagttgataccatgattcctgtgggtcgtggtcagcgtgagttgattattggtgaccgtcaaactggtaaaacagcaatggcgatcgatgcgattatcgctcagaaaaactctggcattaaatgtgtatacgttgcgattggtcaaaaacaatcaacaattgcaaacgttgtacgtaagctagaagaaactggcgctatggcgtatacaactgttgtcgctgctgcggctgctgatcctgctgcaatgcagtatttagctccgtactctggctgtacaatgggtgaatacttccgtgaccgcggtgaagacgctcttatcatttatgatgatttgtctaagcaagctgttgcttaccgtcaaatttcattgcttttacgtcgtccaccaggtcgtgaagcgtatccaggtgacgtattctatcttcactcacgtcttcttgaacgtgcttcacgtgtatctgctgaatacgttgagaaattcactaatggcgcagtaactggtaaaactggttctttaactgcattgccaattattgaaactcaagcaggtgacgtatctgcattcgtaccaacaaacgtaatttcgattactgacggtcagatcttcttagaaacatcattattcaacgcaggtatccgtcctgctgtgaacgcgggtatctctgtatctcgtgttggtggttctgctcaaactaagatcatcaaaaaattgtctggtggtatccgtaccgctttagcgcaataccgtgaattggctgcgtttgctcagtttgcttctgaccttgatgaagcaactcgtaaacaacttgaacatggtcaacgtgtaactgagttaatgaagcaaaaacaatatgctccttactcaattgctgaccaagctgtttctgtttatgcatctaacgaaggctatatggctgacgtagaagttaagaaaatcgtagactttgatgctgcgttaattgcttacttccgttcagaatatgctccgttgatgaaacaaatcgatgaaactggtgactacaacaaagacatcgaagcagcaatcaaagctggtattgaaagctttaaagcgactcaaacttactaa

SEQ ID NO: 755 - DNA, 603 bp, Acinetobacter baumannii
aaaacgatgagaaaagtcccacagcaacagcgttcaaaaattattgttgaccatattttagaggcgacacagcagtgtatcgcccagtatggattactacatacgacgacacctaaaattgcagagaaatctggagtaagtgttgggtcgatttaccaatactttgagaataaagatcaaatcatagaagaactattgcgccgtaaaagcgaattattggggcaacaacttaaagaattagttatacaggaaggaaacattcctttagagctgctcattcccttagcaatagagttgggatttaatgcattaaaagccgatcatggattttttatagaagtgttgaagcattggcatgacaatagtcattcgcaagctgctcagattttagaaaagcatttttttgaagtagggttatatacattcagtagaaatcctcatcaatgggacttcgaacaggtgaagcataagtcctttgtaattattaatagtacgctttttacgatgatgcgttatgtaagccaaaacaattttcttatctcagaacaacaacttaagcgagaattatcgagcatgatactggcttatttaagtcaaaaataa

SEQ ID NO: 756 - DNA, 225 bp, Acinetobacter baumannii
tttaatgagagaaatgaaatgactaataaattatcgcctgaacagtcttggtggggatggaagttacttattgtggcttctatcttgagtgtattgtttatgattattttttacttggccatcaacaatgagcctgactacatgccaagtcaaaaaaagaagcagatgatggagtcacatgagcaaatgaatcacgctgaaatgcatagttcatcagctcaataa

SEQ ID NO: 757 - DNA, 966 bp, Acinetobacter baumannii
gtaaaagagagtaatatcatgagcaataataacgattacgatatttcggattcaaaggattgcgaaaaatttgccaatcaatttattcaggaattcccaattcgctctgccgaaattggacaggggacggtgattaagcgggctttacctagtcgacaaaaacgaatgattggggcatggtgctttttagatcatgcaggaccagtaacgtttcctgccggcaatggtttagatgtaggacctcatccacatattggtttgcaaaccttcacttggatgattgaagggaccatgatgcataccgatagtttagggtcaaagcaattaattcgccctaaacaagtaaacttgatgacagcaggacatggtatttctcataccgaggttgcacctgatactgaaactcaaatgcatgcggcacagctctggattgcattgccggaccataagcgcaacatggatccgaaatttgaacattatcccgatcttcctgttgttgaaaaagacggcctggaatttactgtactggtgggtgaatatttagagacgacttctccagttgtggttcatacaccgttagtaggggttgatctcattgctacccaagatactaagacacgtattccactaaatcctgaatttgaatatggttttatggcattagatggcgtagctcatgtgaatggccatgaacttactgctgacaatatggttgtattagatacaggtttgaacgaaattgagattgaagtaaagaaagggaaccgtgtgctattaatcggtggtgaaccttttgaaactccgatcttattatggtggaatttcgttgcacgtacgatggacgatttaaaagaagcacgtgagcaatgggttaatcatgacgtgcgttttggtgaaattccagattatgtgggtgcccgcttagaagcaccagttcttccagatcaaatgagagcatcaaaatga

SEQ ID NO: 758 - DNA, 2628 bp, Acinetobacter baumannii
accattggcggagcgtggttaatgaacacaaaataccgtaaaccgctggcaggtacccagcttgaatactacgatgtgcgtcaagccgttgaagatattcagccaggcgcatacgaaaaactgccttacacctctaaagtactcgctgagcaattggtacgccgtgccgatgccgagaacttaactgcttatttaacgcagttgattgaacgccgtcaggacttggactttccttggtatcctgcacgcgtggtgtgtcatgacatcttgggtcaaactgcattggttgaccttgcaggtttgcgtgacgcgattgctgagaagggcggcgacccatctaaagttaatccagttgtaccgacacagctcattgtcgaccactctttagcagtggaatacggtggtgctgacccagacgcttttgcaaaaaaccgtgctgttgaagaccgccgtaacgaagaccgtttccactttattgagtggaccaaaactgcatttaaaaatgtcgatgtgatccctgcggggaacggcattatgcaccagattaacctagaaaaaatgtctccggtgattcaggcgcgtgatggtgtagcattcccagacacatgtgtcggtacagactcacacacaccacatacagacgctttgggcgtaatttctgtgggtgtaggtggcttagaagctgaaaacgtaatgttgggccgtgcatcttggatgcgtctgccagacattattggtgttgagctggttggtcagcgtcaggcaggtattactgcaacagatatcgtgttggctctaactgaattcttgcgtaaagagcgtgtggttggtgcttaccttgagttctttggtgaaggcgctgacagtatgtcggtgggcgaccgtgcaaccatttcgaacatgacaccagaatatggcgctacggctgcgatgttctacatcgaccaaaatacaatcgactacttacgcctaacaggccgtgaagatgctcaagtggcattggttgaacagtacgcaaaagaaattggcctttgggcatctgaaatgaccaaagcagagtacccacgtgtactacgttttgatttgtcaacagtcacacgtaacattgctggtccatcaaacccgcatgcacgtgtttcaaccagcgacctaaaagaaaaaggcattgcgggtgtagttgaaaaccgttctgatggcttaatgccagatggcgcaatcattattgctgcaattacttcatgtaccaatacctctaacccacgtaacaccgtggcggcaggtttgttggcacgtaaggcaaatgagctaggtttagttcgtaaaccttgggtgaaatcatcatttgcaccgggttcaaaagcggctgcactttaccttgaagaagcaggtgttctaaaagacttagagaaacttggttttggtattgtggcttacgcttgtacaacgtgtaacggtatgtctggtgcgttagatccagctatccagcaagaaattattgaccgtgacttgtacgcaaccgcagtactctctggtaaccgtaacttcgatggccgtatccatccttatgcaaaacaagcattcttggcatctccaccacttgttgtggcatatgcaattgcaggtacgattcgttttgatatcgaaaaagatgcgttaggttatgacaaagaaggtaacccgatttacctcaaagacatctggccatctgacgctgaaattgatgcgttagttaagcaagccgtgaagcctgaacagttccgtaaagtctacattccaatgtttgacttgggcgaagttgaacaagcgaagagcccactttacgactggcgtccgcaaagtacttacatccgccgtccaccatattgggaaggggcgttggctgcaccacgtactttggcgaatatgcgtccgcttgcgattttgggtgacaacatcacgaccgaccacttatcgccttcaaatgctattttgatggactcggctgcgggtgaatatcttcacaaaatgggcgtaccagaagaagacttcaactcatacgcaacgcaccgtggtgaccacttgactgcacaacgtgcaacatttgccaacccgaaactctataacgaaatggttcgccgttcagacggtactattaagcaaggttcaaaagcgcgtgtagagccagaaggcgaagtgatgcgcatgtgggaagcaattgaaacctacatgaaccgtaagcagccgttaattattattgcgggtgctgactacggtcagggttcaagccgtgactgggctgcaaaaggtgtacgccttgcaggtgttgaagcgattgtggcagaaggttttgagcgtattcaccgtaccaacttggtgggtatgggcgtgttaccacttgagtttaaaccgggtgtaaaccgcaagactctaaagctagatggtacagagctttatagcgtgattggtaatattgcgccgcgttcgactttaactttagtgattgaacgtgccacagcggatggtaaagaagagattgttgaagtgcctgtgacttgccgtttagatacagaagaagaagtttctgtatatgaagcgggcggtgtattacagcgttttgcgcaagactttttagaaggtcaagtggcttaa

SEQ ID NO: 759 - DNA, 696 bp, Acinetobacter baumannii
ctttctataggctcgctgctaggatttgagcacggtttaccacttaatcatctcatggaacttcttgattttattctacacgttgatcagcatctcgccgaatttatcacaaattacgggacgtggatttatggcattttatttttaattatttttgtcgaaaccggtttagtggttatgccgttcttaccgggtgacagcttactgttcgcagcaggtgctttagcggcttctacaggcacaatggacccttggttactgggcattctactcttcattgccgcggttttaggcgatacagtgaactatcatattggacgttttatcggtccacgtgtatttgagatgaattcacgctttattaataagcaacatttaattaagactcaagaattcttcgcccgtcatggtggcaagactattatttttgcacgtttcattccatttgctcgtacctttgcacctttcgttgctggtgctggcagcatgaattataagtttttcttaacttataacgtaattggcgcattctgttgggtagcttcgtttgtcactttaggctatctcttcggtggacatccacttgtaaaagataactttacccaccttatttttggcatcattattattagtattttaccgggtgtgatcggcttcatacgtcaaaagctaaaaaaccgaaaagctaacgtttaa

SEQ ID NO: 760 - DNA, 3981 bp, Acinetobacter baumannii
gttgcagcagggagttgcttcatgaacaaccttgcacgactagaaccggaagttctgtcgcgtcatgcgatttctgcagagcagcttggcatttggtatatccagcgttttgagccaacttgcagtgcctacaatatggtggtggcctttgatgtgaaggttaaccagtcgttgggtaacaagccgatggagattctggaagcggtaatgcatgattatccgctgttgcgtgtcagcatgcctgccaatgatcaggggattgaacaactcatctgggatcgcgtgtatccgaatatcatcttttctgatactcgtcatattgaagcttctgatttgacgcaattggttgaacaggacaccaagcaaccatttgacctgactcagccaccgttatggcgtattcattgttatgaacgaggtcaaaatcattatgtaatcgcatttgtgattcatcatgcgctcatggatttttggtcaattggtctattgctgcgagacgttagcaaacgttttggactcgttgcagagtcggatgcagtgaacggaatcgagtttgcacagtatgccgataagcagcagagcagcgtgattgatgatactgatgagagcttaattttctggaaaaatgcactgaagcatgcaccacatgtgcatagcattccgcttgattatcctcgtccagccgtacagcatcataaaggtagctcactggttttccgtgtgcctgagtcagtgtcatctggccttgtaaacttggcgaaagattatgagatcacattgttcggacttgtgctatcggggttctatatcctgctgcacaaactatctaatgaaaataatctagtgattgctacaccggtagctggtcgacttgaacgttctttacgtaatgcattggggcaatttgtcaacacgattgctattcacatggacatcgatgctgatctgactttacgtcaatttacacagcaggttcaggaacaattaagacagagccttaagcatcaaaaagttgcgttttctagagtagttgaggctgtttcaccaaagcgtgatggcagtattaacccattggctcaggtaggaatgttctgggaacgtctcggtggtatggatgagtttaaagaactacttttgccaatccagaccccagctactctagctggtcaagatctgacgttaggaagttttccggttcgccagcaagaaggtcaattagatcttacgctagaaatgggcggtgaatatcaaggcgaacttgttggtgtactgaaatacaactctgagttgttttctgcgcagtctgccgagaatatggtgcaactgctgcaagctgtactatcagagatggtggctcaccctgaacgtaagatcgttgagttagatatcgcacctgattataaagatggtatccagttcgaggccctccgtggaaaggcgactgattatgctcagcatgatctattcgcaatgattctcaagcagattaatgaacgtggtgacaagcatgctttgacctcaaacgatcatgcggttagctatcgtgagttaggtcaacatattgctggtattactgaatatttgcgtgcacacggtattactcagggcgatcgtgtaggtctaatgttagaccgcacagcgttattgccagcagcaatccttggaatctgggcggcaggtgcagcttatgtgccactggatcctaatttcccaactgaacgtctacagaacatcattgaggatgccgaacctaaagtcatcttgactcaaaccgagttaatggatggtcttaacgtttctgtgcctcgcttagatatcaatcaagctggtgttgtggcacttgaacaagtgcgcgagacgcttgcctttggtgacatagcttatgtgatgtacacatcaggctcgacaggtaagcctaaaggtgtccgtattgggcatccttcaattatcaatttcttgctatctatgaatgatagattgcaagtaacgactgaaactcagttgttagcaatcactacgtatgcatttgatatttcaattcttgaattactcattccgctgatgtacggcggtgtggtgcatgtttgcccacgtgaagtatcacaagatggcaatcaactcgtagattatttaaatgctaagtctatcaatgttctgcaggcaacaccggcttcttggaaaatgctcttagacagtgagtggagcggcaatgcgggattgacagcactttgtggaggagaagcgttagatactattctggcagaaaaactgctgggtaaagtcggttgcttatggaatgtctatggtccgaccgaaactacagtgtggtctagtgcggctcgtatcactgatgcaaagtgtattgatttaggtgaaccactggcgaacacccagctttatgtccttgatgagcagcagcgtttagttccaccaggcgttatgggggagctttggattggcggtgatggtctggcagttgattactggcatagacctgaactgacagatgcacaatttagaacattgccatctctaccaaatgctggtcgactctaccgtacaggggataaagtctgcctgcgtacagatggacgcttgactcatcacggacgtttggactttcaggtcaagatccgcggattccgtatcgaattaggtgaaatcgagaatgttctcaaacagatcgacggtatcacagatgcagtagtgctggttaagaccacagctggcaatgaccagaaattggtggcgtatgtaactggacaagagcttgatattgccggtttgaaaaagactatgcaaatccatcttccagcttatatggtgccaagtgcgtttatccgattggatgagtttccaatgacggccaacaataagttggatcgtaaggcatttcctgagccgatctttgggcagagcaatgattatgttgcaccacgtgatccgatcgaaatcgagctgtgtactacctttgaacagatcttgtcggtcaagcgagttggtatacatgatgatttctttgaattaggtgggcattcactattagctgtgaagcttgtcaatcatctcaaaaaggctttcggtaccgaactgtcagttgctttgttggcacagtactccactgtggaacgtctgggtgagatcattcgtgaaaataaagaaattaaaccatccatcgtaattgagctgcgccgtggaacctatgaacaaccgctatggctgttccatccgattggtggcagtaccttctgttatatggagctttcgcggcatctcaatccgaaccgtacactacgtgctattcagtctcctggactgattgaagccgatgctgcggaagtggcgattgaagaaatggcgacgctctatattgctgaaatgcaaaagatgcagcctcaaggaccttatttcctcggtggctggtgtttcggtggggcgattgcatatgagatcagtcgtcagttgcgtcaaatagggcaacaggtcacaggtattgtcatgatcgatactcgtgctccaattccagagaatgtgcctgaagatgccgacgatgccatgcttttgtcttggttcgcccgtgatttggctgcaccttatggcaaaaagttgacgatcccagcgcaatatttgcgtgagttgagtccagatcaaatgtttgatcatgtacttaaagaagctaaagccattaatgttctgcctctcgatgcagacccatcagatttccgactttactttgatacttatttggcgaatggcatcgcactccagacctatttccctgaacctgaagattttccaatccttttggtcaaggccaaagatgagcaggaagactttggagaaagtttaggttgggatcaactagtcaaagacacgttgacacaagtcgatttgcctggtgaccactcatcaattatgtacgctgagaatgtcgtggctgtagcccagacaattgatcagatgtacccaattcctacataa

SEQ ID NO: 761 - DNA, 585 bp, Acinetobacter baumannii
attcgccgaggattgtttatgactagaagtgtctctattgatgtgctaaaagttattttggcactttttgttatagctctacactctaaaatatttatagattttaatgatatattatattttttttcagttaatggtatttttaggatagcagttcctgtttttttagtcattacaggttactatttttatttagttactaattttggtgcgtggttaaagagagttgcttttttatatataatatggatgtttttttacggtctgttttatattgatttttctttatctgtttatgctttattgaaaaatatttattttattttatttggttatcatcatttatggtatttaataggaaccgtttttggtggtattttgttattttatttaaaagattctaatgttaaatttcaattttttttagcaattctattttttactttaggatgtatagttcaatatttaggaaacttccatttatttaactctaagtgggatatggtgttaaatgctaatcctatttatagaaattttttaaccgttttgttatccctttttaacttttggttatcttattcataa

SEQ ID NO: 762 - DNA, 213 bp, Acinetobacter baumannii
ccccccagggggtgggtgtggagaaaaaagaaaatggttttttcccgttttaaaggtcccggggagattaaaaaaagcggggaaagctctaaccggggaaaccctaaaaaaaggattttaattattaaccgggattttttaaaactatttcattggggcgccccacccgaaatttccagaaaaggaaaatacccgggtccatggggaagctga

SEQ ID NO: 763 - DNA, 711 bp, Acinetobacter baumannii
cactccttttttattgtctactcaaaatgttgttcatttgcaacaataccttatttctacatattttatgcatatagtacctacttgcttcagttggtattgtttgtagttatgaaaaaagttttacaaggtgcatttttcccatttgtgatttttgcttcaggtatgttgttacttggatgtgatcaggcacaagaccacgcaaaggaacaagaatccgttcagactaacgatcaaatatcagaacaagctgatgactctcaacaagaaatcacagctacacaaaataaaactgaattaaaaaatggtaatgttttttatatcgttcgtgatgctgctaacttacagttaaaggctggcgactatatcgaaaagctcaaggatactcaacttgacgttgaacaagccattcaagataaagatcagcatgagctaaaaacaactgtgacgactttgaaagcacagttagaaggtttaaaccaagctttgcttggtttagatatcagaagtcaggaagttgaaaatatccgtcaaagcctactacaggcaaaccagcaagctttaagcatgcctttattaaatgggaaattagagcaaattaatttcgaccaaattgaaaagcaacttaataccatccaaatggatatggtcaagctcgctgctatgattatggcaggagatgaaaaatcagattcaaaaactgattcttaa

SEQ ID NO: 764 - DNA, 444 bp, Acinetobacter baumannii
ctcagtcttatgaggcattgttcagcgaaattgaaccaaaacgataagagaaaaatgatgaaaggcttatatattgtgcctttggcagcggccactttactattgagcgcttgtgctacaacggtaaaaccgacttatgtgtctccgacgcagtatcaatctttgagttgccagcagctacaaagtgaatataaccgtattcaacaatatatcgacaatggtgtacagacaccaaaaagtacaggtatgggcgttgggctcgggcttggcggtggttggggacgaggcggttggggattcggcccatccatttctgtcaatatgggacaatcttcttcaaccaaaaacaccgaactttcacgtgtattaggtcaacaagaagccattgttcaggctgctcagtttaagaattgtccaattattgttcggaaaaagacgaattaa

SEQ ID NO: 765 - DNA, 1173 bp, Acinetobacter baumannii
cgttacattattttgttgattactgctatgtctttagaaaagaatattgaacgtttacagtcgattgatgcattgcgtggtttggtgatcatcattatgttgctcgaccatgtaagagaaactttctatttacataaacaggttaccgacccaatggacgtaacagtaacagaaccagcattatttggcagtcgattattggcccatatttgtgctccggtttttgtacttttaaccggtatttctgcttttttatttcagtcaaaaaaacaagatttacagcaaacacgtgcttttttattaaagcgtggcttatttttaattgtgttagagcttacccttgtgaactttgcatggacggcaacttttccgcctgaagtcatttacttacaggtgatctgggcgattggtattagcatggtggtgctagcttgttgtgtgggtttgcctttgcctgttcttgctggtgtagcgttggtgattatttttgggcacaacttattagattctgtgcacttctcacaaagtatcctacagaatatatggttcgttttacacgaacgtggctggcttgaatttgcgggtatcaagcttcgtacaagttatccggttttaccttggattggtgtgattttattaggctacgtattaggtcagttctttagttcaaaatattcagcaaatcaaagaagccgcgctttactcagtcttggtttggcaagtatcgggttatttgttttactacgttttatcaatgtctatggtgaccagccgtggcaacattttgagtcattacaactgagcctcatgagcttttttaacctcaccaagtatccgccgtctttattgtttattttgctaaatgttgggattggcttgcttgtgctcgttgcttttgaacgtatacagcaatattcatttctaaaaccattggtcgtgtttggttcggtgccgatgttcttttatttactgcatttatatgtattgaaactgatgtatgtgttggcactcagtgtgtggggagctaactacggaaactatttgtcggtcaaccatgtgtggatgttgtggctaattacgattgtactgtcttttgcactctatccagcggttaaatggttctcgaaatttaaacatcaaaataaacatatttcgattttaaaatatttctaa

SEQ ID NO: 766 - DNA, 336 bp, Acinetobacter baumannii
actgattatatttttattctactcatagatacaaatcattatgagaataacatgacaatttataaatcttttttggctttaagttttgttctagtgagcttgggcatttcaggctgtaacctccacactcagcaagagtttgaaaaaatttgcctgtcgggtgggcatagcaagaccagttgcgaatgtatttaccagcgactcgaacaaacctactctccaaagctcatgcagcgcctagaacatgtcagtttgcaaagtcctgttctcccacgggactttgctcctacttttttcagcgtcatgcagcggtgtgacaaaaatagtctgggctaa

SEQ ID NO: 767 - DNA, 555 bp, Acinetobacter baumannii
gttgggtatatcagagaatttccaaagatgagacaacaatcagaacatcatcatgctgaacataatgactatcatcacggccatcaccgttcggggcgtcgtgggagactttttgaagctggacgtatgaaacttttagtccttcatcttattcagcaaagccctaagcatggttatgaaattattaaagaaataagtgatttggtaggcgatggctatacgccaagtgcaggaacaatctatccgactttaaccagcctggaagaaatgaacctcattaacttgctagatgtagagcgtaaacaatatcaaattacggaatttggggaagcttatttaaatgaacaccaagacaagctaagtgggttgttagagaaattgcgtttgagacgtgaaattcacagtaatgatcaattaatcgaaattcaccgtgccatggaaaacttaaagacggctttacgtttgaaattgaataccactgacttgaagcaagagcagatctatcaaattgctgaaaaaattgatcaggctgctgttgcgattgggcgcctataa

SEQ ID NO: 768 - DNA, 879 bp, Acinetobacter baumannii
gttaagcgtatggcaaatttaaaagaaattcgcgccaaagtagctagtatcaagagcacgcaaaagattactcgcgcgatgcaaatggtagctgcttcaaaaatgcgtcgtgcgcaagagcgcatggctcagggccgtccgtatgccgataatatgcgccgtgtaattgctcacttggtacaagcaaaccctgaatacaaacaccgttatatggtggaccgcccagttaagcgtgttggttacatcattgtatcttcagatcgcggtttggcaggtggtttgaacattaacttgttcaagaaagttgtgcagcatgtcaaagcacaacaagagcagtcaattgaagttcaatttgctttgattggtcaaaaagcggtttcgttttttaagaattacggcggtaaagtgctgggtgcaaccactcaaattggtgatgcccctagtttggaacagttaactggctcagtgcaagttatgcttgatgcatttgataaaggcgaattagatcgtatctatctcgtatcaaatggtttcgtcaatgcaatgacacaaaagcctaaagttgagcaacttgttcctttagcaccagcagaagaaggcgatgacctcaaccgtacttatggttgggattacatctatgaaccagaagcagaagaattgctaaatggtttattagttcgctatatcgagtctatggtttatcaaggtgtgattgaaaacgtcgcatgtgagcaatctgcacgtatggtcgcaatgaaagcagcgacagataacgcaggtcagcttatcaaagacttacaactcatctataacaagctgcgtcaagccgcgattactcaggaaatctctgagatcgttggtggtgccgctgccgtttaa

SEQ ID NO: 769 - DNA, 1284 bp, Acinetobacter baumannii
ttgtggcgtatttttcgagacagaaaaaacccagcactatgcatattgttgaatgaaaggacttttttgatgtttcaacatatccccccatacgcaggcgatccaattctctctttaatggaacagttcaatgctgatactcgttctgaaaaagtaaacttgagtattggtctttattataacgaagacagcattgttcctcagttagagaccattatcgaggcgcaaaagcgtattgagcctaagaacggtaaaaccaaactttatttgccaatggaaggcttcaaaccttaccgtgaagcaattcaagcacttttatttggtgcaaacagcccagcagttaaagctggccgtgctgtaaccatccaaacgcttggtggttcaggtgcattgaaagttggtgctgacttcttaaaaacttatttcccaaattcagacgtttgggtaagccaaccaacttgggacaaccacgttgcgattttcaatggcgctggcattaagactcatttctacccatatttcgatgcagaaacgcgtggtgtagattttgacggtatgctttctacacttaaaactttgcctgagcaaagcattgtgttgttgcacccatgctgccataacccaactggtgctgacttaaacccagcgcaatgggaccaagtaattgcagtattaaaagaccgtaatcttattccattcctagacatcgcttaccaaggttttggtgacggtatggaagaagatgcgtatgcaatccgtgctttagaccaagcaggtctaaacttcattgtgagcaactcgttctctaaaatcttctctttatatggcgagcgcgttggcggcttaactttcgtatgtgacgatgcagaagcagctcagtgcacattcggtcagttgaaagcgactgtacgccgtatttactctagccctcctacaacaggtgcttggttagttgatgaagtgttaaatgacgctgaacttaaccaacaatggcaaggtgaagtgaaagagatgcgtgagcgtattatcaaaatgcgtagcatcttgaaagatgaactcactaaagcgctaccagaccgtgactttagctacctggtaaaccaaaaaggtatgttcagttacacaggtttaactgctgagcaggttgatatcttgcgtgaagaatatgcaatctacttagtacgtagtggccgtatttgtgtagcaggtttaaacatgaacaatgtttacactgttgctaaagcgatggctgaagtgcttgctaaatcagtagaagcagcataa

SEQ ID NO: 770 - DNA, 585 bp, Acinetobacter baumannii
aaggaaagtattaccatgattacgacctcagtgaccgaagcagccgaatgtttacaacaaggtcaagttttggcatatccaactgaggcagtctggggactaggctgtgatccatttaatgaacaagcttttcaaaaaattcttgaattgaaacagcgccctattgaaaagggcgtcattttattggctggccatattagtcaagtagaacatctactaacttccttaccgcaaactactcagcaagaaattattgattgctggacaaaccatcaaccatcagaaagagccacaacttggctattacctgctgatcaacacatcccctcatggattaaaggcgagcatcctcttgttgcagtacgtgtaacgacacatcctttatgtgtcgctttatgcaatgcttttcatggttttattgtatcgacgagtgccaaccctagtggacaagaacctgcacattctttacaagatgcctgccaatactttggttcacaattaaactatctcaatggtgatttaggccaaagccaacagccaagccgcatcattaacgccttaactggtgaagtgatacgtccttaa

SEQ ID NO: 771 - DNA, 1578 bp, Acinetobacter baumannii
tggtttgtcatgactaccaatactcaaattactgaagatcgtatcctgatcctggatttcggctctcaatatagtcagctcattgcacgtcgtgtacgtgaagctggtgtttactctgaaatgtatgcctttgatatgtctgaagaagacatccgtgcttttaagccaaacggtatcattttatcaggtggacctgagagtgtgcatgaagagggcagccctcgcgcaccgcaagtggtgtttgaattaggcgttccagtattgggtatttgctatggtttacaaaccatgtctgaacagttaggcggtaaagttgagccgggtactgtacatgagtttggttatgccgaagttgatatcgttaaacgtgaccaactcattggcaacttacaagaccgcgaaaaccaactacacgtttggatgagccacggcgacaaagtgagccagattccagaaggttttacgattactgcaagcacaccaagctgtccagttgctgctgtaagtgatgaaacacgccgtttttacggtgttcagttccacccagaagtaacacacacggcaaaaggtgaagagctactttctaatttcgttcacaaaatttgtggatgtggtggcctttggacacctgaacacatcatcgatttgcgtgtagagcagttacgtgagcaaattggtaacgagaaagtacttttaggcctttctggtggtgttgattcatctgttgttgctgcacttttacacaaagcgattggtgatcaattaacatgtgtatttgttgataatggtttgcttcgtttaaacgaaggtgaccaagtgatgcaaatgtttgctgaaaatatgggtattcgtgttattcgtgcagatgcagaagcgcgttttttaaatgctctagctggcgttaccgatcctgaagcgaagcgtaaaattattggtcgtgagttcattgaagtatttgctgaagaagcacgtaaacttgatggcgtgaaattcttggcgcaaggtacaatttacccagacgtaattgaatctgctgcaagcaaacaaggtaaagcacacgttattaaatctcaccacaatgtgggtggtttaccagaagatttagcatttgaattggttgagcctttacgtgatttgtttaaagatgaagtacgtaaattaggtactacacttggcttgccacatagcatgatctaccgtcatccattcccgggcccaggtttaggcgttcgtattttgggtgaagtgaaaaaagaatatgcagatattcttcgtcttgctgatgatatctttatgcaagagcttcgtgacagcggctggtatgacaaaacagctcaagcatttgctgtattccaacctgttaaatcagtaggtgtagtcggtgatggccgtcgctatgcatgggtgattgcgcttcgtgcagttgaaacagttgactttatgacagctcgttttgcacatttaccatacgaattggttgataaaatctcaacacgcattatgaacgaaattaaagatgtatcacgtgtggtatacgacgtgtcatctaaaccaccagcaacgattgagtgggaataa

SEQ ID NO: 772 - DNA, 849 bp, Acinetobacter baumannii
tggtctgtcatgttccgcgtttttgttttcagtatgttctctcttatgagtacgttaggttggagtcagggtttggttgtctctacgcacccaatctatttgattgcaaaagaaattaccaaaggagttgaagaaccccagttattgcttcaagggcaaagtgggcatgatgtacagttaacaccggcacaccgtaaagcaattaatgatgcttctttagtgatctggttggggaaagctcatgaagctccactcaacaaattactaagtaacaataagaaagcaattgctttgttagatagcggtattctttctattttgccgcagcgcaatacacgtggggctgcgctaccaaatactgtggatacgcatgtctggctagaaccaaacaatgcagtacgtattggcttttttattgcagctttacgttcacaacagcatcctgaaaacaaagcgaagtattggaataatgcgaatacatttgcacgaaatatgttacaggcggctcaagcttacgatagctcaagcaacggtaaaccgtattggtcttatcatgatgcttatcaatatttggagcgttcgctaaacttaaagtttgctggtgccttaacggatgacccgcatgtagctcctacagcggcacaaataaagtaccttaatgatagtcgaccaaaagctcagatgtgtttacttgcagaaagttttacaacaaaagggcaatatcaaaaactgggtagtattaccttccaacccgttgatgaaagtatgaataatgaagataattttgtaacagcatggaagaaactggcgataaaaaccgataaatgtgtattaaatacgcaaaagtga

SEQ ID NO: 773 - DNA, 774 bp, Acinetobacter baumannii
agtagatccatgaaaaatgaggaccaacaattttctttattagagagtatagaagttcatgaatttctatacgagaaagaagatattgttcgtcctcatgcttcattatggggagattttaattttagtttaaatggtattttagaaatacaggtagaagagcaaatatacttgtctcctccaagctatgggctttggattccccctcaaacggttcatcaatctacccatatcgatcatgaaattcattatatctgcattcgtttacaccctcggctttgctctattttaggagatatctgccgatgctttagtattcagcccttctttcgaaccttagttttacaaatattggaacagcaaaaacaaacggaaaagcctgaatatttagaacatcttttacaggttttattcgatcaattacaacaagcacctgcctattctcattatttaccacaaacacggcatcctgttttactgccaattttagaaaagctttcagacccattactttttaatctctctttacagcagttacttcagaacttttctgtcagtgatcgtcatttattacgcttaagccaacaagaactacaactttcactatccgaatggcgtaatcgagccaaaattgtttacgccattcatcagatccgtcaaggaacaccgattaaacgcctagcatacgatttaggatatcaacacagctcaagttttatcgaattttttaaaagatatacaggccaaacacctgttcaaattagaaataattag

SEQ ID NO: 774 - DNA, 699 bp, Acinetobacter baumannii
tttgccgccatgctccattgctgtttcacgaccatgcctttaaacgacaactttgtttacgctccaccacaagatccgctttcaattttatttgaagatgacgatttaattgtggttgataaacctgcgggtttgttgtcggtcatgggccggttacctgaacatcatgacagtgcgtatttaagggtgctggaaaagttccctttagcaaaggttacgcaccgtttagatatggcaacctcaggtttacttatgtttgccaagcatcgcgatgcagaagttgcggtaagtaaaatgtttcaggccagaacagtcaaaaaacattatattgctttggtacaaggccaagtaaaacaagagggcagtgttgaagttccactcattactgactgggaaaatcgcccaagacaaattgtacattttgaattaggcaaacatgccaaaaccttgtttcaaccattggtttatgatgcaacaacagatcaaagtcgagtattacttgagcctgtgacaggacgttcgcaccagttacgtgtccatatgatgcatattgggcacccgattatgggggacaagttatatcatcctgaacctaaacggtttcatttgaatcgtatggctttacacgctgcatatctcgcttttcaacaccctttgaagggaacagatgtggtgattgagtcacaagtgcctttttaa

SEQ ID NO: 775 - DNA, 1584 bp, Acinetobacter baumannii
agaaaatgcatagaaaagtattttctaataactgaacacaataaaaatatgacctacggagaggttatgaacacaatccagaaaatcgaattggacaccgctaaattacttattaacggacagtttatcgaatctaaaacacaagaatggcaagacattgttaaccctgcaactcaggaagtgattggccgcgtgccttttgcaacggttgaagaagtcgacgctgctattcaagctgcacaagatgcttttgcttcgtggcgccagaccccaattcaggcacgtatgcgcatcatgctcaagttacaagacttgatccgtgccaacatgaaagaaatcgcacaagtattgacggctgaacaaggtaaaaccttggcagatgccgaaggtgatattcaacgtggtctagaagtggttgaacatgcctgctcagttggtactttacaaatgggtgaatatgttgaaggtgtagcacgtggtgtagatacgtataccttgcaacaacctttgggtgtctgtgcgggtattacgccgtttaatttcccagccatgatcccgctttggatgttcccaatggcaatcgtgtgcggcaatacttttgttttaaaaccttcagaacaagatccattatcgaccatgatgttggttgagcttgcgattcaagcaggtattccggcaggtgtgctgaacgttgtgcatggcggtaaagaagtggttgaccatttgtgtacccataaagacattaaagcaatttcatttgtaggttcaacagcggttggaacacatgtttataaccttgcagggcagcatggcaaacgtgtgcaagccatgatgggtgcaaaaaaccatgtagttgtgatgccggatgccaataaggaacaaaccttaaacgctttagtaggtgcagcattcggtgcagcgggacaacgttgtatggcattgtcggttgcagtgatggttggtgacagtaaacagtggattcaagagttagttgaaaaagccaaaactctaaaagtaaatgcaggtcatgaaccaaatactgacattggtccagtaatttcaaaacgtgccaaagcgcgtgtaattgacttgattaatagcggtgttgagcaaggtgcagagttactactcgatggtcgcaatgttcaagtacaaggttatgagtcaggtaactttgtgggcgccacgatttttagtggtgtaaataccgacatgcgtatttataaagaagaaatctttggcccggtactttcaattatttgtgtcgacacactcgatgaagcgattgctttgatcaatgccaacccatttggtaatggtgtaggcctattcacacaaagcggtgccattgcacgtactttccaaaaccttattgacattggtcaagtcggtatcaacattccaattcctgtacctgtaccgttctttagttttaccggttcaagaggctcaaaactaggtgatttgggaccatacggcaaacaggctgtgcagttctatacccaaaccaaaacgattaccagtcgctggtttgaagatagccatgaagttggcggtgtaaatacaaccattagtttacgttaa

SEQ ID NO: 776 - DNA, 426 bp, Acinetobacter baumannii
gcaggtagcatggttagcataccccctcatttctctatctcaacagatggttttattcgaatgaacgaaaaccaactcatgagttatcctctccaacacatcatctctatcgttgaatctagacatactgaagcgtctcaaattttctattatggttttactgaatgggcaacttcacaaactccagctttaagtaccggatgggattgggaactcattgagaataatggcatcactaccgtaaaacgagtggggttacctcgaagcaatatcatgattgttgatgtatctggtatggatatcggatttgatattaatgaaacattactcgagaaaaaaatagatactttgttctgggaaccgtttatttatgcccaaatcaatacgtcattaaccaagtcttcattaagtcaaaccttctcttag

SEQ ID NO: 777 - DNA, 663 bp, Acinetobacter baumannii
aacggtataatttcacttttattgtctattttcgctatgtctttgcaagtttggtttgcttatatgttggcctgttgggtcattagtatttctccaggagcaggggcaattgcttctatgtcgagcggcttaaattatggctttagacatggctactggaatgcaattggtttgcaaatcgccttgttaattcaaatcatgattgtagcggcgggtgtaggtgttctattcgcaacgacaccattagcctttcaggcggttaagtggtttggggtagcttatttattgtatttagcctatttgcagtggacagcacctgtaaaagatatagaaattcaacacgaaaaaaaggataaatctgtttctgctctgctgttcaatggatttgtagtcaatatcagtaaccctaaagccatcgtatttttattggcagttttgcctcagttcttagatttaagcaaacctcaatggatacaatatctgattatggcagccactatggttacgattgatttgattgtaatggctggttatacagggctagcttcaaaagttttaagattgctacgttctcctaagcaacaaaaatatttaaaccgtggttttgcagtcatgtttagttgtgcagcgttattgctaagtacggtccatcaagcagcctga

SEQ ID NO: 778 - DNA, 201 bp, Acinetobacter baumannii
caaccaataatcacaaaatcagatatttcaactgtaatggtcaagaaaaatcagatgcaaatatgtagatattatatgctttttgtgcaaagttatttaatgataaatatcctcatgtcgaatgcaattggatttgattataaaataccattatgtagtgattcagccttgtttatgttggacgagattctgcttctgtga

SEQ ID NO: 779 - DNA, 1239 bp, Acinetobacter baumannii
ggaacaacaatgcttcaaactatgattgcagatttccagcaacatttttggttgtatgtctctattcctttcatgagtggtttaattggctatgtcactaaagtgattgccattcaaatgatgttttcaccacttgaatttaaaggtattaaaccgttttttggctggcaaggtattgtgcctcgtaaagccgaaaaaatggcaacgactgctgtagagcttatgacggctaagctcattaagcccgaagaaatttttgctcgccttgacccaaagcgtattgctaaagaaattgaaaaaccattaatggcagcagcagaagatattacccgtgaggttgctcaagaatatcaaccaggcttatgggaaggcatgcctgagtttgcccgccaaagactgatccgcagagtgcaatcaaaagccccggaaattgtcgagcacatcatgagtgaagtgcaacgtgacgtaaatcgatattttgatattaaacatttggtcattagtaatttacttaaagacaaacgcctactgaacaatatttttaaacgtgtaggcaaacaagagtttaaatttttcagtaacgttggttttgtatttggttttggtattggtgtgatccagatgctctgctggattgtcacacaaggaaaatatccttggatgctacctctgtttggcggatttgtaggtttttttagtgactggattgccctacaaatgatgtttagacccctctatccgaaaaaaatattgggctatacatggcaaggcctatttattaagcgtcaaaatgaagtggcagctgactatgcagctttaatttccaaacaacttttgacttcacgccatatgatggaagagttgttttcaggtactcactctgcacgtgttattgagctggttaaccgtcatgtcaaacaggaaattgacatgcaagcaggcgtaatccgccccctcgttgtttatgcaattggtggagaaaaataccagaatatgaaaactcaggttgcggaacgtatcatgcagcaacttccagagactatgaaatatgttgagtcttatgcagaagatgccatgaatattcgcaataccctgattgagcgtatgcagaaattaacgccttcggaatttgaaggtatgctacgtccagcctttaaagaagatgagtgggcactcattgcagtaggcgcagtacttggttttgttgttggtgagctacaaatccagtttatgctttaa

SEQ ID NO: 780 - DNA, 441 bp, Acinetobacter baumannii
ttagcaacaattattgaacggaaaacacggctctgtatcttggcaacattacctgatgcaaaggcagaatcagtgcgcaaggctttaactgaagctctgaaatatttacctgcagaactgcgtaaaacgttgacctatgaccgtggacgtgagatgtcagaacataaaatactcgaagaagatttaggcatagatgtatatttctgtgacccacattcaccctggcaaaaaggcacatgcgaaaatatgaatggtttaattaggcaatatttacctaaagggattgatttaaatcaggcagatcagcattatttaaatcaagttgccatgtcactgaatactcgtcctagaaaggcgttagattggcttacaccattagagaaatttgctcagcttgttgattatcatatggcttttgaaactgtcgcacctcatgtttga

SEQ ID NO: 781 - DNA, 513 bp, Acinetobacter baumannii
atttatgtttttctcgcgagaattttaaaaaaagaggaaatatctatgcgccccttagatcgtatagatcgcatgattctggatattttgcagcgtgaaggacgaattgcgattagtgaattggcatcaagagtcaacctctctaccaccccttgttcagagcgtgtaaagcgccttgagcgcgatggcattatcatgggttattacgcacgcctaaacccagcctacgttgaccgtaacctgcttgtctttttagaaattaagttatctgccaaatctggcgatgtatttgatcaggtggctagagacttagttgagattcctgaagtactcgaatgtcaccttatttcaggtgaatttgactaccttgtaaaagcgcgtttaaaagaaatgagcgcataccgccgcttgttaggagatttattaaagaaacttcctgcttcggcatcttcacacagttatgtggtcatggaagaagtgaaagaaactctgtatttagatgtaagcaagtaa

SEQ ID NO: 782 - DNA, 480 bp, Acinetobacter baumannii
ggaattgcaatgaatatcaacctcacattgattggtcaagcgattgcgtttgcgttttttgtcgcattctgcatgaagtttgtttggccaccactaatcaatgcgattagtgagcgtcagcgcaaaatcgctgatggcttaaatgcagcagaaaaagcgaaagctgaccttgccgatgcacaagcgcaagtaaagcaagagcttgatgcggctaaagcacaagcggctcaattgatcgaacaagcgaaccgtcgtgcagcgcaattgatcgaagaagctcgtactcaagctgcggctgaaggtgagcgtattcgtcaacaggctaaagaagctgttgatcaagaaatcaattctgctcgcgaagaattacgtcaacaagtagctgccttggcagtaactggtgcagaaaagatcctgaaccaacaagttgatgcaaaagctcataacgccatgctgtctcagctggctgctaaactttaa

SEQ ID NO: 783 - DNA, 1185 bp, Acinetobacter baumannii
gaagttaaaatgttaaacactgcatttgaaccatggccaagttttacaacagaagaagctgacgcagtcaaaaatgtattactatcaaataaagtaaattattggaccggtcaagagtgtagaatttttgaaaaagaattcgctgagttttctgatacaaaatatgcggttgctttggcaaatggtaccgtggctctagatgtcgcattaaaagctttagatattggtgcgggtgatgatgttattgtgacatctcggacttttttagcttcagcaagttctattgtaacagcgggcgctaatcctgtttttgcagatgtagaattagattctcaaaacatttcacgtcgtacgattgaagctgtgcttacaccaaacactaaagccattatttgtgtacatttggctggttggatgtgtgatatggatccaattatgcaacttgctgccgagcgtggcatatatgttattgaagactgcgcccaagctcatggagcaaaatataaaggtaaagcagcgggttctatcggtcatattgcggcatggtcattttgccaagacaaaattatgacaactggtggtgagggcggtatggtcaccacgaatgatgaaacgctttggaaaaaaatgtggtcttataaagatcatggtaaaagttacgacagtatttataataaacagcatccaccgggtttccgttggttacatgactcatttggtaccaactggcgtatgatggaaatgcaagctgtgattggccgaattcagctaacccgtatggctgaatggactaaaaaacgtactgaaaatgcagaaaagattttaaaagcctttgaagactctcctttctttagtgttcatactccctctgtagattatattcatgcatattataaatgttatgtccacgtgaatttagaagccttgccagatggttggtcacgtgatcgtattatgcaagaaattaactctcaggaagtaccttgttttagtgggtcttgttctgaagtttatttagagcacgcatttgatggtacaccatggcgcccagaaaagcgtttggaaaatgctcaaaaattaggtgaaactagtttaatgttcttggttcatccgactttgagtcaagacagtatagaaaaaacaattcttgcaattaatgctgttaatagagctttacaatcataa

SEQ ID NO: 784 - DNA, 696 bp, Acinetobacter baumannii
aaaagaaaaataaaagtaggcaataccatgattagtgtacaccacctggaatgttcgcgatcgtttcggattttatgggctttagaagagttaggcttggattatgatattcatttttatcaacgtcttccgaactattcagcaccagaaacattgaaatgtattcatccgctcggcaaggcacctattttgacagatgatgagcaagttatcgcagaatcggctgttattttagagtatttgcagcagcgatatgatcaaaagcagcagtttaaacctaagcaagctcaggatttacagcagtatatttactggatgcactatgccgaaggctcacttatgccgttattagtgatgactttggtcatgaacaacgtcaataaacatgtaccttggctaattcagcctgtggcaaagaaaattacagaaggggttaaagcaaattttgttcgtccacgtatgaaagaccatattagttttttagaaaattatttggctgagcatgaatattttgcaggggatttttcatttgcagatattcaaatgagttttccactagaggctttacagtcacgtcttcaaggtaaatatccgcatattcaagcattcttacatcggattcagcaaagaccagcttttcaaaaagcgagacagaaaggtttagggtcaaacgaaagaaattgtgctgatatataa

SEQ ID NO: 785 - DNA, 267 bp, Acinetobacter baumannii
ctgaatgaaatcagacatctctcacctccttcggaagaaacagatataaaaaaggcaggatttaatcctgccttttcatttgattattcccactcaatcgttgctggtggtttagatgacacgtcgtataccacacgtgatacatctttaatttcgttcataatgcgtgttgagattttatcaaccaattcgtatggtaaatgtgcaaaacgagctgtcataaagtcaactgtttcaactgcacgaagcgcaatcacccatgcatag

SEQ ID NO: 786 - DNA, 549 bp, Acinetobacter baumannii
gcgaggcgaattatggctgaactcttgacgttggcacgtccgtatgccaaagcagcatttgcttatgcttctgagcaaggtgcaacagacaattggtcgaatgcgttacaagtgctcagtgctgcggtgcaagacgaagcattttccgcttatttaaatcgccctgaacttactcctgcggagcaagtgaagctttttgctaaagttttaggtgaagatcagtctcaagcagtgtctaactttttgacacttcttgcagataacgatcgattagtgttgttacctgaaattgcagcagaatatgaacagcttaaatcacagaataacaacaatgtggatgtcgtgattgaatcggctttcccgttaactgctgaacaagagcaactgttgaaatctgctttagaaaagcgttttaacagcacagtaactgtttcagttgaagttaaacctgagcttattgcaggtgttgtaattcgtgcaggcgatcaagtgatagatgattctgcgcttaacaagcttgaaaaaatgcgtactcgtcttcttgcataa

SEQ ID NO: 787 - DNA, 1173 bp, Acinetobacter baumannii
tttttaggaattatcataatgaaaaaggtttttaacggcatggttaattttcatgccttggggataaagaagcatttacttgctttggcgctctgtacaggtgtcgcaatcggtacgatagcagaagttcatgcaaccagtccgaaccataatccaccctcccttaaaagtaatgcacccaatgtatatgttgtaaagcgtggggatactttatgggatatttcaggacattttctaaataaaccatggcgttggcctgaaatctgggcgagcaaccaacatgttaaaaatccacactggatctatccgggtgaccgattactattatgtagcctagatgggcgtcctttagtcggtaaagatgagggggacggctgtgtcggtattatccgtcgctatacaggtcaaaccacaaacctacaaccacaagttcgcgtcgaagcattaaataatagcgttccggttattccacttgaacatattaaacagtggttagagaacagtactattttaccagccgactcaattaccaacacaccttatattgttggtacagccgatcaacgtgtacttgcaggaaaaggccagactatttatgcacgaggacaaggcttaattaatgggcagcgttatgcagtctaccgagaaggtgaaccttactatttcacagacaataaaggtaaaaagcatagtttagggattgagttactacaagttgcttcaggtgttgcggtatcttctgaaaaagatattactacattagaactaacagatagttataacgctgaagtacgtcgtggcgatcgtgttatgcctgaagagcaagctactttgccaacattattttacccagtagatgcgaagcaagtgacggatggtggcaagattattcgtgtcatgggctcaattggtagagctgcaaaaaatagtgtagtgactttggaccgcggtacaactcagggcattcaagtaggtcaagtttttgatattactcaacaaggtgaatcaattcgcgaccctaaaaccaaagaagtgattcaacttcctggccaacaaattggcagtctaatggtttttagaacttttgatcagctaagttatgcttttgttttagagagcgatttaccaattaaggttggttcaagcattcagccacctcaatttaatgattaa

SEQ ID NO: 788 - DNA, 1158 bp, Acinetobacter baumannii
ttcaaaatgattatttcttctggcaatgattatcgtgctgcggcacaacgtcgcttacccccatttttatttcactatattgatggtggagcgtatgcggaatataccttaaagcgtaacgtacaagatttgtcagaaattgcattgcgtcaacgtgtgctgaatgacatgtccgcgttaagtttagagacaaaactgtttaatgaaacgctgtcgatgccagttgccttggcgcctgtaggtttaacaggtatgtatgcacgccgtggtgaagtgcaagccgcaatggcagccgataaaaaaggtattccatttacgctttcaacagtttctgtttgtccgattgaggaagttgcacctgcaattaaccgtccaatgtggttccagctttatgtattacgcgatcgaggttttatgcgtaatgctttggaacgtgcaaaagcagcaggttgttcaacactggtatttacagtagatatgcctgtaccaggtgcacgttatcgtgatgctcattcgggtatgagtgggccaaatgctgcgatgcgtcgttatatgcagtcagtgtttcacccacactggtcatggaacgttggcttaatgggacgtccgcatgacctcgggaatatctctaaatatttaggtaaaccgactgggcttgaagactatatcggctggttaggctcgaactttgacccatccatttcatggaaagaccttgagtggatacgtgaattttgggatggcccaatggtgattaaaggtattttagatcctgaagatgccaaagatgctgtgcgttttggtgcagatggcattgtggtatcaaatcacggtggtcgtcagttagatggcgtgatgtcttctgctcgtgcattgcctgcaattgctgatgcagtcaaaggtgacttagcaattttggctgactcaggtattcgtaatggtttagacgtggtgcgcatgttggcgcttggtgcggatacggttttacttggccgtgcgtttgtttatgccttggctgcagcaggtggacaaggtgtgtcgaacttacttgatttgattgataaggaaatgcgtgttgcgatgaccttaacgggtgctaagtcgatttcggatattaatgcggattgtttagtacaggcgattaaacaaggactttaa

SEQ ID NO: 789 - DNA, 432 bp, Acinetobacter baumannii
tttttggtttttcgtagtggtttgctgcttgcctgtgcagcagtatttttacagattgcggtatttctacagccgctattaccgaagcaatatcaaattgctccggtctgtgaaactattacccgtgctttgcttaaaccaaaagcacagacggaagccatgtcacatgccatgcaccattcacatcaccagcatcatatcgaacaggcgcaagtacctgaccatcatgatcaccatgatgcgaaccatcagtgtcaatattgtaccgtttatgccaatttggttttaccacctgaattcggcgtaaaagaggtgcttgttcgtatacaagttcgcttagtcgcgtatcaacaagctttccggcatgtttactttgcgctacagcgacttttcctactcccgcaaggacgtgcgccgcctctatttgcataa

SEQ ID NO: 790 - DNA, 1173 bp, Acinetobacter baumannii
ggttattttgtgagtgaagttgaaaacaaaatgaaatttttaatgattagtagttttttaccttcagttctaaattttcgtggaaaattactagaggctattcatcatcaaagccatgaaattcatattattgccccagatcttgagcttttccagcctgaaatggataagctaaaatctcttggttactcagtttactctgttgaaatgcaaagaacgggaactaatccaattgcagatataaagacactatttgaaatctataaaattacaaagaaaattaagccagactatgtcttgtcatatacgattaagcctgtgatttatggcacgcttgccgcttatttggcaaaagtaccaaatcgtttttcactcatcacaggattgggatatgcttttcagaatgtagacagtacaagtaaaagaagcacgtttcaaaaaatcgtacattggctttataaacaagcattaataagatcatccaaagttttttttcaaaatcctgatgaccttgctttattcaaacaattaaatttattaagtaataaggtgccagccgtagttgtcaacgggtctggtgttaatgtgactgattttgaagttgtaaatttgcctcgtgctgtgaatggtgaagttagggtttcatttttattaattgctcgattattacaagataaaggaataagagagtatgtagaagctgctaaattaattaaaaaagaatatcctcaaattgaatttaatttagtgggttggatagatgaaaatccaaccgcaatcaaacaacaagaattagattcatggattgatggaaaaattattaaatattggggaaagctttctgatgttcgtcccgctattgctgaaagttcaatttatgtattaccttcatatagagaaggcacacctcgtactgttttagaagcaatgtctatgggacgagctattattacaacagatgctcctggatgtagagaaactgtagagcacgatggaaatggttatttagttgaagtaaagtctgtcactagcttagagatggcaatgagaaagttcattcagaatcctgaattgactgaaattatgggaacacgttctagagagattgcattacataaatatgatgtacatcaagtgaatcatcatatgatgacagaaatgggaattaaataa

SEQ ID NO: 791 - DNA, 1884 bp, Acinetobacter baumannii
aagagtattgtgaaaaagattatttatcagtttgcgtcagctcctcggcttacaaaacaatgttttttggttcttatcgacctgtttgctttccccattattttatggctgtgttatgccatccgattatttgatttaggtgctgaggttattccaggcattaactatggcgtggcgtttgttacaattttagccatcctaagcttaatgctaactggagtttatcggtttattgtccgtacttttaatgaagcctttattgctaaattagcgattgcggttacattgatggtcattgttttatatagcatgaatgctttttcacctgcatttgttccgacttcaattccattaatgtttggcttcttaatgtttagttgggtgtggtgtagtcgtgcatttattcgttttatcgtaaaagctacgttacagactggtgaagagcgtaaacgaattgcaatttacggtgctggtgatgctgggcagcaaattgcagcggtgctttatcgttctggtaatcatttgcccgtttttttcattgacgataatacatctttacaagaccatatggttggtggtttaaaagtactatctttagaaaaagctttacaacgttttgaaaaatataaaactgatgaaattttactagcattaccttcagtaggccgtgtacgtaaaagtgaaattattcaacaactagaacccgcacatctcaaaattactgaacttcctggtcttacacaacttgttgatggtgaactaaaagttgcagatattcgtgaagtagacattattgacttactgggacgtgaccctgtaccccctgtagatcatttacttgcaaaaaatatccataataagatcgttatggtcactggtgcaggtggatctattggttctgagttatgccgtcaaatagttaaaaatcagccaaaaatgttgattatttatgaaattacagagtttgcgctttatagtatagataaagaattacgtttagcggctcaatgtgaaattgttcctattttaggtacagtgcaagatcaacaaaaattagagcgtattattgagcaatatagtgttcagaccgtttatcatgcggctgcttataaacatgtacctttagttgagtgtaatccaattgcaggattaaagaataatgcgattggtactgcgaatagtctaaatgcagctgtgaaaaaaggtgtggaaacgtttgttctaatctcgacagataaagcagtacgtcctaccaatgtaatgggtgcatctaaacgtatggcagagctctattgtcaagcaatggctgaagcccaaaagcaaactcaaattagtatcgtccgttttggtaatgtattagggtcttctggctcagtagtgccgttatttaaacagcaaattgctaaaggtggtccaattactgtgactcatccagaagtaacacgctacttcatgactattcctgaagcatctcagttggttattcaagctggtgcgctaggtagaggtggtgatgtgtttttacttgatatgggtgaacccgttcgtattcaggatttagctcgccaaatgatttctttaagtggtttaactgtgcgtgaacaaggttcaatgcaaggggatatcgaaattcactatagtggattgcgtccgggtgaaaaactttacgaagaattattaattgatcaagaaaatactgaatataccgagcacagtagaattcttcgatcatttgaaaaattctatcctcttacagaaattcaagaagtttttgatcgaataaataatatgactgctgttcagcaagatattgattgggctctttgtcaactcgaacactatgttgatggttataaacgtagtaaagatattatggttaattag

SEQ ID NO: 792 - DNA, 729 bp, Acinetobacter baumannii
ttaaaaattgtcgacaatatgcaagatttgaccttcgcgccagagccactacaaagtcagggaagaacactgaccgagcatgtatttaagcaaatacagacggcgattgttttgggtcaaattccggcaggcagcaaaatttctgaacctgaactggcgcgcacttacggcattagtcgtgggcctttgcgtgaagcaatccatcgccttgaagggcaacgtttggttgagcgcacagctcatgtgggcgcgcgcgtggtttcgctctcactgcaacagtttaaagagctttaccaaattcgggcttctttagagggtctggcttgcaaacttgctgcacagcatattgataaaaagcaaatcttggcattacgtgatgtattgcgtatgcatgctgaagatgaaaactttaaagcaggtaagggatattacttgcaagaagggcaggacgattttcactactgcattatcaaaagtagtggcaataaaaccctagaaaaaatgctatgtgatgagctctaccacctcattcgtatgtaccgaattcagttttcaaacacacccgatcgaccgagcaaagcttgggacgaacacatccgtattttagatgcaattgcagatggcgatggtgaacttgccgagctgctcatgcatcgacatatcaatgcttcttacaaaattattgagcaaacactgctacaagcacaaggagaacataacaatggctaa

SEQ ID NO: 793 - DNA, 1893 bp, Acinetobacter baumannii
gttatggctgtaatgtgtacggataatatcattgcaactttggaatcccacgcaaaattaaatggaaataagatcgcttttgagtatttgggacgccagtctggtggtattcaatctctgacatatgcagatttgaatgagcgagttcaacatcaagcccaaatattaatgaatcttgtagacagtggtgaccgtgccgtattgctgttcgaacctgggttggactttatcgtatcgttctttgcctgtctgaaagctaaaattattgcagtaccagtcagcttaccgtttaaccgtaatggtttttctaatattttgaatattatgaatgactgtgagcctaagattgtactcacgacaaaaaagattcttgagctcgcaggtcttatcacactaaaagctcaaaatgaaaatttgatattacatgctgttgatgccgaattgcagcgtgacttggtggaaaaagattttccgcttattactgaaaaagatatctgcttccttcaatatacctcaggctcaacaggctggcctaaaggcgtaattgttactcataaaaatattatggccaatgaggtcatgattgctgaagcttttggtacacaaccagaagatgttggcctgacatggctgcctgtttaccacgatatggggttgatcggctcggttttgcaaaccgtatatgtgggactgacttgttatgtcatgtcgccgctggacttcattcgaaaacctcttaaatggctacaatttattagtgaaaaaggcgtcacgattagtggtggaccaaactttgcctatgaattgtgcctacatcgcatcactgatgagcaggctgcagcgcttgatctaagccgtgtgcgtgtgctgtttaatggtgccgagccgatcaaggcccatgttatgcaacgcttcatggaaaagttcaatacacaatcaaggctccgactagatactttcttgccatgttatggcttggcagaagtgacgctcttagtcagtggcgtaactggccctctcaatgcaatttcacttgatcgtgacaagttaaatgcccatttggtacagaccagccaagatcagacagccgtgcaagtagtaagttgtggcaagatctcgaaacatattgattgccgtattgttaatcctcatacccgtaaagaggtagcggctcatgaagtcggtgaaatctggctagcaggtgagagtgtcactgcaggttactggcaaaagccggaagttaatcaggaaacttttgaagcaacgatccttaatgaatcgggacaacctggccaagtacactacttaagaacgggtgatatgggctttatcaaaaacggagacctttatataaccggccgccttaaggatgtgattatcattcgtggcaaaaactattatccgcaagatatcgaatgctctgttgaaatggcacatcctgctgttcgtaaaggttgtgttgcggcagtgaactttgctgattctgaaggggttacggttgtacttgagattaagaaaaagtccttagataagacacttaattttgaaaccatcaggactcaagttaaagaacaagtggcggctgatattggcttgcctgtagacggtgtctatttactgcaccaaggccgaataaataagaccactagcggcaaaattagaagaagaaaaattaaagagcagatcgaacgcggtcaactggtctgtttaacccatccaaaccgtagaacggtgattgctcgaaactatgtcaagaacggcttagacgtcatccgtgatcgtgagcagcgggggcagctgattcgttatagctccaatctactcaactcaatgatcaaggaacgtgaagtacgcacgctgatttttaatcgtctgaaaagtgctttgttttaa

SEQ ID NO: 794 - DNA, 1698 bp, Acinetobacter baumannii
aggttttgcttacgaaggagttggacgcttatgagtaaatcaattgaacaattcccaaaggatttaagctcacctttaatacagcttaagtcttcagttgagaaaaactcaaaactacatataaaagagctttttgctttagagccagaacgttttcaaaattattctgtaaaatttgatcagttattttttgattatagtaaacaacgtattaccaaaaatattttggaacaactagttgctctcgcaaacaataaacaattaacacagtggattaatcgtcttttttcgcaagataaaattaattgtactgagcagcgtgaagcaatgcattgggctttgcgtttaccctcggaatattcgaaatttccggagctcacaaaacaggtccatatccaattacagcgtatgtacactttggttgaaaaaatccatgctgggcaatatcgtggcgctacgggtgaagtaattcaggatgttgttaatattggggtaggtggttccgatttaggaccgcacatggtgactcatgctttagctgattttaaagtaaaaacagctaagcctctcaatgtacactttgtttcgactatggacggtagccagttatcagacttgctccatcaactgcgtccggaaacgactttatttattatttcttcaaagtcatttggtaccattgataccttatcaaatgcacaaacagttcgtcagtggcttgaaaaagctttaggaaagcatgaccgcgttgtaaaaagtcacttcatcggtgtatctacaaaagctgaaaaaatgaatgagtggggtattgctcctgataatcagttgctactttgggactgggtaggggggcgttattctctttggtcttgtattggttttcctatagccctaacgattggtatagatggttttcagcagcttttagctggtgcacatgctgtcgatgaacactttcaaaatacaagctttgagcgaaatataccggttctcatggcattactcggtatctggaataataattttttaaatattcagacccatgcagtattaccttatgacggaagattaaagtatcttgctgcttatttgcagcagcttgaaatggagtctaatggtaagtcggtacaacgtgatggccaaaaagttgaattagatacttgtccgattgtatggggcgaggttggtccaaatgcacaacatgccttttaccagctcttacatcaagggactcaggcagtaagctgtgactttattgcaccgatccaacgttataatgcagatcattttacctatgtagagaatgctgaggcattgattgaacaacatcaccttgcattatcaaattgtttggcacaatcacgtttattagccttcggtaatgaagcactagatgtaaaagaattagagaaattgcctatttataaacaatatgaaggtaaccaaccaagttctacattattgttagatgagttaaacccgtataatttaggaatgttgattgctttatatgaacataaagtgtttgttcagtctgtgatttggaatattaacccatttgatcaatggggggtggaaaaaggtaaacagattgctaatcagttacttccaattttaaatggtgctcaaaatgatctttcaacactcgatgcatcaacgcgtggattgattaagatattgttaggaaaagccgaataa

SEQ ID NO: 795 - DNA, 396 bp, Acinetobacter baumannii
agtcaaagcgtacaagagcaacttttgtttgtgtgtagacagggtatactaggtctaaatatacgaataatcgtaaaaggaaaagctatgagccttgaacaacagttgattgaacggttacagacccttgcacctagccatttagaagtcattaatgagtctgccggccacggtggttattttcctggtaaagaatcccactttaaagtgattgtggtgagtgaagaatttaacggcttgcgtttggttcagcgtcatcaaaaagtttatgccttggcttctgatttaatgaatccaggacaaattcatgctttagcaatccacgcttatttaccaagtgagtggcaaggccaagcgccagcaagtccagaatgtgcacatgcacctaaaaactaa

SEQ ID NO: 796 - DNA, 210 bp, Acinetobacter baumannii
aatcacggcttgactgagcccaaccgacatttaaaccataagaacatgcttcctcccaaaaatctttttctgcctgtgtctttgcagattgactcgaccaaacaagaggttgaagtgataccatacaatgctgcacagttggatctatcttcacatattgccgttccacataacgtttctgccatgcttctggataattattcaacataa

SEQ ID NO: 797 - DNA, 294 bp, Acinetobacter baumannii
tgctcagaagtaatctggttttttgaggaaacaggttgccacggtttccaaagcatgagcattactgcgatacataagaccgctaaaatagcgacaagtgtccctaaccatttaggaattaaaggctttttaggcttgttaggtctttcagatacaccgcgttgcgttttgccaaacacgtggattattcctctgtattttgattgttttatttcgagtttagttctcgtttactttaaaacatcgcttcgcatagatagatttccttgcaaagcgttatttcttacaacatga

SEQ ID NO: 798 - DNA, 516 bp, Acinetobacter baumannii
aaatttgaggttatgtctatgagttcttgcatgcatgaacatcatgattctttgcatggtgtacatgatcaccataatgtcgcaagtcgtttagctgaagcagaaactttatgtactgcggtcggtgcacgccttacgcctttgcgtaaagaagttcttgaactcattttaaatgcttcaggtcctatgggtgcctatgacttattagcacgtattaaaagtcaaacagatcgccctgccgcccctcctactgtttatagaactttagactttttattagaaaagggtcttattcatcgcttaacatctattaatgcttatataccatgctgtcacccacgtgaaggtcatcaggctgcattcctgatttgtaccgaatgtcacacggttaaagaagcatcttcacaaggtctaacccaacaacttgaccaacttgcagctttagatgatttcgcagcacaacacagcattatagaaatttcggggaaatgccagcagtgccgcacagctcgttaa

SEQ ID NO: 799 - DNA, 630 bp, Acinetobacter baumannii
acacgaatattattgcactactcaagaatagcagttaaaacaaatgcgttacttgatatcaattacaatcttcaggaaagactcatgactcaatctgtatatcatattccagtaaaagctatttcaggcgaaacggttgaccttgaccaatataaagggaaagttttattaatcgtaaacacagcgtctaaatgtggtttaactccacaatacgaaggcttagaaaagctgtatcaagcaaagaaagatcaaggtcttgaaatcttaggcttccctgcaaacaactttaaagaacaagaacctggttcggatgaagaaattcaacagttctgctcattaaactacgatgttcatttcccacttttctctaaaatctctgtagctggcgaagataaacatccactttatcaagcgctaacaacagctcaaccagaacgcattggagaaggtcctttccgtgagcgcttagaaggtttaggtattcctactaaccctgcccctgaagtgttatggaacttcgagaaattcctagtaaataaaaacggtgaagttgttgcgcgttttgcacctaacttaacagcagacgatgaacaaattgtaaaggcagttgaagcagaattagctaaataa

SEQ ID NO: 800 - DNA, 246 bp, Acinetobacter baumannii
cgatcagcttccggagttgtccaacttgacctgccaacccctttattatcccctgtatgttttaagtttacccagtgctcatatccttcatcatcaaacacaacgcaacttaccttgctaattgaatttgttgctgactctttaattttattgaatatctttttaaacttctcactatcagcggaatttggattagctaacaatttgagagcagttgttcttctattcccttcagccacaacataa

SEQ ID NO: 801 - DNA, 210 bp, Acinetobacter baumannii
aatataaattcacattatattttatgtgtgagtgttatttattacacctgtaagtgtttacaggttagtggtctcttatcgaaaattaagaagctaaatcctttatatgaatcattttttgttcagttatatattttcaatttcttatcattatttaaaattagcgtcccacctattcttaatttagatacgcacaagccaagattttga

SEQ ID NO: 802 - DNA, 1467 bp, Acinetobacter baumannii
caaaggaattcaaaaaggaattttaatatgacaacggctcgtcattcagatacggaaaattctcccgatcatctgcaacgaaaactgtctaaccgtcatttacaactgattgcaattggcggtgcaattggaaccggcctatttatgggctcaggtaaaaccatctccctcgcaggtccttcaattctctttatttatatgattattggaggtatgttctttttcttaatgcgtgcaatgggtgaactactccttgcaaatctgcattacaaatcttttgttgatatggctcatgacctgattggtccttgggccggttattatttgggttggacctattggttaggttgggtgctggtcggtattgcagacctttcagcagtcattaactatttgagcttctggctacccgatggtgcaagcttctcaccaatacagcaggccatgattagtgcaggctgtgtgttgtttgtgatggggcttaacctccttacagtacgtctatttggtgaaattgaattctggtttgcccttattaagattctggcaattattggcctgatcggcgtgggcggctacatgattttcagccatttccaagctccgcaaggcgctgttgcaagcattagtaatgtctggtcacatggcggtttattcccgaaaggtacagaaggcttcttggcaggattccagattgccgtttttgcgtttgtcggggttgagttggttggtacgacagctgctgaaacgaaagacccgcagaagaacttaccgaaagcaattaacgcgattcctgtacgtattattttgttctatgtattagcgttatttattgtgatgtcggtaacaccgtgggatcacattcgtgcagataaaagcccgtttgttgatttattcttaaatgcaggtattccggtttctgcgatcatcatgaacttggtggtgctgtcttcggtcatgtcttcaatgaacagcggtgtgttttcaaccagtcgtatgctgttcggtttatcaaaagacggtcaggcaccgggagcatttggacgtttatcaaaacgcgcagtcccttcaaatggtttgattttctcttgtacttttattatgggcggggcagtgcttcagtactttgttccaaacacaatggaggcatttacattagcaagttcactctgtgtgattctcttcattagtgtgtggagtctcattatggtgtgctatttacgctatcgtaaattacgtcctgaattacatgaaaaatctacattcaaaatgccgggcggcatttggatgagttatgttgttttagcattcatgcttttcactttagtgatcttggcattagagcctgataccttaaaagcgctatatgtcagtccagtatggttgatcattttaggtgtgacttatcatgtgctgtataaaccgcgcatgaaaagactaggacgtgaactcgtcaacgaccattaa

SEQ ID NO: 803 - DNA, 312 bp, Acinetobacter baumannii
acccaatatactccctaccagtatattaaattgtacaagagaaaacagatgagtcacattggtcaggataaaaaaattgttaatcgtgtaaaacgactaaaagggcaaatcaacagcattgaaaatgcgatagaacaaccagaatattcatgtatagatattttgcagcaagttgcagccataaaaggtgcaataaacggtttgatgagtgaattaatggaacagcacttacatcatcacgtacttaaaggcgcagaagtcgatcaaaatgagctagatgaatttttaaaagttttaaaaagatacggctga

SEQ ID NO: 804 - DNA, 1092 bp, Acinetobacter baumannii
tcgttttacacgattaacaatttttttatcctgaccaatgtgactcatctgttttctcttgtacaatttaatatactggtagggagtatattgggtttaaattttatgcaggattatagtgtatcacgtcatcatcaacatcagtttgatgaaggaaatccacttgcacaaaaacgtattttgattgcaaccattttaacggcgtccatgatggtactggaagtatttggtgggtggttcttcaattcaatggcactactggccgacggttggcatatgagttcacatatgttggcccttggtttagcctactttgcctatcgtgcagcccgtcattattccaatgatcaccgttttagctttggaacttggaaaattgagattttagccggctatagcagcgcaattttgctgatggttgtggctatttttatggcttttcagtcaattcaacgtttatttaacccggttgaaattttttataatgaagctattccaattgcaattttaggtttagttattaacttgatttgtgcctggttacttcatgatgatggtcaccatcaccatcaccatcaccatcaccatcaccatcaccatcaccatcacgagcatggccatgggcatcatcaccatgatttaaaccaaaaagctgcgtttttacatgtggttgcagatgcagtgacttctgtttttgcaattgtagcgcttttcgcaggtaaatattttggatgggattttttagatgcaattttaggaattttaggtgctattttagttgcaaagtggtcttttggcttaatgaaagagacaggaaaaacccttctagatgctgaaatggaccatcctgtagttgatgaaattcgggaagtaatagctgaatttccgaaacatgtggaaattacagatattcatgtctggaaagtcgcaaaaggtaaattttcttgtattttggcgcttgaaactgacgatatctctttaaatgcagaccagattcgtgatgctttatcgattcatgatgaaattgtgcatatttcagtagaaattaataccttaaaacctgtttatgttccacgtgaaacattggcataa

SEQ ID NO: 805 - DNA, 192 bp, Acinetobacter baumannii
acgcctcaaacacatagaacaacaacgaattttgactatcttttccagttgagccttgctatcgttgctggcaaatttatcaataatgaaaacacagtaattcatattcgtactgtgtacaaaagcagtggagaaggcgagcaatgcatctgcatatcttgggtatttgtggcacttttatgggctctttag

SEQ ID NO: 806 - DNA, 1983 bp, Acinetobacter baumannii
caagcaaaaacattgcaacagaattttagaggaacacaccaaatggcaaaaattattggtattgacttaggtactaccaactcatgtgttgctgtacttgaaggcgataaagtaaaagtaatcgaaaacgcagaaggcgcacgtacaactccatcgatcattgcatataaagagggagagatcttagtgggccaaagcgctaagcgtcaggcagtaacaaaccctaaaaatacattattcgcgatcaagcgtttaattggtcgtcgttatgaagatcaagcagtacaaaaagacatcggtcttgtaccttataaaatcatcaaagcagacaacggtgatgcttgggttgaagtaaacgataaaaaactagcacctcaacagatctctgctgaaatcttgaaaaagatgaaaaaaactgcagaagattatttaggtgaaacagtaactgaagctgtaattactgttcctgcttactttaacgatgctcaacgtcaagcaactaaagatgcgggtaaaatcgctggtttagatgttaaacgtatcattaacgaaccaactgctgctgcacttgcgttcggtatggacaaaaaagaaggcgaccgtaaagttgcagtttacgacttaggtggtggtacatttgacgtatctatcattgaaatcgcggatcttgatggcgaccaacaaattgaagtgttatcaactaacggtgatactttccttggtggtgaagacttcgataacgcgttaattgaatacttggttgaagaattcaagaaagaacaaaacgtaaacttgaaaaacgatccacttgcgttacaacgtttgaaagaagctgctgaaaaagcaaaaatcgagctttcttcttcgaatgcaactgaaatcaaccttccatacatcactgctgatgcgactggtcctaaacacttagtgatcaacgtaactcgtgcaaaacttgaaggtttagttgctgatttagttgctcgtactatcgaaccttgtaagattgctcttaaagatgctggtctttcgacttctgacatctctgacgtcatcttagttggtggtcagtctcgtatgccacttgtacaacaaaaagtacaagaattcttcggtagagaaccacgtaaagacgtgaaccctgacgaagcagttgcaatcggtgccgcaattcaaggtgctgtattgtctggtgacaagaacgacgtattgcttcttgacgtaacaccattaactttaggtattgaaacaatgggtggtgtattaacaccaatcattgagaaaaacacaacgattcctgcgaagaaatcacaagtgttctctactgctgctgataaccaaccagcggtagatatttcagtttaccaaggtgaacgtaagatggctcaacaaaacaaattgttgggtaacttccagttaggtgacatcccacctgctccacgtggtgtgccacaaattgaagtatctttcgatattaacgctgacggtatcttgaaagtgtctgcaaaagacaagagcactggtaaagagcaatcgatccagattaaggcaaactcaggtttatctgatgctgaaatcgaagcgatgattaaagatgcagaagcaaatgctgaagaagaccgtaagtttgaagaacttgcaaaagctcgtaacgaagctgatgcattaatttcaagctcaaacaaagctgttaaagatcttggtgacaaagtgactgaagatgaaaaaacagctgtaaatacagcagtttctgaacttgaagcagcaacaaaagaaaatgatgttgaagtaatcaaagcgaaaactgaagctttacaaaacatcttaatgccgatcactcaacgtgcttatgaacaagcgcaacaagctggcggtgctgaaggtttcgatccaaatgcattccaaggtggtgatgctggtcaacaaaaagcagacgatggcgttgtagatgctgagttcactgaagtaaaagatgacaaaaaataa

SEQ ID NO: 807 - DNA, 273 bp, Acinetobacter baumannii
actttgcatttaaatgtttgtcgtaatgaaaggaaagctatcatgaaaaaattaggtcttatctctgtagtacttgctggtgttgcatttacagctgttggttgtgcatcagaagctggtttaaacgcttctggttctgctcaaacaagtgctagcccatctggcgtacaagctggtgttggtgtagatgcaggtgtttctggtcaagctcaaccaggtcaagttgatgctggcgcttctggttcagtttcaggttctgcaactgctcagtaa

SEQ ID NO: 808 - DNA, 945 bp, Acinetobacter baumannii
gaatttatttatatttttatttttgccatgaaaaaatttctatggtggggaataagtttatacttcagtataagcttacaggtaactgcttttgctcaaagcaatttatcaaatatttcttttaatcagcctttaaaatataggattgattatatagatccacgttttaaattaacgaaagaacaatttattcaaattggtaaagaagcagctgaaatttggcaaaaagaaactgggaaaacctattttatttatgattctcaagcagagcttactattaatttagtattggacaaccaacaagctactaaaaatgaaagaaaaaatagtataaatgagctattaaagcagcaggaagaatggagagagaaaaataaagctattcttttatttaaacaacaaattgatcaggaagcctctcttttgaataaagaaaaagagaatcttaattataaattcgaacaatatcaaaaagatgtatctctttttaatcaaggaaactatgggcaatttactcaaagcagtttaaacaaacgccaagctgagttaagccagctttcgttagaattacaaacaaagttttctcaacatagcaataaaatagaaatgcttaatagacaaattaagcaaataaatcaacaacaaaatctgcttaatcaatctattgagcaatttaatttgagcacgacttctggctcaaaaacttttcataaaggcttgtttagtcaaaaccaaattcagatttatggctttacatcattcgatgatttgcgcctaacacttgctcatgagtttggacatgcattaggtttaaaacataccgatgatcctaaatctttgatgtaccctcttttaagagagcaggatattcataacttcaaattaacaaattcagatttagatctattggctacattatatggttcaaatgacgaaaatcattaa

SEQ ID NO: 809 - DNA, 732 bp, Acinetobacter baumannii
aatgttcttctctcctgcctccgagtcggttttatgattaaaaaattaggaatattggcgttatttagtttaactacaagtttgagtttcgctaatgtagatactgttcgggaaaatattaaaaaacaatatcctaatttgaaaattagtaatattcagaaaaccgaaatgcctgggctatatagtgctaatctggaccagcaaattatttatcttggtgaagatgggcagcacatgtttgtaggctctatgattcggttaaaagaccaaaagaacttaactaaagatctggttttaggacagaactcaattgattggaaacagttgcctttaaaagatgccattaaaacagtcaaaggtaatggtcagcatgttttagcagtattttctgatccaaattgcccttattgtaagcagcttgaacctgaactcgacaagcttaaagatgtcactatttacacttttatctatcctttaaaacctcagtctattgtggtttctagacaagtttggtgtgcaccgaatcaatcatattcatggaaaaaattaattgagcaaggtgttaaaccaacggttgcgagctgtacaaacccgattgaccgtaacttggaattagggaaaaaattaggttttaatggcacacctactctcatttttgctaacggatttaaactcgtcggagcgcgatctgccgaagaaattcaggcagtttggaaagagttaggtttataa

SEQ ID NO: 810 - DNA, 927 bp, Acinetobacter baumannii
actgttgcatatattgtaataatagctagacatatggatactttaaaagccattcaggtctttgtttctattgcacaacacggtaatttaactaaagccgcagagcatcttaattattctcgtgcaatggtttcgcgttatcttgagcaccttgaacatacgttctcaactcgactatttcagagaaatacccgaaaaatatctcttacacccgcaggtgaaaaaactctgctctactgcgaaaatattttacagcagcaacaacttttacaagaactcgcagcgcctgaacaacacaacggtacaatccgttttacatgcggattatttctatttgaacttggggttgcggaatgtattcggcaatttaagagacagcatcctcatattcagtttgatgtatacctgactgaaagtacgatggatcttatagatgcacaagtggacttggcactacggattactcaaaaagtcgcagatggtttaattgcacggccagtttgtcaaattgaatccgttttctgtgctcatcctgattatttaaaacagcacagtcccctactccatcctcgtcaactcattcaacatgaatgtattgcacatcatagccaacatcaattctggacactttttgataatgaacaacaacctcagaactatcctttaaatgtcacttttaaaagtaatgatgtgaatgcactttacgacatgtgcttacatgcacagggagttgcaatgttgcctacattattagttgagagagatttaaaagaaaaacgcttaaaagctttatttaaaaattttacggcccccgagttaagcttgtcggtcgtgtatgcttctagacaacatttaccccggattactcaagaatttatagcttttatgatcgaaaatttagatttttacttaaaaccgcaaaattaa

SEQ ID NO: 811 - DNA, 342 bp, Acinetobacter baumannii
ctttcctttcattacgacaaacatttaaatgcaaagttcatcttcgcgctgcctataattcacaattttttttctcaacgtgcgtatcattggttgtcttttgtagtaatagcggtacaaattctgcaattttttattaaaattactttcttaaatcaactatattattttataaatgaaactatagataagcacttgtgtaattttatcaattttttattttttctctatttgacagatatattcaaaatatttccctttatagaaacgcaatacaagttgcgtagattgttacagagcttttcgacttttaaaatcgatttttctctaagaaatccgtga

SEQ ID NO: 812 - DNA, 897 bp, Acinetobacter baumannii
agtgttcttcatgaaacaggagaatacctaatgaaattatttaaattatccgcttccgcacttgctactgctacggcattaactatggctcagtcagctcttgctcaagatctgaaaattcagagttttctggctaaaccagagcactttggtgtcacctcaaccttaatagaaggcgacaaagaagttttactggttaatgcacaattctcaaaatctgaagcattacgtattgctgcaaatattctcgatagcggtaaaacattaaaaactattttcgtaagctatggcgacccggattattatttcggcttagatgtatttaaacagtatttcccgaatgtacagatcattgctacgccggaaacagtaaagcatattcaggatactcaagcgcttaaagttaaatattgggggccacaaatgggtgcaaatgcacctagccaaattattgtgcctcaagcttacactgctaaaactttaaaacttgagaatgagtcaatcgagattaaaggtaaaaaagagcttacttatttatgggttccttctgcaaaagcagtcgtgggggggattccggtatcttcaggtattcatttatggatggcagatacacctaaaaccagagatcgtgtggaagttattcaatctttagaaagcatcaaagcactacaacctaaaattgttgtacctgctcatatggttgagggagctccacaaggtttagatgctgttaacttttcgattaactatttaaatagttatgaaaaagcagctaaagcaactaaaaatgctactgagctgagcaagctcatgcagaagcaatacccaacgcttcaaagtgttgatagcttacagctcggcgctaaagtggtaaaaggtgaaatgcagtggccataa

SEQ ID NO: 813 - DNA, 591 bp, Acinetobacter baumannii
tattggcctcatctttttctctcatgcttggcttggtacaagtcgagtttttaccatttttacgctttggaaatgccaatgaacgcggtcgcaacagatacccaacctttagtcggaattatcatgggttcccagtccgattgggcaacgcttgaacatactgccaatatgcttaaacaacttggtgtcccatttgaagcggaagtggtatctgctcaccgtactccggaccgtttgtttgaatatgcagaaactgcgcgtgatcgtggtattcaagtgattattgcaggcgctggtggagctgcgcatttaccaggtatgtgtgcggcaaaaactgatttacctgtattgggtgtaccagttaaatcatcaattttaaatggcgtagattcattactttcaattgtacaaatgccagcaggtatcgctgtaggtactttggcaattggtccggctggtgcgaccaatgctgcgattatggctgctcaaatcttaggtttaactcgtcctgaaatcgcaaaaaatgttgcagatttccgtgctgcacaaactgataaagttgcaagcaacaatattccggggcaggtttaa

SEQ ID NO: 814 - DNA, 189 bp, Acinetobacter baumannii
tgtattccacatgccaatctggatctcattaagctttatcgtcatagtgttagcaatcactgcttacctctctttacgacacaacaaaaagcaattgcagtcctaattcatcacaacaaggcatctacatgtaagatgccttgttatctaaatcttcaaaagagactgtactttaaaaaaacaggttaa

SEQ ID NO: 815 - DNA, 240 bp, Acinetobacter baumannii
aaaaagattaacacccgttgggtgctttttaaacataaccctttgttttttaattgccccaccggttttggtaaaactaacttaatgcaacccgtgggaaaggcctcctgcaaccaaaaccaattggagaagtatgttttgactttccaagattttgtccaaaaaatgtggacccctttacaaaagggaaagggtaaaaaatttaaaaaaaattgcgcttttttaaacctggttttaacg

SEQ ID NO: 816 - DNA, 1428 bp, Acinetobacter baumannii
aaacacagtaattcatattcgtactgtgtacaaaagcagtggagaaggcgagcaatgcatctgcatatcttgggtatttgtggcacttttatgggctctttagcacttttagctcgtgatttaggacataaggtaacaggttccgattcaaacgtttacccgccaatgtctacccagttagaaaatgcaggtattgaactcatgcaaggctatgaccgtagccatttacagcctcatccggacttggttattgtcggtaatgccatgaaacgtggtatagatgccgtcgaatacatgttaaatgaaggcctgccatatatttctggtccacagttccttgctgatcacgttttacaaggtaaacatgtacttggtgtggcgggtactcatggaaaaacaaccacgacaaccatgctcgcttgggtacttgatcaggcgggtttaaacccgggctttttaattggcggtgttccacttggttttagtgaaagcgctcgtttaggcggtggcaaatactttgtggttgaagccgacgaatatgactcagctttcttcgataaacgttctaagtttgttcattatcatccaaaaacggcgattttaaataaccttgaatttgaccatgccgatatttttgatgacctagcagcgattcaaaagcaattccatcatctggttcgtactattccaagtgaaggccgtattattgcgccaattactgaaacacatattgatgaagtacttgaaatgggctgctggacaccagtgattcgtacaagtttagaagcaaatgaaaaagcggctttgtctgctgaattaatttcaattgatggcagccattttaaagtactcgaaaatggcaatgttattggcgaagtgaaatggagcatgacagggcagcatagcgtagcgaatgcattggcaacgattgcagccgctcagcatgtgggcgtttcgcttgaaaaggcatgtgaagctttgtctaactttggcggtgtaaaacgccgtatggagttactcggcacgatcaatggtattgaggtttatgatgacttcgctcaccatcccacagcaatcgacacgactttagatggcgcacgtaaacgtttaggcgaacgtcgtttatgggccattattgaaccacgttcaaataccatgcgcatgggtagccataaagatggcttggcacattctgcacgtttagcagacgaagtgatctggtatcagccagaaggcctagactgggatttacaacctgtgattgaagccgcgactaaccatgcccaagtcagccgttcacttgatgaaattattgaccgtattgtcaatgaagcaggtgagggtgatgccgttgtaattatgtcgaatggtggttttggtggcttacatcaaaaacttatgagcgcattaaaagcaaaagctgcttaa

SEQ ID NO: 817 - DNA, 1092 bp, Acinetobacter baumannii
gagggattcaaggagacaggcatgacagcatttaatcaaaaaattcaaacattgctagataaggggcaaggtcctgctgctcgagcacttgataggttacctagactagctcaagagtctctcgctaaaattttaggatactcttatcaatatccagatctcgattcatttacgaaatgcatgatggctgtgcaaattaaacaggggagagtgggatttattggttcagacccaattgaatcaagaagagcattcgatgcacaaatgcaggccatacgccaaaaaccaactgatattgagttagtagaagatattcgcttacccctacaaagcgggactatctttgctagacattatcatcctgcccctaacaaaaaattgccattgatcgtgttctatcatggaggtggttttgttgtaggtggtttagatactcatgatgaggtttgtcgcttattagcaaaatatgcaaaagtacaggtgctcagtatcgactatcctttagcacctgaagtttcaccacaacatttaattcaatcgtgtgaagatgcattagcttgggtttatcaaaaccgcagacaattaaaaatattaaaaagtagaattgctgtcgcaggggatagtgctggcggaaatattagtactgtcgtggcgcaaagatcagtaaataaagcttatgctccgcaggcacaattattgatttatcctacagtcgacttcaaaagcagacatccttcattttatgcttataacgaaggactagtcttaacaaatactgatattgactatgtcactcaatattatgcaacgcatcataatgtagaacttgatgatccaataatttcacctacctatggcaatctaaagaaaaacccgcctgcttttgtgattacagcggggcatgatgttttacatgatgaagctaaaatatatagtcataagttaagacaaaatggcgtgaaaatgcattatgaagaatttctggatcagacccatggctttattaacctgactccgatttctagaaaagcaaaacgttatacgatcgaaattagtaaaaactttagaaagttttgggataaaaatagttaa

SEQ ID NO: 818 - DNA, 1371 bp, Acinetobacter baumannii
ctggggtacaatcaatcgaaaaaagtgaaaatatataggctttccatgtcattgatcgcaaataccaccgttgtgcgtggtcgttttttagatattcaacaaactgtctctgagccaactgatattccaaatcaaatacgttatttggaagatggtgtattgattagtgaacatggaaagatcaaatggtttggtgcatgggaagatgctcaacagcatctacctgctggagttgaggttcaacattatccagaacaattgattgtacctggctttattgatacccatattcactttccgcaaaccgaaatggtgggagcttacggcgagcaacttttaagctggcttaatacttatactttcccaactgaaatccagtttcaagacaaaacatatgcaagcgaaattgcccagttctttgttaaggaactcttaaaacacgggacaaccacggccctcgttttctgtacagttcatcccgagtctgttgatgccttatttgaagccgcagagcgcgttcagatgcgtttaattgccggcaaggtacttatggaccgtaatgcgcctgaagcgttgtgtgacacgccagaaacggcttacagcgacactaaagcgctcattgaaaaatggcatggtaaaggccgtgctctgtatgcaattacgccacgatttgcgccgacttctacacctgagcaattagaaagagcagggcagttaaaagaagaatttccggatgtatatgtccatacgcatttaagtgaaaacaaagatgaaattgcttgggtgaaatctttattcccagaacaagcgggctatctagatgtttatcaacattatggcctgactggtaagcgttctgtgtttgcgcattgcgttcacttagaagatgaagaatggcaatgtatgcatgatacacaatcggctatcgcattttgcccaacttcaaacctgttcttaggcagtggtttatttccattgaaaaaaacttgggaaaaacaagtgaaagtaggcttagggacagatattggggctggcacatcgtttagcttactgcaaactgttaacgaggcttataaggttcagcagttacaaggtgataaactctcagcttatgaagcgctttatcatgcaaccctaggcggagcaaaagcactcgatttgcaggatcagttaggcaacttcaacgtcggtaaagaagcagactttgtggtactaaacttaaagccaacagcattacaggaacttcgccagtctaaatctaagtctgttgaagattcactgtttgcattattcactttaggtgatgaccgtaatattgaggcgacttatatttatggaaaccgtgcttatcaaaaagaaacagccaaataa

SEQ ID NO: 819 - DNA, 192 bp, Acinetobacter baumannii
acattgcacaataaaatcgcggacctttatagaaagatcatttttgggagtttcgatatgaaacgtactttccaaccatctgaattaaagcgtaagcgcgttcatggtttccgtgctcgtatggcaactaaagctggtcgtcaagtattagctcgtcgtcgtgcaaaaggtcgtcatagcttaactgtttaa

SEQ ID NO: 820 - DNA, 1029 bp, Acinetobacter baumannii
tacagatgtttaattcatctggcaactggtcgaggtttttttatgcccaattgccggatgtatggaggatttatggaaacaatcggcaatttatggctgtacgtagcattctttggcatagtcattgtcatgcttctgattgacttcttgggctttaagcaaaaacaaggtcaagatgtctcaattaagcaagctgcttactggagcgtggcgtgggtaagcgttgcagccttatttggtggtggtttatggctttacctacaacaaacagttggggtgaccttagcaaaccaaaaaactatggaatactttgcaggttacttactcgaaaagtccctcgcaattgacaacgttttcgtctggttaatgattttcgcagcgtttgctataccggctgcgctacaacgtaaaattttactctacggcgtattaggcgcaatcgtactgcgtaccctctttatttttattggtgcatggttcgttcaagagttttcttgggtactttatatcttcggcgcgttcttggtatatacaggctttaagttcttaaaaggccaagaagaagaaaccaacattgaagatatcaagcttttaaaatggttacgtaaccatatgcgtattacaccgcagcttgaaggtgacaaattttttgtacgccaaaacggtttattatgggcaacaccgttatttctagttttgattttggttgaagcttcagacgtgattttcgcagtagattctattcctgctattttcgcggtaactagcgacccgtttattgttttaacggcgaacttaatggcaattttaggtttacgcgcaatgttctttttacttgctggcgctgcgactaaattgcattacttgccatacggcttaggcattatcttattgttcattggtgcaaaaatgttgttgcttgatgtattccacatgccaatctggatctcattaagctttatcgtcatagtgttagcaatcactgcttacctctctttacgacacaacaaaaagcaattgcagtcctaa

SEQ ID NO: 821 - DNA, 204 bp, Acinetobacter baumannii
atagcatcaaaattcttaaatactaaaaatactggtccacttggtcctgctggagccattaaaccggctggcgtactaccagacaaaggaccttgtattagtggcgaaccatcaatccgtgttactcctcgcgcactccaactgcttaatggttttttcgagcgtcgtccttctccatcaattgacatgcctgctggaatttga

SEQ ID NO: 822 - DNA, 261 bp, Acinetobacter baumannii
cctcctccaaacataacagcaatgttatgtgtcagatatcgtcaatacacttttattaaaaagtcggtatctgagcatcgtgaaattcatggtgtaggcaagaccttgatcatgttgatacagatgtttaattcatctggcaactggtcgaggtttttttatgcccaattgccggatgtatggaggatttatggaaacaatcggcaatttatggctgtacgtagcattctttggcatagtcattgtcatgcttctgattga

SEQ ID NO: 823 - DNA, 282 bp, Acinetobacter baumannii
cttcatcaaaaaaacaactggagaataaatatgtggtcacttattgttgctattgtggttggtttcttcgctggcttaatcgctcgagctttacacccaggtgatgataaagcaggttttattgttactactttaattggtattgcaggttcacttctagccacttatggcggtcgcttacttggtctttatggagaaaattcagcagcgggctttattgcttctgtcattggtgccgtcattattctctttatctataacctaattgcacgaaaaagctaa

SEQ ID NO: 824 - DNA, 564 bp, Acinetobacter baumannii
ggcaatatgaaaaaattactgatgttgttgtgtttaggagtaagtagtcactcagtgtgggcgaataccttagttgagatgcaaacaaatttaggcaacatcgaaatagagttatacgatgataaagcaccaatgagtgtgaataactttaaaggctatataaaatctggtttttataaagagaccatctttcaccgtgtcattccaggatttatggctcaaggtggcggaatgactgcgaacatgcacgaaaagtcaacacgagcacctattaaaaacgaagcgggaaatggtattgcaaatacacgaggtactttggcgatggcccgtacttcaaatcctgattcagcaactagccagttttttataaatgttgcagacaataattttcttaaccgttcaccaggaaatccgggatatgccgtttttggtaaagtggtcaaaggaatggatgtagttgaccgtattgttcaggctcctacatcaaactatggcatgcatcaaaacgtaccaaaacagcctataaaaatagtagatataaagattaaaaattttcaaaaataa

SEQ ID NO: 825 - DNA, 597 bp, Acinetobacter baumannii
atgtctttagaaacactcaaccttagcttattccatgtcattaatggggctcaggatgcgagtcaatttatcattcgtcttgctatcttttttgctaatgatctcctctatattcttttattcatacttacatttttatggttttatggcgatcaagatttaaaaaatagggtcattaaatctgtctttctaacctgtgtatcgcttttagtcggttatgttatttctctgttttaccatcacccaagaccgtttgtgatgggtgtgggcaccacctttattgaacatgcgccaacagcgtcttttccaagtaatcatatgctaatttttagcaccattgccctgtcttatttatttgctcagcgcaaaatgattggaattattcttttatttttgtcatttgtggtggcgtggtcacgtatttatttaggtgtgcatttccctttagatatgttgggtgcttttattgtcgcgttactagtcaacacagccggttattacttctggaatgtttatggtacgcctttaacagcattctttattcacctttaccagattatatgcaaaccgcttttagaccgtggtttgattaaataa

SEQ ID NO: 826 - DNA, 393 bp, Acinetobacter baumannii
aatagaatggagatcaagatgagttattatcatatcctgattgaagtaaatgatcacattagtacgattgagcaaactcgagatatcgaactatttgatattattgaacttaaaccttaccttcattctattttattaccttacttcaatgagcaagaaattgagcttgaagatgaaaatattgaatataaagatattttacatctggaagttaagcagacattattgcctatcgagcacctaattgaagaagaacaaaagcagctaccaagtgatacagatgtcacaattactgcttatgaaatttttaatgaccgtgatttaagccaagatgttacctcagttatttttgatatattggaagcagttaagctagatcaatctatagtttag

SEQ ID NO: 827 - DNA, 1209 bp, Acinetobacter baumannii
cactttattcgagaacgttattttatgactactcaagaaaaacagaaaaaattaagtttgaggcccctatctccaagagatccagaacagccgcatagagcagcaactcccctcgaattattattcgatttaatttttgtagtcgcgattgcaacagctggtcagcagctacatcatgcaattattgaaaatcatctatggcatgcattaccaagttatctgatggtattttttgcgctgtggtgggcatggatgaatttttcatggtttgcttcggcttacgataatgacgatgcattgtatcggtgtcttacctttgtacagattgtagggtcattagtcatggccgcaggtattcctgatgtgtttcatagtcaggattttgacatcattattgtcggctatgtgattatgcgtttggctttagtcacccagtggctaagagccgcaaaacatgacccggaacggcgaattacggcgtatcgttatgccataggtatcgtattggtacaaattggctggcttgttgctaactttgctcatgccctttcaattcctttatttttacttctagttgtggtcgagttatttgttcctatctatgcagaaaaatattcgcctacgccgtggcatcctcatcatattgtagagcgctatgcccttcttactattatcgttttaggggaatccatcgtaggtagcttcaatgccattcgtgatgcgcttgcggctcaatctattaatattccggctgtttttttaatgattggcggattaatgttgatgtttgcaatgtggtgggcttactttgaccgcagtgaacagcatcatcatgttaaaggtgtacgtccgtttgtttggggttatggccattattttgtttttgtgagtgttgctgcggtaggagctgcccttgctgctgctgtggatgtcaccacccaccatgcccatatttctgatttatacatgggtgtaattgtcgcggtgagtgtagtgctttataccagctgcatatggatactttacgagtttcagtgcttatctggaattactaaatggttttatcctattactgcactcattattttatgtattccgtttatttgtaataacgtgggatatagcgtgtttgcgatgggtattgtctatacgttacgtttattcatctcgaataaatttatggaaaatatagagccaaaacaggtttaa

SEQ ID NO: 828 - DNA, 324 bp, Acinetobacter baumannii
ccaatggttcgtattttgcgttggttcattcgactgtatcaaattgcgattagtccgcttcttggaccccgttgtcgttatatcccaacttgttcccaatatgcgctagaagcattacaaactcatggtgcaatcaaaggcgtttggttatcttctaaacgtatttgtcgttgtcatccgtggggaggctctggatacgatccggtaccgcctaaagcaattcgttttatttcgtttcatcaaatagattctcaaacgcatcatgttgctgtaccctttcgtgatcgtttaatgaagcaaaatctctctaaccatttggggtaa

SEQ ID NO: 829 - DNA, 1299 bp, Acinetobacter baumannii
gataatatgcgacgtttttcttgtattgttgggtctgtatttttggcgatggcccaggctcaagcagagctggtaattaatggttctacaatatctagtaatgcgactgttccagtaacgaatagtgatacttatacgcctaataataatttccagagctgtttggcaaatttacgttcacaggctattgctgctggtgtttcaggtagcacttatgatcgctatacgcaaaatttaacaccagattactcggtgattgataagttaagttaccaaccagagttttcgacaccgatttgggattatttgtctggtctggtagatgaagaacgtgttgcacttggaaaacaaaaacttgcacaacaccgtgatgttttaaatcgtgcttctcaagtgtatggtgtgcctgctgaaaccattgtagcagtatggggcgttgaaagtaattttggtgatatctctggaaaatatcctttattacaagcgcttggaactttaagttgtgaaggacgccggcaaagttatttccgtaccgagttttttgccacaatgcgtattttacagcgtggtgacttaactgaagatcaacttaaaggttcatgggcaggagcatttggtcatactcaatttatgccatcaacttatgaacgcttagcggttgattttgatggagatggccgacgcgatttagtatcgagtactgcagatgcattggcttcaacggctaatttcttgaataaagcaggttggcagacgggtatgccttggggctttgaagttcaaattccagcaggcatgtcaattgatggagaaggacgacgctcgaaaaaaccattaagcagttggagtgcgcgaggagtaacacggattgatggttcgccactaatacaaggtcctttgtctggtagtacgccagccggtttaatggctccagcaggaccaagtggaccagtatttttagtatttaagaattttgatgctatttatagttacaacgctgcggaaagttacgggctggcaattgcacatttgtctgatcgcttaagaggtgcaggtccatttgttagctcttggccaactgatgatcctggtacttcacgtgcagagcgtcgtgaaattcagcaatttttgattaatcgtggctatgatattggtgctgttgatggattgattggcgataaaacccgtgttgctattcgtcaggagcaaacccgtttaggtttaaatccaacaggacgggcagggcaacaaattttacgtgcattccgccaagaacaagcacgaaaaatgatgcaataa

SEQ ID NO: 830 - DNA, 1095 bp, Acinetobacter baumannii
gggctcgtcagagccctaatttttttaaggagtaatgccatgaatgcgtttcccactttaacgccactttctctaccatgtaatagcagttttgatgcaaaagattgggaaattttatcgagccattggtatccggttgcgcgtattcaagatgtctctactgcacctcaacgagtcaagttactagacgtcaatatggcgttatacaaaacagaaagtggagaaattcatctggttcgagatatttgcccacatcgtggcgtgcctttaaccaaaggttgggtcgatggtgaggagattgtttgtccttatcacggtctacgctataacactgaagggaaatgtactcaaataccagctcagcccgaactaactaaaatttctgatcgtttttctctgaccaaatttccggttgtgcaaagatatggcctcatttggaccagtattcatggtcgtgatattgctaaagccaatattcctgtattagatacttgggatgatgcagagcatcaagcgattttgccaccttttgtggatattggtggttctagtggtcgtcagcttgaagggtttattgatgtcgctcattttgcatgggtgcatcacaacgcctttgcgaatcgtgataatcctatcgtccctaaatatcacactgaacgtaccaactatggcttaaaaacggtctatatcagcaatgtcagtaattatccgcatgaactaaaacatctcgaaccagaaggctttttgtggaagcgtacttttgaggtttatccgccattttctgccgtgcttactgtcgattttccagaaggtgggatcttaaaaattttaaatgcctgttgtcctatctcaagtaataaaacccgcttatttgttccactcacccgtaactttgaccaaacaggtgatttagaaaaagtatatgcatttaatgcccaaatttttgccgaagaccaagacatggtcgaatcacaaaagccagaagaactaccgctcgatctaatgatggaagcacattttgaagcagaccgttcatcaacgacttatcgacggattttggctgaatggggactaagtaaacgttataccgtttaa

SEQ ID NO: 831 - DNA, 348 bp, Acinetobacter baumannii
cagacaaaaagaggtactgctatgtcagcaaaactagttgttactttgttagcaaccagtcttttaactgtaggctgtgttgcttatacagatgatccttattatcgcggtggttatggttaccatgatcatgacgacgatcgttatgaccgtaacgatggacgtcgatatagtgagtgggaacgcaaacgttgggaagagcgtaaaagattatatgaacaacaacgcaaagatattcgtgaacagcaaaaggatcgtcgtgaatgggaaaaacgacaccgtgaatgggagaagaaacgcttagaagaccgagatcatgatcatagagattatcgtcatgatgactaa

SEQ ID NO: 832 - DNA, 1017 bp, Acinetobacter baumannii
aaaataatgagacacaagtctcattattttgtcgaaattgtatattttttgattgatttttcattttatattcttataatacgttttttttcaaatctcccccctttgattatgcgtttaacttctttgttattaggcatggcctttgctttttctaattttcaggctaatgctaatcttgcgactcccctacacacccaagttcagcaaaaaaatgttcaacatttgacatataaaattgctgaagttgaccctcgttttggtttaagtcaagagcaattgatccagattacacagcaagctgctgatatttggaaagaaggtacaggtaaaaattactttacttatgatccaaatgcaaagttagaaattcgtcttgtatacgatgacagccaaaatcgttcagcagagcgtcaaaaaatcgcttctcagttcaaacaagaccaacaacgtgtaattgatgagcaacaacaaattaaacagttgaagcaaaatttaagtcaaactcaatcggatcttgaaaataaaaaacagatcttaaatgagaagttgaagaattttgatcaacagatgatgcagtttaaggaaggaaaattagcacctgaatacactgcaaaatcactttcgaaaactcagaaagatttacagaaacagactgttgctttaaagaaagatatcgctgcttataatcagcaagctgcagacttaaataaaaaggttactcactttaaccagatcaatgatgaattcaatcaatcattaaatcagtttaagcaaaatgcccaagctgatgtatttaagaaaggtatttataacggtaaacaaatcatgatctatgaatatagttctattgatgatttacgtttaacgattgctcatgaattaggccatgcacttggcttaaagcatagtgatcaaccgggtgctttaatgtactcagttcgaaaagatagcgataaaaaaagtaatattttaactgatgctgatcgtgatctattaagcgctttacctcaataa

SEQ ID NO: 833 - DNA, 390 bp, Acinetobacter baumannii
aatgtgtggagtctcatgcgttctaaaaaaattaatcttgtcgttgtcccgttattactcacggcatgtagccataatgatggtcctttggtacaagacgtatataacaaccaatatgactgtgctcgcgactggaataatgaaacatgtaaacaagaaaatagctcaagtggacatggttctagctatgttggaagccgctatttaaggcctgcgtattatcaaaataatcgggaagtttcttatcacggaaataccttacatccttacagcaatttgagtgtaagtcgccccattatttcaaatttcggcgaaaaacgcgtcttccccatcccaaataacttggggggtttggtccctaacgggttctcttttccgcgggtaaattaa

SEQ ID NO: 834 - DNA, 606 bp, Acinetobacter baumannii
tgccaaaaaggactgtacatgtttaaaaacccatttaaacggagatcatcaatggctaatgagcaaaacgagcaagctcaagacattcaaaatgagcaagttgagcaatctaacgagcaaactcaggctgaaggtgtagagcaagcaaacgacgttaccgttgaatctttacaagcgcaaatcactaaactagaagaaaatcttaagcttgaaaaagctcgtactgccaatgcagtttacgaagcacaaaaaagtgtagagcgtattcagcgtgagtctgagaagcataaagagactgtgcttgagaaatttgcaaaagaattgttggactctgtcgacaatttagaacgcgcaattcaggcagctggcgatgaagaaacgcctgtacttgaaggtgttaagttaaccttaaagtcacttttaacgactcttgagaaatttggcgttgtagaagctgatactcaaaatggtttcaacgcagatttacaccaagctgttggcattgatccaaatgcaaaagcaaatgaaatcggtaccgttttacaaaaaggctataccttaaatggccgcttattgcgccctgctatggttatggttggtcaataa

SEQ ID NO: 835 - DNA, 408 bp, Acinetobacter baumannii
ccagacttgggtgtgatggcactttacagttttagcacagatcttcgtatacgctgtgctgcagattataaaagtgtatttgatggtgcgctttttaaagtgcatcaaccccattttttatttcttgcaaaattaaccgaacagcctaacagccgtttgggtattgttgttgctaagaaaaaagtgcgtcgtgcgcatgaaagaaatcgaataaaacgtcttgctcgtgagagctttcgtctacatcagccgaaatttgggtcagacatagatgttgttgtgatgcctaaagttggtatagaaacgattacgaatgctgagctatatcaacaattagattttgcttggcaaaaattacaacgcttagcgaaaaaacattctaaagttgtcccaacctcgcagaattaa

SEQ ID NO: 836 - DNA, 306 bp, Acinetobacter baumannii
ctatttattatttatagatattttaaaaaattaaaatcactgttattaaatccattaatttttccattaatgccaaacacatgtatttatttattctctttctttagcaatttcacaaaacaatcgctatctctggtcatttttatcactttgacgaataaggattacatcctaacaataagaatttatttatatttttatttttgccatgaaaaaatttctatggtggggaataagtttatacttcagtataagcttacaggtaactgcttttgctcaaagcaatttatcaaatatttcttttaa

SEQ ID NO: 837 - DNA, 1206 bp, Acinetobacter baumannii
cgggttctcttttccgcgggtaaattaatcaggcatccacttaatatgaaaagaaaaatatttactccacgtccagactggcaagtggagcatcaaaatattggttttgattattttaatttaccttctctcgatggctcaatttactggtctgaaggggttgcgtatgagtttacccttaaacagattgaacaacttgaagatgcggcatatgaactgcatcagatgtgtttatcggtagtaggagatcttattcaacgcgggcactacccagcttattttcaaattcctgaaacagccataaaccatattgaacattcatggaaacaaaatgctccgatgctgtatggccgctttgatttcgcttacgatgggcgaaatatcaaaatgctggaatataacgccgacacaccgactggcttacttgaagcttctgtcgcgcagtggctgtggatagaacaagtctcgggcattgcaaaccgagaccagtttaatagcattcatgaagatctgattaaacgctggaagacaattttaccgcgtggtagccatgtgcattttgctgcctgtcaggaagctggaagggaagactggggcaatctcgagtatttgatggataccgcttaccaagctcatctacaagtttccgagctttctatggagaacataggttggaacgggcaagattttgttgatctccataatcagcccattcaaaacatatttaagctctacccatgggaatggatctgggaagaagcattttctcaatatatccacccacaaacacagtggattgaaccttgttggaaaatgctactttcaaataaggcgattttggttgagctttggaagtattatcccaatcatccattattggtcgaaacccatacctataacccgcaacaagctttgtctggcaaatgggtgaaaaagccgattttggcaagggaaggggccaatattcaggttttacaagacggccatgaccaaggcgcggcttctggtagcttttattttgatgactatgacaaatatggttatgtcgtacagaaatgggtagacaccccattattttcaggacaactacctactcttggtttatggatggttggacatcaatgtgcaggcatgtctattcgtgaagattgttatgacatcattggtaatgatgcccactttgcagcacattattttgtcgagtaa

SEQ ID NO: 838 - DNA, 1365 bp, Acinetobacter baumannii
gtgaataatatgcatagtcaaaccacaattgccgcaattgcaacgccaccagggcgtggtggagtgggcgtgattcgcttatcgggacctaaggcttatgatattgctcaaaaactgacgcaaaaaaacttacctgaagctcggatggcgggtttccgtaagttttatgatgctgttggaagtattatggatgaaggcattgtcttgtgctttccaaatccacattcttttaccggtgaagatgttgtagaacttcaaggccacggtggtcctgtcattcaaaatgccttacttggccgtttatttgagcttggggcaattgctgcaaaagctggggaattctccatgcgagcttttgaaaatggcaaaatggacttggtacaagctgaagcaattgccgatttgattgatgcgacctctcaagctgcggctcgttcggcagtccgttctttacaaggcgctttttcaacaaaaattaatacagttttagaaaaactgattcatttacgtctgcacgtagaagctgcgattgattttccagaagaagaaattgattttttggctgatggcaaaattttagctttacttgaagacgttcagcagtctgtacatgctgttcaaacctctgcacgacaagggcaattactccgtgaaggtctacaggttgttattgcgggtaaaccaaatgcgggtaagtcgagcttgttgaatgcacttgctggtgttgagcgtgcaattgtgactgatattgctggtacaactcgtgatgttttacatgaaaaaattagcttaaatggtttaccaatcaccttaacagatactgctggtcttcgtgaaacaggtgacatcgttgaaaaagaaggcattcgacgtgcaatcaaagaaattgagcaggccgatttgttgttattggtctacgatttaaatcaaggtgatgaccccttaaaactggctcaagaatactttgctgaacatattgaaccacgtcgtctcatgttaattggcaataaatgtgatttaactggtcaatctgccgaaataagcgattatcaagggttccgtcatatcacagtttcagcaaaacaagagatgggcgtacaaggcctcgtagatgcgattacagcgcatgcaggctttcaccctgaggaagatacatttattgcgagaacacgtcatttagacgcaatgaagcgcactcagctctatttggcagaggcacgtgagcaacttgttgtatttaacgctggtgaactcgttgctgaatcactacgtcttgctcaaaatgctttaggtgaaattacgggtgattttagtgccgatgacctattaggcaaaatctttggttcgttctgtatcggaaaataa

SEQ ID NO: 839 - DNA, 537 bp, Acinetobacter baumannii
gaatctgccatgactgttgcaatgagcatcatgatttcaaccgaagaaattcaagcaaaagtcaaagagctcggcgagcaaatcaattctcactatgcaaatagtgacaaagaattggtcctgattggtctacttcgtggttctgttattttcatggcagacttatgccgtacgattaccaaaccacatgaactcgactttatgacagtgtctagttatggcggcggtaccacttcaagtcgagacgttaaaatcttaaaagatcttgatggtgaaattcgtggtaaagacgtgcttgtggttgaagatattattgactcaggcaacaccttaagcaaagtcgtggaaatgttgcagactcgcgaaccaaattcaattcaattatgcacattagtgagtaaaccatctcgccgtgaaattgatttagaagttaaatttttaggttttgaagttgaagataaatttattgttggttatggcttagactacgaccagaaatatcgtcacttaccatttattggtgaaattggtctgtaa

SEQ ID NO: 840 - DNA, 318 bp, Acinetobacter baumannii
gggatacacatgctttggacagactgcttaactcgcttgcgacaagagctctctgataacgtctttgcgatgtggattcgccctttagtagctgaagaagtagaggggatactacgtctctatgctcctaatccttattggacgcgttatattcaagagaatcatttagagttaatttctatattggctgaacaattgtcggaagggcgggtgcgtcaagttgaaatcttggtagattctcgtcctggtagtattttgtcctctagtgaacagcctgcaacaactacagcagctttacaaactgcccctataccttaa

SEQ ID NO: 841 - DNA, 1131 bp, Acinetobacter baumannii
gaggctgaaatggataaaactatcggtatttttggtggtgggcaattgggccgtatgatggcgcaagcagctttaccattaaatattcaatgtactttttttgaagcaaatacggattgtccagcaggtgttttaggccaagttttttctagtcaagatgaacaaggtttaaagcagtttattgaaagcgctgatgttttcagtcttgagtttgaaaatacgcctgttacagatgtagatgtgttaacacaaactaaaacactgcaccctccccgtattgctttagcaactgcgcaaaatcgtttgtcagaaaaagcattgtttgatgaacttgagattcctgttgcgccgtatcgtgctgtagatagtctagaaagcttgaaaaaagctgttgctgagcttggtttgccgattgtacttaagactgcaactggcggatatgacggtaaaggtcagtttgtacttcgttcagaagaccaaattgatacagcttgggcagagcttggccctgcaaaaagcttagtggctgaaagctttgtgaaattttctcgcgaagtttcgattattgcagtacgtggtcaaaatggtgaagtgaagacctggccattggctgaaaaccaccatcacaacggtattttgtcgcactcaatcgtacctgcaccgaatagtgaagctctacaacctgttgctcaagactacattacgcgtttgttaaatcatctcaactatgtaggtgtgctaactctcgagctatttgtgacagaacaaggcttgtgtgcaaatgagatggcaccacgtgtgcataactcaggtcactggtcaattgaaggtgccgtatgttcacagtttgaaaaccatatacgagctgttgcaggactaccattggggtcaacagacgttgttcgaccaacggttatgatcaatattattggtcagcatcctaaaactgaagatgttttggcactaaatggcgctcatctgcacctttataacaaatcggaacgtgctggccgtaagttaggccacattacgttaatgcctgtggatagtaatgaattgacgaatttatgccgtcagttagcgaaaattttgccagaaccactcgctttaacagatgatatgatcatttaa

SEQ ID NO: 842 - DNA, 423 bp, Acinetobacter baumannii
attacagttttatcttttataatattttcgatccatattaatacttacatcatcgtgatgatgaaggatgtgcctttgagcccaacggttttagctttcgttctgttaattatttctaactgttttatgacacttgcatggtatgggcatcttaagtttttgcaccacgcaccattctggcaagcgattttatttggttggactattgccctgcttgaatatagttttatgattccggcaactcgactcttgagtgaccaaggttggactttgggtgaaatgaaaattacccaagaagttgtcacgcttattgtatttgttccatttatggtgttgctatttaagcagccgttcaagctagactatgtttgggctatgttatgcttgtttggttgtgtctattttgtatttagaagccagtaa

SEQ ID NO: 843 - DNA, 183 bp, Acinetobacter baumannii
gtgatgaccgtaatattgaggcgacttatatttatggaaaccgtgcttatcaaaaagaaacagccaaataaaaaaggcattgttaagtttttgttattatttggaatatgtgctattgcgttaaagcgtgatcgacatattccgcaaaatgataaaatttcacagtcatcaaagggtgcatga

SEQ ID NO: 844 - DNA, 1779 bp, Acinetobacter baumannii
ccatttggggtaatagatatgcaacaatgggccaggtttgcaattctcggggccatgtttgtcaccgcatatttgctcattttggcttggcaaaaagattatggaaatgctgcaactgcaccgcaacaacaagcggcggctgtaagttcacatgaagtatctgctgatttgccaaatgctaaaactgcaacagtggcttccgatgtgccacaagcaaatattgcgcagtcacaaaccacagatgcaactgcacctgtgaatcaacagcttatttcagtacaaactgacctttatcatctttggatcaatccaaaaggtggtgatattgttcgtattgaattactctctcacgacaagagcaaagacagtaatcaaccatttgttatgcttgaaaatgatgccaagcgtacttatgttgctcagtctggcttaattggtttgaatggaccagatagcagtcgtggtggtcgcccattatatgctgttgaaaaaacatcatatactttagctgatgctaaaggggtacaagatcaaagtggacattctgagaaagttttaacagttcctatggtgtttaagacaccagaaggcgttgaaattattaaaacttttacatttactcaaggtcaatatccaattgttgtcaaacatcaagttgttaaccgtagccaacaaaactggcaaggtcagatgtttggacagttgaaacgtgataattcggaagatccaggtaagtcttctcagggtattttcactttaagtacgttcttaggtggtgcatggggtactccggatgctcactacaacaaacttaagtttgcgaatttctctgaagaaaaactcaataccgaagctaaaggcggttgggttgcaatggttcagcactactttgtaagtgcttggattccaggacaccttaaactgactcaagcaaatggtcagccttatgtcgctaaacttgaatctcgtcagtctgcggatcatatgaatattattggctttacttcgccagtaattaatgttccggcgggtacttcaatggaagtcgatgcgaagctttattcaggtccaaaagtacaatctgaattaaaagatttagcggtaggtttaaaccagactgttgactatggttggttatggccaattgcgaagttattgttcctaggtcttcaattcttccatagcattgtaggcaactggggatggtcaattatcttacttaccattatggtgaagatgattttatggcctttatcttcaaaaagttatcgttctatggcgaaaatgcgtgtgattgcaccagaaatgcaacgcatgaaagaagaattcggtgaagaccgtatgcgcttctcgcaagaaatgatggcgctttacaaacgtgaacaagttaacccgctttctggttgtttaccgttattgctacaaatgccaattttccttgctttgtactgggtactcatggaaagtgtggaattacgtcatgcaccgtggttaggctggattcaagacttgtctgcgatggacccatggttcatcttgccattaattatgggtgcgacaatgtttgctcagcaaatgttgaacccgcaaccagctgatccaatgcaggcgaaagtattccgcattatgccgattatgtttacggtatttatgttgttcttccctgcgggtcttgtgttgtactggattgtgaacaacagtattacaatcttacagcaatggtttattaacaagagtgttgagaaaagtcgtatcagtaaagctgaatcgacatcttaa

SEQ ID NO: 845 - DNA, 249 bp, Acinetobacter baumannii
cacctaaaattcctaaaattgcatctaaaaaatcccatccaaaatatttacctgcgaaaagcgctacaattgcaaaaacagaagtcactgcatctgcaaccacatgtaaaaacgcagctttttggtttaaatcatggtgatgatgcccatggccatgctcgtgatggtgatggtgatggtgatggtgatggtgatggtgatggtgatggtgaccatcatcatgaagtaaccaggcacaaatcaagttaa

SEQ ID NO: 846 - DNA, 387 bp, Acinetobacter baumannii
gctgtgtgttctttctttttgacatggtccgataaaatgttaaaaatttatggtattaaaaactgtaactcgatgaaaaaagcatttgatgctttacaagcaaaaggtttgagctacgaatttcacgattataaaaaacaagggatcgatgctgatactctaaaaatctggctaaaagaaattggacaagatacggtgctcaacaagaaaggtactacgtggaaaaaactatctgaagaagaacaaacgcgtgctttaagcagtgaagatcatcttattgaggcgctaattgctcagccaagcttaatcaagcgaccagttctacagacctctaaagggtttctggtaggctttgacgaaacggcctatcaaaacctaagcgcataa

SEQ ID NO: 847 - DNA, 3387 bp, Acinetobacter baumannii
acagatagttctgttttttataaagtgcagccgtttatatatccttatgattataaaaaaatgctttttaatatatttagtgtcttggaaaaaatagggctaaatgctcagaaacgtgctatccacgtacaattttctaatgaactactcaatcatcaagtattcttacaacgtatagaaggccaacatcagctaaatggtggcctaatggcagagttgatctgcctttcaacaaatgcccaaattgcattgaagcaatttattggtgttcaagtcgctgttgatcaggtcactgattcggggcaattgttccgaactacaggtattgtgactgaggccagttatggacaaagtgatggcgctttaacgctttataagctgactatagaagatgcgacaaatttatggcacaaacgccgtaatagtcgtgtttttatgaataaaagtatcgtagaaattaccgaagttctatttaaagaatggcaagaaaaaagtccactgtttgctgcgagtttaagtcttgatttgggtgggttaagtcaaaactatgatattcgtccgttcactatgcagcataatgagtcagactatgactttctcacacggttgtggcgaagtgagggggttagttggctcattgatgaatcagagctttttgtccctcattttactgcaccaatacaagctcaaaaactaagattaattgatgacaataaccaataccaagctttagcgcgtcgtagtattcgctatcacagaagtagcgcaaccgaatatcaagatagtattacaggctttgttgcagtgcgaagtctgcaaccgactgccgtacatgtacagcgttggcagcccgatgcgttagcgcaagaagagggtaatggttcagttgttactacccatacacactcagataactttgattcggctactttaagtcttgagcaagcatggcacgtaagccccgcctggatgcaagatttaaaaggggaagatcaggcaaccgcttcaagcagtagccaattagaaaaattaaatcagcacttcactgacatgcatgcgagtcgggccaaatactttaaagcctacagtagtgtgcgcgatacccaagtcggctattggtttaatctacgcgaacaccctgaaattgatcaacatgaaggagcagatcaagagttcctaatcattgccaaaaatttctataaccaaaataacttacctaaagatttacatcagcaagttagccaattattaacccaaagtcgttgggatcaacatggttacgatgatatcgaacgtcaaagtaatgagctgacgttaatacgccgtcaaatcaaaacggcacctgaatacaatccggaacagcatcgaccaattgcttacccacaaagagcgaaagtcgtgggacctgagggagaaactattcatgtcgatgaatggggacgcattaaagtacgttttctatttactcgtagtgatgatcatggtcatgatggtggcgcaggaagtaatgacaatgataccgactcggcttgggtggatgtactgactccttgggcaggagaaggctatggtgcacgtttcttaccacgtattggtgaagtggttgtcattgacttttttgatggcaatatcgaccgtccatttgtgacgggccgaatccatgaagcgcagcgttcgccaactaaattcgatgtaaaagggcagcttcctgatactaaaaagctaagtggcatacgcagtcaggaaatcaatggaagtggcttcaaccaattacgctttgatgacacaacagggcagatcagtactcaactccaaagtatccatgcggcaacacagttgaatttaggtaatttaagccatcctaaagaacaagcgacaagccaaggccgtggtgaaggctttgagcttagaacagacgcttggggagctgtgcgggcgggtaaaggcatgctcattagtacctatgcacaagagcaagcgattgcagaccatttagaggccgcacaagcacaatccttactttcacaaggttatgaaagcatgaaaatgctcagtgaagttgcagccaagcaacaaactgatgctttgaatgtaattaatcgcttacccaaatttatccagtcacttgagctaaaaaccacagggcaggcattaaatagtacggtgaatctatttaaagaaggaattaataacgatcctatccatgccctaaaagactgcggtggctttattcaagacatcggtgcactaggaggaaacgcaaaaggcgttgtagatgaatttaattctttctttagcgatgccaaagatgcggtagaaaatttaaaagcattcatcgaaaacgttgaagaacatggccctgatattgttaaaggaaaactcgcaagtattaaagaccgaattcataaaaatccatttgaaagtattcaagaggtcgggaaagtcttagcaaatgtcgagactaaagactttgatttgatgagtacgtgtggaacttttagtaaaggcagtaaattggaagtatcaccttctaaagcattgagttctttacaaggctttatggaaggttatacccaaggtttagaaagcagttccgatactaaacaacaagagcaaggcaagatcttcagacaagcccttatgttgttagcatcgccaaatggtattgctttgacgacgcctgaaaatattattttgcaagcttcgcaagatattgccgaaagtgccagcggttctattaatttaagtgcgcaaaaaaatattattgggcacgcacaagacaaaatcagtttgtttgctgcgcaaaagggtttgcgtgcttatgcagcgaaaggaaagctcgaactacaagcacaagatgatgctattgaagcaattgcgaagaaggtcattaagctcatttctaccgaagaaaaaatcgagcttacgagtccaaaagaaattgtattaaccgcaggtgggtcacagctcaaaattaatgccaatggcgtattttcaacaacaggcggtaagtttgaaagtaaagctgggcagcatttatttgcgggtggggcaaaggtttcttatgaggttcctgagttaccgaataccccaacttttagtaaccgtttagatatttatgatctattttgggaaagtgattttagcaaacttagctataaagcgttcatgccagagacaaattcatttacttcaggagctatagatgagcatggacgaacaggaaaaatcggtactcctgatccaacaaatgttcaagttttaattggctctgatgatgaatggggacttttaattgatagttttgatgaagatgaaattttggaagatcagagcataaatagtaataactctgcaattgataataatattgaagataggggctga

SEQ ID NO: 848 - DNA, 1260 bp, Acinetobacter baumannii
ttgccgaactcgaccgtaacagtcgtgaagttagcccagagccatgggcaccagtttgggactaaactcatgaacactcaatcaaatacggcgttctcgttattggcattggcaattggtgcctttgctattggcaccacggaattttctccaatggggttacttccgaacatcgctaatgatttagggatttcaattccaacagccggtatgttaattacaggctatgcacttggcgtaatgctaggtgcaccgtttatgaccctgtggtttggtggttttgcacgacgtaatgcgcttatttttttgatggcgatctttacggtcggtaacctgattgcagcgttttcaccaaattatatgagcttattaggtgcacgtctcattacaagcctgaaccacggtgcctttttcggaattggttctgttgtggcagcgagtattgtaccagcgcataaacaggctagtgcagtagcaaccatgtttatgggcttaaccattgccaatattggtggtgtgcctttagcaacatgggttgggcaaaacattggctggcgtatgtctttccttgcgatttccgtgctcggcattattactatgctcgctttgtggaaagcattaccgcaaggtatggttgcccaaaaaccaaacgtgaaggcggaattaaaagtattaacgcgtacccctgtggtccttgcattactcactaccgtactcggtgcaggtgcaatgtttacgctctacacctatattgcgccaagtttgactgagtttacccatgcttcaccgaccttcattacgttcatgttggtgttgattggtgtcggtttctcgattggtaaccatttaggcggccgttttgcagacttatctatcaacaaaactctgattggtttcttggtactgttgattgtgatgatggtgactttcccaattcttgctcaaagccagattggagcagccattgcgttggtgatatggggtgcagcaacctttgctttagtaccgccattacaaatgcgtgtcatgtcagtcgctcacgaagctccagggcttgcctcttcagtgaatattggtgcgtttaacctaggtaatgcagtaggtgctgctgcaggtgcattagtactcgatttaggttggggttatagtgtagtatcttttgcgggtgccttactggcgggattaggtttgttattggttttattccaaatcaaacgagaaagcagccccgctcaaaccttacaacagtgttcagactaa

SEQ ID NO: 849 - DNA, 843 bp, Acinetobacter baumannii
aacagaagattgggaaggattatgtcagcagctccacgcattggtattttgggtgcaggcggccgtatgggtcgtatacttattcaggcagttcaacaagcaggttatcaattgggagccgctgttgtacgcccagaaagtactttaatcggtgctgatgctggtgaacttgcaggaattggttcaattggagtgaagcttaccggaagcttggcagaggttcttgaagactgtgatgttgtaattgacttttcgactcctgcagcaacatctgagcatttaaagctatgtcgtgaagctggtgtagctatagtgattgggacaacgggaatgtctgatgaacaaaaagctgagcttgatgaaacggcaaaacatatacctgttgtatatgctgcgaactactctgttggcgtaaatgtatcaatcaagttacttgagcttgcagcaaaagtatttggcgatacagtagatattgaagtgattgaggctcatcaccgtcataaagtagatgcaccatctggtactgcattaatgatgggtgaagcaattgcggatacgttaggccgtaacttaaaagaagttgctgtttatggtcgtgaagggcataccggtccacgtgatcgtcaaaccattggtttcgaaaccatccgtggtggcgatattgtaggggaacatacggtcatgtttattggtgagggtgagcgtgttgaagtgactcacaaagccactaaccgtatgaactttgctgccggtgcagtacgagctgctgcatgggttgtgggccgtgaagcgcgtaaatatgacatgaaagatgttttagggttgaacgacgtacaggtgtaa

SEQ ID NO: 850 - DNA, 255 bp, Acinetobacter baumannii
agcagtgcatctcggatgtgctgctttttacttgcaaaattccttgtttttctcaaattttccccgatttttcattttttagaatatttttttaaaaatcataaaattaatttttatcagaaaaaaacacctaattccttatatttagaatttataaaattataccgatcgttaaaaaataattacttttcactttcatattcaatacaagagattaaatgcttttacaagaaagagtatcattgcaccaattaa

SEQ ID NO: 851 - DNA, 906 bp, Acinetobacter baumannii
accatgaaatcaacaattgaagaacttgttgcctttatcacaattgttgatacaggttcatttgtggcagcagcagaacatttaaagcaaacaccttcgggggtgagccgatctttaacccgtttggaagcaaagttagatgtgactttgctagagcgaacaacgcgtaaattgaaactgactcaagaagggcaacaatttcttataaaggcccgtaaaattttgaatgagctgaatgcggccgaagaagaacttcaaaagtctgatcaaggtactgccggtcttattcgggttgattctgccacaccgtttgttttgcacgtgattgcaccattaatgcataaattccgtgagtgttaccccgatattgaaatcgaattaaatagcaatgatcaggtgattgacttacttcagcataaaaccgatgtcgcatttcgatttggggaacttaatgactctagtctgcacgccaagttggtatgtaagagccgtttatatattgtggcaagtcctgactatctagctcttaagggaacgccaacacaacctgaagaacttgaacagcatgatttgattggctttactagacctacttatatcaatagctggccaattaaagttggcgatgaatatttttttgcccaatcaaaaattaaagcatcgagtggggagaccgtacgccaactgacgattagaggacacggcattgcgcgactatctgaatttgaaatttggaaagatatggaagaagggcgattgattgcattatttgaagacaaaattgagcatcaatatcaaagcatccatgctgtgtattatcaacaagagcatctaccaaaacgaattcgtttatttattgagtttttggcagaacagttaaaagacggttttaaaaacgctctctaa

SEQ ID NO: 852 - DNA, 465 bp, Acinetobacter baumannii
aatcttatgtctaccgagacctcacttcgtccattgttttggaaaaattatacgctagagcaactgactcaggctgagtgggaggcactgtgtgatggatgcggattgtgctgtttggtcaagctagaagatgaagatacacatgaagttgcgtacaccaaagtggcgtgcaagttacttgattgcaatactggacgttgttctgactacccaaaccgtcagcagcaagtacccgactgtttacaactaacaccggaaaccttaaaaaccatacactggctgccatcgagctgtgcctataaacgtttgaatgaaggcaaaaatttaccttcttggcactatttaaatacgggttccagacaaagcgtagtgaaagcgaaaaagtcggtagcagggcgttgtattcctgaaactgatgtacatgaagatgatatcgaagattatgtggtgcgttgggtgcgttaa

SEQ ID NO: 853 - DNA, 1920 bp, Acinetobacter baumannii
gtcaatattccgactgatctaacgctatatcagtatcattcagccagagtggaagtcatttcactcaagcacaacttgttggaaacacaaatgcctgactatcgttcaaaaacatcgacacacggaagaaatatggctggcgcacgtggcttatggcgtgcaacaggaatgaaagatgaagatttcggcaaaccgattattgcagtggtcaattcatttacccaatttgttccaggccacgtccatctgaaagatttaggacagcttgtcgcggcagaaattcaggcagcaggtggtgttgctaaagagttcaatacaatcgcggtggatgacggtatcgcaatggggcatgacggcatgctttattcattaccatcacgtgatttaattgcggactcagttgaatatatggtgaatgcacattgcgccgatgcgatggtgtgtatttcgaactgtgacaaaattactccgggaatgttgatggctgcgatgcgtctaaatattcctgtggtatttgtgtctggcggaccaatggaagcaggtaaggttaaattccgcggtgatgaaaaagcaattgaccttgtagatgctatggttgttgcagctgatgacagctacacagacgaagaagttgcagaatttgaacgttcagcatgtccaacttgtggttcgtgttcaggtatgttcactgcgaactcaatgaactgtttaacagaagcgctaggtttatcgttaccgggcaatggttctatcgttgcaacgcatgcaaaccgtaaaaaattattcttaaaagcaggtcagcttattgttgaattggccaaacgctactatgagcaaaatgatgcaagtattttgcctcgttcaattgccactaaagctgcttttaaaaatgcgatgacacttgatattgccatgggtggttcaaccaatacagttcttcacttgttagctgcggcaaatgaagctgaagttgattttacgatggacgatattgatgaattgtcacgtcgagtaccagtgctttcaaaagtagcaccagcaaaacaagacgtacatatggaagatgtacatcgtgcaggcggtatcatggccattttaggcgagcttgatcgtgcgaatctacttgatgtatctgtaccaactgtacatgagaaaacattaaaagatgcgttagataagtgggatattatccgtactgaagatccagatgtatatgagttctatcgctcgtctccgggtggcgttccaactcaagttgcattctcacaaaaccgttactactcaactttagatggcgaccgtgaaaagggcgtgattcgtaatgcagaacatgcattctctaaagatggtggtttagctgttctttacggcaacattgcgcttgatggatgtattgtaaaaactgcgggcgttgacgaatctattttaaaattcacaggttcagcacgagtttttgagagccaagatgcagcggtagaagcaattttaggcaacgaaattaaagctggtgatgtggttattattcgctacgaaggtccacgtggtggtccgggcatgcaagaaatgctttacccaaccagctatcttaaatcgaaaggtttaggaaaagactgtgcgttagttacagatggccgtttctctggtggttcatcaggtctttcaattggtcacgtttcgccagaagctgctgaaggcggtgcgattggtttggttgaagatggcgataccatcgaaattgatattccaaaccgtaccattcacttgaatattgatgatgcgactttggcgcaccgtcgtacagttcaagaagcgaaaggttggcatccgaaggaagaacgtaaacgtaaggtatcaaaagcgttaaaagtttatgcaatgcataccacaagtgcagcaaaaggagctgtacgcgttctataa

SEQ ID NO: 854 - DNA, 1209 bp, Acinetobacter baumannii
aggagtaatcccttgattagaaaaagtaattctttattaaaaattttatttagcagtatttgtttgatatctggttctgctatggctgctccaattacagatttgagtaagcaaattgtgagtgaaaaaccgggctcaatactttctatagcgcaacaagatgtgacggatttatttcctcatgcagatcagcgcttattagtaaattatcgtagtcgaggtgtgaatgacgagcctatcgttgcctcagcgtttattttattaccgaaaggaacaccaccaaaaaatggctggcccgtactagcttgggcgcatggtacaacaggagtagccgatacttgtgcaccttcgggtgattatgccggtggaccagttcattcatatcaggaagttgcttcaaaagcgttagatggttggcttgcacgaggctatgcagtagtcgcacctgattatcaaggtctgggtactttaggtgcacatccttatatgaatgcaaagagccaattgcatacagtagtagatgcagtgcgggcgttacatatgcttaagccaaaagattttaataaacagtggttggtgatggggcatagccaaggcggtgctgctgctattaccatagcggcatatggtcaaaaagatgctcctgaactcgatctaaaaggggcaattgctcttgcgccaggcggctatcaatatgaaggcattgcagaatatgtgaaaactaatccaaacccagaaccaagtgtggcagcatttttcccgattgtattattgggagcacaagcagcagagccaagtattattcctgagaatttagtcagtccagaaatgggcaatgtgctgactcaagcacgtagccgctgtttatctgaacttcaatctgatttgaagaaatctccttctagcatatttcgacctaatgcagatttaaaacctcttttatcttatttaaaacagcagtctattgaaaatatggtgccgactgtaccgttaatgattgttcagggttctaaagatcatttagttgaccctagaggaacatatgcttattaccaacagctatgtaaatcaaaaaaaccaacaatttatcaaactattgatggtggagatcatcgcgatgcactacgtcagagtcatacttttgctactgactttttaaatgtcatagagaaaaatcagacaaaatcgtattgctcaaatcttaagtaa

SEQ ID NO: 855 - DNA, 537 bp, Acinetobacter baumannii
ccgtgtccgtttatggggaaaaattgccaagtcatgatcatgaagaatattcaaattcagcctttaaccattgagaactttcagcccttcggagaagtcatttgttgtgacgggcatgatttttttcatattaatgatgcacacaccgagcgctaccatgcgctcgtcgaaactgaaattgaaggcgaagcaaaggcaggaattagtattttccgaaatattaaggccagtgtgttacctatggaaatttcaatgctagagcgccatccgaaaggctctcaagcattcattccattgcagcaacaaaaatttttaattattgtggcccctgctttagatgaaaatactcctgatatttcaaaactatgtgcttttgtttcggatggcaagcaaagtatcaattatcgggcaggtacttggcatcatcctttgcttacctttgaagcgccgagtgattttgcagtagtggatcgaattggaggcggtgcaaattgcgatatttttcaatttccagaagctataaaaattactgtctaa

SEQ ID NO: 856 - DNA, 1041 bp, Acinetobacter baumannii
ctgttcatgcctgaattttctttttctgatgccctcttaaactggttcgatcaacatggtcggcatgatttgccttggcaagtcgcagatgatccatacaaagtctgggtttctgaaattatgttacagcaaactcaggtaaaaacagttctgcaatattttgaccgctttatggaacgcttcccaactgtagaagctttaggctatgcaacttgggatgaagtagctccttattgggcaggtcttggctattacgctcgtgcccgcaatttgcataaagccgctggccttgtagcacagcaaggtaaatttcctgaaaccctagaagaatggattgcactaccgggcattggtcgctcgaccgcaggtgcactcatgtctttgggtttacgtcagtatggcgtgattatggatggcaacgtgaaacgtgtcttagcccgtttctttgctattgaagatgacttaagcaagccacaacacgaacgtgaaatgtggaaactagctgaagaactttgccctactcatcgtaatcatgactacactcaagcgattatggacttgggtgcaaccatctgtacgcctaaaaagcctctttgtttatattgtccaatgcaagctcactgtcaggcttatcagcaaggtttagaacaagaattaccttttaaaaaaccgaaaaaaacaccacctgttaaaacggcagatgttcttattattcagtgcgaagatgaatggttctggcagcaacgccaagctcatggtctatggggcggtttattttgtttacctattttagaaaatgaacatgaacgcttgaaattaagtcagcaatttaagctacaacctcaaccacaaacttttcagatcagtcatagctttactcacttcacatggttacttaatgctcatgtgttccacgtggaacctgatcaaaaagaacatctggcgattgaacttgaaggccaatggctgagtccagaacaagctattgctaaaggtgttccaactgctatgaaaaaattgatctcgacaagccgttcatga

SEQ ID NO: 857 - DNA, 1128 bp, Acinetobacter baumannii
aagcgaatgccgctgagtcgtgttgaagaacttgtcgccgatattcgtgcaggcaaaatggtcatcttaatggatgacgaagaccgtgaaaatgaaggtgaccttgtcatcgcagcaacgcatgtacgccctgaagatattaacttcatgattacacatgcacgcggtttagtttgcttaactttaagccgtgaacgttgtaaacaattaaacctcccgctgatggttgaccagaacggtgcccagcatggtactaactttacgttatctatcgaagcagctgaaggtattaccacaggtatttcggcagcagaacgtgctcacacgattcaagctgctgtggcagcacatgccaaaccaaccgatattgtacaaccgggtcatattttcccactcatggcacagccaggtggtgtattacaccgtgcaggtcataccgaggcaggttgtgatttagcacgactggcaggtcttgagcctgcatctgtcatttgtgaaatcatcaaagaagatggcacaatggcacgccgcgcagatttagaaatttttgctgagaagcatggcctaaaaattggtacaattgccgacctaattcactaccgtatgaccaatgagcaaactgtagaacgtttggatcaaagaacgattcaaacagaatatggttcatttgagctctatcgctatcgtgagataggtaaccctgacattcatttggctttagtcaaaggtgagccaaaagaaggcgttacaacggtacgtgtacatggttttagtcctgttcgcgatttgcttaagctaaataaagctgacggtgaaccggcttggaatctagaccgtgcgctacaaacgattgcagcaagtgaccgcggcgttttagtctggatcggacaagatcatttgcaagacttgggaccagcgttggatgatttaactaagccaaaaccggtgaaatccaatgcagcactttcacatcaatatcaaaccattggtgttggtgctcaaattttgcgtgatttaggtgttgaaaaaatgaagcttcttagctcaccattgcgtttcaatgccttatctggctttaatttagaagtagtggaatatgtcactgctgatcaaatcacaacgaaataa

SEQ ID NO: 858 - DNA, 1128 bp, Acinetobacter baumannii
  unsure (965): Identity of nucleotide sequences at the above locations are unknown.
ggagcaccgccaaacatggctaaacgtgattattatgaggttttaggcgtttcaaaaaccgcaagtgatgatgagatcaaaaaagcctatcgtaaattggcgatgaaatatcatcctgacagaaaccctgacaatgccgaggctgaagaaaaatttaaagaagcttctgaagcttatgagattttatcggacagcgaaaaacgcagcatgtatgaccgtatgggacataatgcgtttgaaggcggctttggtggcgctggtggtggctttggcggtttcagtgcagaagatatttttagccagttcggtgatatctttggtggagcgtttggtggcggcggacgtcagcaacgccaacgtcgcggttcagatttacgctatgtcatggaacttacccttgaggaagctgtaaaaggggttaaaaaaacaattacctttactgctccagcaccatgtgatgtgtgtgatggtaaaggctctaaaaatccaaaagatgtagaaacttgtaaaacttgtcacggttcaggacaagtgcgtatgcagcaaggtttcttctctgtacaacaaacttgtggcacatgtcgtggccaaggcaaaattattaaaaacccatgccatgcatgtcatggttcaggtgtagcagatcgtcagcaaacattagaagtgacgattcctgcaggtgtggacaatggtgaccgcgttcgtttaagtggtaaaggcgaggctattcgtgatggtcaagctggtgacttatacgttgaagtggttgttcgtgaacacgaaattttccaacgtgatggtgccgacttatatatggacgtaccagtaagcattgctgatgctgcacttggtaaagaaattgaaatcccgactttggaaggccgagttagcttgaagattcctgagggaactcaaacaggtaaattattccgtttacgtggtaaaggtgtgcgccctgtacgtancagtatggtgggtgatttactttgccgtatcgtggtaaaaacaccggttaacctaacctctcgtcaacgtgaattacttaaagaattacaagcatctttcgatggtgaagacagtgcttcttcaccaaagaaaaaatctttctttgatcgcttattcgattaa

SEQ ID NO: 859 - DNA, 1947 bp, Acinetobacter baumannii
agaaaaattacccttagtgatcgaattctttgcgcacaccatcaaataaggaaaacgtacaacgtgacacaatatacggctcaatcgcttgaagttctttccggtttagaccctgttcgtcgtcgtccggggatgtataccgatacttctcgtcctaaccatttagcccaagaagttattgataatgctgtcgatgaagccttagctggtcatgccgacaaaatctgtgtcacggtttataaagatggttcattgtcagttgaagataatggccgtggtatgccagtcgatattcaccctgaatatggccaaagtggtatcgaaatcattttaaccaagttgcatgctggtggtaagtttagtactgataactatcagttttcaggtggtttacatggtgtggggatttcggttgtaaacgctttatctacacgtgttgaggtagaagttcagcgtcagggtaatttataccagatggcctttgagcaaggtgaacctgttgcgcctttggcagtgctagaaggcaaagcaccaaaacgtgcgactggtacaacggtacgtttctggcctgaagctaaatattttgatagtccaaaatttgcgttaaaagcactcaaacataatttaaaagccaaagctgttttagcagctggtttaaaaattacttatatcgatcaaattaatgatgaaaaaatcgaatggcaatttgaaaatggccttgtcgattatttgatggatgaattacaagatcgtgaaattttgccaaaccctgcatttgtaagcagtggccaagcagaccgtgcagcatgtgaatttgcgatttgctggaatgtagagggtggcgaacaggttcaagaaagttatgtcaacctgattccaactgcacaaggtggtactcatgtgaacggtttgcgttcgggggtgaccgaagcgctacgtgaattctgtgagttacgcaatttattaccacgtaatcttaaactttcggctgaagatgtttgggatggcgtgaactatattttatcgcttaagttccaagaaccacagttctctggtcaaaccaaagagcgtctttcaagtcgtgaagctgccaatattgttttaaacattgctaaagatgcgtttgcgctctggctcaaccagcatgctgaaattgccatgcaacttgctgaaatggcaatttctaaagcagggcgccgtttaaaagctgcaaaaaaagttgagcgtaaaaagattgtttctggcccggctttaccgggtaagctggcggactgcgtgggccaaacacgtgaagaaagtgaactctttattgtcgagggtgactctgcgggcggtagtgccaagcaggcgcgtgataagaactttcaagctatcatgccaattcgtggaaaaatcttaaatacatgggaagtttcttcagatgaagtacttgcttctcaggaagttcacgacattgccattgcaattggtgtagacccgggtagtgatgatttatctgaattgcgttacggcaaaatctgtattttggccgatgccgactcggacggtttgcatattgcgactctgctatgtgctttattcgttaaacactttccagcattggttgaagaaggccatttatttgtagcaatgccaccattgttccgtatcgacattggtaaagatgttcattacgcgctagatgatgaagagcttgaaaccattttgaaaaatgttaaaggcaataagaatccgcaaattacccgattcaaagggttgggtgagatgaacgcaattcaattacgtgaaacaacaatggatccgaacacccgtcgtttggttcagcttgatctagatgatgcacatttaacggcaggtttactcgacaagctccttgcaaaaaaacgtgcagcagaccgtaagcaatggcttgagcagaagggtaacttagctgatatcactgtttaa

SEQ ID NO: 860 - DNA, 705 bp, Acinetobacter baumannii
atcatctgtacacttcccatatgtggcgagaaaaacaagatagagcagaacatgaataaaaaacaaattgctttgaccactcttctttgcttaagcagcctctatactggggctgcctctacagacaaggctaaactcagcctagaccgtaatcatattaaagtgtggacctatcaaaaagcagataacccagtctttcaatataaggcggaaacaacgtttgatgtaccccttgaacgcgctgtggcggtaattttagatgtagatcgtgcggctcaatgggtgccttatatgggcaaggtccaaatgctttctcaggatgaaaagaaaggcgaatttactttatatatggtgttagattttccttttccgctaaaagatcgcgatgtagtggttaaaggaaaaatgagtaaagcagccaatggcttaattactattaaaaatacggcagttaatagtaactatcctatacaacccgatgtcgtgcgcctaacacgctatgaaggggactggacatttcagaaacttgccaataataaagtcaaagtcaccactagtggctatgctgatccagcgggtgcaattccgttgagcttcgtcaatatgtttgttcaacagcaaccttatcagatgctgcttaaaatgaaacgggaagtaatgaacccgatttatgagcaacctaagttgccggaaattttaaaataa

SEQ ID NO: 861 - DNA, 1074 bp, Acinetobacter baumannii
agcaaacacacggtagtttggagcaaggtaaagtcgctgactttgtggcttgggatattgagcatccatctgaaattgtttactggctgggcggagatttgcctaagcgagtcgttcagcatggacaagaagttattttttaaacggtgtcacatgaatcacacatttaaatggcaaggccgccatgatggcgagggtgaggcacatcaacgtattcaccatattgtgaacaaaacccaacatgccgaatttgccctgattggttttagctctgatgaaggcgtgaaacgtaataaaggccgagttggtgctgccgacgcaccagatgcgattcgtacccaactggctaacttaccaattcatcgtccagtcagtattgtcgatttggggacggtgacctgtgaatatggcaatttagagcaagcacaaagcgaattagctgaacaagtcgcaaatagcctagaacatggcttaaaacctgttatattgggcggtggacacgaagttgcatttggcagctttagcggtttatttcaatatatacaagcgcatgcgccagataaaaaaataggcatcattaattttgatgcccatttcgatttgcgtgaagcagagtatgccacctctggaacaccttttttacaagctgctcgtctttcagaacagcatcaaaaacaatttaattatttatgtattggagttgccaaccatgccaatactaaagttttgtttgatacagccgatgcgttaaattgttcatatttacgcgatcatgaggttaatatttttaacctaccaaacgtgctcgcggcggttgacgcttttattgaaaaagtagactgcttgtacgttacgattgatttagatgtcttcgcggctgcggttgcaccgggggtcagtgcgccagccgtaaaaggaattgatttagctacttttgaagcaatttttaagcatattcaagagactggcaaaatcaaacttctagatattgctgagtgcaatccaaaatttgatttggacaatcgaacagcaaaactggctgcctatattgtttatcaatatttattttcttaa

SEQ ID NO: 862 - DNA, 1077 bp, Acinetobacter baumannii
agcttcataacccaccagaacggttcaaatccgcttaaggagtttccgatgagcaataatacgattcaggcttatgctgcaatgcaggcaggtgaaaaactggtcccatatcaatttgatgcaggtgaattacaaccgcatcaggttgaggtaaaagttgaatactgtggtttgtgtcattctgatatttctgttttaaataatgaatggcgctcaaccgtgtaccctgtagttgcaggccatgaaattattggacgaattgttgctttaggctcagaagccaaaggactacaaattgggcaacgtgtcggtattggctggaccgccgaaagttgccaagcctgtgatgagtgtattggcggtcagcaagttctttgtacgggcgaaaatgtcgcaacaatcgtgggacatgcgggtggctttgccgataaggttcgtgctggttggcaatgggccattccccttcccgaagatttagaccccgaaagtgcaggccctttactttgcggcggaattaccgtttttgacccattactcaaacacaaaattcaggcaacacatcacgtgggtgtgattggtattggtggtttgggtcatatcgccattaagctcctaaaagcgtggggctgtgaaattacggcgtttagttctaacccagataaaaccgaagaactcaaagctatgggagccgaccatgtggtgaatagccgcgatacagaagcggtaaaagctcaaaagggtaaatttgatttattgctgagtaccgtaaatgtgactttaaattggcgtgctttcatttctacactagcaccaaacggttctttgcacttcttaggacttacactagaacctgttcctgtttctgtaggttctctcattgatggtgccaagtcagtaactggttcacctactggttcacctgctgctctacgccaacttttaaagtttgccgcacgcaaaaaaattgcgcctcaaattgagctatttccaatgtcacagctcaatgaagcaattgaacgtctacactcaggtcaagcacgctaccgcattgtgcttaaagcagactttgcagaataa

SEQ ID NO: 863 - DNA, 375 bp, Acinetobacter baumannii
gaggatacaacaatgactgacaagaaatgtccgtattgcgattttgatgaatatgacatcattgataagaatgaatttgctgtaattttaccagacccaaatccgttgtctaaaggtcactgtgtagtgactccactacgccatgtcagctcgttttttgatattacgtctaaagagcaccaaggcttactgacacttcttgaaattgcccgtcatgaaacccagcttcgccatcagccagacggtttccatattggctttaatgatggtgaagtgtttggacagacttctgaccatttccacattcatgtcattccatattacaaaaatcaaccgttgaaacttgatcaacgttggggtgtacaaaaggattaa

SEQ ID NO: 864 - DNA, 209 bp, Acinetobacter baumannii
aagggggggttttggaaaaagccccaaaaaaaaagggttttaacccaaacccggcccccggggggtttccccttaaaaggggggtgtggcccaaaggggggtttgggccctttaaaaaccccccccccttgggaaaaaaagggtttaaagggggggccccccaaggggttgtttaaagcccccaaagccccaaaggaaaaaaaaggcaa

SEQ ID NO: 865 - DNA, 189 bp, Acinetobacter baumannii
agaattggaacaatagcaggaaacaataaaactattgttcctgctgccatctgcgttgttgtaggcgttcaccttcaacttcacgcttgtttcttgccgactcatagagtttggttccctttaactcaggcggcaaataatcttgcagtacaaaatgctcagggtagtcatgaggatagagataattaa

SEQ ID NO: 866 - DNA, 885 bp, Acinetobacter baumannii
agtgcacatgcaatgaaccgattgtgcaaatcgaaaaacaaaggatggacaatgaaaaattttaaaaacaaagtcgctgcaattacgggcgcgggttctggcattgggcaacagttagcaattcttttggcaaaacagggctgccatctttcgttgagtgatattaatgaaaaaggattacaacaaactgtcgagcttttaaagccgtacagcaatattactgttaccaccaaaaagcttgatgtgtctgaccgtgaagcagtaaagcagtgggcgcaagaaactgtacaagatcacggttctgttaacctgatttttaacaatgctggcgttgcgttaggttcgactgtcgaaggcgcaacctacgaagatttagagtggattgttgggattaacttctggggtgtcgtatacggtactaaagaatttttaccgttcattaagcaaactcaagatgggcacattattaacatctcgagcttatttggtctgactgcacaaccaacccaatctggctataatgcaactaaatttgctgtacgcggctttaccgaatcgttacgccaagagttggatattgaaaaaagtggtgtgagttctttgtgcgtacatccggggggaattcgcaccaatattgctaaagctgcaaaaatgagtgatagcttgagtagtttaggtatggacccagctaaatcgattcaaaactttgataagtttctacgtaccccaccagaagaagcggctcgtcaaatcttggatgccgttttgaaaaataaacgccgtttattgattggtagtgatgcaaaatttcttgatgcattgcagcgtttgttcccaacaggatatcaacgcgcttcaaccgttgtgaccaaatggatgaaataa

SEQ ID NO: 867 - DNA, 729 bp, Acinetobacter baumannii
gtatacttggccaaaacctataaattaggaaaccattctttaggaaacaatttatttatggcgactaacgactcaaccagtaaaaagaaaacaaaaagtgtgagtaaagaacgtcagttcaaagggttatctctatctgaacgtaaagaggcacgccgtgaaaaactgattgaagcgggtattgcaacctacggaacccttggttttttttcagtgacggtaaaagatgtctgccaagaggcaaaactcaccgaacgttatttttatgaatcatttaagaagagtgaagatttattccaaaccatctttttaaaaatgattgaagaattacagcaaaatctgatgcaagccgtgattaaagctgcacccgatccagaaaaaatggtcgatgcgggtttaagagctctgctgacgacattaaaagatgatcctagattagctcgtattgtctatgtcgacgcagtcttggtacaagaattacataatcaggccaccattcaagaaacacttgcgcaatttgatcgcatgattcaggcctttgttatgctgaccatgccccaaattcagcaccatgaaaatgagctctctttaattgcaactggtttgaatggatatgtcacacaaattgcgattcgatgggtgatgggagggtttgagcagtctcttgagcaggttttaactgcatgccgtatcgtttttttatctttattagctcaagtttcaaaataa

SEQ ID NO: 868 - DNA, 924 bp, Acinetobacter baumannii
tgttctatggctgagttctcaattattgatcaatactttaatcgtcagtcacatcctgacgttgcgcttggtattggtgatgactcagccttaattactccccctccaaatcaacaactggtgatctgtgccgatacacttgttgctggacgtcacttccctcttgaaacctcgccccatgcgattggctggaaaagtgttgccgtaaatctgtctgatattgctgcaatgggcgccaaaccccatagtattttacttgcgatcagcttgcctcaagttgaccatgaatggcttgaaggatttagtcagggaatctatgactgttgtaatcaatttggagttgctttaattggcggagataccactcaaggtccgcacctcaccattaccgtcacagccatgggctggattgaaacaggaaaagctgtattacgttcaggcgctaaggtcggtgattatgtttgtgtaagtgggcagattggtgatgctgcttatgggcttcagcatttaggacattccctacaacaaagactggactatccgacgccacgttgtaagcttggagaagagctaaaagggctcgcctctagcatgatcgatgtgtcagatggtttagctcaagatttaggacatattttaaaagcgtccaaggttggagcacgactcatcctggaaaaaatacctgttgatcctgtactgcaacaactagaagaacaacaacgttggcaatatgcgcttgcaggtggtgatgactacgaattatgttttacaataacaccgcaaaattatgaaaaacttttgcaaaaacaactagacgttaagattacaatgatcggacagatcgttgagcaaacaaaactaacttttgagcatttgggttcagattacccattgcaaattcatggataccaacactttgcataa

SEQ ID NO: 869 - DNA, 636 bp, Acinetobacter baumannii
accacgcatttaatttcaaacctagttactcagggtaaatgcaaagcgatcgtgattgcttgtaacaccatgacggctgtagcgattgaaacgattagaacgcaaattaatgtgccacttattgcgatagaaccagccgtaaaacctgctgtggcaatgaccgtgagcaagcatattgctgtcttggcaactgccaccacggtaaagggcaaaaacttaaaaagtttaattgaaacgtatgcgcaacatattaaagtgtctttagtgccgtgtattggtttggccgaaaaaattgaaacgggtaaagcacatacagtagaagttaaagattatttaaaaaatattttggcgccgttggtcgaacaaaaagtcgatacgattattttaggatgcacacactatccatttgtctcagacacgattcaggaaattgtaggccgtgatattcaaatcattgagccttcggaagctgtaacagcgcaattaattcggcagctcaatcaatatcatttaagttctgaaagtccaaatgagggaaatcatattatttggaccagttcagacccgttggaagttgcggacgtgactttttctttgttaggtaaacatttacctgtagaaactactgatttttaa

SEQ ID NO: 870 - DNA, 819 bp, Acinetobacter baumannii
attcaattttatagacttttctgcaatgaaattgtcataattaatctttgtaataagcctgtcataactacaaaacggttcaccgttaaatctataggatattgcgttgtgaaagatgactatattttaattgtcgatgatgagcttcctattcgtgaaatgatccatacctctttggacatggcaggctttcagtgtttacaggcagaagatgccaaacaggctcatcaaattatcgtcgaccaacgtccggcgcttatcttgctcgattggatgttacccgggggcgtaagtggggtcgacttatgtcgccgtttaaaacgtgatgaaaacttagcagaaattcctgtcattatgttgaccgctcgcggtgaagaagaccacaaagtacaaggtctagatgctggtgcagatgactatatgaccaaaccattttcaacccgtgaactggtttctcgtattaaagctgttctacgccgagcaaatgcattaagcggtgaaaaaacaattgatgccaatggtttaattcttgatcctgtaagccaacgcgtaagctttggtaacagtattttagatatgggaccaacagaataccgtctgcttgcattttttatgacccatccggaacgtgcctatacacgtgcccagttgctcgatcaggtgtggggcggtaatgtatacatcgaagatcgtactatcgatgtgcatatccgtcgtttgcgtaaagtcctagaaccttttggtgtagaccgatttgttcagactgtacgtggtacaggttatcgtttctcaacacgtgcagatttagccgcaggttaa

SEQ ID NO: 871 - DNA, 879 bp, Acinetobacter baumannii
tcctatcattactggagaatcgccgtcttgagttttacatctcgcttaaaaaaagaattatttattaaggcacaaaatcttgttcctcagcatcagttaagtcgtgtagtgggtaaagttgctgcaagtgaaaatccaattttaaaagctgctgttattcatgcatttaaaaccaaatacggcattgatttatcaattgctgaacaaggcaatgcactgaaatataaatcttttaatgatttctttacccgtgccttgaaagatggcgtacgtttagttgatgaaaatccggatagtattgtttcaccagcggatggcgcgatttctcaaattggtaaaatcactgcgggcgaagtatttcaagcaaaaggccaaagtttctctgtagaaaagttaattggcgatccacaacttgctcaacctttccaagaaggtgagtttgcaacggtttatctttctccacgtgattatcaccgtgttcatatgccattttcaggcacattaactgaaacgttatatgtaccgggtgagttattctcagtaaatcaggtgactgctgaaaatgtaccgggattatttgcccgtaatgagcgtatggtatgtttgtttgatactgagcttggtcgtatggccgttgttttggtcggcgctatgattgtggcaggtattgaaactgtggcaacaggtaaagtaaaaccatcgggccgtatcgaattacagcatcatgagttgaagttagagaaaggtgctgagcttggccgtttttatttaggttctacggcaattattttatttgaaaaagataaaatcgagtgggaaaaacgttttaaagccgagtccgttgttgtcatgggcgaacgtatgggccatacgctttaa

SEQ ID NO: 872 - DNA, 354 bp, Acinetobacter baumannii
atcctaaactataaaacttttaaaggtgaatataagtattttaataataaaaaattctttggtactgatggtactttacctaataatgattttttacaacttgataaaatcattattaagagtaaagataagaaaatagaaattggtgaaaatgatatagagcaatacttttttcctaaaaatggtatagacagtgacaagaacgagcttgctgattttaaaatatatttcttaaataataatatttttattttaaatacttttaataatggtggtgcagcagcatataatatcgttttaaatataaaaaatggaaaactagttgccaataaagcttggaaggttgaaatttaa

SEQ ID NO: 873 - DNA, 1059 bp, Acinetobacter baumannii
agatcttcataccttcaatatcagtccatctataaaaatatgcaagctgattttttaaatttttatgaaaaattgaacaaaaggagagcaattgtgtccgaatcttatctatctggagcagaacttattgagcagattcaaaagtctccttattcacgtgatttaatcggttatcacggacagcctccagaggtgaaatggcctaataatgctaaggttgccgtgcaatttgtgctgaattatgaagaaggtggcgaaaaacatattgaacacggtgacgaaggttcagagcagtttttatccgagattattggcgctgcaagttacccagccaaacatatgtcgatggactctatgtacgaatatggttcacgtgctggtttttggcgcattcatagtgagtttcaacggcgcaagctccccatgaccattttcggagtagcaatggcgcttgttcgcaacccttatattgtagaggcaattaaacaggccgattacgatgtggtttctcatggctaccgctggcttcattatcaagagacagatcttgaagtcgaaaaacagcatatggaacaagctttatctgttttagaaaacttgtttggaaataaaactataggttggtacaccggacgtgatagccccaatacgcgtcagttgcttgcagagttcccgcaaatacaatacgactctgattattatggtgatgacctgcctttttggaccacacttaccgatacggcgggtgcgtcacgacctcatctgattattccttatactttggaatgtaacgacatgaagttctgctccccaggtggatttaatagctcagaacagttttttcaatatttaaaagatagttttgatgtgttgtatgccgagggagaaactgcaccaaaaatgatgtctattggaatgcactgccgtattttagggcgtccgggtcgttttaaagcattacaaagattcctggactatattgaaatgcatgatcgtgtttgggtatgtcgccgtcaggatattgcagaatattggtttaaaaatcacataaatcaataa

SEQ ID NO: 874 - DNA, 594 bp, Acinetobacter baumannii
agggaaaaatatatgaatattatctacctccatggctttaatagtagctcttcttcaattaaagggctcagccttaagcagtattgtagcgaattgggcataaatgtgcatttgccagatttaaatagatctccggaacaggtagtagcacaggtttcagagctgattgagtctttacaagaggtggctttagtcggcagtagtcttggtggtttttttgcgacatattttgtcgcgaaatataatattccggctgtactgattaaccctgctatgcaaccatggaagctgtttgatgagttatttcaagttgaaagcatgccttataaggtgaacgatcaatggtcaattgatcatgttcagttacgacagttagaacaactggaactgaaacagcctgaaaatgctgacaaaatactcgtcttgttgcaacaaggcgacgaaattttggattatcgtcaagcacaacgctattatagtgctgcaacaccatcctcattgattttgacggatgctcatggcaatcatgccatggaagattttgaagaaaaattacccttagtgatcgaattctttgcgcacaccatcaaataa

SEQ ID NO: 875 - DNA, 687 bp, Acinetobacter baumannii
aaaacagaatataattataaaaaatatattttatttcagaactttaaaatggaaaaatctttaaaagaataccaagctattatttttgatatggacggtactttagtcgactcctttagcttttttttaggtgctttaaatcagcttgccaagaagtataaatttaaatctgtagagctacatgaagtagagcagtacaaacatctttcaccaaaagaaattatgaaagagatgaatgtttccagatggaaactgccttggattgccaaagatttcattcgtttaatgaaagaaagagatcaagacgtttacatgtttgagggcatgcgggaccacttaattgaactacataatcggggatatacgctcgcaattattacttcaaactctaaagaaaactgtcaaagtattcttggtacagaactatgtgaactttttagccatattgatggtggctcgtctatatttggcaaagctcaacgaattaagcgtgttctcaacattttgaatttaaataaaaaccaagccatttatgtcggcgaccaaacgactgatggcgaagctgcacataaagcaggcattgattttgctgcggtaggttggggttatacgtcggctgaaaaattaaaaaccattcagcccaaagtcgtgctcaacgacttggcaaccatgaaagaatttttctaa

SEQ ID NO: 876 - DNA, 747 bp, Acinetobacter baumannii
ctgcaaagatatctatatcatgcgttcaaagattttctttttttaggattgatgatgaaaatattaaaactgtcttttttagcactcgggatgggtcttagcggattcgcacaagcagattttataggcgtaaaaggagacgttggctactggttttatgacggcaaagctaatatgtcttcacaatctcctgaagaacaagatctagaccgaaaaggtagtgctcaactttcattagcttttgagcacccaatcccatttatcccaaatgcaaaaattcgttatgttaatttagatactcaaactaaatcagaaactttgggtcaagctaactataacgttgatttagatcatagtgattttattctctactatgagttactagataatattgtcagtgtagatgcaggtcttggtgcaactgtactaaatggagatattactgcctataccggtaaacgtgtagatattgataagacatatccgattgcttatttatcaggtgaagtaaaacttccatttacagggttaagcgctaaaggtgaagcaacatatacaaactttgatgatgcaaaaattacagatgcgttagtagaagcaaagtataagtttgccgataatttattaatcgatttaggcttaacagctggttatcgtatcctcaatatcgatttagatgattacgataacaatgaccttaaatttgaatttaaagggccttatgtgggcttagaagcacatttctaa

SEQ ID NO: 877 - DNA, 1104 bp, Acinetobacter baumannii
gatatgaatctgttaaaacctctcatcatgagtatgatgattgtttgcatggtcacattaatggggtgtagtaaagaggctcccaaaacagaagaaataccctatgtgatggtgacccagccttcaaccacacttcacgaacagaaaagctatgctggagatgtacaggctcgacaacaaactgccttggcatttcgggtgggtggacaagttacggctcgctatgtggatgtaggtgaccgagttagagttgggcaagtattagcaaaactcgatgtggaggatgcacagctacaattaaatgctgctaaagctcagctagacaatgcacaggcagcagcaaaaacagcctcagatgagcttaagcggtttcaacaattattacctataaatgccgtgagccgttcgcaatacgatacggtaaaaaatcaatatgatgcggctcaggcagcattacaacaagctcgttctaattatgaagtttctgccaaccagactggttataaccaacttgtttctaataaaaacggtgttattacagcgcgtaatattgaaattggacaggtggttgcagcagggcaagcggcttatcaactggcaattgatggtgaacgtgaagtggtcatcggcgtaccggaacaagcggttagcgagattaaagttggccaagcggcatggataactttgtggtctaaaccgaacgaacgatttgccggatatgtacgcgaagtttctccagctgctgaccagtcccgtacattcacagttaaggtggcactcaaagaaggtcagtctgctattcagctgggacaaagtgcacgcgtattttttagttcgactcaaactaatgtcatgagtgtgccactttcgagtgtatctgcaacagataaccaaccttatgtatgggtggtgaatgcgaatcagaccttacgtaaagtgcctgtaacgattggtgcttatggcagagatagtgtgccggtattatcgggtttaacaccaaatgattgggtagtgattggtggtgtgcacttgctgcgcgataaacagaagattcacccgattgatcgtgaaaatcgtgcagtgaaaattcagggagccaaataa

SEQ ID NO: 878 - DNA, 453 bp, Acinetobacter baumannii
agcatgtctcaaacactgcaagccgcttatgcagcaaaacgtaaagcacgtcgttttgctgtacaaggtatttatgagtggcaaatgagtcacaaccctgtacatgaaattgaagcgcgtacacgtgctgaaaatgcaatgcacaaggtagacttgaactattatcacgaactacttactcaagttatcgctcagcacgaagaccttgatgcgttacttattccggtacttgaccgtgaaattgacgcgctagatggtgtagagctcgcaaccttgcgtttaggtgcttacgagttacgtgatcatctagaaattccatatcgtgtggtacttgatgaagcaatcgaacttgcgaagcattttggcggagcagacagtcataaatacatcaatggtgtattagaccgtttaagttcgacactgcgtagcgcagaaaaacaacaagcaaaataa

SEQ ID NO: 879 - DNA, 1053 bp, Acinetobacter baumannii
atgaaaaatcatgtttttaacaagaaatacggatactccattatggcaacattgcacgctccagcttttgaacttcctgaaattttgaatactaaaacgaatttggcagatgcccgaattggtgcacaagtgattgagtgttcagatgatttctttgcagaagcaaagcgtatgctgcaatttgaagcacctatttttgttgaagataaatttgatgatcatggtaaatggatggatggttgggagacgcgccgtaagcgtcatgcaggccatgactggtgtattgtgaagctaggtgtgagtggaaaaatcagtgcacttgatatcgataccacgttttttacaggaaattatcctgcatctgcctcattagaggcatgttatgcaccaaatggtgaccttactggggtaaagtggcagagtattttggaaaatacagagctagggccgagtcaacatcatatttttatggtcgataatgatgcaattttcacgcatatacgcctcaatattttcccggatggcggtgttgcccgtttacgcgtttatggtgacgtccatattcaggtgaccgaccacgagcagactctcgatttattggccttagaaaatggcggtcgtgtaattgcttatagcgatgcgcactttggacatccacgtaatttgattaacccaggccgtggcgtcaacatgggcgatgggtgggaaaccaaacgccgccgtgcaccaggttatgactggtgtattcttgctttgggtaaaagcggaaaaattgaaaaaattgaaattgatacggcgcattttaaaggtaactttcctgctgaagtttctattcaggctgtctaccttgaaaatgcaaccgatgcacagctgattccacaaagtatgttttggtcttacttacttgaagcccaacctatgcaaatggaccatattcatgaatatatgaatgaaattttacagcatgaaaaagtctcgcatatccgtattaatatgattccggatggtggtattagccgtgtccgtttatggggaaaaattgccaagtcatga

SEQ ID NO: 880 - DNA, 1497 bp, Acinetobacter baumannii
gttgatttccatagcctaaaggtgttctataaaccagtacagatacagaaatttttaaaaaagcagcacagaatgacttttcaatatcaggttcttgccaatcaattagcacatcgtatttatcaagatgaacttaaacctcatcaaaagctcatttccttacgagattttgcccgtcaacaaggtattagtttaagtacagcaaaaagttgctatgaattacttgaggcgaggggactcatttatgtaaagccgaagtcaggttattttgtggttgctcgtaccccatccagccctattccggatagtccagattttttatctttgcctcgacatgtctcaaatctggagttgcataaccaaattcaggaagctgccttacaaagtcatcttgtacctttgggatcgattcagttaacgccgcactttattcctgtagagggtttacgtcgttctattcaacgtgctttaaaaaattgtcagcctcaagattttctttattgtaataaacaaggtcatgaacaattaagaaaagcgctatccgatcattggcgtgaggatggtatttatatcgctccagaagatatttttattaccaatggctgtatgcctgctttgtctttagtgattcagaagcttactgaagtgggcgatagtattcttattcctacacccacctacaatggtcatttacagttattagcaagtttaaaacgacagattgttgagattccggcagatcatcgcggaattgatcttgagcgcttagaatctttaatgcagcaaggtttggcgaaggtttgcttaatgacagccaactaccaaaatcctttgggatattgctttagcaacacagagaagcagaagattgctgaattatctgcaaagtatcagtgttttattattgaagacgatatttttggtgagtgtggctacagtagtgagcggccattacccattcgatattgggaccgtgaaggttatgtgatttggtgtggttcagtgtctaagtctttgtcgagtgcgtatcgagtaggatggttttgtttaacgacaaagctagaacatctaaaacttgaactgctagtaagtaatattggggtgaatacacccttacagttaggtctagctgattttatttatagtcgggcttatcgagagcatttagagcagttaaggcctaacttgatgcggcaagttgaagaataccgtagctgtattttaagagcctttgaaggtataccaattgcattgagccagcccgaaggcggatatgcattatggatacagttacctaagagtgtagatagtttagcgctctattacactgcccaagctcagggaattactgtagtaccgggccatgtttttggtgaggatgaacgctatcgacatttcattcgtttaaacgcaggccatgagttaacagcagatgtccgccaagcaattatgagcttggcagagtggtcgcgacaacagatgcaaacagtgagttag

SEQ ID NO: 881 - DNA, 1410 bp, Acinetobacter baumannii
atatccgcccagctcaacaaagagatgggcgatggagaacacatgccaccaagacagtccttaattcaacagcaaaatctatggaaaacattttttgttttcttgctacctttgattgctaccaatattttgcagaacttgtcaggaactattaacaccatctttgttggtcaaatgatgggagttgatgcgattgctgccgtctcggttttttttcctattttgtttttgctcctcgcttttattatcgggatttcaacaggtagtactgttttagtagggcaagcatggggcgcgcaaaatatagaaaaagtccaaagtgtagttggttctaccctgtttatgaccatcattggtggaattattaccgcgattatcggtgtgtttttcgcccatgatattttggagcttttaggtacagatccaaaggtcatgcatctttctttgccgtatgtgcaatggatgctggcaggtagcccacttctgttcgtttatattatctatacctcaattttacgtggtgtaggagatagtacgacccctttacttgcccttgctctaacaagtgtaattggtttggtgattacaccaatattacttaaaggttattttggcttaccggctcttgggattattgctccagcaatcgcaacgatcacgggttatgtggctattttgatttttctagcgatttatcttaacaagaaaaatcatccacttcgcccgaatcgtcagcttctgcaacatatccgtcataattcagaactgagcaaaatcattttacgcttaggcgtcccaactggtattcaaatgattacgacctcaatggcgggtttagttattattgggttggttaaccattatggttcacatgctacagcagcgtatggtgcagtgaatcaggtgctcaactatattcagtttccagcgatttcgatctccatcgcagcctcaatttttgcagcgcaagcgattggtgcgggtaaatcagatctattagcacgagtaactcgcacggctctgggaatgaactttttatttacaggtgccttaattgcacttggttatctattttcaaaatatttaatggctttgtttattaccgacccaactgtggtggtattaggtcaacagcttttgtttattgtactttgggcaattttattctttggcgcaggtgccatttttgcatctatcatgcgtgcgagcggcaccgtgactgttccaatgctgattaacatctctgccattttatttattgaaattccatgcgcttactggtttagctcaatgtggggacttaaaggtatttgggttgcctatgccttggcatttgtcagtctatgtattattcaaggcttgtattatcaatttatttggaagaaaaagacgatcaaagttcttatttag

SEQ ID NO: 882 - DNA, 210 bp, Acinetobacter baumannii
agtgactgccataatgtattaggaaccctaaaggtcatggcctcatttgaatttatagaagatgaactaaacgatggcaacggtcaagcccgtttcactgtatttggtgtaggtggcggtggcggtaatgccgttcagcacatggtacagtctgatattcagggtgttaaaattatacaggttttttttggggttttgggccccctttaa

SEQ ID NO: 883 - DNA, 840 bp, Acinetobacter baumannii
ttaaagcgtctgcacaccatctttaaatatgaaaaggaaaaagctatggatctccaactgaaaggtaaaacagctattgtaactgcggcaacagcaggcatcggtctagcaattgcgaaaactctggctaaagaaggaactgatgtcatcattacgggccggacccaagacaaattggtggcggcggtagccgagatagaagcaaatgctcccttgggcaaagtatgtgggtttttagctgatcttagtacatcagagggagttgagacattaatttcacaacacccttacaccgatattttagtaaataacttaggatattatgaagctaaaccatttactgaaattacagacgaagactggtggcatatgcttaatgtgaatgttatgtcaggtgtgcgcttatctcgtcactactttccaaaaatgttagaaaataattggggaagagtgatttttatgtcgagtgaggtaggagcattcactccaccagatatggtgcattatggcgtaagtaaatctgctctattggctgtatcacgtggaatggccgagttaacaaaaggcacaggagtgacggtgaacagtgtacttccttctgcaacacgttccgaaggtatcatggactatttacgtcaaactgctcctcgtcccaacatgacagatcagcagattgaagcacatttttttgagacatatcgtccaagctcattgattgcaagaatgattgaagctgatgaaatcgcatctatggttgcgttgttagcaagtcccttgggatcagcatctaatggcgcagcagttcgtgttgaaggcggaaccttccgttccattctgtaa

SEQ ID NO: 884 - DNA, 390 bp, Acinetobacter baumannii
ggtgaaatacagatggggcaagaccatatcgaacagcatcgccgttatattgtaatttcttatgcgttcatgtttcttgcattgtttacggttatttttgcggcctttgcttatctggtcgctcgtaaagtagctgttgtggatgatgcggaagtttggattcatgctcatgcgctatggattatgcgcaatggtattctattcctcctcatgtcagtttttgctgtggtctggtttattcctctcttcttttttgcatgggatagcaacctttgggtaacggcttcaacagttgctggtgtagtttttagtgctattgcttggttatttttattaaatgcatggttaaaaggcttgtctaaatatttaaaaaataaggcagttttttaa

SEQ ID NO: 885 - DNA, 183 bp, Acinetobacter baumannii
cctgcttttaagaataattttttacggtttgcatgcgttgcaacgatagaaccattgcccggtaacgataaacctagcgcttctgttaaacagttcattgagttcgcagtgaacatacctgaacacgaaccacaagttggacatgctgaacgttcaaattctgcaacttcttcgtctgtgtag

SEQ ID NO: 886 - DNA, 765 bp, Acinetobacter baumannii
atcgaatttaatttcaggattaatgtcatgagtacagcaattaaaacccgtgaaattcaatatactgcaccagatggtagctatttaattggttactttgcggctccagaaagtgaaacacctgtaccaggtgtcattattggtcctgagtggtggggtcgtaacgaatacactgaacaacgtgcgcgtgaacttgctgaacacggttatgctgcacttgcaattgacatgtatggcgataaaaaagtaacaacgactgcagctcaagcttatgaatggatgatgcagacatttgaagatctagacactgtgactgatcgtgccaacgcagggcttcagactttggctgctcaaccggaagtaaatagtgaaaaacttgcagcggtaggtttttgctatggtggcaaagtggtactcgatctagctcgctcaggtgctcccctcaaagcaactgcgacattccatggtacattagctcctaaggctcctgctcaaaaaggcaacattcaaggtgaggtattggttctacatggtgaactagacagcatggtcaccttagaagatgttgctaattttgaaaaagagatgcaagctgctgaggttaaacatgaggtagtggttttaaaagatgctaaacatggctttagtaacccgcttgcagatgaaagagctaaagcgaatggtgtagaccttggctacaacagcgaagcggagaaacaaggccttgctaaaatgtacgctttattagaacgtactttaaaataa

SEQ ID NO: 887 - DNA, 717 bp, Acinetobacter baumannii
tttgtttgttttttaattaatatacccattggtacattaattaaagaaaaacttataagtatttatttttatatagttttattagagggtttcgtgcaaacagttaatcaaagtggtcgccccaaagatctggaaaagcgtgctcgtatcttacaggccgctaaagctatttttttaaagtccggttatcacggtaccagcatgaacctgattgcacaggaagcaggcgttactaaactcacggtttataatcactttcaagacaaagcaaacctgtttatctgtgccattacagaaacttgtgaagagactctaggcactaaaccatttgaattagatgcatcggcagacttttatcaaacactttatatggtgtgttcacgtgccttgcagattatttattcccccgaagcacttaaactcgagcatgtattatttgaacttgcagcagagcaaagtccactcgccctacagttttttaatgcatcccatactcgtctgcaaaatcagttagttgagttttttcaaaaagctgctcaattaggttttattcaagccgatgatccgctatatcaaacagagctgcttttgaccttattgcttggtgtacgccatcacaaggttctacttagaattattcctgtaccgaatgctcaagagatagatcggtttattcggcatgctattgatttatttctactcagatatcggcattaa

SEQ ID NO: 888 - DNA, 237 bp, Acinetobacter baumannii
aaacagattaaattcccgttccctttaaaaaatattttttactttttattgtgggcaaagagttttgatatagtaagccaattacgtaaaacagaagattgggaaggattatgtcagcagctccacgcattggtattttgggtgcaggcggccgtatgggtcgtatacttattcaggcagttcaacaagcaggttatcaattgggagccgctgttgtacgcccagaaagtactttaa

SEQ ID NO: 889 - DNA, 576 bp, Acinetobacter baumannii
gcaaatctcaaatcactcttggcactgttattgctaaaactctatatcaagacaacgagtttaggaataacagtgtttttagccgagtttaatcaagccccacccgaccaactcaagactctgttaaacaactgcgtccatattcctgtatgggccgaaaaaattatttcagaacgtccctactcatcaacatcagtacttttagggtatgcagaacaattaagccacacatggtcatggcaagagattcaggccgctttagccacccatccaaaaattggtgaaagacaggcaaaaaagcagctcaatgcaaaagagcaaaatttttcagcccaagaacaagctggcatttccttagatgaacaaacacaacaagccctgctgcaaggtaatatcgagtatgagcagaagtttggttttatttttctaattaaagccgcaggcctcagtagcaacgagattttaaaaaaactccatcaacgtcttcaaaacaacttagctatagaaaaagtcattgtacatgagcaactcgctgcaattgctctattacgtctatctcaggaagtacaaacatga

SEQ ID NO: 890 - DNA, 1704 bp, Acinetobacter baumannii
tgtaagctcaaaggaaggagtccgactgtgacaacaacgacaacaaaatttcgtgatgtagaaattcgtgcaccacgcggcactgaattaacggctaagagttggttaactgaagccccattgcgtatgttgatgaataaccttgatccggacgttgcagaaaacccgaaagaattggtggtatacggtggtattggccgtgcagcacgaaactgggaatgtttcgacaaaattgtagatacgctaaaaaatcttgaaactgacgaaactttattagttcaatcaggcaaaccagtaggtgtatttaaaactcataaagatgcgccacgcgttttaattgcaaactcaaaccttgtaccgcactgggcgaactgggaacactttaacgaattagacgctaaagctttggcaatgtacggtcaaatgacagcgggttcgtggatctacattggtagccaaggtattgtacaaggtacttatgaaactttcgttgaggcaggtcgccaacattacaatggtgatttaaaaggtcgttgggttcttactgccggtttaggcggtatgggtggtgctcagcctttagctgcaacacttgcaggtgcatgttctttaaacatcgaatgccaacaagcaagtatcgatttccgtttacgtacccgttatgtagatgaacaagcgactgatttagatgatgctttagcgcgtattgatcgttatacaaaagaaggtaaagcaatttcaatcgcacttcatggtaatgctgctgaaattttacctgagcttgtacgccgtggtgtacgtccagacatggtaactgaccaaacaagtgcacacgatccacttaatggctacttaccagtaggctggacttgggatgaataccgtgaacgcgcgaaaaaagaaccggaagctgttgtaaaagctgcaaaacagtcaatggcaaaacacgtacaagccatgcttgatttccaaaaaatgggtgttccaacatttgactatggcaataacatccgtcaaatggcgaaagaagaaggcgtagcaaacgcttttgatttcccaggcttcgtacctgcatacatccgtccattgttctgccgtggtattggtccattccgttgggcagcgctttctggtgatccggaagatatttataaaacagatgccaaagttaaagagttaattcctgatgatgagcatttacatcattggttagacatggctcgtgaacgtattagcttccaaggcttaccagcgcgtatttgctgggtaggtttgggcttacgtgcaaaacttggtttggcatttaacgaaatggttcgtagcggtgaattgtctgcaccgatcgtgattggtcgtgaccacttagactcaggttcggttgcaagtcctaaccgtgaaactgaagcaatgcaagacggatcagatgcagtatcagactggcctttattaaatgcattgttaaatacagcaggcggcgcaacttgggtgtctctacatcatggtggtggtgtaggtatgggcttctctcaacactcaggcgttgtgattgtgtgtgatggtacagatgaagctgctgcacgtattgctcgcgtactaaccaatgaccctgcaacaggtgttatgcgtcatgctgatgcaggttatgaaattgcgattaactgtgccaaagagcaaggcctacacttgccaatgatcacgcaataa

SEQ ID NO: 891 - DNA, 906 bp, Acinetobacter baumannii
ctaaacatcaaagatattttgcttattcatctattttttcgcaacaataaaaaaagcaaaatgcacctcaagttaaacaattatttaatttcaggtgaatacatgaatatcccacgttttggtctaggaactttccgccttaaagaacaagctgtgattgattctgttaaaaatgcgttagatgtcggttatcgtgcaattgatactgctcaaatctatgaaaatgaagcagcaattggtcaagcgattgctgaaagtggcgtatcacgtcaggacttgtttttaactacaaaaatctgggtagataattttgctcaagagaagtttattccaagcttaaaagagagcttacaaaagcttcgtactgaccatgtcgatttaactttgattcactggccagcaccagatttaggcgtttcaattcctgaaatcatgcagcttttacttgaagcaaaacaacaaggcttaaccaaacaaattggtatttcaaacttcaatattgcacttacccaacaagcaattgacacaattggtgtagagcatattgcaacgaaccagattgagctgagtccttatcttcaaaaccataaacttgtgaatttcttacaagagaagaatattgatgtcacttcatacatgacgcttgcatacggcaaagtgcttcaagaccctgttttagcggagattgcagcagctcataaagcaatgacagcgcaaattgcattagcatgggcattgcagcgtggttttgcagtcattccatcttcgactaaacgtgaaaacctgattagtaatttaaaagcacaggatatcgagttaactgcggctgaaatgcaaatgattgccgaactcgaccgtaacagtcgtgaagttagcccagagccatgggcaccagtttgggactaa

SEQ ID NO: 892 - DNA, 555 bp, Acinetobacter baumannii
agagttgtcaatatcatgaacgatcaagacattttaaacttctggttttcacctgaacaccgttcactctggtttgcaaaaagtgaggattttgatgcaaaaattcgtgatcaatttgcagaagttcatcgacaggcaactcgagcagaactttggtcttggcggaaaacaccagaaggtcgtcttgcagagattattgtgctagatcagttttctcgcaacatttatcgtgatcaacccgaatcttttgcttatgacggccttgctttagccttgtcacaagaagcaattagcttgcaactcgatgcacaacttaacccagaacagcgctcgtttttgtacatgccatttatgcatagtgaatcgaagctaattcatgagtttgctttaaaattatttcaacgcctcggcaatgaaattaatttaagctttgagaaaaaacataaagtgattatagatcgctttggacgttatcctcatcgcaatgccatccttggacgtgtctcaacaccagaggaaaccgaatttttattagaaccgaacagtagtttttaa

SEQ ID NO: 893 - DNA, 501 bp, Acinetobacter baumannii
tcaaatcacaacgaaataatcgaggttgctatggcaattcgccgtattgaaggtttattacatctcgcaagcgaaggtcgttatgcgattttagtgggtcgtttcaacagttttgttgttgaacacttattagaaggcgcgatcgacacgttaaaacgtcatggcgtaaatgaagataacattactgttattcacgctccaggcgcatgggaactaccgatcgttgctaaaaaattagctacatcaaaccagtttgatgccatcattgcactcggtgcagtcattcgtggtagcacacctcactttgactttgttgctggtgaatgtgcgaaaggtttaggtgtagttgcgttagaaagcagcttgcctgttatcaatggtgtattaactactgacagcatcgagcaagcaatcgaacgctcaggtacaaaagcaggaaacaaaggtagcgaagctgctttaactgcaattgaaatggttaatttattaaaggcaatttaa

SEQ ID NO: 894 - DNA, 726 bp, Acinetobacter baumannii
atgcaattaaagcaacttgcggcgacttgtgccttgttatctgcaactgccatggttcaggcaaaaccaatctggcaagattttagcgtgactggactttatggtgaaaactatgaagttgtagatgacaaagaaaccaccattactttggaatatgcagcaaaagttaaatacgctgatgtgtttttctttatggaccgcatgcgtggcgaaaatgaccacaagagtacttattttgagttatcaccacgtttaagcttaggtgaagtttctggcaaaaaactggcatacggcccaattaaagatgtgctcattagtaccacttgggaaagtaatagcgaaaacggcaataactttgacaacttcttgtatggttttgcagttgatttagatatcccatatttccaatatgcgaatttaaacttctaccgtgcgaataatgagaacactgacgacgattatcaaatgacgttcgtttatggaattccatttaaaatcgcatctgaagatttcttggtggatggtttcctcgactggtcaactgctgaaggcgaccatgcaagcgagttgaactggaccactcaatggaaatggaatgtaggtaaacacatttctcctgatacacgtctatacctcggtattgagcactctgtgtggaataataaatttggtattaaaggggccgacgaaaataacgtcagtgctttggttaaataccacttctaa

SEQ ID NO: 895 - DNA, 732 bp, Acinetobacter baumannii
aaaggttccctcatgttaaaacaaaccttgctctatactggtaaagcaaaatctgtatatgaaacagacaatgccgaccatctgattttagtctttcgtgatgatgcctctgcgttcaatggcgaaaaaatcgaacaactagatcgtaaaggcaaggtgaacaaccgttttaacgccttcatcatggaaaaacttgctgaagcgggtatcgaaacgcattttgaaaaattgctttctccaactgaagttcttgttaaaaaacttcaaatgattcctgttgaatgtgtaatccgtaactatgcagcaggttctctatgccgtcgtttaggtgtagaagaaggtaaagagttaactcctcctacatttgaattgttctacaaagatgatggcctaggcgatccaatggttaacgaatctcaagcgattgctttaggttgggcgactgctgaacagttagaacaaatgaaagtgttaacttataaagtaaatgatgtattaaaagcattatttgctgaaggcaacatgattttggtggacttcaaacttgaatttggtgttttccatgatcgtatcgtacttggtgatgaattctctccagacggttgccgtttatgggacaaagacactaagaaaaaactcgacaaagaccgtttccgtcaaggcttaggcggtgttgttgaagcttatgaagaagttgctgctcgtttaggcgtagatttatctgacatctaa

SEQ ID NO: 896 - DNA, 861 bp, Acinetobacter baumannii
ggtgctccaaattcacaattgaggttaaattttcgcatgataccaaaggatcagtatccaagtgatgtaaaaattcttcgagtcgtttccattaacgtaaatggcttacgttcttcagtgacgaaaggcttacttgaatggttagaacaatcagatgccgatgtcgtatgcatgcaggaaagccgcattacccatgaacaatggactgagaaatttagacccgaaggatggcatacccatctatttccagcagagcgtgcaggctacgcaggtactgcaatttatagccgcttaccctttgtctctattaaagatggtttagggtttgaattggccgatagtcaaggccgcttcatttctgccgaattcgatttaggtttgtcacatcccgtacatattgcatcattatacttaccttcaggctcaagtggtgaagaagcgcaagcacgtaaagatttatttttaggtgaatacgccaaaatcttgaaacaatggcgtgatgagaataagtccatcattatttgtggcgattacaacatcgttcataaacgaattgatattaaaaactggtctggcaaccaaaagtcgtctggctgtttaccgcatgagcgtgcttggcttgaccacatttatgatgaacttggctatgtagacaccttccgtgttgtaagaacagaagcggaattgtattcatggtggtcaaatcgcggacaagcgcgtgcgaaaaatgtaggttggcgtattgactatcacgcatgttcaccagactggaaagcgcgcactgtaaatgcatgggtctataaagatcaatggtttagtgaccatgctccagttattatcgactataaaattcaagaataa

SEQ ID NO: 897 - DNA, 1479 bp, Acinetobacter baumannii
tcttatccaaaaaatgtaatcggatttactatgtctccaacaacagctgcgaaccaagcaaaaaaactgattaaagtgcctgaaatgcgccgtatcaaacacattcattttgtgggaattggcggtgcaggtatgtgtggtattgctgaggtgttagctaaccaaggatataaaatttccggttcagatattaaggcatcaaaaaccacacaacaattagaagaaaatggcattaaggtctatatcggacacgaagcagaaaatattaaaaatgcaaatgtgcttgtcgtgtcaacagcaattgacccggaaaatccggaagttaaagctgccattgaacaacgtattccgattgtacgtcgtgcagaaatgctcggtgaacttatgcgttaccgtcatggtattgctgtggcaggtacacatggtaaaactacaaccacaagtcttttgacgacaatgttggcggaagaaaacctcgacccaacttatgtgatcggtggtttacttaacagtacaggcgtaaatgcagcactgggtgaaagccgctttattgttgctgaagctgacgaatcggatgcatctttcctttatttacagccaatggcagcgattgtaaccaacattgatgctgaccatatggatacttatgaaggcagtttcgataaattaaaagataccttcgtacagttccttcataacttaccattctacggcttggctgtggtttgtggcgatgatgcgaacatccgcgagattttgccacgtgtaggccgtccggttattacttatggttttaatgaagataatgacatccgtgctatcgatgtagagcaagatggtatgcgttcgcactttactgttttacgtaaaggacgtgagccgttacgtctaactattaatcaaccgggtttacataacgttttaaatgctttggctgcaattggtgttgcaactgatgaaggcgtttcggatgaagcaattagccgtgcattaaaaggttttagtggtgttggacgtcgcttccaagtacaaggtgaatttgaacttggtgaagggaatgtaaaattagtcgatgactatgggcatcatcctaaagaagtggaagctacgattaaagctgctcgtcagagccatcctgatcgtcgtttagttatgcttttccaaccacaccgttactctcgtacacgtgattgttttgatgactttattgaagttttatctcaagtcgaccaattattattactagaagtttatccggctggggaaaaaccaattgttggcgcagatagccgtactttggcgcgtagtattcgcttgcgtggtcaggttgaaccgattttgattgatccggttgaaggtaatttgcaaaacatcatgcaaaatgtgttacaaccaaatgacttgttattaacgcaaggtgcaggtaacgtgggagcaatttcagtagaacttgcacagcaccatttgtatgtgaaataa

SEQ ID NO: 898 - DNA, 969 bp, Acinetobacter baumannii
aataaacaaaaagtattgaattatcgggttaaggatttaaacgtgtcaaatgctacaaaattcggcaaagttgccgtgttacttggtgggaaatcggctgagcgtgctgtgtctttagatagtggtcaggcagttttggacgccttgttacgttcaggtgttcaggctgaggcatttgatccgcaaaaccgtagcgtaactgaacttgtaaactatgaccgtgcatttattgtattgcatggtcgtggtggtgaagacggtcaaatccaaggtgtgcttgagtggttgaacatcccttatacaggaacgggtgtacaaggttctgccattggtatggataaagtcaaaaccaagcaaatctggcaaggtagtgatttaccaaccgcaccgtatcgcattattactaaagaaactgacttggattcagtgattgctgaattggggttgcctgtcattatcaagcctgtacatgaaggttcaagtgtaggcatgagtaaggttgagaaagctgaagattttgcggcagcaattgaaaaggcaactcagcacgatgctgtagttatggcagaaaagtggattacaggacgcgaatttacgatttcattcttaaatggtcagcctctacctgttattcgtttgcagccaccagcagatgttgctttctatgactacgaagcaaaatatcaacgtaatgatgttgagtatggcattccttgtggtcttagcgaaactgaagagaaaaaactacaagctctatgtttacgcgcttttcaagccgtaggtgcagaaggctggggacgtattgatgcaatgcaggatgagcaaggtaacttctggcttttagaagtaaatactgtgccaggcatgaccagtcattcgcttgtaccaaaggctgctaaagcagtaggttatagctttgatgaattgtgtgttgcaattcttgagcaaacattggaaggtacggcttaa

SEQ ID NO: 899 - DNA, 183 bp, Acinetobacter baumannii
aaaataaaaaagagagcatttgctctcttttttattttctatggattggcatttctatgcttaaagtctagatttagtgagaatagtcatctattttggtatgtgagttctttcatttgcctcttgttaggttctttatatgcaatagggggcatatttttttataaaactaatttgaaatga

SEQ ID NO: 900 - DNA, 291 bp, Acinetobacter baumannii
ggaataagaaacgcaccaccgccattttcatacgcaacgtacggaaagcgccaaatattacctaagcctacagccgaaccaacggctgcaataataaaaccagatcgtgacgtccagttttcacgagtatctgtcatagaacacctaatgttaaaagattacttatttttactgctattgttgattgttattccgcatgcaaaaaaagaaccaaaaaatacttttgtgtttgtagaaaataaaatgcaccttttgagtatttttattcccttaacaaacaagcaaaaatag

SEQ ID NO: 901 - DNA, 1431 bp, Acinetobacter baumannii
tttattggaaaaaaattacgtgacaaggatgagaataatcatatgtcaacacaagagcaaggaaacctgaaacatggtttgagtaatcgtcacatccagctgattgcgttgggtggagcgattggtacagggctgtttcttggtatatcacaatcgattaaattggcaggtccatcggtaatcttgggttatgcgattgcaggatttattgcttttttaatgatgcgccagctcggtgaaatggtcgtagaagaacctgtaagtggatcttttagccacttcgcttacaaatattggggaccttttgcaggcttcatgtcaggatggaattactgggtactcaatgtacttgtgtgtatggcagagttaagtgcaattggtctttatattcaatattggtggccgcaaatcccaacgtgggcatctgctctaacgttctttattctcattaatggtatcaatttactgcatgttaagttttttggcgaaatggaattttggttttcaattgtcaaaatcttagcaattttagccatgatcggtttcggttcatatttactcgcaaccggcacagcagggcctcaggccagcatttctaacctttgggcattaggtggtttcttcccatttggtattgaaggcttggttatggcaatggctgtgattatttttgcttttggcggtattgagcttttcggtattactgctgctgaagcgcgtgatccagacaaaactttacctaaagctgtaaaccagattatctatcgtattttgattttctatattgcgacactttttgttttattctcattatttccgtggaatcaaatggcagaaggtggcagtccttttgtgatggtctttgcctctttagatagccaaggtgttgcgacattattaaatttcgttattttgacagctgcggtttccgtctataacggaaccagctattgcagcagccgtatgcttttaggccttgcccaacaaggtaatgccccgaaagctcttgcccgtattaataaacgcggtattccaaccaatgcggttctagtctctgcatttgtaacggtattgtgtgttttactcaattatattttccctgaaaaagcatttggtttactcatgatgctggtagtagcagcgattgtgattaactgggtagtgatttcatggacacatttaaaattccgtaaattcatgcaacgtcaaggtcaaacgactaaattccctagcttcatgtatccatttagcaactatctttgcatggcattcatgtttggaattttagttgtgatgtctttaacgccagacatgcgtgtagcagttatgatgattccaggatggattttgtgtttgatggtggcttatcaatttaagcgccgtaaaataaaagctgagcagcctgtacatgctttagaagccgatatgtaa

SEQ ID NO: 902 - DNA, 486 bp, Acinetobacter baumannii
atgttcatgaaactttcttctatacctgtagtcaagttaccacttgttgatgtcagtacagacccgttagatttattggtagcaggtttggcgctgcgtatgaaacagttggcacgtacaagtcctaagtttattgagctggtgcatgaccgcgcattccgcattcaaattggtactgatttaggtgtggctcgccaaattattattaatcatggtcacatcgatacagttgctggatcacctgaaaaagctgactttattttgcagtttgcagatagcgaacaaggcgtaaaaactttactcaaaggtgacccaacagcatttatgacgggtatgcaagacggcagcattaaaatggaaggtgatttcagcttgctcgtttggtttaaccaagcagctaaattgattccaccaaaattaccaaaaccagtaaaagataaagtacgtcaagcacgtgcttttattaaagaaaaaactggtcgttaa

SEQ ID NO: 903 - DNA, 651 bp, Acinetobacter baumannii
gatggcatgaaaatgaataaacaaccacaaaattcggctttagtcgtagttgacgtgcaaaatggttttacccctggtggaaacctagcagttgccgacgctgatacgattattccaaccattaaccaattggcaggttgttttgaaaatgtagtcctcactcaagactggcatccggataatcacatttcttttgcagccaatcatccgggcaagcagccatttgaaacgattgaactggattatggatcacaggtgctttggcctaagcattgtatacaaggcactcatgatgccgaatttcatccggatttaaatatcccgacagctcaactgattatccgaaaaggttttcatgctcatattgatagttactcggcttttatggaagctgaccacaccacaatgacaggtttaacgggttacttaaaagaacgtggtattgatacggtctatgtggtcggaattgctacagacttttgtgtcgcatggactgctttagatgcggttaagcaaggctttaaaactttagtaattgaagatgcatgcaaaggtattgatcttaatggttcattagaacaagcgtggcaaactatgcagcaacaaggtgttgttcgtattcaatcgactgatctgttgaatgaatgctag

SEQ ID NO: 904 - DNA, 1308 bp, Acinetobacter baumannii
ttgccttggaagtttaacttgattgcgcctagacaagggctatttgctagcctactgatcattagttttgcattgcatacctttttattggtgattgcaacgacacaccagctcaatgaaaaccgtgcgagtcaaggtcagctcatgaccagtcaactcgttgcagacagcttatctgagcttgaacctgccaatacggtctctttagctctgattgccaatcgctatgcgaccaatccaagtgtggcatctatccgtattcttgacgccaataaacaagttttggcaacaagcggcatgtcaaaaactcgccaaggtgaaatttttgttcgtgatgcgcttcaaaacgagaaaaaagtcggttctattgaaatcacactaattcaaccaagtattggggaaattcttcgtacccaatggcttgcgattttagcttcactgtttttacatgttttattatggctagcttaccgcgccattgctcgcccaacgcgtagcgaatacttagcccgtattaacgaagaaaaccgtttaaaacatgaaattcaagagttaactcaagctctcgcgcttgaaaaacaaaatacagtgaccttggttgctcaagctcagcagcaagctaaagctaaaccaattgttcgctcgcaaccagaaaaaagcttagagtctacagaccaaaataccttggcacttaatattcaattttatgatcctaaacagttattaagtagtgttaaccagtctgtttctgtaccgtactttaaactttgtcagctctttttaaataagagtattgagctatgtacaaagcattatcatttgaaagcgactgatattgatgttgtagatgagtttcatgcagagggcacaacacttgccatttcgacttcacatccacacgctgtagaatgtctacttatggtaggtacggttttccaattgctttcagacgttttatataagcgttaccgtgaagataaacgctttgcactacaaactcgcagtgccgtgtgtaatgccgtagaagcaatgcaaattgatgccaaagaagctgctcaacgtttagcgcaacatcttcatgcgaaagaatctgcactctaccttgataatgaacagcttaaagcaattcaagacagctatcagcttgttgcaatgcctaacccaagtaatgtcatgactcgtcatgcatttatgatcaatggtatgaatgctgaatgtgcagagcttgcacaaaatattcgaactgaaattttgatgggtaaaaaatcaattcctcaaaatgacagcccgagtagtgcagcatcttaa

SEQ ID NO: 905 - DNA, 852 bp, Acinetobacter baumannii
ggagtaaacctgatggaccatgaactagaagaagagaaagtcgatcaaaccctaagctggcgtgaaaaaatggcagttgaagaacacgagaaactgtcgccccgtttagtgtatgaaattatccgccgtgatggtgccgaagagttagatcgcccaacagccgcgctcatcttttcaggcattgcagcaggtctagtcatcagtttttcatttgtatttaaagcgattattgcttcttatatcccaactgatgccatctggaccgatttaattaccaatttcggttataccattggattcctgatcgctattttaggacacatgcagctctttaccgaaaataccattactacagttgtgcccctatttaagccctttaccttagacaaattacgagctgtaggccgtctatggggaatcgtgtttctatgcaatatcattggaacagctttggcgagtttattcttcctgaccaccgacctgtttactccaaacattgacaaagccctagatgagctcgcacatcatgttgcgtctttttccgccacccaaaatctgcttaaaggggttatgtctgggcttttaattgctgcattggtctggatgctaccttccgtcagcaataaattcctagtcatctttttcatgacttatctaataggactaggcgactttacccatgtggtcgttggctctacggaaatgtcctatctggtctggcaaggagaagcttctcttggtgaatatctgtttaatttcctaatcccaaccaccattggcaatattattggtggtacaggcgtgtttaccctgctgatttatggtcaagtgactgaagaattggaacaatag

SEQ ID NO: 906 - DNA, 579 bp, Acinetobacter baumannii
tccatgattgaattgatcagggccgatcaatatacaaaaatgctttggaaaaatggtgtaggctttactttagaaattgctcgaagccaaggtgaagccgactttgagtggcgcatttcgatggcagatgtaacaacttctgggccattttcgttatttcccaataagcaacgcattattagcgtactcgatgggcagggcatggtactgcatgtcgatgaccttcctgccaaaacgctgaaccaaggtgatatttttgcttttcatggtgaaagtcaggtccaaagtgaactggtagacggtgcaattcaggatttaaatttaatttatgatcctgcaaagtttcatgcccgttttcagtggttgaatgaggcagcggagcaggcatttataacctcggcagacctgatttttatttttaatcagggtggcgaaacggaagtgaacgttgatgagcattccgttcagcttgctgctcatgagacgctaaaaattgagaaaaatgctagtgtcacatcaatcaattttccaaaaaaacagcacaaaaattgctatatcattgagttaattcaacgttaa

SEQ ID NO: 907 - DNA, 378 bp, Acinetobacter baumannii
aaaaaagatgactataaggagttcagcatgcattcgaaagttattggtctaatcgccattatggggataataagttcagtggcatttgcagaacctgcaatccagcccggagaaacattagagagcttatctaaagcacgtattacaacaaacgtaaatactcaagcagcaacacctacagcgcaaacaagcgatgctaatgctgaggttaaagttgaagatattgatccaatcattgaagaaaaaactgaagaaaccctaaaggcagctgtacaaccagctcctcaagctactgtcgaagctatagtggctccagttacatcaagtgaactcaacgtaagtgttgatgatattgatgtcgctcatcctacagaataa

SEQ ID NO: 908 - DNA, 561 bp, Acinetobacter baumannii
tatggctgtgacagggagtattttgtgcgacgtttagtttcccatctctcacttggttttctcattattctattagcagcctgcgccagtgcgcctaaaaaacctgccccgctttcaccagcccaagttagcaaactcaagagtatgcagcttccaagtcggcttcctgttccggtaaaaggtgtcgatcgagatgagttaaaagatacatggggagctgctcggagtcagggccgtagccacgaaggaattgatattttggctccacgtggaaccaaagtgtacagtgtaactgaagggctcattgccgatcttcgtaataataacctcggtggcaaagtcatctggattttaggcccggcaggaacatggcattattatgctcatcttgatggacataaacgtggcttaaacgtaggtgactatgtcaaaaaaggtgatttaattggctatgtcggcaacacgggcaatgcacgttatacttcacctcatcttcattatggtctttacttagatggtaaaggtcgtggtgctgttaatccttattcatatttacgctag

SEQ ID NO: 909 - DNA, 1266 bp, Acinetobacter baumannii
gtgatgagtgaagctgttccctcagttgttgcgattgacattgggacgcataaagtttcagttttgattggaaaaattcatgcgccggataacattcaggttatcggtatggcaactgctcgcaatcgaggcatgaacaaaggaaaaattgtaagtctcgataaagtcattgctgcgattaaaaacgctgttgctgaagcggaaaatatggccgaatgtcgcattcatagtgcgtgggtatctattccgagtaccgagctacaaagtttctatgcttctggacgcacacctgttgctaacccggcgcatgtgattacaaccaatgaagttgtacgtgcattagagttggcaaaagcaagccatgtgacttctgactattatctagcgagtgcagtcccattaggatttgaattaggcgactcatctgaatgggttcaaaacccaatcaatatgaccgctcacagcatgactggtcattatcagcttatgatgatgccgattgccactatgcagaaccttgatcgtgccatgaaaggcgcgaacattggagttgagaaaatggtagtttcttgcttggctacggctgaggcaagtttgcttaaagatgaaaaagaatatggtgtctgtcttgtcgatattggtgcaggtattaccaatctggcagtttatttagatggccgtttggctttagcacgcaccttacagcgtggtggtgagcatgtgacacgtgatattgctgccgtgttacaaacaaccactgaagaagctgaacgtattaagattctgcatggctgtgttgatctaagtgctgttaagcctgaccatatgattcaagtacagggtattgatggtccgcaaacgattagccgaattgagttagcggaaattattattgctcgttatgaagagattttcagccagattcgcgaagaactcgaacaaagcggtgcaatccatggtctatatcatggtgttgtattgactggtgatgcttgccagattgaaggtatggtaagtttggcgcgtcgtatgttaggtgtgtctgcccatctaggtaatccgccattacaggtgtatgctgatgatcagcatcaagctgcattacgccgctcaatgtatgcaacagcagctggtttacttatgtttagccaaagtgaattacaagaagctgttgaggagcctgaagagggaaatgaccgttcggtatgggaacgaatggtgaatggctggaatgcttttaatagcaaacttaaagccattttttag

SEQ ID NO: 910 - DNA, 1101 bp, Acinetobacter baumannii
accgtgaccgattcacagcaaagcaaacctaaacatgtcatgatgatggctgccggtactggtggacatgtttttccagccctcgccgtagccaaacaacttcaacaacaaggttgtcaagtttcatggttagccacgccaacaggtatggaaaatcgtttattaaaagatcaaaatattccaatttatcaaattgatattcaaggtgtgcgtggaaacggagtgatccgtaaacttgctgcaccttttaaaattttaaaagcaacttttagtgcaatgcgctatatgaaacagcttaaagtggatgctgttgcaggctttgggggatatgtggcaggcccgggtgggctagcagcgcgtttattaggtattcctgttctcatccacgagcaaaatgcggttgcaggatttaccaatgcacagttatcccgtgttgctaaagtggtatgtgaagcgtttccaaatacatttcctgctagcgaaaaagtagtgacaaccggcaatccggtacgtcgtgaaatcactgatatcttaagtccaaagtggcgctatgatgaacgcgagcaagcgggtaagccgttaaatattttaattgtgggcggatctttaggtgcaaaagcactgaatgaacgcttacctccggcattaaaacaacttgaagttccactgaatattttccatcaatgtggtcagcaacaggttgaagcaactcaagctttgtacgcagatgcgccagcaaatttgaccgtacaggttttgccgtttattgaagatatggcgaaagcttatagcgaagcagacctgattatttgccgtgctggtgctttaactgtgacagaagtagcaacagctggtgttgcagcagtttttgtaccgcttcctattgcggtggatgaccaccaaactgcaaatgccaaatttctggccgatgtcggtgctgcaaaaatttgccagcaatcgactatgacaccagaagttttaaatcaattgtttactacgctgatgaatcgccaattacttacagaaatggcagtgaaagcgcgtcaacatgcccaaccaaatgcaactcagcatgtggttgatcttatccaaaaaatgtaa

SEQ ID NO: 911 - DNA, 1308 bp, Acinetobacter baumannii
gacacaatagactatagtgaaaagacgataaagctatttgagatgtcagacacccatattccacttcctgaacgcctgcgcccgagagacttgtctgaaattattgggcaagatcatttgttaggtgaacatgcgcccttacgtcaaatgattgatcaggggcatttgccttctattattttttgggggccgccaggcgtcggtaaaacgacaattgctttgcttttagctcaggcaatagatcgtccatttgtgagcttatctgcgctgaatacgggcgtaaaagaattacgtgaagtgattgcagaaagtggtgacttactgacacctgtagtttttattgacgaaatccatcgctttaataaatcacagcaagatgcattattaggtgctgtagaaaaaggtaaaattaccttaattggcgccaccactgaaaacccatcttttgaagtcaatagtgcacttttatcacgctgtcaggtctataccttaaacagtttagacagtgaagcaattcagacgctacttaacaatgcactccaaaacgataaatttttaaaagaacgctatattcatattgaagagtatgatgctcttttacagtttgcagcaggtgatgctcgtaaggcactcaatttacttgacttaattgcaagtacttttgagcccgaagttgaaaataccattaccaatgcggttgtagtaaaagtcgctcagcaaaatattgcgcgttatgacaaatcgggtgaacagcattacgacctcgtttctgcctttatcaaatcgattcgtggtagtgatccagatgcggctttgtactggatggcgcggatgcttaaaggtggggaagatccggtttttattgcaagacgtatgttgattgccgcttcagaagacattggaaactcgaatccaaatgcactattgcttgcaggtgaatgtttccgttctgtacaggcggtgggaatgcctgaggctcgaattattttgggtcaaacagcagtttatttagcgaccagtgcaaaaagtaatagtacttacctcgcgattaataaggccttggaacttgctgagaaaacggcaaatttaccagtacctttacacttgagaaatgcgccaaccaaactgatgaaacagcaaggttatggaattaattatctctatcctcatgactaccctgagcattttgtactgcaagattatttgccgcctgagttaaagggaaccaaactctatgagtcggcaagaaacaagcgtgaagttgaaggtgaacgcctacaacaacgcagatggcagcaggaacaatag

SEQ ID NO: 912 - DNA, 780 bp, Acinetobacter baumannii
atgattgaagaaaaaatatctgggggggttcaatcacttgaagttggcttatccgtactaaatgcccttttagagcacaatcaacccattattctcaaagacttatctagtaagcttgagatgcatcctgccaaagtacaccgctacttggtgagcctaattcgcatggattacgccaaacaacttgaagatggccaatatgccttaggtgatcaagcatggcgtttaggcttaaactgcattcagcacagcgatactttacagttagtacaacatttaatttacgacttacaaagcaaaattggctgtggtattcaaattagtaagtggtcacccaaaggccctgtcgtggttcaatcgattgaatctaaccacccaatttcgattgtgaccaaagtcggctcaattatgcctttagtcaattctgctgcaggacgtttatttgcttcttaccttcctgagcattttgttcgtcctttattagaaactgagtggcaaaaacatcaggaacttgggctaaacattgcgccacataactgggaagaatttttagaacttaaagagacgatccgccaacaacaaatgtctgcggcgaaaggtgatttacttaccggtattaacgcagtaggcctgccagtatttaactcaaaccaagggattgagttttgtattgtggcgcttgatagcgaaatgtttttacctgttgacccacaaagtaaaattattgaaacacttaaaaatgagattaattcaattaatcaatatattaaaagccgctaa

SEQ ID NO: 913 - DNA, 1236 bp, Acinetobacter baumannii
tctgacgaagagacatctctatttaggagttcctttattattatgaaaattcgtttaatcactcgtcctataaataaaataaaacaggtgattctcgatttcatccatcacaatcacattattaactggaccccattacaaaaaagcgcactaatgcttaccctcgcctgcgcaatgaatttcagttggattttatggaaaggctatattttaattactcctagtatttggcaatgggcaaatctatctttagttgaatcacaaatctggctgaatttactgaccttatttttattagctgtactcattattccttgttatcgctacaaagaccaagcttgggcgcaaaaaattgtgcctttaattagtgtacaagcctttatgctgatgttgtgccacgatggatatttaattggtagtatcagccctgccacaatggtgggttacgtaggcactattggcgtaggtttggttttatttgaaagaaaaattgtttatagcgcttttatacctgcaactattattctagcgatatgtacatatttaagtatgacgggggttatctcatatgcgcccctatttaattttacagcgatgcgtcatgcccaaaccaatccattttggctaggaagtatgctgttttttattatgcctattttagtggcgtgttttattttatttgaaatattgctgacccaatggcgtcaacgagaaacctatattcaacgtttaagccaaatcgacccgttaactaatgtcttaaatagacgaagcttaaacactcatcttgaagcacttcatgagcaacaatttgattatgccgtgatacttcttgatatcgatcattttaaaaaaattaatgatatatacggacatcaccaaggtgatcaggttttgattaaaattgctcaatgtctttctgaaaacttacgtaatgaagatattattggacgttttggtggagaagaatttattttattacttcctcataccgatattattcaagcagaaaaaattgccgaacgttgccgacaagctttacaagaattgactatcttaaataatcaaaatatccaaattcatgtaagtgccagctttggcatcagcagttctgcttttgcaaatgacccctatcttgtgattagacaagccgatcaagccctctatgcggtaaaggcctctgggcgtaatcaagtacgcacttttcaccaactacctcagatcaaatcaatttga

SEQ ID NO: 914 - DNA, 1191 bp, Acinetobacter baumannii
aagcaaaaggagataaaaatgatgagacgattagcagcccccttattatgtagtagtttcttcttgttaatggcctgtggttctaataatactaattcaaaaagtcctgaacaaaatacaactgtaaaaacagagcaaaccagtgctgccaaacaaacttatcaggtcgcggcagtcgcacattttaaagagccttgggcgatcaccagtttgcctgatcaacgcttattggtgactgaacggcaaggtaagctaaaaatttttaatccacaaaataaacagatgttggatgtccaaggtattccagccgtaagttatggtgggcagggcggtttaggtgatgtagccttgcacccggactttgccaaaaatcactggatatatcttagttatgcaggcaaaggacaaggtgggtctggtgcagtgatttcacgtgcaaaattagatttatctaaccctaatcagccaaaaattaccgatataaagcaaatttggcagcaagtacctaaagtgtcaggacaaggccattatgggcatcgcatgctttttggtgcagatggtaagctttgggtcagttcaggtgagcgccaaaagtttgaccctgcccaaaatatgaaaagcaacttgggcaaaatcttgcgtttaaaggacgacggttcagcagccttaggtaaccctttttatgagcaaggcggtgtcactgctgaaatatggtcacttggacatcgtaacccattaggaatggcctttgaccgtaaaggacagctatgggtggttgagatggggccaaaaggtggtgatgagcttaatattattaccaaaggcgaaaactatggttatccgattgtttcaaatggagatcattattcaggtcagcctattccagatcatcacacgcgcccagagtttaaagcaccagaaattgactggacccctgtaatctcaccgtcgagcttaattatttatcgcggacaacaatttcccgcatggcaaaataaagctttaattggcgggttatcttcagaagcaattgttgttatagatttagagcataagcccgtaaaagaagtacaaagattagagatgaagcaacgtattcgtgggttacatgaagcacaagacggttcaatttgggtaattgaagatggccccaatgctcgtttactcaagctgagtaagaaaccctcttaa

SEQ ID NO: 915 - DNA, 402 bp, Acinetobacter baumannii
agaatgagtttatcccaaatgaaaaaacattttcaatttatcgtttttactactttcatgattggatctgttgaggtttcatatgctgactttggttttattcaagatacggatgggtacgttaatgttcgacgaaattcaactttaaattctaaagttacgtccaaattgaataataatgaaattgtttcttgtgtgaaggatgaacggacaaataatttttgtttagttaatgcaagcaaaggtgtaactggatttgtctataaaaatagagtaaataatttgagtggttacaattctattaagctatctcaatattctagagaaaaagctgtttataatgataaaaatataatagtagaagtgtatgcaaaaaaagctattttagatcctaaactataa

SEQ ID NO: 916 - DNA, 408 bp, Acinetobacter baumannii
agttgtttttggaatgaggtctggtgttcagaccgaatgtttttagacgttttcattaagacggaggtttctatggtaacagcgaattttgccgctatcgccggactcagcttaattgctgtcgcgcttgttgctgtgttcttttctccttaccgtcgttggcttggttttatgcttgcagggatgtttttttgggggctattggaagtggtccgttttggagttcaagtcacttttgaaatgccagtcacatatagttatttaactgcactaagtctagcgatggtaatggttacatttgttttattacgtgaggataaacaggcacagaaggctttggcaaatcgccaatatatagaacacacgccagtatatgaagatgatcagcagcaatgttctagccgataa

SEQ ID NO: 917 - DNA, 465 bp, Acinetobacter baumannii
ttgcagaaactttctctaacaatgcgcgctttaatacaacgagttcttgaagctaaagtagtagtagacggtgaaacgaccggtgaaatccagcatggcttattggtttttttagggatcggtcgagacgacacgcttgccaccggacaaaagctcatcgacaagattttgaaatatcgtatttttgatgatgagcaaggcaaaatgggctggaatgtatctcaggcgaatggcggaatcctgcttgtttcacagttcactttaatggctcaaacgcaaaaaggactacgtccagactttggtccggctatgccacctagcgatgcaaaagcactatatgaacagttagtagaatatactcgttcacagtttgaaaatgttcaaacaggtatttttgctgcggacatgaaagttcatttgattaatgatggaccagtcactttcaatttagaagttgaagcatag

SEQ ID NO: 918 - DNA, 1356 bp, Acinetobacter baumannii
ggcatttttttgatgaaccagatttttaaattatttattcccatgctctctagcaatttaattgtagttttaagtggtttgattgatattgcttatgtagggcattttagtaatgaccatgttgccgccttatcggtgaccttatctttatatacagtggtttatgtcattggaatggggatactgcaaggtgtgatgcttaagctctcggaagcttatggttgccatgacataccacgtattcgtcaaatttttattcaaggcgtttggctgatgttaggttcggcattggtaagtattgccttgctttacttgttccgtgatctaccaaaattatttggtgcatctgaacatgtcgttttaattactaaaaactgtatttgggctttgttatttattttacctgcccatttattgatgcgcttatttacagctttgtctcaggtcactgaaaatgcgtataaggttttattatcagatagtcttttcttcatttttaaaattattttgtcctatcttctgatttatggtgtcgctttattttcaattccgccactcggggcgataggggcgttgttagccactatcattgtacggtggtttatgttggccgtttattacctgttttttctagagaaaaagtacatctttattgaacatccagaatggtcagatgaagatagccggcaaagtctgcgtatgattttaaaaatagggatacctactgcgatcatggcgttgatggacgttgttgcattttgttcagttgctattctgattttgcctttcgggagtgtggtgtctgcagcccatcaaattgtcgcgagcactggcggtttcatgtttatttttccttcatcaattgcctcggcttatagcattttggtgtcaagaactatgggcagcggcaacatgaaagaagcagacaaaattgccagacaaagtatatgggtaattatggcagtgagtggcagtttatccttgtgtttatggttggagaggggcttaattgtcacgttctattcagatgatttggctgtacagattttggctgcatcactgctcttgattgtctgcatgtctcattttcttgatggcttaatgacgttactaacctctttgttgcgttgttgggatgtgtcgattttacccatgctgatttttttagtcgtggtgctatgtttcggattgggcggtggttggtggatggcttatacagggctgcactgggggagtcactctatatctgcaatgggaatttatggtttctggagtatggcggccataagctatttagtagcttgtgtattgagtgccttctgttttcgttttagaaagcaattaagaggtttttga

SEQ ID NO: 919 - DNA, 744 bp, Acinetobacter baumannii
tggaaacgactcgaagaatttttacatcacttggatactgatcctttggtatcatgcgaaaatttaacctcaattgtgaatttggagcacctcatgacaacgcctgtgtcatttcacccgcaagcatttatcgaactcgcattatcacgcggtgtgcttaaatttggtgagtttactttaaaatctggacgcgtgagtccttatttttttaatgcaggcctactcaacgatggtgaagctttatctcttttagcacaaggctatgccgataaattaacacaatgtgaaaatgttgatgtgatttttggaccagcttacaaaggtattccgtttgtagctgcgactgctgttgctttgtcgcaaacacataacaagagcgtgccatggggctttaaccgtaaagaagcgaaagatcatggcgaaggtggtgttttagtcggtgctgcggttgaaggtaaaaaagtctggattattgacgacgtgattaccgcaggcacagcgattcgcgaagtggtaacgattttgaaaaatgccggtgcaactattgcgggtgtgttggttgcgctcgatcgtcaagaacgtggtcaaggtgaactttctgcaattcaagaagttcaaaaagaattagaaattcctgtgcacgcactgattaccatgaaagatttaatggattatttggaggcgaaaggcgaaaaagaagcgctagcaaacatgcaagcttaccgtgaaaaatacggtatctaa

SEQ ID NO: 920 - DNA, 372 bp, Acinetobacter baumannii
gcaactcgctgcaattgctctattacgtctatctcaggaagtacaaacatgatcagcactcatattttagatacgaatttaggtaaaccggcggcacaggtcgaagtgaagttgtttcatgcagccactcatgaactgatagcggctgcaattaccaaccaagatgggcgagtgagtgattttggaataaaaaacttaggtaaaggtgcttatcaacttgaatttgaagttgccccttatttttcatcacagcaaatcaaaacttttttcccccgtgtttgtatccaatttttcatagaagacatcaaccagcattaccacattcccttactcattagtccgtttgcttattccacttatcgcggtagctaa

SEQ ID NO: 921 - DNA, 1257 bp, Acinetobacter baumannii
caaatcagctgcccaatagttttactgttgggcagtttcgaggataggctaatgaaaaaactttggcaaaactgccatattgccaccatgcaaaatgggcaatattcctacattgaagatgctgcaattgtcacagaagggcatctcatccactggattggaaaacaacaacaacttcctgccgacacttattccgaaacagttgacttaaatggcgcttgggtaaccccggggttcatcgactgtcatacgcatagcgtatttggtggtaaccgtagtgttgagtttgaaaagcgcttacagggcgtgagttatgctgaaattgctgcaagtggtggcggtattgctagtacagtacgcgcaacccgagaagccagcgaagaacaattactgaactcagcccttaagcgtattcgctgcatgcaacaagacggtgtaaccaccattgaaattaagtctggctacgggctcaactacgaaaacgagcgcaaaatgctgcgtgtgatccgtcaaattggtgaaaaattaccgatgacggtaaaaagtacctgtttagccgcacatgctttaccgccagagtacaaagaccaaagcgacgcttatatcgagcatatctgtacagaaatgctgcctaaactgcatgctgaaggtttagtcgatgctgttgatgctttctgcgagcatttagcattttcgccagctcaggttgaacgcgtttttaaaacggcacaatcattggggctacccgttaagcttcatgccgaacagctctcatcgctaggtggttcaagcttagcagcacgttatcatgctttgtcggctgaccatttagaatacatgaccgaagatgatgtcaaagccatggcagagtcgggcacggttgcagtgttattaccgggtgccttttatttattgcgtgaaacccaatacccaccgattgaaagtctgattaagcatggcgtgcgtattgcgctgtcgagtgatttaaaccccggcacatctccggcactttctttgcgtttaatgctgaacatgggtagtacgctattccgtttaacgcctgagcaagcattagcaggtgtcactattcatgctgcacaagcgctcggtttagagcaaacacacggtagtttggagcaaggtaaagtcgctgactttgtggcttgggatattgagcatccatctgaaattgtttactggctgggcggagatttgcctaagcgagtcgttcagcatggacaagaagttattttttaa

SEQ ID NO: 922 - DNA, 1365 bp, Acinetobacter baumannii
agcattaaatgctcaacaaattgcacaaactcaaaaacttcacgtaggacagattctgccatgagtcaggttacttcaaattcatcacgttttaacctgcgcgctcaagttgtccagaccttgctaaaagttcagcaaggtcaatcgttggctagtattttaaatacacagctgaatcaagtagcagagcgtgatcgtgcactatttcatgaacttgttttaggtacattgcgccaatggttcgcacttaagtcaattagcctgcctttactcagcaaacctttaaacaatgagacagtagaaacctgcctatatgttggcctttatcaagttttatgcacgcgtattgcagcgcacgctgccatctcggaaacagtcgatgcgactaaacaacttggtttccctgcactcagtggtattgttaatgcaattttgcgccgagcaactcgcgaaactgaagactttgaacaaggtttacatcaagcgcatggcttaccaagttggctttttaaacgcttaaaaaaggattggggagaacaaacagaagctctctgccaatcgttaaagcaagttgcgcctttaactttacgggtgaaccagcgtcatattggtcgagatgcttatttagcaaaactgcaaagtttagacattcaggcacgtgcgtgtttgttttccgaagctgctattgtccttgagcaatctgtacaaatcactcagttaccgggttttgaacaaggctggttctctgtacaagatgaacatgcacagctatgtgccaccttgttgcctgatttaaacaataaaacggttattgatgcttgtgctgccccagggggtaaaacggctcatttgcttgaaaagtttaaaccagcacagctcatcgccattgatcaggacccaagccgtttagtccgcgtgactgaaaacttaaatcgcttagcactcgatcaaagccatacggaaattttggcagccgatgcaaccaagtggaatcctgttcaacctgtagattgtatcgtacttgatgctccttgttctgcgacaggtgtgattcgacgtcatcctgacatacgcctattgcgccaatctagtgacatagcccaaaccattgagctacaaaagcagatcttagagcacatgtggcagcaactcaaagttggcggtacattgctttatatcacctgctcaattttaaaatctgaaaacgaacagcagatgattaacttcttcacagaacatcctgatgcaaaagaagtgaaaatcgaggcagattggggaattgaacaagttcatggcagacaactgttgccagaagcacaatctggtgatggattttattattgtaaaattcaaaagattacataa

SEQ ID NO: 923 - DNA, 1590 bp, Acinetobacter baumannii
gcgagcaaatgcatgagtcaacccactacaccatctcaatcagttattcctgcttgggtggattcgtcgctactacaaggcatgttacgtggaatagaacgtgaaagcctacgtatgcaaagtaatgggttcttatcacaagagttacatccaaaggcattaggttcagctttaacacatccgaaaatcaccacagattattctgaagcgttgatggagtttattacttcaccacagccaaccattggtgatgccttgcatgagctcaccgatattcatgcggttgtgcaccgtcatttagaaaatggtgaaaaactctggccgttatctatgccatgtatgctagatgacaatgaagaacgtattcgtctagctcaatatggcacttctaatattggccgtttcaagacgctttatcgccgtggtttaggtattcgttatggtcgccgtatgcagacgatttcgggcgtacactataatttatctttccctgattctcttttttctgctttgcaggcacatgaaactgacgaaaaattaaaagcacttagtctgcaagattatcgtagtcatcgctattttggtctgattcgtaactttattcgtttaacgccactggttatgtttttggtgggtgcgagcccatcggtttgccgttgttttttgacgggtcatgaacaccatttgttgcctttaatcaaagggtcatattatttaccgtatgctacagctctgcgtatgggacgtttaggttaccaaaactcggcacaaaaaagtttaggcattcactataacaacttaactggttatctggacggtttacaaaaagcagtacattctccatatccgccatttagccgtttagggttaaatgatgcctctggtgaaccattgcaaattaatgatcatgttttacaaatcgagaatgaatattacagtctcgtgcgtccaaaacaagttcctcaagcgggtgaaacaccatctcaagccttgaaaaatcgaggagtggggtatgttgaacttcgtgcagtagacgtaaatccatattcggcaattggggtcaatgaaacaacagcaggtttccttgaggcattagcgctttattgtttattaagcgatagtcctgaactgttatgccctgagcaagatttgattgagaaaaaccagacagaagtggttaatcgtggtcgagcaccaaacgcaaccattactgatttaaacgggtcttaccatattgaagattgggcacgtcagcatatttctaaaatgcaggattgtgctcgcttactcgatcagacctatgcaacagatctatacagctcggctttagctgtgatgcaagaacgtattgatgaagtagatgaaacattatctgctcatgtgattgatgacacattaaagcatggtggaacctggagctttggtagtcatatggcacagttacatgctgaaacttatgaaaagcatgaaatcagtgcagagactttgcaatattttgaacaattggctgtgcaatctttacagcagcaagaacaacttgagcaagatagtcagatcagttttgatcaatatcttgaacaatatagataa

SEQ ID NO: 924 - DNA, 789 bp, Acinetobacter baumannii
gagataaaatgccaaaaccgtttaaaattgttctacctaaggatttcaaaggaatttaatatgtttggaaagtatgtattttatacaggttggttgttagcaaccttgagtttaagtgtatcggcatgtgcagataattcaaaagtgaattgtaatacaaataatgtttatggagatttaaaatgcttagagaaagaaaataaaaaattaattaatcagctggataataaaaaaaataaagaaagaaaagattataatcaatggataaaagaaataaaaaataaatgcgaaggtaagataagctatgcttctggagagggggctggtttaattaaaaatcagtgttatcgagaagagtatttgtctagactctcttttattaatacgggaaaagttaaaaaaagtgacacaaatattcatggtttagaattaacgtatttaccatataattcaaatgatcatcttaaatgtatcatgaaaaaagaagtaaatagttgttctaaagttaatttagttaaatcatctaatctaattaaatattatccatttatttcacctgcatatggcgatagcattgttctgcctgaaacagatgacagtaaacaaataattgtttctccttttgaagacaatgaagatgaaggtccacagttagaaatttctattattaatgcttttggtgtggtagaacaaaaaactatatctgcaaacaaaaatgtaataatcgataaaaactataatttaatttataaagaagggaataaagaaaaaatattaaaattaaaataa

SEQ ID NO: 925 - DNA, 1017 bp, Acinetobacter baumannii
ggcttcaatcgtttttcacgtatactacgcataaactctttttggattgcatttgtgaaaattatttttgctggcacccccgaatttgctgcaacagcattggcggctttattaaaaacttcccatgaaattatcgcggtttatactcaaccagaccgcaaagcaggtcgtggacaaaaactaacaccatctcctgtaaaacagcttgcgctggaacataatattcctgtttatcaaccgcttcacttcaaagcttcaactgaagaaggcttggcagctcaacaagaacttgctgctttaggcgctgatgtcatggtagttgcagcatatggcttaattcttccacaagctgtgctcgatacacctaaatatggctgtttaaatattcacggctcattattaccacgctggcgcggtgcagcaccgattcagcgtgcaattgcaacaggtgacgacgaaactggtatcaccatcatgcaaatggctgcaggtttagatacaggcgatatgatgtataaaacctattgcccaatcacttccgaagatacatcagcgacgttgcatgacaaacttgcagctcaaggtgcaacagcaatttgtgcggtacttgagtcagaagaaactctgcaaaaatatttagcagaacgcgaagttcaagacgaaagcttaacagtctatgcgcataaactcgtgaaatcagaagctcgtattgattggtctatgaatgcagttcaagttgaccgcaatatccgggcattcaacccatggcctgttgcctttattcaacttgatgaaaataatgcgctgcgtgtttggaattcgacaatttctagtcaaagcaaagtaaatgctcaagctggtgaaattattgcaatcgataaacagggtgtacatgtcgcttgcggtgaaaatacatttatttgtttaacgagtgtgcagtggccgggtggtaaagcattaaatgctcaacaaattgcacaaactcaaaaacttcacgtaggacagattctgccatga

SEQ ID NO: 926 - DNA, 1056 bp, Acinetobacter baumannii
atggatattttagagaacccattagaattatgcggttttgcatttattgagtttgtttcaaaagaaaatgaattagatccaatttttgaaacaatcggcttttcaaaagtagccaagcataaatcgaaaaaagcgtacttatggcgtcaaggaaatatcaatattatcctgaattatcagccagaatcttatgcttcattcttttttaatgagcatggtccatctgcttgtgcgatgggattcaaaactcgtgatgcagcaaaagcttttaaaaaggcggttgagcttggtgcagaaccaatgtactcaaaagttgggccaatggagcttaacattccggcaattaaaggtattggtggcatgccaatcttcttagttgaccgcgatatttatgaaaatgactttgttttctttgatgatgcgcagcgtaaccctgaaggtgcgggcttaaaagaaatcgatcacttaacgcataacgtctacaaaggacgtatggagtattgggcaaacttctacgagaagattttcaacttccaggaaattcgttatttcgacattaaaggtgaatataccggtttaacctctaaagcattaactgcaccagatggcatgattcgtattcctttaaatgaagactcagacaagggtaacggccaaattgcagaattcttagctgattttaatggcgaaggtattcagcatatcgcgtttatttgtgatgacttaatttcgacttgggataagttaaaaggccttggtcttaagtttatgacaccaccgccaaatacatattatgaaatgcttgaagagcgtttacctgaacatggtgaaccaactgaagagttaaaacaacgcggtattttattagacggcagtactaaagatggccagaagaagcttttattacaaatcttctctgaaaatatgattgggccagtcttcttcgaatttattcaacgtaaagatgacgacggtttcggtgaaggtaacttcaaggcattgtttgaatcgattgaacgtgaccagattcgccgtggtgtgctcgaagcaaaataa

SEQ ID NO: 927 - DNA, 183 bp, Acinetobacter baumannii
tatagcgttagatcagtcggaatattgactcatcatcataatttgatcattctccattctatagaagcaaataatattgggaaagccaagaacgataatactcagtcaatatttagcaaaacttacatgaataattttttatttttttataatctttttttatcaataaaagtttttgaataa

SEQ ID NO: 928 - DNA, 780 bp, Acinetobacter baumannii
ttggataatagaatgagaacatttcaaattttaacttttgctctgaccgctgttgctgcaggaagtacttttgccgcagagttctcgtttgatcgtccgggttcaggctttggaacaggcattacgccagttggtaaattagcatgggaacaaggtttaccaagtgcaacttatacagagacaactgttgatggcgttaaagaaaaaacagttactgtaaatgaggatatgttattccgtacaggtttagctgatggtttggaattgcaattaggctggcaaggtccggcatggactcaaactaaacgtgctggtaaaaaaacggataactctggttttggcgatgtaagcatcggcttaaaaaaagcgattgatttaaatgatgaaaatttaacaatggctgtattggctgaagctattatcgcaacaggtaatgatgagtttactgcccatgacgatatatatagtttaagttcagcagtagcttataaatataatgatttgttggatacttctattaccatgcgttatgaagtacaaaacagtaactgggcagtgactgcaattccaaccatcaattataagattgcgggcaaactttcaggatattctgaatttgtttatcgtaaagctgaaagccaagactaccaatatggtttaggaacaggtttagtttacgcagtaaataaccgcactcaacttgatgcaaatattggtgtggacttagaaggtcaagataagagctacaaaggtggcttaggcatggcattcttattctga

SEQ ID NO: 929 - DNA, 1170 bp, Acinetobacter baumannii
ctgatcgatagtattcttctgccacacagtatattaataaaactggaagcacatcgaatgcgtaattataaaatagatattcttcgaggaatttctatccttttggttcttttacatcattttaatattccctataaacttaaagatacatgcttaggttttgatttcttaggtgaagcatttagcacagtcatcgcaagaaacggaaattatggcgtcaccatgttttttgtgatttcgggttttttaattacccatcacactttaaaacgagacaaacaattttctgcaattaacctcaaacatttttatatccgacgagcagcgcgtattttaccgtgtctggtattactcatattaggtgtaagcatacttggttcatttgacttaaaaccctttatgaaccaagcaccgaatggcattgaggtctcttaccctttaaccatatttgcagccttaaccttctggatgaatatcctgattattaaatttggttgggtaaactacgctttgggcgtgttgtggtcgctctctgtagaagaagttttttactttgtttttccattattatgcttgcttacgcgtagtaataaggtctttattgttgtactaattggcgtaattttatatggcccttattttaggtctctccattttggagaagaaagcggcgcttatttatatcactatttttcaagttttgatggtatagcggtgggctgtttaacggcgattttttctcataaatatcagccaaattggacctataaaaaacctctttcatggttgattattttgagtatgaccgctctatatttatatgcgcccattaaagaagtcagtacatggggtattagcttatttgatcttgccacaagcttactgattttgtgtttccaacatccttccgaaacacaagcacataatctatttaccaaagtgatggtctggttggggcaaagaagttacgaaacttatttgtttcatctggttgtattgggccttatgaaagttgcgtttattcctgctcaaaccgactctagcatcaaaattatgcttttaattggctatttggttctgacttttatcatcagcgcagcgattgaaaaatattattccagcccactcaacaactacattcgaaaggtttttattaaagataaatcataa

SEQ ID NO: 930 - DNA, 600 bp, Acinetobacter baumannii
cgcggcgccagaacaacaaccagattgggaatagtaaaaaggagtttcaacatgacatttgccattaaaaaaatacatcacgttgcatatcgctgtaaggatgcgaaagaaactgttgagtggtataaaaaaatgctcaatatggactttatcttagcttttgcagaagaccatgtaccttcaacgaaagcttttgacccgtatatgcatttattcctagatgcaggtcaaggcaacgttttagcattttttgaattgccaacccaaccagaaatgggccgtgatgaaaatacgcctcaatgggtgcaacatattgcctttgaagttgaagatttaaatgcccttttagctgccaaaaaacatttggaagacaacggcgttaaagtattaggtattaccaaccatggtatcttccactcaatttatttctttgacccaaatggacatcgtttagaactgacttataacgatgcacatgctgaagaaaaaattgcaaaaattactgaagaaatgaaaactgaaatgttagaggaatggagtaaaaccaaacgcgctccacaccatactcatttcttgcatgaagaagaattaggcgcgtaa

SEQ ID NO: 931 - DNA, 1827 bp, Acinetobacter baumannii
atgaaaaacagaaccttacattttgcttgtatcagtgttttattttggatgtctcattcgtctaatgctgcaacccccgaaataaatacaaatactatcgaaaaatcacaatctaaacaaaagagtgatgtctctgttcgggtgaaagctttaaaccaacttttacaggaacagtgggaatatactttgaaaaataaccctgaaactgcaacgactttaggcgatttacgctacaacgatcgatggaccgagtcttcaaaaagtcagattgagaaagataaaaaaactacccaaaattttttaaaacgttttgaagcgattgatagcacagggttttcagcaactgatcaattaaataaagatttaatgatttatcagttgaaagagactcttaaaaattatgatttgaaattgtatgagatgccttttaatcaaatgtggggactacatttacaatttccgggatttattagttcgattccatttgataatgctaaacaatatcaagattatatttctcgtttaaaacaaattcctcttattcttgagcaaggtattcagttagcgaaacaaggacaaaaagacggcttgatgccaccgaaatatttaattgaaaaggtggcaaagcagattaatagcattgcgacgcccgcagggaaggacagtgtgtttgcctctccattaaagcaatttccaaaaaatatttcgaaagcagaacaagagcgtttaagccgtgaaatattacagactatagatcagaatgttcggcctgcttatcaaaaactcggagcatttatacagaaagattacttaccctatggacgacaacacgagggtatatggagtttgccaaacggtgaagagctctatcgtttttatgtagaaaataatacgacaacctcggaaagccctgaaaacattcatcagctcggattaaaagaagttgctcgtatagaagcggaaatgctgaaaattgccaaagcacaaggtttcaatgacttaaaaagtttccaacaatctctaaaaacaaatccagctgttttcccaaaatctcgtgaagaaattttagagatttatcgcggatatattgcccaaatgcaaccagagttgccaaagctctttggtttattacccaaaaataaagtcgaagttttacctgtagagcaatatcgagaaaaagaagcggcaggtgcggagtatcaccaaggaacacctgatggttcacggccgggacaagtatatgtaaatactggcgacttctctgaacgttccaaaatatcaatggaagcaaccgcttaccatgaggcaattcccggccaccatatgcagattgatattgcccaaaacttgccaaatttgccgatgttccgaaagcagcccaaccacaccgtctacattgaaggatgggcactttacgcagagcaactgggtaaagatgttggtttctataaagacccgctttcagactatggaagactatcgagtgagttgttccgtgcttgtcgtctagtggtggacactggcgtacattataaaaaatggacccgtcagcaaatgattgattttatgcgtgaacactcagctttagatgaaccagatattcaggcagagacagatcgctatattgctattcctgcccaagcattggcatataagatgggccaactaaaaattttagagctacgggagctcgcaaaacaggagcttggagaccgttttgatatcaaagcgttccatgacatggttttaaatgcaggaacattgcctttaaatatactcaatgcccgtattaaaaattggataaaggaacaaaaagcggcagcttaa

SEQ ID NO: 932 - DNA, 3162 bp, Acinetobacter baumannii
aaatcgtgcagtgaaaattcagggagccaaataaccatgaaatttaatctctctgaatgggcactgaacaataagggtattgtcctttattttatgctcttgctcggcattattggtgcaatttcttattcaaaactctcacaaagtgaagatccgccatttacctttaaagtcatggtcgtacaaacctactggccaggggcaacagccaaagaagtttctactttagttacggaccgtatcgaaaaggaactgatgaccacaggtcagtatgacaagattatggcgtattcccgtccaggcgagtcgatggtgacttttgttgctaaagattctctcacttctgcacagattcctgatgtttggtacaacgttcggaagaaggtcaatgacattcgccatgaactcccaagtggtgtgcaaggtccattttttaatgacgaatttggcgatactttcggtaatatttatgtactgacaggcaaagactttgactacgcgcttttgaaagaatatgccgatcgtttgcaattacaactacagagagtcaaagatgtaggcaaagttgagctaattgggctacaagatcagaaaatctggattgaaatttcaaacactaaagcggttcagctcggtattcctgtttctgccatacaagaagccctgcaaaagcaaaatagcatggcaagtgcaggcttttttgaaactggaacggatcgtattcaaattcgagtaagtggccaactacaaagcgtagatgacattaaaaaaatgcctttactggtaggcgataaaaccattcagctgggtgacgttgctgatgtctaccgtggttttagccaacctgctcagccgcgtatgcgttttatgggtgacaatggtattggtattgccgtatctatgcgtaaaggcggcgatattattgccttaggtaaaaatctggaaactgaatttgcccaactgcaaaaaacattacctctaggtatgaaactacaaaaagtatctgaccaaccagtagcggtacaacgtagtatccatgagtttgtcaaagtacttgctgaagcagtcattattgtcttgttagtgagctttttctcattaggtttccggacgggtttagttgtcgctttttccattcctttagttttagcaatgacttttgctggcatgaatttattcgatgtcgggctgcacaagatttcgcttggtgccctaattctagctttgggtttgcttgtagatgatgccattattgcggtcgagatgatggccattaagatggagcaggggtatagccgaattaaggccgccggatttgcatggaaaacaacagcatttccgatgttgacggggacattaattaccgccgcaggctttttacctattgctacggctcagtccagtacaggtgaatacacacgctctatctttcaggtcgtgacgattgctttattggtgtcgtgggttgccgcagttttatttgtaccttatttgggtgaaaaactactacctgattttaccaagaccggacatcaagcaccttggtatgtccgtttatgggcaagagtaactaaaaaaccgcaaccacaaactgtggccatttcacagggccaccattacgatccttatcaatcgagtttctatttacgttttcggaaaatggtcgagttttgtgtgacctaccgtaaaaccgtgattgcaacaacggtggggatttttgtgctgtctgtactcatgtttaagatggtgccacagcagtttttcccgccttcaaaccgcgctgaaattttagtcgatttaaaactcgaagaaggcgcatcgttaaccgctacagagcaagcggtgaaaaaggttgaacaattcctgtctaaacaaaaaggcattgataattatgtagcctatgtcggtacaggttcaccacgtttttatttacctctagatcagcaattaccgcaagctagctttgcgcagtttgttgttttggcatcatcgcttgatgatcgtgatgaaattcgccgttctttagaaacccaaattaagcagttactcccacaagtccgtactcgcgtgtcattactcgaaaatggcccacctgttggttatccattgcaatatcgcgtgtcaggtgaagatttaaatctggtacgtaaagaagcacagcaggttgctagggtaattagtgaaaacccgaataccaccaatgtgcatttggattggggtgagccaagcaagattatttcaattcaaattgatcaagaccgtgctcgacaaatgggtgtgtccagcctcgatttagccaacttcttgaacgcctcaattacaggtagtgcgattgaacagtatcgtgaaaagcgtgagctgatcgaaatccgattacgtggtgataaagctgagcgcgttgaagtagcttcactggcaagccttgcagtaccaacagcgaatggaacaactgtacctttagcccagattgcgaaaattgaatacaaatttgaagatggtctgatttggcaccgtaatcggttaccgacaattactgttcgtgcagatattcgtaccaatttacagccagctaccgttgttggagagttagctgaatcaatggacaagttacgcgctgagctgccaagtggctacctcatcgaagtggggggaacagtagaagagtcggcacgcggacaaagttcggtcaatgccggtatgccactctttttggcagtggtcatgacattactcatgattcagctgaagagtttgtctcgggcaacaattgtatttttgactgcaccattaggcttaattggcgttgttttattcttacttttgtttaataaaccatttggttttgttgccatgctaggaaccattgccttatccggcatgattatgcgtaactcactcattctgattgatcagattgaacaagacagacaggcagggcatccaacgtgggaagcaattattgatgcaacagtacgccgtttccgtccgatcattctcacggcattggcagcagtactcgccatgatccttctttcgcggagtattttattcggtccaatggctgttgcgattatgggcggactcattgttgctaccttgctgacattatttttattacctgcattgtatgcagcgtggtttaaggtgaaaaaaacagcataa

SEQ ID NO: 933 - DNA, 501 bp, Acinetobacter baumannii
attaaaagcagtacgtttaagtcaggagataacaaaccattacaccatcaaaatgtacaattgaagtcagttcatgcatgcttaaaacatgccaacataaaaaagttttgcatagaaaagatccacagtaagaaagagaggatggtatttatgaatattgaaatccgcacagataaaaacatccataatagtgaacgtttaattacttatgtacgtgcagaacttactcaagaattccaacgtcatagcgaacgtattacacatttctcggttcattttagtgatgaaaatggggacaaaggtggagacaaagatatccactgtatgatcgaagcacgtccttctggcttaaaaccagttgcagtgcaccataaagcaggaaatattgacgcttcaattcatggcgcgattgaaaagctaaaacgtagccttgaacatacctttgagaaaaaagaacacccgagaggtggtcaaccagaattcattgatgatgaagtttaa

SEQ ID NO: 934 - DNA, 219 bp, Acinetobacter baumannii
ggcgaaagcagagccaaaagtaccaggtgctttaggagcaagaccagatccaaaaccaaccccacagaaaacgatgcagcggttgaaccaagacatgtctttaaaatgaatcggcggtttatgcaaagtgttggtatccatgaatttgcaatgggtaatctgaacccaaatgctcaaaagttagttttgtttgctcaacgatctgtccgatcattgtaa

SEQ ID NO: 935 - DNA, 468 bp, Acinetobacter baumannii
agtcttggaagacccaaggatattacaaaaatgaaaaagattgctttagctttaggacttgttggtatggctgcatttgccaatgcggctgacccactaaacggaacggtatggaaaacgattgatgaccaaaccaataagcccaaagccgtagtaaagtttacggaacagaaggatggaaccttaactgcaaccattcaaaacattttgacaccaggtgaagaaaacgcttgtacaaaatgtgaaggtccgtataaaaacaaaccgcttaaaggtgtgaccattgtacataatctaaaaaatgtaggtggtaacagttatgaaaacggtacaattttagacccgaaatctggcaaaacttacaaattaaaaggtgagttggctgagggcggtaagaagcttaaattacgtggttatattggcgtttcagcattgggccgtaaccaaacttggattcgtgcgaactaa

SEQ ID NO: 936 - DNA, 1383 bp, Acinetobacter baumannii
aacttattgagtagctcagtccctagaccgaacttttatttgtataagacgcgagatgaagacaaggaagcgaaaatggaacaaaaactaaactcttttattgaagtttcacctcaatctgatttcactattcataatttgccttatggtatttttagtagaacagccgaaggcgagcgtcaggtcggtgtagctatcggtgattgggtcattgatctcgctgctcttgaaaagcatggtcttttaaaactttcagatcaagacacctactttaaccagcctacactgaataaatttattgaatcgggtaaagccaattggtctaaagttcgtaaaacgctacagtctcttctttcagttgataatttaacgcttcaagaaaatgaaccattgcgccaagaagttttggttaagcaagacagtgttactttgcatttaccacttcaagtatctggttataccgatttctattcttctaaagaacatgccaccaatgtaggctgtatgttccgcgaccctaaaaatgccttacttccaaactggactgaattgcctgttggttacaatggccgtgctagctctgttgtagtcagtggcactcaagtcgtgcgtccatctggacaaattaaacttccaaatgaagagcgtccagttttctcagctacgcgtaaactcgatttcgaacttgaaacagcatttgttattggtaaaccaacggagcttggccagccaatctcaattgaaaatgcttgggaccatatttttggaatggtattactcaatgactggtcagcgcgcgatatccagcaatgggaatatgtacctctaggtcctttcaattcaaaatcttttgctagtgccatctcaccttgggtagtcacgcttgaagcacttgagccatttaaagtggaaggcccaaaacaagagcctaaacctttagcgtatctacaagaaaatatcgcgaatagttacgacattaatttgagtgttgaaattcaaagcccgaaatcaacacaacctgatgtgatctgccgtactaattttaaatatatgtattggtctatggctcagcagttgactcaccacaccattggaggctgtaacgttcaggttggtgatttaatgggttcaggtactatctcaggttctacacctgactcttatggtagcttgcttgagttgacttggaacaccaccaagcctctaacacttgcgaatggtgaaactcgtggtttcttgcaagacggcgacacactcatcatgaaaggccactgtgagaaaaatggtatccgtattggttttggtgaagtccgaaatacggtacttcctgcattaacttttgattttgcagaaacttcggagcctaattatgaagctgtatag

SEQ ID NO: 937 - DNA, 534 bp, Acinetobacter baumannii
ataaaaatgaggttttacatgcgattaagttaccgtttggtgagtggactgcttgttctggcaagcattgtcggcatgtcttttgcgttgtatttggaacatgtaaaagggttggagccatgtccgctctgtatttttcaacgtgttggcttaatggcaatgggttttgtggctcttattgcgtttttgcataaccccgtttccaatgcgattaaacgcttttatgcatttttggcaggtattgcaattttatggtcagtaggggtggcgggccgacatgtttggctacagcatttaccaccagatcaagtaccaagctgtggtcctggtttaaattacctcattgatgctttaccaatgaaaaccgttttacaagaagtactttctggctcaggtgagtgtgcggcaattgactggacttttttaggtcagtctttaccagtttggtcattggcctatttccttttactgttattggtttgtttatggcagttattccgtttttatccagtgtttaagacggttaaaaagtaa

SEQ ID NO: 938 - DNA, 882 bp, Acinetobacter baumannii
gcaaacattggaaggtacggcttaaatatggcacaacttccggcatccatgcgccgtaaacgtgcggcaattacctccattcatgaaaaaccgcctacgcgcaagcaaaaacttgccaatgccggcggatgggtgttgctggttattgcctttttagtcttggcggtcggaatttacggactatataaagttattactgatgcaactgttgcaaaacttgaagttgtaggttcaacaactccagttgagactcagcaagtgatgcgatatgtgcagccgattgtaaaagataactactttacatctgatttagagcagattcgtgataaagcattagaaatttcatgggtagaccgagtcgtcgtatctcgtgcttggcccaatagtattcgcgttcgtgttatgcctcgacatgctatcgcccgttggggaacaggtcgcttattgagcgatggtggcgatgtatttagtgaagcagagccgagacttcatcctgagcttccgttactacacggtccggtaagtcagtctaaaatgatgatgcgacgctataatgaaattaatcagttattccatcctgttaatttgcgtttaaaagagttatatctaacagagcgaatgacttggtttatgcagtttgactctggtttacgaattattgttgaccaagatcaaacaatgaataaattgcaacgtttaagtcacttggcacaatctgacctaaaacctgtgtggacgaaaatctcagccattgatttgcgatatcgtaatggattatctattcaatggaagaatgcaaccccacctaaaatcgtgaatggtcagtttgttgtaacgagtgatgacacaagcattgcaggtggtacaaaagcaaagccataa

SEQ ID NO: 939 - DNA, 1326 bp, Acinetobacter baumannii
cattattgtggtttagaaatagattacgcctgtgatctggccatatttaaatggccagccatgatcagtttaaatattattcaaagagatcaagccatgcacactgcaatcgccaactcatttgccaagcttcccgtcactgttttatcgggctttttgggtgcaggaaagaccacattactcaaccatattttaaataatcgcgaaggccgccgtattgccgtgattgttaatgatatgtctgaggtgaatattgatgcggcattagtacgcgaaggtggggcagagctttcaagaacagatgaaaaactggttgaaatgagtaatggctgtatctgctgtacgttacgagaagacttattggttgaagtgagacgtttagccgatgaaggacgctttgaccaattggtgattgagtcaacaggcatttcagaacctttacctgtggcagaaacttttacttttgaagatgaagatggaaactcactcaatgagtttgctcgactcgacactatggttacggtagtcgatgcttttaactttcttaaagactacagttcagttgactccctacaacaacgcggcgaatcattaggcgagcaagatgagagaactgtggttgaccttcttatcgatcagattgagttttgtgatgtgattgtgctgaataaaattgatttgattgatcaggctcagcaagaccagcttatcgccattttaaaaacgttaaacccgcgtgcccgaattgaaattgctcaatttggaaaggtcgctttagataaaatcttaaatacacagttatttgattttgatgaagccgcgcaagcaccgggttggttaaaagagttacgcggcgagcatacacctgaaactgaagagtatggcattagtagctttgtttaccgtgcccgccgacctttccatccagagcgtttttatgatttggtacaggctgaatggccgggagtcgtgcgttccaaaggttttttctggttggctgccgaacggacattggcttactcatggtcacaagcgggagcaatggctcgacacggtttagctggttattggtgggcagccattgcggaagaagactggccgagtgacctagccagcattgaacaaattaagaaaaattgggatgaccgcacaggtgatgcgcgtcaggagctggttttaattggtatgcaaatggatgagcaagctttaatacaacgcttagatagctgcttgttaagcgatgaagaaatggctttaggaccacaagcttggcagaactggcctaatccttttaagcaagaagatgaaaccatgttgattgcttaa

SEQ ID NO: 940 - DNA, 1842 bp, Acinetobacter baumannii
aatatgtgtggtatcgtcggaggcgttgcagaacgttgtgtaaccgagattttaattgaaggtttaaaacgtcttgaatatcgtggttatgattcggctggtgttgctttactgaataagcaacagattttacgtgagcgtcgtgttggtaaggtaatcaatcttgaagatgccgttgctgatcaacaactcacggggacaatcggtattgctcatacccgttgggcaacacacggtaaaccaaccgaaaataatgctcacccgcacatgtcaggcaaggtagcagtcgttcacaacggtattatcgagaactatcaagagcttaaagatgaccttcaagctttaggatatgtatttacttctcaaacagatactgaagtggtagcccatttagttgcagaagctctaaaaaatactgatagtttacttgaagcagtagaatctgtagttcctcagcttaaaggtgcctatgcgttaggtattattcacagcgattacccagatgaactcattactgtacgtgaaggttcaccacttgtaattggtgtgggtattggcgagaactttatcagttcagaccaattggcccttttaccagtaacgaaccgttttatttacttagaagaaggcgatattgcccgtcttactcgtacttcaattgaagtatttgtaaaaggtgaacgtgttgaacgtccagttaaagaacttgatgcaactgtaagcagcgcttcaaaaggtgaatataaacactacatgctcaaagaaatttatgagcaacctgaagcaatcaaacaaacaatttctcaagcgcttgatggcaacaatttacgtgatgatttcttgaaagatgctgaagcagatttcagtaaacttcaaagtgttcaaattattgcgtgtggtacaagttatcactcaggaatgatcgctaaatattggtttgaacagctaattggtgtgccatgccaagttgagattgcgagtgaattccgttatcgctcaccagtgattgtggaaaatacactttacatctgtatttcacaatcaggtgaaacagcggataccttagctgcactacgtgaaactcaaaaacgtgctaaagcaaataatatcgacattcagactttaacgatctgtaacgtcgcaacgtcttcaatggttcgtgaaactgatcatcacttattgacgcttgctggtcctgaaattggtgttgcatcaactaaagcgttcacgactcagcttgctgcattaatgttgttaatcttaaaaattggtcaagtgaaacagcgtattagcaatgtgatgattgaagagcttgctcgtgaattgtggcatagcccgaaagtgattcttgatacgcttaagcaagatgctgaaattttacgtttatcagaattgttcgttgaaaaacaacactgtttattcttaggccgtggcacacactatccaatcgctttggaaggtgcattaaagcttaaagaaatttcatatattcacgcagaaggttatgcggctggtgagttaaaacacggtccattagcacttgttgataatgaaatgccgatcgtaattcttgctccaaatgatgaaatgcttgataagctaaaatcgaatatggaagaagttcaggcgcgtggcggtgagttattcgtttttgctgatgaaaatagcggtgtagtcgaaaaagatcgtcaacacgttgtacaaattccagcagtaaacgaatggcttgcaccaattatttatagcgtaccagttcagttgttgtcttatcacgttgctgtattacgtggtacagacgttgaccagccacgtaacttggcgaagtcagtaactgtagagtaa

SEQ ID NO: 941 - DNA, 216 bp, Acinetobacter baumannii
atcggtcacggtctaattcttcaactcaaaaaacaatggaaattgtcatctatttttgtagccgtttattttaatcctaaagcttcattaacgaaaagcgaatttcactcgtttataacagaaagatgtgcttttttgaaaatatgcctacaaagctatggtgtatttggtattgtgattttattaattcatatattttcgggtgatttccaataa

SEQ ID NO: 942 - DNA, 495 bp, Acinetobacter baumannii
agttctaagggcggaaaaaccatgcttttaatcagtgcttgtttaattggggagcctgtacgctacgatggccgctcttgcttacacactacacttaagcagttatttttaaataaaaaagcgcatgcactttgtccggagttattaggtggttttactactccaaggttacctgcagaaattgttgggggtacgggtcaagatgtgcttgatggtaaggcaaaaatcatggattcatctagtttagatgtgactaagctatatttaaaaggcgcctaccgtactttagacattgcacggcaaatacaagcaacttgtgtggttttaaaagaaaacagtccgtcttgtggtagtcaaaaaatttataacggtacttttcaaggcgagaaaattacgggtgttgggattaccacggcactgttacagcgccatggttttgaagtgatttctgaaaatgagattgaagaatggttagcagcacatcctctttgttga

SEQ ID NO: 943 - DNA, 1362 bp, Acinetobacter baumannii
cgtaaatggggaaaagatatgccgagcttaacaccgttacatgaaacttattgtaaatgggatcgtacgccacctagtcaggccgacgtactagaaggtttagctcaactgttcagtaccagcttaaatggtgtacatgaattaatacaagtcattaatattgaagtattaaaaaatgcttttggtattagtgcccaaaatgctaaaaatttccaaaaacggccttctgtccaaaaggcatatcagttttcttatggtgccttacaaaaatatggtagttgttttttagcaccagggttacgtcgtattattgaaaaatttccaacccttcatgagaagccattaacaccaacccttcattttttagtaggagtgttaaatggtattttcggagactatctacttaaacagcacagtcccctcgccttgccaatggttctatacgaccactacggtgcaatccaacaaggcgaacttgcaggccgtattgtaattttagttcatggtttgtgcatgaaccatcttacttggtcaaatgcacattatggcgggattggtgagcgtttgttagcgcagcgtgatcacaacacgatgctgtatttaaattacaatacaggccgccgtatttcagccaatggccgcagtttctcaaatttattagaagatttagtacagcgtaatccaagaattaccagcattgatttaattggtcatagtatgggtggactagtttcccgtagcgcactgttttacggtaaacaaaatatgtaccaatggattcatatggtcgaaaacctcgtctgtattggatctccccaccacggtgcagtacttgagcgttttggatttgcgctacaagatcggctaggcgcttttccatttgttggcctaattggtcagctggttaacatccgtagtaatgggattttagacctacgccatggtagtgttcgagatgatgactgggaatacatggatgcccgtattggtatgatggatgacaaccgtgctccggctcctctaccttcccatatcaatacctttttagtggcaggaacactcgagtttgaaaaggtgcgtaataaagcgcttaccgtgattggcgattacttagtgagtgtaaaaagcgcgctaggtgaacatcctaatccacgttttcagcttaaagttccagactcacataaagcggtgttttatggcttaaatcactttgaaattcagtatcactcaagtgttgccgaacagattactcgctggttatatcctcatgtgaatgattatgtgcaagacggtattcaaacccatattattgatatgccgaactatacgcttgaagatttagaaggaattgtagagacgtaa

SEQ ID NO: 944 - DNA, 1305 bp, Acinetobacter baumannii
gcttattttatgtccaactggtttcccaaatggcagccttaccaaggtgatgttgaccatcgaccggtctctaccaatgaatatctccctccagttcaaagtgctattttaggtatccaacatgcatttgccatgtttggagcaactgttttagcacctttactcatgggctttaaccctaaccttgctattttaatgtcaggtatctgtaccatcctgttcttcttaattacaggtggtcgtgttcctagttatttaggatcgagttttgcctttattggggttgttgcagcagccacggggcatatcacaggttcaggggccaatccaaatctttctattgcgttgggcgggatcgtagcgtgcggtatcttttatgcactcatcggttttattgtgatgctcacgggtacacgctggattgaaaaacttatgccgcctgtggtgactggtgcaattgtgatgattattggtctcaaccttgcccctgttaccattaaaggcgttgcaggccaaccatttgaaatgtggatggccttaattactgtactttgtatgggcagtattgcggtttttacacgaggcttattgcagcgtctacttctattggtaggtttgatcttggcttatgtaatctatgcgattgcgacaaacggtctaggtttaggtaaaccgatcgattttagccagatcttacaagcttcgtggttcggtattccaagcttttcacatcctacttttgataccaaggctattttaattattgcaccagttgcactgattttagtagcagaaaacttaggccatatcaaagcggtaggtgcaatgactggagaaaacctaactccacaactaggcaaagcctttgtcgctgatggtttagctacaacactttcaggcagtgttggcgcgccagggatgacgacttacggtgaaaacattggtgtgatggcagtcactcgtgtgtactcaaccattgtatttgtgattgcaggcatctttgctattttcttaggtctatcaccaaaatttggcgctgtcattagtaccattccaagtgcagtccttacaggtgcatctattgtggtatttggcttaattaccattgccggtgcaaaaatctggattgaaaacaaagtcgatttttctaacaataaaaatctgattgtggcttcagtaaccattattttgggtgctggaaactttgaattattgttcggtaatttcaatttaggtggtattggtacagcaacgtttgcagccattattttaaactggctgtttagtttaaaagataaaacctaa

SEQ ID NO: 945 - DNA, 255 bp, Acinetobacter baumannii
gaacattttatgtcggaagcgctgatcaatcgcttagtagagtttgccgagtctggcaaccagcaaaagatcattttaaatggcaatagctatcaaggctggatcatggaaatcagtgatgatgccctactgatcagtaccggtttttcagataaagttggcaaagacttttggctaaagtttgaagacttaactcaagctgaactgtattattgggatactcgcccaaatgaatgggtaccattcaaactctaa

SEQ ID NO: 946 - DNA, 693 bp, Acinetobacter baumannii
aatatatttatgaagcgttatttaggtttactcgtattatctctggcggcttgtagtactcaaacaccccagccgacgattactcatcgctctccctctttgcctcaaccatctaaaatggtagttaaaataaaacaacaacctgaagattatatcgtttggatcgcaactgcagatcacagacagtctgtacaagcttataagcaatttcttaagcaaaaaggacttgccgatttagttccagaccacgagttattacgttcagcccgagactggcaaaaatgtggagttgagccttacgcagttccaccacgcgagatttggtccaatattgttccgacgctcaatatattaaaagcattggttgacgatggcgtaattaacgattttgaagtgacttcggtctatcgagctttagctttaaaccgctgtgcaggtggtgctgatgcttctcgacatgtctttaatgcagcacttgattttaggattgggccagaacagcctagcgacttagaccagttcaatattcaacaaactaaaaccaagctttgtcagttctgggcgactaaaggccaagcgtttaatatgggactgggtgtttatgcttcaggacaaatccatattgatagtcaaggttttagagcatgggggccagaccatcactatagaacctcaatttgtcagggactataa

SEQ ID NO: 947 - DNA, 2232 bp, Acinetobacter baumannii
ttatcatttatacttttatttttgttaattgattttatttttatgttaagaatttctatatcatctccccaaattaagggttcattcccgctcagcttactcagtttaatgattttaaatattcaaggtgctaacgccgaggaattgattgaatcctcatcaaaagccgcagccaccatgccaaccataaaaatcgaggccatgagtgagctcgacccgattaaaagctatatcgattatgacaaagccaatgtcactcgtaatggtttagataaaaaagatatccctcaaaccgttgataccattgatgttcagaaatataaaatttatggatcgaatgacttaagcgtcatgctgcaaggtacaccaggggtatcaaccagttacgatatgcgcggcgatgggatcacgattcgtggttttggtgctgacacaggtgatatttaccgtgatggcatacgcgaaagcggacaagtacgtcgtagtacagcaaatatcgaacgtatagaaattttaaaaggccccgcttcggttttatatggccgtagtgctggcggcggggttgtaaatatggtgagtaaattcgccaattttgactctaaaagttcagttggcgcatatgcgggttcatacgataactacggaacaaccgctgacatcaaccaagtacttaatgacaatttagcagtgcgtttgactggagaatatggtgaggcaggcagcttccgctctggtattgaaaataagattgagatgttttccccaagctttacctataaaaatgacgatggaaagctgacttggaccacacaatatacctatgacaaattaaatcgtgtacccgaccgtgggccaacacgtgacaacttgcctgcgggaacttcaattaaaatgggatttgcccaaaacggtgattatgttgatgatattttgcaagtcgttcgtaccgatgtgaattatgaatacgcgcctgattggaacttccactgggcggcaagttaccgacaagcagaacagaactttgaccacttttattttggaaattattgtggtttagatggaaaaaactcaaagaatgaggcttgtacaaaaaaaggttacatcgaccaaatttactactggcaacaaaccagcaataagaccacaaccaatacatttgatattaaaggaaagttcaagacaggccagcttgaacaccaaattatggttggtacagactggacttatgaacaacgagagccacgtctagccaataaaactcaaaatggatcggccatttatggttacgttaatccaatcactggtgaacgagagtacagtcgtggcaatggcccattaaagattagtcagcataactataatgaaggcacaacttacggcgtatttattcaagatttaattggtctaaatgaccaacttaaacttatgatgggactccgctacgattacttcgacttttcaactactaacaaaattaagaatgaacatcgtaatgtaaaagacagtacttttagcccaaatgttggcttggtatggcaaccagttcctgaacatagcttttatacgtcttactctaaaagcttcgcaccgtttggtggacaaatgggtgtcaatcaagttactggaagtactgatgtcgcgaaaatggataaagagcctcaatataacgagcaatatgaagttggggtaaaaagtgaatggttcgataatcgtttaaatactcaattttctgtctttgatatccgaaaaaataatattcgctataaaccaaaccctgacagtgaaccagaggtttgggcaactgcgggtcaacatcaatctcgtggtttcgaatttagttttattggccgtgtacttgataatgtctttgttcgcggtgggtatggctataccgatgccaaagttaaagaagacaatcaaaaccctgagcgagaaggcaattatttagccaacacttctaaaaatacgggtaatttatttgttcgctatttaccaactgaacagtggtataccgaagtgggcgtgacctatgtgggttcttattatccaaatattaataatcaagtaaaaatggaaggcttcaatcgtgtcgatgcagcaattggctacagtgccgacccttggaatgtcacacttgcggtgaacaatttaaccaataaagagtactggcgttcggacagtatgccaggcacaccacgtaatgtgttattgcgtttgaattatcagttttaa

SEQ ID NO: 948 - DNA, 615 bp, Acinetobacter baumannii
gagcaatttatgatgcaattacgtcttggtttagtccttgcagtttcagccttaagtttagctggctgtggtcgcttcgcactcaataatcactctttagattataaaaatgcaaagcaactcgccccacttgagtaccctgccgatgcaactgtacgaccagcgacacctttgtatcctgcaccaacagtagaccagcttgctatcgatcacgcaccgaagtttgaaaacaagcgtggcaatcgttttgcattgccacgtcctgaaccacttcaaactgatacgacagcagatgcatctgctcaaacaggtagtgcgcttggtcgccctcaacttgtgacagatggtaataaaaacccactgttaaaaattgatggaagtactgccgagatttggcaatacaccaaagctacgttaagcacgttaaattacaacgtcatcgctcaaggtaacaatcaagcgacgattaaagtaaatgacaatacatatgtgcttaagctcactggtgttggctctagtcatagccttgctctatttaatccagataacacttttgctagccctgatgttgccgcagaagtgttaaaccagatttaccaaaattggccagcctag

SEQ ID NO: 949 - DNA, 1368 bp, Acinetobacter baumannii
ccaaaatttatgtatgaaccctaccccgtccccgaacaggtacgtgaacaaaagctttcccgctacagtagtttatggacgtttgctaaacaagatttacgacttttattatttttcctgattattgcaggtttagtcggtttaggaattgggtatttctggagctgtatttttattgcctttgtggtgttttttacacttcagttgcgttctttatatttggtcaatgactggattgccaataatccatacgatgtccctccgaacctcaacggaatttggggggcattattatttaacgtttaccgtgcccagcgccaagaacgtattgttcaagcggaaatggtaggacttattgaccgcgctcaatcttcattagttgcacttgccgaagcggtagtcttgattgatgatcaacatcaaattgaatggtggaacccagccgcagagcgtttactaggaattagtccacttgaccgtggccgtaacttattaaccattttgcgccagccaacttttattgaatattttaacaatatcgatcaggcacctgatgggattaagctccattcaaatcttgatgatgaccgttatgtgcaggtcaaactcacacggttcggtggagaaagtcgtttattggtggcttacgacgtaacgcgtatgcacaaccttgagcaaatgcgtaaagacttcgtcgataatatttcgcatgaacttcgtacgcccttaactgtactcagtggctatatcgaaacatttaccgaccaagaagatattaacccgcgctggaaacgtgcatttgatcagatgcagtctcaaactaaacgtatgaatgcgttagtgaatgatttactgctgttatcgaatttagaaaataacaagaaaattgcaaaaaatcagattattgaaatgccgagcttaatgaatcaattatttgatgatgctcaggcctacaatgccgattatgggcatacactcaatttacatattgatagccactgtgacctcatcggttcagacatggaaattgccagcgcatttagtaatttaattactaatgccattaagtacacaccaaaaggcggaaccattaccattggttggcacgatgacggtgagcatgcttactttagtgtacaagataccggtatcggcattaaccctaaacatttgccgcgtctgactgaacgcttctaccgtgtagacagcgaccgtagtcgtcaaaccggtggaacaggtttaggcttggcgattgtaaaacacgtactcatgcaacacggcgcctatttagacgtgcaatctaaagaaaatgaaggatcaacctttaccgcagtgtttccaaaagaaagactctataacatgacttaa

SEQ ID NO: 950 - DNA, 762 bp, Acinetobacter baumannii
gtatttgttatgcccagaacatcaaaacaagaacatactgagctttcgattgaagctgatagtccagttcctttatatcagcgcgtaaaacagctgatttcacaaaagatttatgaaggctcttgggctgtaaataaaaaaattccttcggaaagtgaactcgttaatcaactcggctgtagccgtatgacggtaaaccgtgcgctacgcgagttaacaacagaaggcttacttgttcgaattcagggtgttggttctttcgttgctgaagggcaaggccgaactgcacttttccaaattaacaatattgccgatgagattattgcacgaaaccataagcaccatgctgaagttttagtcttagaacaaatttatgcaaatgcagagcaaagcgtgttaatgcagactcgcgaagggcaaaaattatttcaatcgattattgtgcattatgaaaatgatgtacctgttcaggtcgaagatcgtttagttgatgcagcactgattccagattatttagaacaagattttaaaaccattaccccaaatgcttacctcatggcaaaagcacccgtgacagaaggtgaacacattgttgaggccgttttagcatcacctcaagagtgtaagtggttaaagattactaaagctgaaccgtgtttactcatccggcgtcgcacatggtcaaacaaacaactcatttcaagtgcacgattgatttatccgggcagtcgctattatctcgaagggaaatttaatccatga

SEQ ID NO: 951 - DNA, 1167 bp, Acinetobacter baumannii
gagcgtgttatgaatgtggtgattattggtgcgggaatgggaggtctaaccacaggcattgcattaaagaaatttggtcaccaagttcgtatttttgagcaaactgaaaagattcttccggtcggcgccgcaatttcgctgtggtcgaatggtgtgaaatgtctaaattatctgggattaaccgagaaaatcgccaaacttggtgggcaaatggatgacttggcctatgtagatggtttaactggagatgtgatgacacaattcagtttacggccattaattgaagaagtaggacaacgtccttatccggttgcacgtgccgatttacaaaatatgttaatggatgagtttggtcgagatcagatttatttaggcaaaaaaatggtaggccttgaagataaagctgattttgtagaggttcattttgcagatggtagctcaacacaggctgatttactcataggagcagatggtacgcattcaatgactcggacctatgtgttaggtcagcaggtacaacgtcgctatgcaggttatgtgaactggaatggtctggttgaaatatccgaagatttagcaccagctcagcaatggacgacttatgtaggaaagggcaagcgcgcgtctctgatgccagttgcggatggacgtttttatttctttttagatgtacctttaccagcagggttagagaataatcgggatgaatataaaaaacttttaaaacaatattttgttgattggtgtcaacccgtacagcagcttattgaacgcttagacccacaaaaaaccaatcgggtagaaatccatgatattgaaccgttcacacagttttataaaggtcgtgtggtgattttaggtgatgctgcacatagcacgacacctgatattgggcaaggcggttgccaagctatggaagacgcgatttatttagcgcggtctttgcaaattaacactttgggactagaggatgctttacgccgctatcaaaacaagcgtaatgaacgtgccaatgaattggtgcttcgtgcgcgcaaacgctgtgacgtaacgcatatgaaagatgaaacggtcacgcaggcctggtatgcggaactacgccgtgaacaaggcggacatattatgcagggaattattagcaatattgtgggtaatccactcgattaa

SEQ ID NO: 952 - DNA, 213 bp, Acinetobacter baumannii
gatgagtctatggaactatttaagcctgaaaagagattaatgaatcatccaatccattttggtgaaaatccattagtgattttatctaattttagccactctgccttaaagcaaggatggagccaagctgaaatcgaaactgtcatttctgaagcttcccaaggcgactatatgaaactcatacgtaccttgagagcatataccttgttttaa

SEQ ID NO: 953 - DNA, 1224 bp, Acinetobacter baumannii
tcattgactatgtctccacttatccattctttacttgatacagacttgtacaaatttacgatgctacaagtggttctgcataaattcccgcaaacacatagcgtctatcattttcgttgcagaaatttagaagatacggtctatccattagtggatattttggatgacttaaacgagcaactcgaccatttatgtaatctcaaatataaagaagacgaactacaatatttaagaaaattacgatttattaaaagcgactttgtcgattatttagaattatttcaactcaaacgccgttttattcatgcgagtatagatgaagaaggtcgattagacatccgtattgaagggccaatggttcaagccatgatgtttgagatttttgttttagctattgtaaatgaattatattttagccggattaaaacagatgaagtctgggctgaaggcgagcgtcgtttacaagcaaaacttgaattaattcagcaatacgaaaaagctcaactaccgaatgatccaccatttttagtttctgattttggtacccgccgccgttatagttttgaatggcaaaaacatgtagttgctgcatttcataacactgtgcccaatgtgttccgtggtacaagtaacgtcttgcttgccaaagagttaaatattacgccaattggaaccatggcccacgaattcctacaagcttttcaggcacttgatgttcgcttacgtgactttcaaaaagctgctttagaaacgtgggttcaagaatatcgcggagacttaggaattgctttaactgacgttgttggtatggacgctttcctcagagattttgacttgtattttgccaaactatttgatggtttacgtcatgacagtggtgatccgtacgagtggggtgataaagcgtatgcacactatcgtaaattaaaaattgataccaaaaccaaaatgttgacctttagtgatggccttaatttaccaaaggcttgggagctacatcaatatttcaaagaccgtttccaggtgagtttcggtattggtactaatttgaccaatgacatgggccaaacaccgctcaatattgtattgaaactggttgagtgtaatggccagtctgttgctaaaatttcggacagccctggcaaaaccatgactgataacgatacattcttggcctatttacgtcaggttttccaaatcgaagagctggatgaagcaatttaa

SEQ ID NO: 954 - DNA, 666 bp, Acinetobacter baumannii
cttttgattttgcagaaacttcggagcctaattatgaagctgtatagttactttcgtagctctgcagcttacagagtacggattggtctcaaccttaaaagtctcgcttatgaaactgtatccgttcatttggttaaaaatgagcagcaaagtgaagactatttaaagttaaatcgcagtgccttagtaccaactttcgtggacggcgatttaaccctgtcacagtcattaagtattttggaatatctggatgaacaatatcctgaaaccaaattacttccaaatgatgtgaaagaaagagccaaaatccgtgcttttgcacaggcgattgcctgtgatattcacccgttaaataacttacgcgtgctgaaatatttaaaaaatgatttaaatgtttcggacgaacaaaaaaattactggtatcagcactggattcttgaaggctttcaaacactcgaacagcaacttcaagattcaaatggacaattttgctttggacaacacgcaaccattgccgactgctgcctgattccacaggtttacaacgcgaaacgcttcaagattgatttgtcggcgtttccaaaaattgaatcaatttatcaacattgtttgtctatcccagccttctataacgcggcgccagaacaacaaccagattgggaatag

SEQ ID NO: 955 - DNA, 336 bp, Acinetobacter baumannii
atgaattatatttttattttatttaaaggtataaataatcatgagaataatatgaaacttcataaatttatattggttttaaaccttgtgttcggtgtttacagtattaccaatgatgatgccaatgctcagcaggaatttaaaagaatttgtttgtcaggtgaatacatgcaagccagttgtgattgtatttgccaacagcttgcacaggtgtattcatctcaaaccgtacaacgtttaaaacacaccagtttgcaaagtcctgttctcccacaggactttgcccctaacttgtttagcagcattcaacgctgtgacaaaactgaaatgggctaa

SEQ ID NO: 956 - DNA, 1164 bp, Acinetobacter baumannii
gagaacaatatgctacagcttcagtccaaatttcccgcacaaggggtgactatttttagtacgatgacggcaatggcacagcgcttgggtgcacttaacctttcacaaggtttcccggattttcctgccccccctgctttgctcgaagccctatctcatgcaactttggctggacacaatcagtacccacctggtgatggcattctcgcactgcgtgaacagctcgctttacaatttcaacaacgtgatcagcttcaacttgatcctgtaactcaaatcacgattacgccgggtgcaaccatagcaattttctgtgccatacaagcttgcatcaatgcaggtgatgaagtcattatttttgacccgagttatgacagctatggaccatctgtcgagttagcaggtggtaaagcagtacatatcgcattgcaagcacctgactttaaggtgaactggcaacaagttaaagatcgaattaacgataaaacccgtatgattgtggtaaataccccccacaatccaacaggtacaatctggtccgaacaagactggttagaactgatcgcactaattcaggataaaaatattgtagttttatctgatgaagtctacgaacacttagtttttgatggtcaacagcactttagcgcgttgcatttccctgagcttagagaacgtagttttgtgattggttcttttggaaaaacctttcatgtgacaggctggaaaaccggttactgtgttgcttcacctgatttaatgcgtttgttccgccaaatttatcaatatgttaatttctgtggcacaacaccatgtcagattgctctagcgcaatatatggagcaacatccagaacatattcaagagctgtctcagttttaccaaacgaaaagagatcgatttaatcaggcaattcacaatagccgttttttactaaaaccatctcaaggtacttatttccaaaaccttgattacagccagattaaacctgacttaaacgatgtagaaatgtgccagtttcttgccgagcaacacaagattgtggctattccagtttcggttttctaccagcaagcgcctgagtctttacgcttgattcgattctgctttgctaaaaatgatgagactctgcaaaaagcaggagaaattttaaatcaatgttaa

SEQ ID NO: 957 - DNA, 1377 bp, Acinetobacter baumannii
gagaaaaatatgaatcatcagcaaaagaatgcgatttctccagagcatgaatatttaggaatttccaaaagttttgcttacggcttacagcatgtgctcaccatgtatgggggcattgtagccccgccactgattattggaacggcagctggcttaagcgcagcacaagtcggaatgctcattgcagcagccttatttgtaggcgggttggcaactctcatacaaactatcggaaccaaatatctaggggcaaagttacctctggtgcagggtgtgtcttttgctggtgtggcaaccatggttgctattatcactacaggcggtggtttacctgctgtctacggcgcggttattgcagcctctctaattggactatgccttgcaccttacttttcaaaaattattcgttttttcccacctgttgtgacgggatgtgtcatcacgattattgggttatctctgttacccgttgcgattcgctggatgatgggtggcaacaataaagcacctgattggggtagcgtcgagaatatctctttagctttgctgaccttaggcattgtgattattctaaatatgctgccacaagcaagtattcgccgtttatcaattttgttggctattgttgctggtactacccttgcctactttatgggttttggagattttagtcaggtgagctcaggcgcatggctgcaatttccacacttatttgcatttggtttaccaacttttgagctaagtgcaattttatcgatgctaatcgttactttggtgattatgacggaaactacagccgatattattgctgtcggagatattgtaggaacccaagtcgattcaaaacgcatcgccaatggtgtacgtgcagatatgttttcaagcgctattgctcctatctttggttcattcatgcaaagtgcttttgcccaaaatgttggactggtggcaattacaggcatcaaaagccgctttgtcgtggcagcaggcggagtcattctgattattttaggtctattacctgttatgggccgccttattgcggcaattcctatgccagtacttggtggtgcgggtttggtcttatttgggtcggttgcagcaagtggaattcgcactttggcaaaaattgattataacgatcagaaaaatttgattattgtagcaactgctttatcagctgggatgattccaattattaaccatgaattttatgctcatttcccagtttgggtacaaactttgttccattcgggtattagttcgacttgtatctttgctatcttattgaatttgttatttaatcacttaccttcatttcgcagctcgcgtacccctcatttaagccaaacaataaacacacgaaatacacattaa

SEQ ID NO: 958 - DNA, 1320 bp, Acinetobacter baumannii
gatgaccgtatgaatatggcagaagaagtacaccatgcacccaatctgaagcgcagcaaatatttcgctacgatggcacttattattgtggtggtgctgtggattgggttattgatcgccaatcgctttctgccagagtacacagacttaattcatattttaatgctaggtgcggaagctggtgtagtgggtggactagcagattggtatgcgattaccgttctgtttcgaaacccatttggtaagcttcccatccctaagtttttgcgtgatcataccgaaattattccacgtaataaggcacgtattgccgaatcaatgggtcgatttgtgcaggaaaacttcctgtcgcctcaggtggtcgaacgaagcctagaaaaaaccgatttaagtcttgcgattggccaatggcttgccagtccacaaaacaatacgcaagtggtacaactcattcagcaaactgtacctaaagtttttgaatttgttagtcaagaacaaattgccaatttcgtgcaaaacaacagtgtgcaatgggtgcgtaacactcaagtcaataaacttgcgagtgaaatgctgcgtgcagtattggaaaatgatttccaccaagatgtactgcaacgtggtctcgatatcgcgcatgagtgggtggtacaaaatccggataaaactcgcgaattgacaagaaaaatgtttaaagcgctgggggtctggtctcttgcaaaaggtgcaagctggatcggtattgatgttcagcagcgcaccattgattcactggttgaaaaagtagaatcaatgctggctgaccatgaacacccatggcgacaggaaattgaaactattgcccactcgctcatgctggagttggcaaaccctgagagtattgccagccaacgtctaaatagtggcaaagatgcgttgctagatagtcctcaagttctaaatttcattagtggtgctgtcactattttatgtgatgccattaaagaagatttaatgaaagaagactctggtattgcaatgaacctcagagctgccattcagcagttgggtgaaaatcttgtccaaaatgtaaaagtacgtgaagttctcaacaaagaaatgacaggacttgccatgaactttacggaccaatatagccataaaatcatacgctatgtgagtgagcgcattcatgagtgggactcacgtgaaatgattggaaaaattgaaaacgaagtcggtggcgacctacacatgattcgtgtgaatggcgttgtagtaggtgcatttatcggcttaactctaggtgtaatacgagcagcgattgaatcaattttataa

SEQ ID NO: 959 - DNA, 1233 bp, Acinetobacter baumannii
agtcaattcatgcgagaaatcattcttatatcctttttaggaccggaccaaccaaaccagtttacccgattaatgcaagtactatccgtacattcattgcaaatactggatgtaggtcaggctgttattcataatcaactgacattgggcattgtggtcgcctctgaaaatgaaaccgcgaccgcgttggcaatgaaagagattttgattttagcacatgatattggcttaacagtgcgctttaaacctatctcgggcgcagaatacgatcaatgggtcagcgaaggtggacgaactcgttatatcgtcacggctttagcaccggaactcactgccgcacatttacaagccgttacacaaattgtgtctagccaaggctttaacatcgaaactgtaactcgtttatcaggccgtgtagatcttgaaaaagatagcacattgcctcgccgtgcttgtgtacagtttggtttaagcagtggtccgactttagatgctcaagctatgcgtgcagcttgtttgcttctttcaagcgaattaaatattgatgtggctgttcaggaagataacgcttatcgacgtaaccgccgtttagtctgtttcgatatggattcaactttaattgaacaagaagtgattgatgaattggcgcttgaagcaggggtgggtgagcaagttgctgaaatcactgaaagagcgatgcaaggtgagttggacttccagcaaagtttccgtgcgcgggtcgctttactcaaaggtcttgatgcgtcagttttacctaaaattgcagagcgattgacgatcactgaaggtgccgagcgcctcatttcgactttaaaagcactgggatataaaacggcaattttatctggtggcttccaatattttgctgaatatttacaagctaaattaggcattgatgaagttcacgctaacgttttagatgtacaagatggcgttgtgactggtgaagtaaaaggtgtaattgttgatggtgcacgtaaagcggagttgctgcgtgagctggcgaacaaactcggtatttcactagagcaagcgatggctgttggcgatggcgcaaatgatttaccgatgcttgcgattgcaggacttggcgtagcatatcgtgctaaaccactggtgcgtcaaaatgcaaatcaggcgatttcaagcgttggtttggatggagtactgtatttactcggtatgcatgacaaagatttaagccgtgcttaa

SEQ ID NO: 960 - DNA, 555 bp, Acinetobacter baumannii
gagatggtcatgttaaccacccaacagcaggctttaattaaagccatagaagaattagaactcgcgcaagtacaaaaattacttgctgagggtcttgatccgaatttcattgatccggaacaaggaccgccagtgtccattatttgtgatggaatttttaaatggtgggaagacgtttctgaagcgtatgaagcggggactccattatcacaagaagaaaaacagcaagccctgcaagtttatctcgatattcttgaagccctcattcaggcaaaggcaaatgttcatctttgggatgcagaagagttttatggtccactatgggatgcagcaagttcggcatgtgcaccagcagttcagcgcttgctagatgaaaaagttgatccaaacacacgtgatgaagaaggactcaccattttatcttcaatcagtcagttgttctttgattgtgattttgatgaaatagattggtcagaagcgcttcaagaagagcgtgaaacactagagttattgcgccgtcacggagcaaaaatgtcaaaagaattaactacttga

SEQ ID NO: 961 - DNA, 864 bp, Acinetobacter baumannii
aaagtaaccatgacgatgacactccctgattttaaactcgatttattaatagaagcagaagagttagtgccttatttaggcaatgaatatatccgtattgttgatttgagccgtgcatcagtttatgagcagctccatgttccgcatgctattcacttacagcctaaatggttagttgctcaacatgaagaagcaacaggtgttttaccggatgaagcaggtttacaagcgcttattgaaaaattgaatatttcaccaaatcaccacgtggtggtctatgatgatgaaggtggagcatgggcagggcgtttaatctggaatctccattgcttaggttttacccgtacaagtttaattaatggcggaattcatgcatggcttggtgcaggtttacccaccacagctgaggttgaagaacttcctcgagttgataacttaattcagatcgatttatcacatgctgctcagttcagagtgaactatgaagaactacgcaaacaagttgagcaagaaagtgtgcaactctgggattgccggacgagtgatgaatatagtggcgtccgtttagcagcgcgacgcggtggtcacattccaaatgccctccattttgaatggagtactgcacttaatcgtcaaaatcatctaaaattgcatccgcttgaacgcacgcggcagcgtcttgaacaacttgggttcgatttaaaacaacctgtagtcgtatactgccagtcacatcaccgttctggtttggcttatattctggctagacttttaggttgggaagcaaaagcctatgatggtgcgtggagtgaatggggcaatcgcctcgatagtcctatcattactggagaatcgccgtcttga

SEQ ID NO: 962 - DNA, 1470 bp, Acinetobacter baumannii
aacggtcacatggagtggccgaatccaactaaatttcctcaaggattggagattataatgtcacaaaactccacactacagcggggcttaaacacccgccacattcgtttcttggcattgggctcagcaattggaactgggcttttctatggttcggcaactgctattaaaatggcagggccttcagtattacttgcgtacatcgttgcagggattgcaatttatattgtgatgcgcgcactgggtgaaatggcagtccataaccctgtctctggctcatttagccactatgcttctcagtacattggtcctttggccggctttacgacgggctggacttatgtttttgagatggtgattgttgcaattgccgatgtcactgcgtttggtatttatatggggttctggtatcccgatgtcccacggtggatctggattttgtctctcatcatgttcttgggcgcgattaacctcattcatgtgaaagtctttggtgaactcgaattttggctctcaattgtcaaggtgagtgccattgttgccatgattttaggtggcttaggtttgatgttctatggcttccatgctgaccatagcagtgtagtgccagggattcaaaacttatggatctatgaaggctttatgccacatggcattgcaggcttggttgcatgtttatctgtagtggtatttgctttcggtggtatcgaaattattggtattacagcaggtgaatcacaagacccgaaaactactttacctaaagcaattaatgctgttccggtacgtattttacttttctatgtactgactatatttgtactcatgtcgattttcccatggaaccagattggtagccaaggcagcccgtttgtacaaatttttgaaaacttaggcattaaatctgctgcaaatattttaaatattgtagtggtaactgctgcaatttcggcaattaacagtgatgtgtttggtgcaggccgtatgttgtatggtatggcaaatcgtggccaagcacctcgaatcttccaaaaattatcgcgtaatggcgtgccttggatgactgttgtggttatggctggcgtgctgttaattggtgtggtgctgaactacctgattcctgaaaatgtgtttgtcatcattgcatcaattgcaacgtttgcaactgtttgggtatggctcatgatcttgctttcgcaagtggctatgcgccgtaaattatctactgctgaaattaaggcacttgatttccctgtatttggctggccatatgcccctgcttttgcaatcggttttatggtgttcattttagtgatgatgggctacttcccagattcgcgtcctgcaatttatgtaggaatcacttggcttgctctcttaactattgcttatcgtatttgggtaaaaccagagcaaagcttgggaaaggaaagtgagcctgtccagcaaaacatagaaatggaaagctaa

SEQ ID NO: 963 - DNA, 1500 bp, Acinetobacter baumannii
tcttttaacattaggtgttctatgacagatactcgtgaaaactggacgtcacgatctggttttattattgcagccgttggttcggctgtaggcttaggtaatatttggcgctttccgtacgttgcgtatgaaaatggcggtggtgcgtttcttattccctatctattagcactcattactgctggtttaccgttattatttttagattatgcggtaggccatcgtagtactggttcacctcctaaggcatatcgtgccttatttaaaggtggtgaaacattagggtggtggcaggtttgtgtctgtatcatcattggtttgtactatgcaagtgtacttacatgggctggtagctatgtttacttctctattggccaaatgtggggaagtgatccggaaggtttcttctttaatacctatttacagaccacaaaagcaaccggttttgatttacagtttgtaggtcatttattctggccgattgttgggatttgggcacttactctcatcattctttatggtggtgtgaaaaaaggtgtggaattatcaaataagattttcatgcctttattattcattctcttcactattttagttattcaatcgttacgtttaccaggtgcggtacaaggtttaaatgcattctttacaccgaactggtctgcaatgatggattataaagtttggttagctgcctatggccatactttcttttcactctcagttggtttcgggatcatggtcacctatgcatcctatttaaaaccaaaaacgaatttaactggttctggtttaatcgttggttttgcaaatgcatcaacagagattttagcgggtattggtatcttcgcagcgcttggctttatggcacatgccgcaggtactgaagttaaggatgttgtgagtggtggtatcggactcgcatttattgctttccctaaaattatttcaagtttaggttctggtgctgatctattcggtcttttgttcttctcttcattatttgttgctggtatttcttcaatggtcagtattttggaagtgcctattgcagcaatgcaagataagttaaagtggggacgtaagaaagcggtaacgattattggtggtggtagtgcactggtttcaattattttattctcaagtgtaaacgcaattaagctcgttgatattgttgatcactttattaataacattgggattattggtggggctttattatcaattattagcgtagcttggtttaaacgttcagcacttaaagagcttcgcgaccatgtaaaccgtatctcaaccattcaattgggtaaaggctgggacttcactttaacagtcattacctctttaatcttattaacaacactctgtatgactgtttttaatttgatcaaaaatggctatgatacttatagtatgagcttacaaggtgtcttcggctggggcagtgtgattttctgtgcagtcgttgctatcgtgttaagtaaaatgaaagatcgctag

SEQ ID NO: 964 - DNA, 1548 bp, Acinetobacter baumannii
gaagccaacatggaattactgatccaaccgggaaaactgaccttagccgatttacgtcaagcttacctcaacccaattaaagttaaattagatgaaagtgcttcatctgcaattaatgcaagcgtggcttgtgtagagcaaattgtaaatgaaggacgtacagcttacggtattaatacaggttttggcttacttgcttcaactaaaattgcgcctgaagatttagaaaaattacagcgttcattagttctttcgcatgccgcaggtgtaggcgaagcacttgatgatgcaatggttcgtttaattattctattgaaagcaaatagcttggcacgtggtttctctggtattcgtcgtaaagtcattgatgctttgttggccttaattaatgctgaagtttacccacacattccacttaaaggttcagtaggggcttctggtgacttggcaccccttgcacacatgtctttggttttacttggtgaaagtaaggcacgttataaaggtgaatggttaccagcagttgaagctttaaaaattgcaggtttagaaccaatttctttagcggctaaagaaggtttggcacttttaaatggtacgcaggtttcgacagcttacgctttacgtggcttatttgaagcagaagatttatttgctgccgcgacagtttgtggtggcttaagtgttgaagcaatgcttggttcacgtgcacctttcgatgcgcgtattcacgaagtacgcggccaacgtggtcaaattgatgtagctgcggcttatcgcgatttattgactgattcgagtgaaatctctcgttcacatgaagaatgtggcaaagttcaagacccatattctttacgttgccaaccacaggtgatgggtgcatgtttaactcaaatccgtcaggctgctgaagtattagaaattgaagcaaatgccgtatctgataacccgcttgtgtttgctgaacaaggtgacgtgatttctggtggtaacttccatgcagaacctgttgcaatggcggccgacaatttggcattggcaattgcagaaattggttcactgtctgaacgtcgtatttcgatgatgatggaccgtcatatgtcacagcttccaccgttcttggtagcaaatggtggtgttaactcgggctttatgattgctcaggtaaccgctgctgctcttgcgagtgacaacaaagcgcttgcacatcctgcaagtgtggatagcttaccgacttcagccaaccaagaagaccatgtatcgatggctccaaatgctggtaaacgtctttggtatatggctgataacgtccgcggcattttagctgttgaatggttaggcgcttgtcagggtctagacttccgtgaaggtttaaaaagctcgcctaaacttgaacaagctcgtaaaatcttgcgcgaccaagttccttactacagtgaagaccgtttctttgctcctgatatcgaacaggctagtgaattgcttgcgagtggttgcctaaacgagttactcattccaaaactactccctagtttatctgaagtgtga

SEQ ID NO: 965 - DNA, 555 bp, Acinetobacter baumannii
cttttgagcatttgggttcagattacccattgcaaattcatggataccaacactttgcataaaccgccgattcattttaaagacatgtcttggttcaaccgctgcatcgttttctgtggggttggttttggatctggtcttgctcctaaagcacctggtacttttggctctgctttcgccttactttttgttcccatctggttatctctcgggtttactttaagtttaatcgctattctcatcatgtcagtggtgggtatttatatttgcggtcaaactgcaaaagtaatcaacgtacacgatgatggtcgaattgtttgggatgaatttgcaggtcaatctattacctttcttcccctactctatttacaacaaataaattggatttgggtaattacaggatttatattatttcgaattttcgatgtttggaaaccttggcctatacgcgtcattgatcgccaagtacacggtggttttggtattatgcttgacgatattattgccggtgtatgggctgctctttgtacactaattattatccatttgagttaa

SEQ ID NO: 966 - DNA, 1026 bp, Acinetobacter baumannii
tcagtcataatttgcataattgtcattcaacaatctgttattgttagaactggacaatcaaaatactgcaaccatcccacattttgtttttcttacctcagattcggatggataaataggatattttttaaaatgactcagcaagcacagaccattcaaggctcaatcgtcgcaatcgtcactcccatgttgaaagatggcggtgtagattggaagagtcttgagaagctggttgagtggcacatagaacaaggtacaaacagtattgtagccgtcggtacaaccggcgaagcctcaacattgagcatggaagagcacacacaggttattaaagaaattattcgtgtagccaacaaacgtattccaattattgccggtactggtgcaaactcaacccgtgaagcaatcgaattaactaaagctgccaaagaccttggcgcagatgcagctttacttgtaaccccatactataacaagccgactcaagaaggcctttaccaacactataaagcgattgctgaagctgttgaattaccgcttattctttacaacgtacctggtcgtacaggtgtagatttgtcaaacgatacagctgttcgtttagcggaaattccaaatattgtcggcattaaagatgcaacaggtgacgtaccgcgcggtaaagctttaatcgatgctttaaacggcaagatggctgtgtactcaggtgatgatgaaactgcatgggaacttatgcttcttggcgcagacggtaatatctcggttactgcaaacattgcacctaaagcaatgagcgaagtatgtgcggttgcaattgcaaaagatgagcaacaagcaaagacgcttaacaataagattgcaaatttacacaatattctattttgcgaatcaaacccaattcctgtgaaatgggcactacatgagatgggactgattgatactggtattcgtttaccactcactcctctcgctgagcaatatcgcgaacctctccgcaatgccctaaaagatgcgggaattatttaa

SEQ ID NO: 967 - DNA, 330 bp, Acinetobacter baumannii
gcaatatcaatcaaaccacttaaaactacaattaaattgctagagagcatgggaataaataatttaaaaatctggttcatcaaaaaaatgccttattttttttctttgcgatttatgtcgatattcacgttatttttagtgcatcaattcgaagcaaaagacataccagttttaaattcagctcaaataaaaagtgctttaaataaaaagaccaaactatccgtttggccttcttttgtcatgtatgttgtttatacagttattcttgtttgtgtttacttgcccaataagtcgcaagtgcaggacccgaaatattatgccaaaggctga

SEQ ID NO: 968 - DNA, 2157 bp, Acinetobacter baumannii
gggctgaaaatgaataaaaaatcattagttacaatacaaatcttagatttatttggtagcccaatttcaaaagcacaatatgaagtaaaaaatcagagaacggggcaagttatcgctgctggaacaacaaactcatctggatgtattgttgaaatcagccgagataaaggaactgctttagatgtatatattaaaagtatgtttaaaggctcaatggttaaagtacaaagttttgtaatgtctaaagaccgaatggtcgtaaaaattacaagtcccaaagtacttttaaatttaaaaacattaacaaatcaaggtaataatgggcaatataaaagaaaaacacatattgttaaaaagggtgatacgctatttgaaatagcacaaaaaaatcatacgaccgttcgagcactagaacgtttaaataaaatagacgatccaaataagattagtattggacaagttattaaattaccagttcatattcctgcttctggaaatcattcacaccaagacaaacctaagcacaagcactcagctcaatctacaaataaacctactgcgagcagtacaaaaactaccccagctccagcagcaaaaaggccagctaatcctgcttctcaaacaaaacaagaaaatgggcttccagaaaaagcacatcaactttatgaagatactaaaaaagcattgaatgaagctgcaagttcagtttctaaaattttgactattgatgatcgtagtcaagatggaggtactcctaaagcaaatactacaaatatttgtaaaaccaatcctcaatgtatttccagtggtaaaagtgagttaatcagagaagttaatattcgtttagcaggttttggtggagcattaccaacagatgaatttacagaactgactgcaacatgtattagacaattccaacgggattatatgggggttccagacactgggaagatttgtggttctgttttagttgctttagatcaattttatgatgaataccccatttctagcttcatgggaaaagctgcatgtaattgtggtaagtgttctggttttggaaatggaaagatgggagtgcaatcaggtataaatactgctaatgaatatccaggtattcatagatctttaatctggatattaaaatccttaaatttttatttaaaaaatgaatttaaagataagaagattaatgtggcatatatagaatctggttatagatgcattgaaaataataagaaacatgagagaacatctgtaaaccatatggggctagctctggatatacattttcataaaaatggagttagaacacgagaattaagtgatatggaatttattcgaaaaaatattatggcaaaaaaaatgggggcatctgaacaaagaatcagggataaaatttatttagaacctaaagtctttagaagtggagaggctggtgcaacttcttgggtgcattttgatattacaatgtttctagctaaatattttaataataatatgtttaaaacaaaagtaagtgacttaaatggagttaaactagttaatcttgcggcttcgtcacgtattttaagttgtgggggcatagttgcattaccaaaatctcaaaataatataacagatgaactagtattaagtaatgaagatattatagacattatgaaagtaaccgaaactgaagttataaaatttaagacagaaaaatattttttagaacaagcggctggcgttgtcgatactattatgaatagaactaaatcaggagtatggggaaatagtgtaagaaaagttgtgaatgctgataggcaattttctaaaattactggaccgaagagtttggacccatatggtagcgttgaaaatatgcctatgtcgcatgtaagcagaaaagttagaaattttgttaatagttatcttttagagcgagctaacggaaaaaaatcaattattggagagaatctaaactatgcaaataaatattactcagatgaaaaaaacagaaaagcttgggtagataaatttcataatgaggcggtgaaaaatggtatgatacttggtacaggtaaagctatacatgcccacggaacggttcgagagttaagagataaaatgccaaaaccgtttaaaattgttctacctaaggatttcaaaggaatttaa

SEQ ID NO: 969 - DNA, 408 bp, Acinetobacter baumannii
gctatggaaatcaactcagagagtagcaaaccaatgaaattaaaagttatattgttatttactattgttttagcaggttgccaaccacaaccaaaaaatgaacagcacagacacacggtttgccaaagtttgattgaaggttatttaaaaatgaccaaccagcaagactacaaaatggagcaacgcactgatgacgagaccagtgcgatttctcattatgaatataaacgtaatagctcaaatgaagttgttatggtgaattcagtctattccaaactatattttagctgccgagaacatcaaaaaagctattttctgtctcaacattcatcacaaggacaaacgactccacttttagaagttcattttccaactgacagttacactacttttagagagcgtttttaa

SEQ ID NO: 970 - DNA, 1824 bp, Acinetobacter baumannii
ttattattgatgaaaaagcttatttctcagggaattatttattttctagtagccgctacttttgtattgagtcagtttgtctttgcagaagataagttattgtcacccgaacaggctttttcattttcggttgaatcgccacaatcgcataccgcaaagttatcgtggcagattcagccgaattattatttgtatcagcataaatttaccgtacaacagggcaatcagcctttaactttaaatttgcctaaagcggtttctcaatatgatgagaactatggccaaagccaagtttattaccatcaagtcaacttccagattaaaaccaagccttcagagcactacacagtaacttggcaaggctgtgccaaagaccgtatttgttatcctccacaaactattgagtttcaaactgacgcagatggtctggtcggtctgcaaaatcaggcaggtgcagcaccaaaacgcttattagatttggtaaatacccaagcatcaaactctacggagcctttagaaaatcagagttcagctactcaagctgaaggagctgctccagagattgcccaagatcaggtttggtcagcaaagttaattgaacactcgctttggtatggtgttttattattttcaggtttaggcatgctgcttgcatttacgccatgctctttaccaatgctgccgattttaacttcattaattatccgagatcacaaaggtttaaaagcttggacgattgcacttacttttgtgtgtagtatggcattggtctatgcaggtctaggcttgattgcttcttcagcgggtttaaatttccaacgctggctacaacagcctgctactcttattgcgtttagtttgttgtttgtggtttttgcgctaaatctgtttgggctttttgagcttcggttaccgcaaacttggttaaatcgacttgaccgtattcagtctatgcaacaaggtggcactttagtaggtgctggagtcatgggtgtggtttctgcgctcttggttggcccatgcatgactgcgcctttagctggaactttattatttatttctcaaacgcaaaaccaatggcaaggggctttgcttttattctgcctaggttttggcatgggaatacctttactcatcgcgagtgttttaggtgcaaagttcttacctaaagcgggcgactggatgcatcagattaaagtgatttttgcttttctgatgttggggttaagcctttatttcattcgccctttattgccagattggggcatgcaagtgcttagtttattgctagggctggcttttattatttatgcgctgtatcagtttttttggaaaaaagggcagttacagtggctttatgcgctcctacttttattggtaacgccatttgtggtttataaccagtatcaacatattcaaaatcgtagcttacaaaattctgagtatatggctgagtggcatgtggcgaccacggcagcagactttcaaaagattttagcagcagctcctacagatcgggctattgttgttgatgtctatgccgattggtgtgtggcttgtcagcctattgaacatcgtattttaaaagcacctgaggttcaggcggctcttgcgccttactatctcattaagcttgatttgagtcattatgaccagtcacatgaagcattgctcaaacaatggaatattcttgggcctcctacatatctctttttaaacaagcaacagcaagaaattcgttctttacgtttaacaggcgcatttagtcagcaagagcttttacaacagctgggaagcttatcaaaagctaaagattcaaattga

SEQ ID NO: 971 - DNA, 606 bp, Acinetobacter baumannii
gtacctatgataatctatggtgatgtagattcaggtaattgttataaaatcaaactgttactatccctattaaatataaatcatagatggattcatgttgatattttaaataaagatactcaaacagcagagtttctatctttaaatcctaatgggaaaatacctgtcttagttttagatgatggacgggttctaagtgagtctaacgctattctaggctacttggctgagggaacggaattgattcctgcagatccttatatgaaggcaaaaatgtaccaatggatgttctttgaacaatatagccatgaaccgtttattgcagttgctcgttttattaataaatatctaggtttaccgccagaaagaatagaggaatatcataaattacaacccaaaggccataaagcattatctattatgaataaagctttagtagggcacgactatcttgttggaaataaatttacaattgctgatattgctttatatgcatacacgcatgtagctgaggaaggcggcttcgatttaaagttatacccaaatattcaagaatggtgtcaacgaattcaaaaatatccaaaatatgtgagtatggttgaataa

SEQ ID NO: 972 - DNA, 591 bp, Acinetobacter baumannii
aataccaagataaatataaggagcatcatcatgaaaactcaacgctgcggatggtgttccgatgatccactctatattgcttaccatgatgaagaatggggcaaaccagaacacgacgaagcccgattatttgaaatgctctgtcttgaagggcaacaagcaggcctatcttggattaccgtactaaaaaaaagagaaagctaccgccagcacttttttaatcatgctattgctgacattgccgcatttacggatgactttttagaaacaaaactatccgatgcaggcttaattcgtcatttaggcaaactcaaagccattcgcgataatgcgattgcttggcaagcccttaaagctcaagttggtgatgtttctaaatggctttggcagtttgtagatgccactcctcaacacaatgatgttgcagattatcgcaaggcccctgctcaaactgagctcagcctaaaactttccaaaacgcttaaaaaaaatggttttaaatttgttggtccaaccacctgctatgcatttatgcaggcagtgggtatggtcaatgaccatgaaaatgattgtcaatttaaagcttcataa

SEQ ID NO: 973 - DNA, 222 bp, Acinetobacter baumannii
aggctaaagatgaaactttatcgctatttaactggacctgatgactctgctttttgtgcacgagtgactaaagcacttaattatggttgggagctctatgaagcacctactatgacttttaatggctctcaagtcattgtaggccaagcgatttgcaaaacaattgacgaaaattatgatccagaaatggatattttagatgttctcaaaaataatgcgtga

SEQ ID NO: 974 - DNA, 978 bp, Acinetobacter baumannii
tgcttggactttaattgcgatttggtatggatgaacagtatgtctgcattactccgttttactcagtttgttcaaaagacgtttgccctatgggtaattatttttgcagctctagcgctatggcagcctgaattttttgtttggctgaaagcttatattccatggattttgggcattattatgcttggcatgggaatgaccatgaccgttgatgattttaaaggggtactacaaagccctaaagccgtgttaattggggttgtcgcgcagtttgtggtgatgccgggcttggcatttattttatgtaaattatttaatttgcctcctgaaattgcggtcggcgttattttagtcggttgttgcccaggaggaacagcttcaaatgtcattacctatatggccaaaggcaatgtggctttatcggtcgcctgtacctcggtatcaacactcttggctcctgtgttaacgcctacaattttctatctacttgccagccaatggctaaagattgacgcggcttcgatgtttatttcgattttgcaggtcgtactacttccgattgtgattgggctaattttgcgaacttggcttaaacgtcaggttgaatcctatattcaagtcatgccattagtttcagtgattgcaattgtagcgattgtggcagccattattggtggcagtaaagcagctattttacagtcgggtttgctcattttggcggtagtgatattgcataatgggcttggatatttattaggttttgccgcagcgcgtttcttcaaattgccttatgtggacagtaaagcaattgcggtagaagtaggaatgcaaaactcaggcttaggcgtggcgcttgcagcagtgcattttgcggcttctccgattacagcggtaccaagtgctattttcagcctttggcataatatttcgggtcctgcacttgcgacttattgggcaagtaaacacaaacaagaataa

SEQ ID NO: 975 - DNA, 192 bp, Acinetobacter baumannii
tcgggcttcgtcgtgttctggtttgccccattcttcatcatggtaagcaatatagagtggatcatcggaacaccatccgcagcgttgagttttcatgatgatgctccttatatttatcttggtattttagagtttgaatggtacccattcatttgggcgagtatcccaataatacagttcagcttgagttaa

SEQ ID NO: 976 - DNA, 1314 bp, Acinetobacter baumannii
gatttatttttagaggcactactcatgtcactgctacgccgttggtttgaccctatccgatcgagctggttttaccaaaagccttctcgtcaagcggtgttacccacggaaaatggtttaagtatttatttacgacttgatgatgtgtatagctatctggctgttcagcaattgtctcagctagatgaaattttaagtgatgaacttaaacctttaaaaattattatttcccatacggcttctgaacctccaaatagcatgacgcatgaggagtggcagcattattgtttaaatgatgccaaaattttagcaaatcagcaccggtttgcttttgatgagtttccagaaatcccaagtccagaatctttaaaacaagccgctgtcatattaaaaagaaccccattacaaggtcagaacttcttacatttacttgaagatatctttcacatgctttggcaacagcaatatggaaaattgcgtactctacatgccatggcggtcaagcatcaggttcctcagcattttccagaacgtatttttacggatgaacctgttcgagcggcatactttgagtttggtggacgtaaatatcatgcagtagatgatttattacgtttaaccagacgtttaaaacaacaaaagttactgacaggtaatccgatatttttaattaatcatatcgaatggcgtgaacatttgattaatgatgctgaggcgttaaatgaaattcaggctttgcatcctgaacttgatgtatttatcgctttagaagacccgatgagctggttgttgcttgcctatattaaagaagagctcgcagactattatgatattcagctaaaagtttatcctttgagttatcggggccgagactggtttgactggagcttggcaacacgtgtgtctaaacgtaccgaggttgcttttacacctttttgccgacctacagaagaaagtacgcttgggatggcaaagcttttctatagtgtgccggaaaatcagcaacttgatacaattttcactattttgcaggctgtttggacgaaaggaaaagatctatctttccagaagcatttccaacaattacagcagcaactgggtattgagcagttaactgaacaggatatacagtcggttttagcgcaaaatgatgcactttgccaagacaagcatcaacctgatttgccggttttagagttgcgtatcgatgggcaaagctatgtatttaatagcctgtatcgggtttggatgattgaaagtatttttagcaatgttttagaagaaaaatacaaaacggcctcaacttctaattga

SEQ ID NO: 977 - DNA, 2787 bp, Acinetobacter baumannii
atgttattttttaagcaaaaattcacattttcttacgctcaaagcttggaatgttcgttaatcgcgctatattcgaaaagaataagaacaggagaaaatagcatggttcagcaaatcgatgcgccactgcgtgaggatgtccgcttacttggcaatttattaggtgaaaccctaaaacagcatgcaggacaagaactgtttaatcagatcgagcaaatccgtgctcttgccaaaggtgcacgtgatggtcaagctgaagccgaaaagcaattagaacaattatttttagaattgcccgatgaagagctattgcctcttacccgcgctttttctcacttcctcaattttgccaatattgctgagcaatatcatgtggtacgtagccgcagacaggcagagtttgatccagatgcaaactccccgaatccccttgttcacttatttaaaaagtttaaagataaaaatatttcgacagaaaaactgttccagcaaatttgtgatcttaagattgaattggtacttacggcgcatccaacagaagtgagtcgtcgtaccctgattcaaaaatatgacgatatcaatgcttgtctatcacaacttgaccagcaaaaacttactccgcgtgaacgtcaaaatgctcttgccaatttaaaacaacaaattagttcagcttggcaaacagatgaaatcagacagcatcgcccgaccccggtagatgaagcaaaatggggctttgccacaattgagcaaacgctttggaatgctgttcctaaatttatccgtgagctaaatgaactggtccaagacaattgccaacaaaacttaccacttcatattgctccagtacgttttgcatcttggatgggtggagaccgtgatggtaatccgaacgttactcatcaaattacccaagaagtattgtggttatcacgctggcaagctgccgacctctatctaagagatatcgaaaacttacgttgggaactatcaattcagtcttgttccgaagaaatggttgaagccattggtagccctcatccagagccttatcgtgagtatttacgtgcaacacgtgagcgtttaaaagcaactcgtcattggttagctcagcgcctacaaggcttagaagctgatgacagcaatgtcattaaaagcaaagatgaactgttacaaccattattgctgtgctatcgctctctaattgacagtaatctgcctgaaatcgcgaatggtcaactactcgattttatctaccgtgtgaactgttttggtattgaactgcttaagctcgatattcgccaagaatcaggccgtcatcgccaagccatttcagcaattaccgaatacttaggtctgggtaattttgagtcatggactgaacaagcgcgccaaaatttccttattcaagaactccaaagcaaacgcccactactaccgaagtatattaatgagccagaaggtagtttgattggtcacccagatgtacaagaagtatttgcaaccatgcgtactttggcagaccaaccacctgagtctttaggggcttatattatttctatggctgaatatccaagtgatgttttagctgtattgttattgcaaaaagaagccggtattcagcatcctttacgtgtagttcctttatttgagactttaaaagatttagatggcgcagcaactaccatgaatacgttgtttaatatgcattggtataagcagcacattcagggtaaacatgaagtcatgatcggctactcggattcagcaaaagatgccggtttcatgtctgctaactgggcccaataccgtgctcaagaagagttgactgcaattgctcgtaaacacggcgtacagttgactctgttccacggtcgtggcggctcaattagccgtggtggtgctccaacgcaacaagcactcttttcgcaaccaccgggctcaatctctggtgcaattcgtgtgacagaacaaggtgaaatgatccgcttcaaattcggtctagaaggtattgccatgcaaaaccttgaaatctataccgcagcaacgcttgaagcgacattattaccaccaccagagcctaaggctgagtggcgtgaacttatgaaccgtatgacagatcattctgtgaaggtttatcgtcaaacagtgcgtgaaaacccgcattttgtgaagtacttacggactgtcactcctgagcttgaattacaaatgttgccgctaggctcgcgtccggcaaaacgtaaagtaagtggcggtatcgagtctttacgtgccattccatgggtgtttgcttggacacaaatccgtttgatgttacctgcatggttaggtacaggtgcggcgattaatgaagtgattgctgatcagcaaaaagcaacgcttgatgaaatgcttcagcaatggccttatttccagacactcattgatatgctggaaatggtattgtctaaagccgatgccaatattgcactctactacgagtctcatttgactgaagatgaagacttaaaagtgctgggcaatcagttacgccaacgtctaaaagatgctgtggaaaccttgcttgcgttaaaagatgaatcaaaactattaagcgacaatgaagttttggatcagtctatgcaagttcgtaaaccgtatttactgcctttgcatcttttacaagctgaactcatgaaacgccgccgtgattatcttgctgaacgtcaggcagagcatacccctgttgaccatgcacttatggtaagtattgccggaattgctgctggtttacgtaatacaggctaa

SEQ ID NO: 978 - DNA, 1008 bp, Acinetobacter baumannii
gaaaaacgagtgaaaaatctcagctatactcatgctaatttaaattttaagaagagcttgagcatgcgtgtacttgtcgtcatggatccgattgaaaccgtaaatctgaaaaaggattcaaccatggcaatgttgtgggcggcgagccgtcgtggacatgagttaggttatgcattacaacaagatttatatatcgatcaaggtaaggcttacggtctcatctctccgttaaaagttttcgaagattacaaccattattatgagttaggcgaaaagaaaaaagaatcaatcgcagcttatgatgttgtcctcatgcgtaaagacccgccttttgacatgaacttcgtctacacaacttacgtgctcgaacaagctgagcgtgaaggttcatggattattaataagcctcaatcactgcgtgactgcaatgaaaaattgtttgctacgcaatttcctgaattacaggtgccaacacttgtaacatcgcagcagagcttgattcgcgaatttattaccgagcacggtgatgttattgttaagccgcttgatggtatgggtggtatgggtattttccgtttataccaagacggtgtaaatattggttctaccttagaaatgcttacagagctaggtactcgtccaattatggctcagcgttatattccggaaattgtagaaggggataagcgtattttaatggtaaatggcgagcctattccttactgtctagcacgtattccgcaaaatggtgaagtacgcggtaacttggcagctgggggcttaggtcaagcgcgtccactcacagaaaatgacaaactcattgctgctaaagttggtcctttcttacgtgaaaaaggtttggtatttgtaggtcttgatgtaattgggaattatgtcactgaaattaatgtgacaagtccaacctgtattcgtgaaattgatgcgcaatttggtacttcaattgccgatgatctatttgatgtattagaagctggtcgtccagcataa

SEQ ID NO: 979 - DNA, 198 bp, Acinetobacter baumannii
tttagggtggtagaacgaaagagggttgacagactggtgcccatagagaccagcacgcacggggcgtcccccttccgtcctaccgcaaagaaagggggacgcaagggtctaacgacttatagtaaaactataatccgctatggggacttacggtctgtcaaaaccgtctggcaatgtaggccagcaacgagatattaa

SEQ ID NO: 980 - DNA, 189 bp, Acinetobacter baumannii
actcattctttagtttggctttctatttttcagccaagaacgctaagtatcagaaagatgcctcacttcgattttattaccattaatatagcttttaacatcaaaatttatactattcaactcatgctcacttttattatatattttcatctaactgttatatttttatattccacagtatttgagtag

SEQ ID NO: 981 - DNA, 1386 bp, Acinetobacter baumannii
gttaaatcattcgagttattcatgtcaactactgtcattattcttgctgcaggcaaaggaacgcgaatgcgttctcagctccctaaagtactacaacctttagctggtcgcccgctactaggacatgttattaaaacagcaaaacaactactagcagaaaacatcattaccatttatggacatggtggcgatcacgtaaaaaagacattcgcacaagaaaatattcagtgggttgaacaagcagaacagttagggaccggtcatgctgtacagatgactttaccggtacttcctaaagacggcatttcattaattttatacggtgatgttcctttagtccgtcaaacaacgcttgaacaactgattgaagcatcaaataaaaccggtattggcatgattactttacatgtcgataacccaacaggttatggccgtattgtccgccaagacggtaaaatccaagcgattgttgaacataaagacgcaaccgaagctcagcgtcaaattcaagaaattaacacaggtatttactgtgtcagcaatgcaaaacttcatgagtggttgcctaagctttcaaatgaaaatgcacaaggcgaatactatttaactgatatcgttgcgatggctgttgctgatggtctagaaatcgcctcaattcaaccagagctcgcatttgaagttgaaggtgtaaatgaccgcctgcaacttgcagcacttgagcgtgaatttcaaaaacaacaagcaaaagaacttatgcagcaaggtgtaacttttgctgatcctgcacgttttgatttacgtggtacagtaaaagttggtcatgatgtccgtattgatgtgaatgtcattattgaaggcgactgtgaactcggtgactttgtcgaaatcggtgctggctgtatcttaaaaaatacaaccattgcagcaggtactaaagtccaagcgtacagcgtttttgatggagcagttgttggggaaaatacccaaattggtccattcgcacgcttacgtccaggtgctaaattggcaaacgaagtacatatcggcaactttgttgaagtcaaaaatacaacgatcggtctaggcagtaaagctaaccatttcacctatttaggtgatgccgagatcggtgctgaatcaaatattggggcaggtacaatcacctgcaattatgatggtgcaaataaacacaaaaccactattggcgatgcagtttttatcggttctaatagctcgctggttgcgcctgtgactattggtaatggagcaacagtcggtgcgggttctgtgattacgaaagatgtggctgaacaaagtctctcctttgagcgtgctcaacaaatttctaaagcaaattatcaacgtccccaaaagcttaaaaaataa

SEQ ID NO: 982 - DNA, 735 bp, Acinetobacter baumannii
acagtgacatttctagcaattattatgatggtgtttgcctttgcgggcatgattaaaggcatgatcggcttaggcttgcctgcggtatcaatgggcttactcaccatcgcaatgagcccttttcaggctgcatctcttttaattgttccttcaatggtcaccaacgtctggcagctttttgccgaaggacatgtctgggcttttattcgccgtttctggacgttgctcgcaggtattgtggtgggctcaatatggagttttctacctaccttaagtcaaagtcatggtcaaagtagtgaaattttattaggttgcatgttggccttatatgggctttatggcctatgtgtgaagaaacttccgcatttaggaaagcatgagcgctggttatcacccattattggatatatcggcggggcagtgactgtagcaacaggcgttattattattcctattgtgccgtatttgcagtctttgcatttaaaacgtgatgagttggtacaggctttaggattaacgtttacggtctctaccatttgccttgctgtgtttttacaccataacccgatgtcaggaataacactggactatcgtttatctttcgctgcgttgttagctgcgctcattggaatgtggatcggtaaaaaaatccgctatcgactgaatgagcagatttttcgccgtatcttttttataggcttgatgtcattaggactttatatgattttgcattaa

SEQ ID NO: 983 - DNA, 918 bp, Acinetobacter baumannii
atttttgcatttcaatacgttcctatcatgcgttttgatttttttgatttacagctggttcttcatattgtctcgactggtagcctcaccaaaggcgctgaccgctctgcgatttcacttcaagcggcgagtgaacgtataaaaaaacttgaacagtattttgagactcctttatttattcgccaaaccacaggtgtagaactcactacagctggacatgcatttgtagaacatgctcgtcagcttttagctcaaaaagatcaactcgaacacgaaatgcagcggttcagacagccgacaacagaagcattaacactttggtgtaactcatctgctcaaagtgaatatctacctaccttattaccgcaatatctagtgcttcatcccgaaatgaatatcgatttgcatgaagcagaaagttcagaaattgtagatgcattaacccaagggattgcaagtcttggcctagtttcgagttttttcaatacccgacatttgcaaactaaagagtttgcaagcgacccattagtacttatttgccctgtgacacatgagttagcccactacaaagagctaaatttagtagatgctttaagctatggttttattggactcaaatcgcatcactctttacaacagtccattgaaacccaagccaaattattaggctttaatatacagtatcggttgcgcttacctaactttggcgcaattgccgaggtagtcgccaaaggtgtgggaattgcgattatgcctgcccgtgctgcacagcgcctacaatcggactatgattttcattcaattcaactgctaggcgcatgggcaaaccgtaaactacttttggccacacaaagtttcaatcagttgcctagtagttaccaacagtttgcagactttttattgcaacatcgtccttaa

SEQ ID NO: 984 - DNA, 960 bp, Acinetobacter baumannii
aaaataaaatttatagggaaacaagtaattaacataagcggatactatatgaatatacctaatgttttaaaatattatttcacagaaacatttcttaaaacagcaattcgcaaaccaagtcagttgaatttacccccaactgctctgcgccctatgcttgaacaactttgccgagcatttccaaaacaaaaaaatgtaactgttcgaccaatccgacttgctggcattaagggtgaggaaattaaagctcaagattcagcgacccagcttatttttcatattcacggcggcgccttttttttaggaagtttaaaaacacatcatgcgttcatgacagatttggctgctcgtacccaaatgcaaattattcatgtggactatccacttgcacccgagcatccatatcctgaggcaactgaggccttatatgacgtctatcaatcattattagttcaaggtatccagcctaaagatattattttatctggtgactcttgtggagctaatttggctttggcactttgcttacgtttaaaagaacaacccgaacttatgccaagtggcctgattttattgtcaccttttctagatttaaccctaaccagtgagtctttaagatttaaccaaaaacatgatgccctactttctcttgaagctcttcagatcggtattcaacattatattggcaatcatattgcggcagatgacccgcttgtttcacctattttcgataacttagaaggtttaccgccaacattagttcaggtcggttcaaaagaaattttattagacgatgccaaacgttttagagagaaagctgaagaagcaggtgtcaaagtacactttaaactttacacaggcatgtggcataacttccaaatgtttaatgcttggttcgaagaagcaaaacaggcgatggcggatattgctgagtttgctcatgaacttgataagacgtaa

SEQ ID NO: 985 - DNA, 627 bp, Acinetobacter baumannii
aacatgatttctttagagcttttcattacatttttaattactacaattatttttgcttatattccgggtccagcaatgctgtataccgctgcacagacgctttctcgtggtagaaaatctggtttgatggctgcatttggaattttcgtaggaggttgtttccatatcatagcggcgtctttaggcttaacgaccatctttcaaatcattccaaaactctatgatattattaaaattttaggtgctttgtatttagtttggttaggcattaaattaattagatcgacctcgtccccgactcttcagcaaaatgttgaaaatggtcagttatctttgaggcagagcattctggtcgaagttttaaaccctaaaaccgctattttttatatcgcttttttacctcaatttattaatacctcattagattttccagtttggtctcagttcatcattttagggctgattgtgaatctgatctttgtttctgctgatgtggtttgtgtgtttttagccaattacattagtcaaaaattaactaaatcgaagaagccccaaaaatctatgtcagtgatgggtggactcatttttatggggctaggcgtttttcttggctttaaaaatcagtag

SEQ ID NO: 986 - DNA, 192 bp, Acinetobacter baumannii
cgccccacttcggtgggcttttttttaaccgttgatcaaatttggcttcatttttgcttaagaccctgtatccttagcgtgctttatttggggggagatcatttaaatgcaattaaagcaacttgcggcgacttgtgccttgttatctgcaactgccatggttcaggcaaaaccaatctggcaagattttag

SEQ ID NO: 987 - DNA, 600 bp, Acinetobacter baumannii
cgcatccattcttttatgctcagctgggagttcaccatgaaatatctctctctttgtttagccttaggcactgccataactttaagtgcttgttcaactatacccagcaaaccaaaaacgttcgatcagcttggccagttttcggcctatccgttaaatgctcaaacgtttcgaatcagctttcaggctgatccaaacatgagctatggagcagccgaagaaatcactttggtgaagtcagcacagactacagtacaaaaaggtttccgcttttttaaagtgctgaacgacccaagtaatcaaagccaaaagccaccgcgtcaagctgtagtttacccatctgcaccaagcttttacccgtatggttactaccgccgctatccaggtttctggcatgatccgttctatgatttcccacaagtggtcaatatcgaccctgttcaagtgtcgtatactattgaatgttatcgggatcaaaagcaggctcctcaagatgcctttgatgcaacgttaattctcaaatctatcggacaaaaatatggtttaagcccgacaggagaattgttgccgccacctgagccgccagtaaaacaaaaatga

SEQ ID NO: 988 - DNA, 1326 bp, Acinetobacter baumannii
tactgtatctcgtcttgtatcaaaattgatgaacttaccttgaaacaacaagctccactttcaacagactctttagatacatggctcaattattggagccatgttcacgttacagggatcgatcttggtctggaacgtgttattcccgtagcagaaaaattaggcgtgactaaacccaacgccaaagtttttactgttgctggaacaaacgggaaaggttcaaccacaacaacgcttgcgtctatattaaaagcacaagggtacaaagttgggttgtatcaatcaccgcatatctatcgttttaacgagcgagtcaaattaggtggagttgaagttgatgaccaaagcctgattgatgcttttgtacaagttgatcaggctcgtcgcgagtgtgatttaagcctatctttttttgaagcaaccactttggctgcttttgttatttttaaacatcaacaatgcgatgtatgggttcttgaagtcggtttaggtgggcgtcttgatgttgtcaatgtcattgaccctgatatcgccgtgattaccaatattggtctcgaccatacagattggttaggtgataccatcgaaaaaattgcttttgaaaaagcaggtattatccgacctcatattcctgtcatttttgcaggtgagcaatctttgcctcaagcgattcaagagaaggcaaatagctcacaagccacgctatacgcgattagtagagattatttttataaactcgccgatgatggaaaacattggtattttgcaagtgaaagaaccactttaaggttgccacttggtacacttgcaatcgagaatattgcaggagcagttgcggccgtattaaatagcggacttaaaatctcgcaactagcgctagaagagggcattacaaatgcccgcttggctggacgcttcgaagtacgcgaagttaatggaaaaaccattatttttgatgccggacacaatcctcatggtgttgaatttttgttaaagcaattgcgaaatttcttagaatacaataaacagtacacagaagttgtcgcagtattttcaatgctggcagataaagatataaaatcagtagtcgatttgttgaaacctactgttttacattggaaaattgctgagttgaatgtgccgcgtgctgcaccgattcagcaattgaatgacgccctgcaaggccagacaatacaacaatttggcaatatcaaagaggcttttaaatcagcgcttgagcaaacaaataacaatcagctgattttagcctgtggttcgtttcatactttagaagcgatttgggagtatttggaagaatgtcaatga

SEQ ID NO: 989 - DNA, 240 bp, Acinetobacter baumannii
tttacctactccggaccgcacttggaaaatggagccagcatgacagataaaatcgatattgcacaagaattacaacttaaacaggttcaaattcagcctaaagactttagccgcccttctcttactgaatgtgaagaatgtggaaatgatattcctattgagcgtcagcgctatggttctgtaactctttgtgttgaatgtaaaaatacacaagaaaaactttctaagcggtactattaa

SEQ ID NO: 990 - DNA, 1842 bp, Acinetobacter baumannii
gattataactctggtttcaccagtattgaggaacccgatatgccacaatacaaagcgcccttacgtgatatgcaattcgttttgcatgaattattaaatgctgaagaacactatgcaaaattacctgactttcaaggtaacgtaagccgtgaattggttgatcaatatttagaagctgcggcagacttctgtgaaaatgaactttctcctttaaaccaagttggcgaccgtgaaggttgtacttggaatgatggtgttgtaactacaccaacaggctttaaagaagcttatcaaaaatacatcgaacttggcttcccgtctttatcagcagaagaacaatacggtggtcaaggtttacctaactctttaggtatcgcaatttcagaaatggtaggtagctctaactgggcatggggtatgtaccctggtttgtctcacggtgcagtacgtacattagaacatcacggttctgaagagcaaaaaaatacttacttaccaaaccttgtttcaggtgtttggacaggtacgatgtgtttaactgaatctcatgcaggttcagacttaggtattatccgtactaaagcagaaccaaatgcagatggtagctatgcaatctctggcgagaaaatctttatctctgctggtgaacacgacatggctgaaaacattatccatatcgttcttgctcgtctaccaggcgcaccaaaaggaactaaagggatttcgttattcatcgttcctaagttcaatgtcaatgcagacggaactctaggcgaacgtaatgccgtacgttgtggttcaatcgaacacaaaatgggtattcacggtaacgcgacttgtgtcattaactttgaccaagcaaaaggttatttaattggccctgaaaaccgtggtttgaactgtatgttcaccttcatgaacacagcacgtattggtactgcggttcaaggtttatctgcatctgagtcttctttccaaggtgctttaacttacgcgaaagaacgtttagctatgcgttcactttctggtcctaaagctccagaaaaagaagcagatccaattatcgttcaccctgccgttcgtaacatgcttttaactcaaaaagcatttgctgaaggtggtcgtgcacttgtgtacttacttgctcaatatgcagatatcgttgaaaaaggcgaaactgaagaagagcgtaagtttgctgacaacatcttgtctttattgactccaattgcaaaagcattcttaactgaaacaggttctgaatctgctaagcacggtgttcaagtgttcggtggtcatggtttcatttctgagcatggcatggagcaaatcgtacgtgatacacgtattgcttgcttgtatgaaggtacaactgaaattcaggcactggacttgttaggccgtaaagttttacaaactcaaggtgcaatgcttcgtgattttactaagattgttcacaagtttgtagaagcaaataaagacaatgctgccatgaaagaatttgttgggccacttgctgcgctgaacaaagaatggggcgacctcactatgcaaatcggtatgcgtgcaatgcaaaatccggatgaagtgggtgcagcggctgtagattacctctacttctctggttacgttactttagcttatctatgggctcgtatggcgcttgtagcacaagagaaattagctgcgggtacaaccgatgttgatttctacaatgcgaaagtaactactgctcgcttctacttcaagaaaattttaccgcgtgtacgctctcatgtagatgttatcgcaggtggtttagacccattgatggcattagatgctgaacatttcgctttctaa

SEQ ID NO: 991 - DNA, 564 bp, Acinetobacter baumannii
attcaattatcttgttcattaaatagaattaatatgtggaattatttagtaagtttttctacttgggcggaaaataactcagggcaaatacagatagttattgctgtagttgccttgtggttagctatattaggttataaaaaagttataaaacaaattcagatggctaaagagcaagaagaacagaactatcagcagcgtaattatgaaattaaaattgaagtgattaatttactttttaagatttcagattcaattcataagaaattaaaaggtctttatgacctacaaactggtttaaaaaacagtgaagaagattttaaaaccaaagaagaatcaattctgttaaacgatacacttaaaacagttcaagagaaaatcgataaaacattagagattagagaacaattaaacagcacattagagagttttattaaaaaagacgatattgactataagctatttgaaaaaaaattaaatactctttatttagcactaattaaagaaaataaggagactaatgaggttgatcttctaaaagctgaattctttattgaggattag

SEQ ID NO: 992 - DNA, 546 bp, Acinetobacter baumannii
aagaaggcatctatagtcatgttgatgtcaaaccatttaataaagcatttccaaaagggtaaacgcatgcagcttgcaaccaaaagctttcttggcttgtgtttgatatgttcaactgccggagcagttgaacctgctgcgacaccagcaacgcttccaactgcagcgtcaacacagaatgataaaccagcacctacttctgcaactgtagctaaacccgcgactacaacagcaccaacctcaacacaaccgcttacagcagaacaaatcgcaaagaacaagcaacagcaagatgcaaaaattaaggctttagttcaagatcaagcatctcgtctaaaacagctagaacatgcaaaccttgaagcgctagcacaaaaccaagaattgcagctaaagaacgataacttgtctgttcaggtacaagttttacaaagtgaacgtagtgctcaaatgttcttatatggcgcagtaactcttgcaggtggcgtactgcttggcttctttattgctagttatgtttacaccaaacgtcgacgtcagtggtaa

SEQ ID NO: 993 - DNA, 411 bp, Acinetobacter baumannii
tctcaaaaatcacaaaacatctggtgttcaacctggagatggagaatctggagggccaattccatgatgtcacgtgaaaatggccgaaagcttgaaactgagttagatcatatccgtcaatctgtccaggacattctaaccacaccagttggcacaagaatcatgcgtcgagaatatggttctttgatctatcaattaatcgattccccttttgatgaaattgccactctgcagttatatgccgccacagctactgctcttttacggtgggaggacagaatcattcttaattcagtttcattggtcaatgatgaagaaggttcatattttttagatatggattgcagtctggtcgatagcaataagcaggcctctttaagtattcccctttcaattggatctgccttatga

SEQ ID NO: 994 - DNA, 726 bp, Acinetobacter baumannii
gggaaaagatcaggagtactcatgaatttggaacaagtccgccttgttgacgaagcaattacctctcgacattctgtccgtgcttttttaagcactcccattgagccagaagtcattaaagatatattaagagtcgcaagtcgagcaccttccggtaccaacactcaaccatggaaagtttatgtagtcacaggtcataaacgtgatgaaatggtagagcgtgtttgtgcagcacagattgaggtttccaaaaatcccgaacttgcagagcaatataaagaaacttttgcatattaccctgaaaaatgggtctctccttttattgaccgccgccgtgaaaatggttggggactctatggtttattagatattaaaaaaggtgaaaaagaaaaaatggctgctcagcagttacgtaacttcaaactgtttgatgctccagtcggaattttctttacagtcaataaagcaatgggaattggttccaaaatggatatcgctatgatgattcaaaatgtcatggtcgctgccaaggctcggggattagacacctgccctcaagcagcttggaaccatttccatccgctagtgttagatattttaggcgcagcagatgatgaagagctggtatgtgcaattgcactaggtcatgccgaccctgaacatattgtgaatacctttattacacctagagagcctgttgagaattttgcagtttttcttgattaa

SEQ ID NO: 995 - DNA, 324 bp, Acinetobacter baumannii
agaaaaatgtctaaatatcattgcaaatgtggtggccttattcttcccgactttgaatccttccagataggtgatgaagttaattgtatggtcgaaacccataaacctattggaaatggcatggtgagtgtaaaccaacgggcttttgtagggacaatcctcaaaattaatggagatgagttcaaaataacttcaaaaagaaaacaatacacgttctttcgaggcgaattttctccaatagatgcaccaggaccaatcgaatattttcgtttaggtaaatgtcgttgtgaattagatcaggagcaaaaaccatgcgcggaataa

SEQ ID NO: 996 - DNA, 1068 bp, Acinetobacter baumannii
atgagtacgtcgatttatcaacgtcctaataagaaatggaaagcagatgttgttttaaatggtgtgcgtgttactaaaactttagaaaaaaaagaattagcaattcgttgggccaaggagactgaacgagatcttattttaaatgattcaactcaaaaggcacttaacagtaaaattgttattactatgcgtgaggcactaggtcgttattcagatgaagtttccagatttaaagctactggaaaaaaagaaatgcaacggatccgctattttcaggataatttgccaaatactgattggccacttagttgttataaaggggagtttttaaagcaatgggaagatgcagtttctaaaagaacaattaaaccacttaagccttcaactattctgcgtgattattctactttgtcttcattctttaactggtgtcgaaaggataaagggtggattgagtctaatcctgttgaaaatcttagaaaaccaaaaaaacctccgcatcgcgaaagacgtacagaggttgaagaacttcagcgcatgcttgctgcactcaaatataaacctggaacagtgccaactactaaaatgcaagaagtaggattgatctggcttattgctatggccacgggaatgagatctggagagatagtaaatcgcttgcctgtgcacgtctgtttgtcaaaacgttatgttcagttggataaaacaaagaatggtactgctagaaaggttccgctagatgattttgcgcttcagctgtggaccttagctttaaaaattgatcggaaggggagtcctaaagtttttactgtttctgattcttcacgtgattcactttttagaaaggcacgtaaaaaagctggattagaaaattcagatctaacatttcatgactcacgacatgaggcagcttctcttatggccagacgtattaaaaatgcccttactttatgcaaaatttttggttggaaagaccctaaacaggctttgacatattacaacccaactaatgatgagatcctggacgaattaaatcagtcatccggattaagccggttgttagcataa

SEQ ID NO: 997 - DNA, 207 bp, Acinetobacter baumannii
gccaaaacgtcctcaaccaccagtcaatgcccctgctccagtagcgactcaagcaaaataattctaaaaacagtaaaacaaaaggcgccagaaggcgccttttgtttatacataactatttacgattttgactatttgtctcatctaaacttcatcaaaagtgtttacactcaaagcacttacatagttcaagtatttttttcttga

SEQ ID NO: 998 - DNA, 222 bp, Acinetobacter baumannii
ttttcgaggtcaatgaatatgaaaactaatttatcacaacacccttgtgaaaacaaatgctctaaattcaatggggaacagtgccgaacttgtttaattggtgaagatcttggcgatgaccgccatcttgctaatcacatttctgtaaagtgccaagttattcctcatgacgaattaaagcacctcaatcgcgcacaccaagcaataggggaagtttcatga

SEQ ID NO: 999 - DNA, 1740 bp, Acinetobacter baumannii
cgcttaacttttaggactttttccatgcgcgcaagccgctttttatttgcaacgttgagagaaaccccaaacgatgctgaagtgatttcacatcagctcatgttacgtgcggggatgattcgtaaattggcatctggtttatatacatggctgccgatgggaacacgtgtgcttaaaaaagttgatgccattgttcgtgaagaaatgaaccgttcaggtgctatggaagtgttcatgcccgtaactcaacccgcaagcttgtgggaagaatcgggtcgttatgaacaatatggtcctgaattattacgtttcaaagatcgtcacgacaatccgtttgtgcttggtcctacacatgaagaagtgattaccgatttagcacgtaacgagctaaaaagttataaacagcttcctgtaaatttctatcaaattcaaaccaaattccgtgatgagatccgccctcgttttggtgtaatgcgttcacgcgagttcatcatgaaagatgcttattctttccatgcaactcaagaatcattacaagaaacttatgatgtgatgtatgacacctatagccgtattttcactcgtttaggtttagatttccgcccagtacaagcagatacaggttcaattggtggttcagcttcacatgaattccacgtattagctgcaagcggtgaagatgacattgcattttcaactgagtctgattatgcagcaaacgttgaaatggctgaagctgttttagtgggtgagcgtgcagcgcctacacaagaatttaaattggttgaaacaccaaatcaaaaaacaattgctgatgtttgccagttcttaaatgctgatcctaaacaatctgtaaaagcattattggttcaaggcgttgctgatgagaaaggcaatgtacctgtcgttgctctattcttacgtggtgaccacgaactgaatgaaattaaagccgagaaacatcctctagtggccgctcctcttgcgtttgccacagaagaacaacttcaagcatttggcttaactgcaggcttcactggtccacaaggtttagttgaaaaaggcatcactgtaattgttgaccgtgctgcatctgttctttctgacttcgttgctggtgcaaatgaggcagacaaacatgctgtaggcgtaaactgggaacgtgatgcacagattactgaagttttcgatttacgtaatgtggttgaaggtgacccatctccagatggtaaaggtacactacaaattaaacgcggtattgaagtaggccatattttccaacttggtactaaatactctgaagctttaggatgtaaagttctcggtgaagatggcaaaccatttacagtaacaatgggctgttatggtattggtgtgacacgcgtagttgcagctgcaattgaacaaaattacgatgacaaagggattatttggccacaagcgattgctccttttgaaatcgcaattgttccaatgaatgcacacaaatcaccacgtactcttgaagcagcagaagcgctttatgcagaacttcaagcccaaggctttgacgtattacttgatgaccgtaacgaacgtccgggtgttaaattctctgaccttgaactaatgggtattccacaccgtattgtgattggtgaaaaaggtcttgatgcgggtacttttgaatataaaggtcgccgtgatgctgaagcgagcaatttaactaaagaagaacttttagataaattagcgcgttaa

SEQ ID NO: 1000 - DNA, 1083 bp, Acinetobacter baumannii
cagtttttaccatttaacgccacaattacgctttctaatgagccactcatgactccagaattacccggaacttatattaatttattagctgagatcgttaagcgcagaggtatctcttgtgagcagtttttagagggtagtggagtaacaccggaacaattaaaaaaaccgtattggtatgttgagtttaataccttaaataacttacttgagcatgcgattcaactcactcatgagccagcattagcgggttatttggcattggaaatgaaagcttcttgttatggttctgtaggtatggcagccatggtgtctgcaaatcttgaagaggctttaaaaatacttgaacaatttattggttcacgttgtgatgcctttaaacctgagttaaagcaagagcaagacgatgtttactggtctattcatcaacctttaaaaagttttcaattaagttcagatgcgactatttttttgttgttaggttttgttcacatcgcaaaacatctaacagggttatcttctttaggtacagtgcaattgaatatgcccgaaccactaggtttttcaaaaataaaagataaattaggcgtaagttgtttatttgagcaaaaacataatatttggatttttccaaaagaatatttaatgcagcctatactcacggctgaccctatgctggcacctttgctgaaagcccagtgtaaaaaagatattgataaattgaagttacgaagtggatggaaagcagaaattagccaagtaataaaaaaattattgatcaatagtcagggggaaatattaaaagttaagcaagttgcccaaatgatgaatatgtcagaacgtagcctacagcggtatttggcgatagagaatacaagtttctcagcattagttgatttaactcgaaagcaatatgcacaagatcttttgcaaaatagttcaatgtcaattgaagctgtggcattaagtttaggctatgccgatacaccccatttcactcgtgcatttaagcgctggatgggtgtaaccccgaagtattatcaaactcaattaaaactaaaaaatttagagatacgtgaataa

SEQ ID NO: 1001 - DNA, 861 bp, Acinetobacter baumannii
gcggtgcaaccgaatattttttcaagacagccgccatctttccgctcgttcattattgcggtcattacatgcttggtggtgctgttctttgattggcgcatgccttatgtaattcagccagcaagggatgtcttgtacgctgcatataatccaatttatgcacttgcaagttatccggtactgtcgagagaatggctgaatcaacaaactaaatctgaaacacaactgcgccgtgaaaacactgcaatgcaggctgagctattacaggctcaggtccgcttgcagaagctgtctgaattatctgctgaaaatacccgcttacgtggtttactcgatacgccattaattattgacggtcgtatggaaattgcggaagtaattgggacagatgccgatccacttcgtcacattatcattattaaccgtggtgcaatggatcatcttaaagttggtcaaacggttctggatgataaagggattatggggcaaattatcaatgtatatcctcatagttcacgtgtgatgttgctttctgacaaagagcattctctatctgttcgtttagagcgtacagggatgcgtgcaattgtctcgggtactggtgatttaggccgtttgaaaatggaatatgtgccaacgagtgcaaatattcaggtcggcgataaagtattaagttcaggcttaggtgagcattttccagcaggttatgccgtgggtacggtggctaaaatccgtcgccataattcaggtgagtttgctgaaattgatgttacaccagcagcacaattagcaactggtcatcatgttgttgtacttttctctgactcattagcgaaggagcaaccatatgccgatcgctaa

SEQ ID NO: 1002 - DNA, 264 bp, Acinetobacter baumannii
ttaattaaaccaataggtaacgaaatggctcgacctcgttcacgttataaatgcccccattgtggtgaaccttttgcaatacgttcaagtgatgcattaagtccactactccgtatgttccaggcacagtgccaaaatctgaattgtggctttacagctcaaggctacatggaattgaagttccagctttcacctccagcccaaccaaatcctgaaattaatttacctactccggaccgcacttggaaaatggagccagcatga

SEQ ID NO: 1003 - DNA, 366 bp, Acinetobacter baumannii
tcaagtgcttttctgggaaaaagtatgaaaaatgatgatttgtcgacgcgcggtagtcgacttagggatgagcggaaacgcttagggtttcaaaatcaagaagatcttgctgatattttgaacgtaaaaaagaactcagttgtacgttatgaaaagcacaatgcagccttagatactgaccaattggatctgctcgaggaccacggctttaatattccttatattctttggggaagggttgaattgaatagtagtgacttagaagaaaatgaatcaaagctcattcaactgtatcgacaaacacgtgaagaaatgcgccctggtttaatttctatagttgaaacctatgccaatcagtttaaataa

SEQ ID NO: 1004 - DNA, 1788 bp, Acinetobacter baumannii
acgattatgccaatttacaatgctcctttagctgatatgaaattcatcttaaatgatgtatttaaagcagaacaattttggcaggctaatgagaaactcgctcatgtagatgctgcaacagctgaagcaattttagaagaaatggctaaatttgctcagaacgtgactcatccattaaaccgtactggtgatgaagaaggcgctcgctacgaaaacggcgaagtctttactcctgctggctttaaagatgcatttcgtcaatatgcagaaggtggttggattggcttaggtgcagatgaagaatggggcggtcaaggcatgccaaaaatgcttaccgttcttgccgatgaaatgttattcgcgactaacccatctttcatgctttacccgcttctttcagtgggtgcaggtatggctttaagcagctacgcatctcaagaacaaaaagaaacgtatttacctaagatttattcaggtgaatggtcaggcaccatgtgtttgactgaaccacatgccggtactgacttaggtattatcaaaactaaagccgagcgcaatgaagatggtacttataacattacaggtactaaaatcttcatcactggcggtgacaacgatttagcagaaaacatcattcacttggtacttgctaaaactccagatgctcctgctggttcacgtggtatctcgctatttattgtaccgaaataccttgtaaacgaagacggttctttaggtgaccgcaaccatgttggcccaggttctattgaacataagatggggatcaaagcatctgcaacttgtgtgatgaactttgacggtgcgaaaggttacctcgttggtaaagaaaacgaaggccttgctgccatgttcgttatgatgaactacgaacgtttatcaatgggtattcaaggtttaggtgcttctgaatttgcttatcaaaatgctgctcaatacgcgactgaccgtttacaaggccgcagtgccgctggtgttcagtcaccaagcaaacctgctgatagcattttagtccacggcgatgtacgtcgtatgttgttaaatgtacgtgcaaacaacgaagcttctcgtgcctttgcagtttatgtaggccagcagctcgatatcactaaattctcaactgatgcagaagccgtgaaaaaagccaatgaccgtgttgcacttttaaccccaattgcaaaagcttacctcacagatacagccttccaagcgacattagatgctcaaatggtatttggtggtcacggttatattcgtgaatggggtatggagcaatgtatccgtgatcttcgtattgctcaaatctacgaaggaactaacggcgttcagtctcaagatttaattggtcgtaaaaccattaaatgtggcggtgcattcattgctgagtacatcactgaaattcgtgactttgcaaatgacctagacactgacttgaacttcattaaagatgcaactttagatgctgcaactgaaatcgaagcaatcactcagtttattattgagcaagctgcagagaacgtagagttcccgaactctgctgctgttgattacttacatgcagtgggtctactcagcttctcttatatgtttgcaaaaattgctgccgctgctaaagataaatctggtgatttctaccaaaacaaacttgcattggctcaatactttgttgaacgtatcttgccagatattgatgcacgtattgctaaaatcaaagcaggttcagacttaattatgggctttagtgaagattactttacaaaccaagcgtaa

SEQ ID NO: 1005 - DNA, 222 bp, Acinetobacter baumannii
ggattcgggccttctctgaaaagaggtacagttcttgaaaactctttatgtttttttcctgaacaatggtgtgtaaaagtccataggttgtcttgcaatcattcaaggctgaatgtgcattctttaatccacgtcttgtcgatttacggtctcggcttatgtgataggccagtgcagttaggttatgggcttccaatgttggccaaaggtagcgagccatag

SEQ ID NO: 1006 - DNA, 804 bp, Acinetobacter baumannii
attgcagctttaaacacaatgcaagtcagtaagtggattcggattttcttagcagccattggttcaattttatttttggacggcttatttctagcttttctaaataaaattcatgtaggcacacttgttcctttagttttaggagcattcttctgtctttatgcattattttattatcatttagaacggtttttcttctatcactatcggcttcatactctttggcgttttgggtggttgtgtttctggatttggttaattggcttaggctatttttttaattttattaaagaaaataaagacgcaagtcaaaaccttcccgcagttaaagcaattattgttttaggaagtggtgtcgaaaatggacagccttcagctattcttgcaaagcgtcttgacacagcagcgccagttgccctttcacaaccgcaagcaaaggttattttaacaggcggtttagacttctccgaaaaagaacctgaagcattagtcatgtcacgctacttggaacaacattttcatatagcaaaagatcgaatgatccttgaagacaaaagcacaagtacagaacttaatcttaaaaatagtaaacctttacttgaacaagctcatattaatgctaatcaacccattgcaattgttacaagtgacttccatacaccacgagctgcagctattgcaaagaaacaaggctatacacaggtttatatggtcgctgcagaaacacctttaattactcgctacaacgcttggctacgtgaatattttgcgtacgctagtgggtggcttctaaacgagtattaa

SEQ ID NO: 1007 - DNA, 522 bp, Acinetobacter baumannii
cgcatggctttacctccaaaattaaaaaatatgaacttcttcaatgaagggaatagctacttgggcaaagttaaaactgtgactttacccaagttagcgcgtaaaactgaagactaccgtggcggtggtatgaacgggactgtaaaagtcgatttaggcatgtccgatgatgggttagtgcttgaatcaacttatggtggtttagatcttctgacactccgtcaatttggtatggaaaaaattgacggtgtttatctccgttttgctggggcataccagcgcgatgacgatagcgaatatgatgccgtagaagtagttgttaaaggccgtcatgaagaaattgatggtggtgaatcaacacctggcgaagacacagaacataaagtcgtgaccaactgtgtttactataagctgacagtgaatggggttgttgaagtcgaaattgacattcttggcatgaaagaagtgatcggtggcgtagatcgtcttgaaaaacaacgcaacatcttaggcattatttaa

SEQ ID NO: 1008 - DNA, 402 bp, Acinetobacter baumannii
tcatgtaagttcataataagtaatttgagggcaaaagaaatggcacgtattctcattgttgatgactcaccaacagaaacttttcgttttaaagaaatcctaactaagcatggctatgatgtacttgaagcatctaacggtgcagatggtgtgactttggcaaaagctgagcagcctgacttggtattaatggatgtggtcatgccaggtgtaaatggttttcaggcaacgcgccagattacccgtgatgaagacacgaagcatattccagtggtgattgtgagtactaaagatcaggcaactgaccgagtatggggtaaacgtcaaggcgcaatcgattacttaatcaagccaatcgaagaaaagcaattaattgatgtaattaaacaatttctaaattaa

SEQ ID NO: 1009 - DNA, 312 bp, Acinetobacter baumannii
tttctccatactcacgttaggaaaaaagtagtggctgcaaataaaatacttttacagaaaggattttgtgcagaaatggagaaatacacgaggtataaggagctttacatgagtttaccgctcatcaacaagcagttcatgaaacaaggattggcgattaccattgcaaccatgaaaatgaacgtaactcacgcaactactgagccacaagaaatacaacagcttggtacagttcttaatgcactcttctttaatgaaaaagaaaagggcacagatagtcgtgttatgactatggcttgttacagtctttga

SEQ ID NO: 1010 - DNA, 801 bp, Acinetobacter baumannii
atgaaaaataccaaaattaacgcacgtcatcttattatcgacctctttctttcttccgcttatcctcagctcagtatcaaacaaattttggttgcagctaaactttttaacttaagtgaaaatggtattcgagttgcgacaacacgcttgttaaatgaaggtatgatccagagcgtagaacgcggaatctatcaactttctccatctgcaaaagattgggcgaaagttattctcaatcgtaaaaatggaattaaacaaactaaagaatggcagcagcattatcttgccgtgtttacaggaaccttaggccgcatagaccgaacagcactaaaaaaacgggaacgtgcacttcgtcaatttggttttaaagagctggaaactggtatttacatccgcccagacaatttagcttatagctttgaaaaaacctgtgatgagcttgttttagcagggctagagaaagaagcaaaaatttgtattattcaacatgtcgactcaacaacgcttaagcaaattttttctttatgggataccaaacaactcgaaaaaaattatgaaatgtatagccgagatattacacactggcttgaaaattatgctcactcccctttaaacgatgcagcagtcaaggcacttcttttaggaagggaaacaattgccttactcatgaatgacccattattacccgcaccatttgtaaatgaatctgctcgtaatcaatttgctcaagatgtacagcaactagatgcaattggccagaaactttggaaaaaaatatatgaacaggaattaaatttatag

SEQ ID NO: 1011 - DNA, 831 bp, Acinetobacter baumannii
attgggagtacgaccatgaatacacttacacagcttgacgatgctgtatttatccaagatcaacaggtaaaaaccgatagcctgaaagttgcagaggtatttggtaaacctcataaagatgtattacaaaaaatccgaaccttagatagttcacctgattttaacgagcgaaatttttcgcccgttgaatatttagacagtaaaggtgaatctcgtccaatgtacgaaatgaccaaagacggttttattttcttggtcatgggttttactggagctgctgctgcaaaaatcaaagaagcttatatcaacacctttaatcaaatggctgccgtcctttacaacaatgatggcaatcaccaacagatccatgaaggtgctgtagtccagctaaaatctggtggcccgctttacaccattagtaaaatcttttatgaccaaaatggttatatgcagaatgctgaagtcatatggcacaacaaggccaatctctacagagaactattgcccattaactgtttaacgcttgaatccaagaacctgattcaaaacaaaacactagaagatttttgggcatcactgcacaattttggagttggtaaactcaaccacagccggaaccaaaatattctggcacttaatctcatgcaaatttaccaatgcattgaaggtttaccacctaaaaaccaactgtcagcaatcctaatgcatagcagcaatcccttccccatttatatgcagcacaatcatgcggtcagtagtgccattaccaataaaacggtgaaatgctggatatttaataccaaacaacagcaaatcccattgctatggtaa

SEQ ID NO: 1012 - DNA, 3102 bp, Acinetobacter baumannii
cttatgtggtttacccgaattagtgtgaagtaccccgtttttaccatcatgatgatgctcagtctaatggtactcgggttagcatcttggaaacgtatgaccgttgaagagtttccaaatattgatttcccattcgtagttgtcactacgcaatatgcgggtgcttcacctgaagccgttgaatcggatattaccaaaaaactcgaggatcaaatcaataccatttcgggtattaaacaaatcacttcacgctcaagtgaagggctttcgatggtgattgcagagtttaatcttgatacgtcttcggcaattgcagcacaagatgttcgcgacaaaattgctccagttattgcccaattccgcgatgaaattgatacgccgattgtacaacgctacgatccatcatctagcccaattatgtcagtcgtgtttgaatcgaacagcatgagcttggctcaattaagctcctatgtagacaaaaaaattgtacctcagcttaaaactgtttctggtgtgggtaatgtcaatttactaggtgatgctaaacgtcaaattcggattaaggttcatcctgaacaattacaaagctatggtattggtattgatcaggtcattaacactctaaaaaatgaaaatatagaagtacctgcaggaaccttacaacaaaagaattctgaactggttgttcagattcaatcaaaagtcatccatcctcttggatttggtgatttagttattgctaataaaaatggttcccctatttttctaaaacaagtagcaaccgttgaagatactcaagcagaactgcaatcaagtgctttttataatggaagaacagcggtttctgtcgatattttaaaaagttccgatgccaatgtaattcaggttgttgacaagacttatcaaaccttagagaagctaaaagctcaaatgcctgcgggtttgaattataaagtcgtcgctgacagctctaaaggtattcgtgcttcaattaaagacgttgttcgcaccattattgaaggagcagtcttagcggttttaattgttttactctttttgggttccttccgatctactgttattacaggtttaaccttaccgattaccctacttggcacattaacattcatctgggcatttgggtttagcattaacatgatgacactgttggccctgtcactgagtattggtctgttaattgatgatgcgattgtggttcgggaaaacattgtcagacatacagagctcggcaaagaccatgtcactgcggctttagatggtactaaagaaattgggttagcagtactcgcaaccacactcaccattgtagcggtatttttaccagttgcctttatgggaggcttaatcgggcgtttcttctatcaattcggggtaactgtaagtacggctgttcttatttccatgttcatcagctttacactcgacccaatgctttccgcacactggaaagatcctgtaaagaaaaaggagagtcgactgcaacgtttttttaaccatatttctaatttgttagatcggcttactcatgtttatgaaaagctattaaagcttgctctacgctttcgtttcatcacggtcattattgcaattgtttcattggttgtggcattaggcttatcaaaaatgatcggaaccgaattcgtacctacaccagataaaggtgaaattcgtattcagttcgaaacccctgttgattcttctttagaatatacccaagcaaaattacatcaggttgatcagattattaggcaattccctgatatcgtttctacttatggagtggttaacagtgaagtcgactccggtaaaaaccatgcaggtttaggagtcaccctaaaaccaaaacaagaacgtagcgcagacctgacaacactcaacaatgaattccgtgatcgtttacaaactgtagctggcatccgagtgacttcagtcgctgctgctcaagactcagtgtctggtggtcaaaagccaatcatgatttctattaaaggatctgatctaaatgaactacaaaaaatctcggatcgtttcatggctgaaatggaaaaaattgatggtgtggtcgatttagaaagctctttaaaagaacctaaaccgactttaggtgtacatattaaccgtgtactggccagtgatttaggtttatctgtttctcaaattgcgaatgcgattcgaccactcattgcaggtgacaatgtcacaacatgggaagatcgtgacggcgaaacttatgatgtgaatatccgtttaaatgaaaataaacgtgtgcttccccaagatgtacaaaacctatatctcaactcgaataaaaccaatgcaaatgggcaaaatattttagttccattaagcgccgtagccacaacccaagaaaaacttggagcttcgcaaattaaccgacgtgaccttgaacgtgaagttttaattgaagcaaacacttcaggacgtccaagtggggatatcggtcaagatatcgataaaatgcaaaaagcattcaaattgccagctggttatacctttgatactcaaggggcaaatgccgatatggctgaatctgcgggttatgcgttaacggcaattaccctttcgattgtatttatttatattgtgttgggttctcagtttaatagttttattcaccctgctgcgattatggcatctttaccattgtccctgattggtgtcttcctggccttattcttatttaggagtaccctaaatctattttcaattattggcattattatgctgatggggctggtaaccaaaaacgcgattttgcttatcgactttattaaaaaagcgatggaagatgggataagtcgttatgatgctattttacaagcaggcaaaacccgtttacgcccaatcttgatgacaacaagtgcgatggtgatgggtatggttccattagctctaggtctaggtgaaggtggtgaacaaagtgcaccaatggctcatgctgtaattgggggtgtcattacctctaccttattgactcttgtggttgtccccgtcattttcacttatctggatgacttgaaaaactttatgctgcgtcaaacccgacgattcatgtcataa

SEQ ID NO: 1013 - DNA, 288 bp, Acinetobacter baumannii
agtactaccacgcgttacttcaccagcactgacacctcagcagatctaccaaatggaccctgtagattttgccaatttaggagggcatttggtcacttttttgtacccgaaagccttacagaaggaaatcaaggctcagacagcttagagctggtcgatgatgtagatgaggcaatagctaatattgccgtcatcttccattggccaccaagtacctatgatgacatggatattgttgaattgagtaaatggcatcgtagagcaatcaaaagaaatcaaactaactaa

SEQ ID NO: 1014 - DNA, 351 bp, Acinetobacter baumannii
ctatggagcaccacaagcatgattacaaatgtttgggctgaactagaccctaatgaactgccttttattgataaggaaattggtccagaagatttcaaaactcaatacctttgtagttgggatcctggccatgacattacccatcaacttaaagatgaccagcgcaatattgatgaggctatttttcaggtcaaaacctgcattaacaatttggaaaattcgacatcacgtttagtacgaaagaacgcaaaggaggttttacaagtcataaaacaaaatttgaactgggaaaaacacccggaacttaaccagaaaatccacttattacaaagcctgttatatcgaggctag

SEQ ID NO: 1015 - DNA, 393 bp, Acinetobacter baumannii
agggttttaaccatgaaaatgacggctaaaattgcattattcagtgcagcaattgtaactatgggtagtttggctgcttgtcaatcaacaactcaaccacctaagccagaacatggcatgatgcaagatggcccacgtgatagtcaccaccatcgtatgaaacaccgtgaatttacgcctgaacaaaaagcagcatgggaacaacaccgtgcagagcgtaaagctcgttttgagcaaattcaaaaagcatgtgaaggtaaagctgttggacaaactgtcaatgttcaagttggagataaaactcttgaaggtacatgtaacctccgctttgagccaaaacgtcctcaaccaccagtcaatgcccctgctccagtagcgactcaagcaaaataa

SEQ ID NO: 1016 - DNA, 888 bp, Acinetobacter baumannii
aggatggtaaccatgaataccccagcatcaaatgataaaaatccaactccagatttggcagaagataatgcgttcttcccatcaccgtattcactgagtcaatatacttctcctaaaacagattacgatggcacaacctatccaacgccgtatgcgggcaataaaaaggtcttaatgattgcaactgatgaacgctatatccagatgcaaaacggtaagttcttttctaccggaaaccatccagtagaaatgcttttgccaatgttccatttagataatgctggttttgaaattgatgttgcgacactttcaggtaatctagccaaacttgaaatgtgggcaatgccaaagcaagaacaagtggtattagatactttccagaaatatgcagataaattaaaaaatccgttaaaacttgccgatattttagaaaatgtagtcggtgaaaactctccatatgcggctgtatttattccgggtgggcatggggtattagcgaagattccgcatagccttgaagtgaagaaagttcttaaatgggcagttgaacaagacaaatttattattacgttatgtcatggtccagcttcgttactggctgccgcagtagatgaacagcctgagaattatatttttaaagattatcaaatttgtgtattccctgattcgttagataagggagcgaatattgatattggttacatgcctggagctttaccgtggttagtcggtgaaaaccttgaaaaactcggtgtgaagattttgaacactggcattactggtcaatgtcatcgagaccgtaaattgttaacaggcgatagtccacttgcttctaataatttaggcaaacttgcagctgaaacattgctggctgaagtgaaggattaa

SEQ ID NO: 1017 - DNA, 858 bp, Acinetobacter baumannii
tgtggccaaactcatttggagtacgacatgattttaaaatttggttcaaaaggtgatgccgtagcaactcttcaaaagcaattggctaagatgggttacaagggtgttaaagataaaccactttcggttgatggtcatttcggtgaaagtactgaatttgcagtgattcagctccagcgtaaatttggcctagttgctgacggtaaggtcggtgataaaactcgccaagctttagctggtgattcagtaagtaagtttttaaaagatgaagactataaaaaagctgcaatacgtttaaaagttcctgaattagttattcgagttttcggagccgtggaaggtcttggtgtaggttttctaccaaatgggaaagccaaaattttatttgaacgacatcgaatgtatttttacttatgccaggcattaggtaaaacatttgctaattctcaggtaaaaattactccaaatatagtgaatacattaactggaggttacaaaggtgatgcagctgaatatacacgtttaagtatggctataaatattcataaagaatctgccctaatgtctactagctggggacaatttcaaatcatgggtgaaaactggaaagatctcggttattcatctgttcaagaatttgttgatcaacagcaacttaatgaaggtaaccaactcgaagcgtttattcgctttattgagtggaaacctggcttattagaagccttacgcaaacaagattgggatactgtctttacactttataacggcaaaaattataaaaaacttggctaccaagcgaaattccaaaaagaatgggatcaccttgagcctatttatcgtgagaagactgcagcatga

SEQ ID NO: 1018 - DNA, 2115 bp, Acinetobacter baumannii
tataacaaaacaaaaggcgtacgattagagactcacctcatgttgttctataaaaatattttgaccttatccattttggctgccatatctatacctgtatttgcagcagaaaatgaaaatgttgagaagttagaaactatccgcatcaaggcgcacccccttgagcaaacttcaaaagattttgcagtcgctgatactgtagttgaccaaaagcatttgactgaaggggccgccactattggggatgcgctcaatagtgaggtggggatttatgcgaatcagtttggggctggttcaagtcgtccggtgattcgtggccaagatggaccacgtgttaaagttcttcaaaattcatctgaaaatgtggatgtctcaactttgtctcctgatcatgctgtaacagtagatccagttcttgcaaaacaagttgaagtgattcgtggaccctctactttattgtttggtgcaggaactgtgggtggtttagtcaacgttattgataacaagatccctacacaaatgcctgaaaatggttatgaaggacaagttggcttacgttacaacactggaagtgatgaaaagctggcaagcgctggcgtaactgttggcttgggcagccaagttgctttacgtgttgaggggttaactcgtgatgcgaataattatattgctcccaattatattcatgaaggtgaaaaagagcgccgtgtagacaatacttttgcgcagggtgactcggttaatgttggtttgtcttggatttatgaccgtggttatacgggtatttcttatagcaaccgcagagaccagtatggcttacccgggcatagccatgagtacgaaagttgtagcgctcatctaggtggaagaccacatttacattgtgatgctcatgagcatgatcatgaagagggtgaagaggctcatgcccatgaagaacatgagcacgaacatggcggcccatggattgacttaaaatctgagcgttatgattttaaaaccgagttaaatgatccatttgcaggcttccaaaagttacgtgcccaagcgagctatactgactatcagcatgatgaaattgaagaagggacaatcgcgactcgattccaaaacaaaggttatgatgggcgtattgagttagtccataatcctattgctgattgggaaggggtaattggtacccagttaggccaacaaaaactaaatttaactggtgaagaagcatttatggcaccaaccactaccaaaaagtggagtgtttttgctttagaacataaacaatggaaagatgttcattttgaactttctgctcgtgcagatcagcaagaaatagatgtagatgataactctaaacaagattttgacggttctgctttttcctatgcaggtgctgccaactgggagtttgcgccaaattataagctttcatttgtagcatcacaccaagagcgtctacctcttgcacaagagttatatgcaaatggtgcccattttgcgaccaatacttatgagttaggaaatgatcaactcagtaaggaaaaatcaaataatgttgagttaggtttgcattttgataatgacaaactcgattatcatcttcatgtttaccataactggtttgatgactacatctatgcgcaaacccttgaccgttataaagacttccgtttagttcaatacactcaagataaagctcgtttctatggtgctgagggtgaaattggttatcaaattacgccaatgtacaagatcagtgcttttggcgattacgtgcgcggtaagattgatgccgagggcaatgctcctcgtattccggctgggcgtttaggtactaaagttgatgcagattttggtgacggttttagtggttctgctgagtactatcatgtctttaatcaagataagatcgcagcttatgaaaccgaaacagaaggctacaacatgctcaatttaggggtagcatactctggacaatatggtgcaaaaacagattatcgtgtttatatgaaagcaaataacttgttagatgacacggtttatcaacatgcgtcgttcttatcaaatatcccgcaagttggacgtaactttaccgtcggtgtagattttagtttctaa

SEQ ID NO: 1019 - DNA, 1416 bp, Acinetobacter baumannii
tatataatgacaaatatagtgactatggatattgtttcaattaaaaatttcatccaaaaaaataaagtaagacatttatcaaataaagttctacatacccatccctcacctaaaatgtggaaaacggatttaaaggaagaagaaaataattactttttattaaatacagatgctcaatataagtctataaatttatatttaggcattccatattgtattcctactgatccacctcattgtggattttgtcttttcccaacacaagactataaaggtaagcgggaaatggacttttatctggattttttaagtagggaagcccacttatataaagaattttatcaaggagctaagcttgaaagtttgtatgtaggaggaggtacacctaatttacttcagcctaatgattatatgaaactgactaaggttgtatcttctctttttcccgatgctggtatatctagccctatagaaatgacattagaaggtatccctcaactttttaatgaagataaaataagagcaattaaagatgcaggttttaaccgtgtcagtatgggagtacaacaggttaatgatgagttaatcgctacaagcggtcgaaaacaaacgagaaagcaggtttttgatgcaattgaattgttccataagtattctttatcttgtaacgtcgatttgatctatggctggccaaatcaaacggttgaggcaatgctaagagacttggaaagtattgttcaatcaggaataaaacatattactcactatgagcttaatattgctggtcgttctgactttgcgacaaaacaaaagcaaaatacgccctctattgagaagaaaattgaaatgtataacattgctaaacagttcttaataagcaaaggctataaacaaaaaacagtatatgattgggaaaaagaagataataaccaattaatttcagagaaatatttatatgaagataaccttagagactgcttagatgccaatgggcaaagtaaaatgaccacaatgagtgggctgggttatgcagccgttaatatgagactgcaacctaactcatcaagcattaaatctgtttcagcaatgaatcatcgaaacctaactgaatactacaatgcaatatctttaaataaacttcctgttgaacgtatgtttgttcatgatactgaagatgtaaagttaatttggatatttcaagcattacaagagatgaaaattaacaccaaaaagtacgagaaaatttttaatagtgatattaaactcgattataagcctatttgggatgcattagtcgaagaaggttgggtagagcataatgatgaatatattaaacttattaatgaaggtgagttttatactccacttattcaggcattattaagtcaacctagaataaaatctttgcaacagtag

SEQ ID NO: 1020 - DNA, 1932 bp, Acinetobacter baumannii
agtccggagacctacttgtttcatctatctacccgatcattcacgtggggtgaatgtatggagcatgttatgtctaaatcttttcaacctactcgtctggtaggggctatcgctattgcgatggggtgttcacctgttatttttgctgaagatgcaacagatgcaactcagcttgacccaattgttatcactgcttcaaaaagtgctgaaaaagcaagtgaagttccggctcgaatttctattattgaacctaaaattgtagaacagtcacctattgctgaattaccacacttattaatgagtgatgcagctattaatatggttcaaagtggtggcttagggcaaacatcttcaatttttattcgtggtactaattctgagcatgctttgattttacgtgatggcgcacgtctgaacactgcctcaactggtgcagcaaatcttgcatttattgataccacagatattaaacaaattgaaattctcaaaggaccagcatcagttctttatggtacggatgctattggtggtgttgtacaaattatttcaaagactccagaaaaaacctcagcatttgtgacaggtgaaattggtgaaaataaaacttataaatcgattgtaggcgcagatcttgccgaaaacggattttatgcgcaagttcgcggtcaacgtttagagtctgacggttcacgtatcactgatctaaaaggtaatgacattaaaaaagcctcttatgatcaaaaaggcttcagcactaaagttggggtagaaaaagaagatttcggggcatctgttgactacacacaaaatgaaggaacaagccaatacgatacttttcgttatgatggttcattgacttctcaagatttcaaaaatgaattacttaatattcgtggccgtgtaaatctcaattcagatatttctctaaatgcaagattatctcaatttaaagatgaacttgatcaaaatggttcaagggattttgtacatagtacgacaaaagaagcagaggtttacggtaaatggcaattcacctcatctcaaaatgtattggcaggcgtaactcatcaaaatattgatggcgatgtactctcttatggttcgccttacgatgaagatgtcaatagcacaggctatttcgtacaacatcaatatcagaacaatggtttaaatacccaagtcggtgttcgtgttgaagataacgaaaaatacggaacacataccgtggcacaaggtgcaatccgttatcaacttttaccattgacgagtatttatgccaacattggttcagccttcaaagcaccaacactaaatgacatgtatggttctggtggcaatcccaatcttaagccagaagaaagtatttcttatgaagtcggtatagatcagaagttaaattacaatatttcgactggcctttctgcctattacaccaaaatagacaatctaattgaatcacgctgtatagctgtatgtaatggcgattggataaatacattccctgtttatcaaaatatcaacatcgacaaggcatctatgcgcggtggtgaagtctatgcaaattggaatagagatgacttatttattaaatcatcttataactatgttaaagctatcaacgatgaaacagatcaagaattatcaagacgtcctcgtcaaagctttactgtaagtacgggtttacaaaatgaacattacggactgagtatttcactttctgcaaaatctaaagcgaaagactacaaacaagatacgccaggatatacaactgttgacttcaatggttactggaatgccacaccaaacgttaagctttttaccaatatccagaatattggagatgtgaaatataaaactgcttcctatgataaaggcatctattacgtaaatggtggccgccttgcatcagctggtgtgaccttaagctactaa

SEQ ID NO: 1021 - DNA, 1230 bp, Acinetobacter baumannii
tttagtcatgcaagcctgtttgttgaattaaaacctcaattaacaggcttttttatggctatagatcaataccaccacggaatccgtgtccttgaactcaatgatgggatccggccaattcgaaccattgcaactgctattccgggctttgttgcaactgcagatgatgcagacccattagtatttccagaaaaccaagcagtactaattacaaatatacaagctgcagtagctaaagccgggaaaaacggaacattagcaaaagcacttcaaaatatggccaaccaaaccaacgctatttgtgtcgtggtccgtgtacctactgcagttgatgaagcagctcaaactgcaaacgtcgttggaaccgtaactgctgaaggaaaatataccggccttaaagcccttctcgttgccaaatctaaattaggtgttcagccacgtattttaggtgcaccagggcttgatactcaggctgtggccactgagttagttgttattgctaagaagttgcgtgctatggcttatgcgtatgcatggggctgtaaaaccaaagaagaagcagttgcatatcgtgaagcctttgctgcacgtgaacttatgatcatttggccaaattttgtagcatttaataccacaactgctcaaacagaaaccgtaccagctgttgctgttgctatgggattacgcgcaaaaattgataacgaaatcggctggcataaaaccctttcaaacgttgcagtatcaggtgttactggcattgatgctgatgtgacttgggacctgcaagacccagcaactgatgctggctatctcaacagcaatgaagttacaaccctcattcaacatgaaggctttcgtttctggggatctcgtacttgttcagacgatcctttatttgcttttgaaaactatacgcgtactgctcaagtgttggccgacaccatggctgaagcacatatgtgggcaaacgatttaccacttcatggttcattggccacagacattatcgaaggtcaaaaagccaagcttcgtgaactaacgcgtaataaatacctcattggtggtgacgcctggttcgatccggaagcaaatactccagatacgttgaaagtgggtaaattggccactgattacgattacacccctgtcccacctcttgaagatttgaccttcagacaacgtatcactgatcgctatctcgctaactttgctgcatctgtaaaagcttaa

SEQ ID NO: 1022 - DNA, 627 bp, Acinetobacter baumannii
gcacaccatgcttgtatttgccattatgtttgctggttatctgttttttgttggcttagttgctttgtatgcaattgtacgaggtggctaatcatgttttacaaaactaataaaccagaagctattgaagcacatgttcagttttttaaagaaaaagctgctcttcatgagtctgcaagaaaatttgcagcagagtatgacgcaaccgaagttgttttacataatcgctgccaaatcttttttgctggccttcaattaaaaacatcaaacaaagttaatttgcatgtttggcgaaagcccgctgttcactattacaacattagccatcttcgtgttaaggcaaccaagaaagaacataaagctgaatgggaaagagaaaaagagcgatatgcagagttgttaaaaaaacactttccaaatggcgaaaaggtttcacttgagccgttttttaactcactaggaatttctgcaggcagcctaattatgagtggttttggttggttcgttcatgatggatggatgtatatcgataccagtctgaaactggaccacttaactgaaattttgggttctgaatatctcgctgcacagcaagcaaaaaccaaatctgagaaggaggctgtctaa

SEQ ID NO: 1023 - DNA, 492 bp, Acinetobacter baumannii
gcattaaatgctatttacttctcatccagagtgtatgttggaaagacaatgaaaaaagtattacaacctttatttttaactgttcttgctgtgccaagttttgttttcgcagcagaaacagcttcagcccctcaaaccacaacggttgataaagtacttgcggcaaaaggcccaacttcggctcaggctgtagtgaaacaagaaaatacgacggtgattagccctcgtacaggtattcgttacacattgggtaacacgggtaatcgcccaatcattttacaaactgctgcgatcgctccagcaaactctgcaaatattaaccgtattgttgcaagtaacccagctctatctccaaagagccaagaaaaagcaaaagttgcattaattggtgaagcggctgttgctggtgcggcagcagttgcagcgaataatgtaactgccccagctgtaccaaacagtgttacacctgcaaatcctgcatcattgaactaa

SEQ ID NO: 1024 - DNA, 699 bp, Acinetobacter baumannii
accatgaatgctcctattggtttaattttaccttctcaacaaatgttgagttcagatatcgctctcattaccaatatacgtttagactccgtcaaaagaacaattgaacgtttagcagaacgccgtgttattactttaccaccaacggtggaaaagcctacagctggacgcacaagcaccgaatatgtattttctggtgaacaaggtaaggtggattcgataacagtagtagctcaactctgcccagaatttactgctgcgattgtgaaacgttggtatgaacttgaacagcaaacaccagcatttgatatcaacaatccacagcaccttttacaggctattgaagttcaagccaaacagaatctacggctaacagcagaaaacaaaaccttgtcacaagcaatagaaactatcactcatactgaacacggcgtaaaattccagcaagcatgtaaaattctgaatgttaagcagcaagtgttagctgaatggcttagaaaacacaactgggatcgctatctaaataatgctagggcttcaacttattacagtgaaagtcgagggtactgtgaaaccaaatattcacttaaagaaggtgtaaaatcctctggccaaccatatagttatactcaaaccgagtttttcattctgccaaaaggtatgcaaattttggctaaaaggtttggagaatctttatga

SEQ ID NO: 1025 - DNA, 486 bp, Acinetobacter baumannii
tggatgaatgcacaaattttagatccatgctgcggctcaaagatgatgtggtttgaccgtaacaatccaaacgtaatttatggggatatcagaaaagaagaacatacattgtgtgatggtcgctctttagtgattgaaccagatgtgatgatggacttccgtgacatgccatttaaagacggccaattcactttagttgtgtttgacccgcctcacctagtgaaggctggcaaacaaagttggttagccgccaagtatggaaagttatcagaagattggcgcgaagatattcgtaaaggttttgcagagtgctttcgcgtgttggctaatggtggtgttttaattttcaaatggaatgaaacacagatcaaagttagtgagcttttagaactgacagatcaaaaaccattgtttggacacattagtggaaaacgcagcaatacgcattggattacttttatgaaaattgaggtagctgagggatga

SEQ ID NO: 1026 - DNA, 384 bp, Acinetobacter baumannii
atggaagatgcattccaaaatctgaaagtaatggttattgatgactcaaaaactattcgccgtaccgcagaaactctattgcaacgcgaaggttgcgaagtgattactgctgtcgatggatttgaagctttatctaaaattgctgaagcgaatccggatattgtttttgtagatatcatgatgcctcgtttagacggttatcaaacttgtgctttgattaagaactctcaaaattatcagaacattcccgttatcatgctctctagtaaagatggtttatttgatcaggcaaaagggcgtgtggtaggttcagatgaatacttgacgaaaccttttagcaaagatgaattgctaaatgcgattcgtaatcatgtaagttcataa

SEQ ID NO: 1027 - DNA, 1947 bp, Acinetobacter baumannii
aacagtcgtgctttagcacggctttttcatttaagaagaaagcgaatgcgttaccctgcatggaaatatttactgattctggttgttctggtagtcagtacattatacgcactgcctagtctatatccggatgagcccgccgttcaaatttccggtgccaaagctggtacccaaattgatcaaagtgtggtgcaaaaagcagagcaaattttaaaaacagcaaatattgcaagccacgataatacttttacaaataatgctgctctcttgcgtgtcagctcttctgaagcgcaattgaaagcaaaagaagtattacgccgtgacttaggtgatcaatatgttgtagccctaaaccttgcaccaacaactccagaatggttgcaaaaaattggggcgaaaccaatgaaacttggtttggacttacgtggtggtgtccacttcttgcttgaagtagatatggacaaagccatttcccaacgtatggaaacctctgccactgatttgcgtcgtcagttccgtgaaaacaaaattaaatttaacaatcttgcgttaaataataatgtgatcactgttcagtttgctgacaatgcggatcgtgatgcagcaatggattttttacgccgtaatggtaatgaatatacccaacaggcattagcgagcacgacaggttcaatcttaaagctcacttatactgatgtacgtcgtcaagaaattcaggcttatgcagttaatcagaacttaacaacactacgtaaccgtattaacgaacttggtgttgcagaagctttagtacaaagtcagggtagcaaccgtattgtcgttgaattaccgggtgttcaagatacagcagaagctaaacgtgttttaggccgtactgctaacctcgaattccgtttggtatctgacttaaatgatcaatatattgatccatatacgggtaaatataatggtcaacctttacctccgggtacggaagtttttgcttatcagtctttagatagtggtcgccaactgttgttgcaacgtaaccgtatcttgactggtgaacgcgttcaaaatgcaagctctggttttagccaagactctggtggtgccgaagtaaatattacgctcgacagtgctggcggtaagctgatgtcagatgcaacccgtaatgcagttggaaaacgcatggcggtattgttcatcgaaaataaacaaaagattagctacgttacagatccaaaaactggtgctcaaacagaagttcgtacaccatataccgagtctgtcgtgattaatgctgcaactgttcaagccgttttaggttcaactttccgtattactggtttaagttcacctcaagaagcatctgaacttgcgttaatgcttcgtgctggtgctttagctgcgccaatgtacttcgttgaagagcgtgttgtgggtccaagccttggtcaagaaaacattgataaaggtgtactatcaacgcaaatcggtttcttgcttgttgcaatctggatggtcgtattcttccgtctatttggtttaatcgcgaactttgcacttgtatttaacttggcaatgattttaaccattatgtcttggataggtgcttccctcaccttaccgggtattgcgggtatcgtcattaccattggtatggccgtcgacgccaacgtactgatatgtgaacgtattcgagaagaaatgctctggggggcctcacctaaacaggccattgtggcgggttatgatcgagcctataacaccattttcgactcgaacttaacaacgttccttgttgcattcattctgtttgcaatcggtacaggcccgattaaaggtttcgccgtgacattaatgatcggtattatttgctcaatgtttactgccattacagtaacgcgtgcgattgtacaaatcatttatggtaaacgccgtaacttgaaaaagttgagcatttaa

SEQ ID NO: 1028 - DNA, 195 bp, Acinetobacter baumannii
ttaaatagtgctaaagatagacactcatataacgctctaatttgccctacaagctcacaaaaattattgatgtacccattatcattttttaatttaaatcatttacagctcaagccagtgcaaaattggtgcatatatcaagttgcttttgaagtttattttttgaatatggaagaagatttgaccttgaattaa

SEQ ID NO: 1029 - DNA, 630 bp, Acinetobacter baumannii
tttggatccgcagtattaccacgcaatggaggaggcagtatgaatatgaatttcaaacctcaagcaaaaaaaatgaaagttttagttgcgtgtgaatactctggtcgtgttcgtgatgttttgtataaaggttgggatcttgttgttgctcatcctccttgcacctttctatctgtagctggcaatcgttggtttaacgttgagcgttacgggcaaaaagctattacccggctgaaagatcgtgaacaagcaatagcatttttcaaactctttacggatctggagtgtgaaatggtggctattgaaaaccctattggatgcatgagcaaaacctatcaaaagccatcacaagttattcatccgtacatgtttggcgatcctgagcgaaaagctacctgtttatggttgaaaggcttgccagctttacaggcaactaatgtggttgagccaacgattgtgaaatacaaaaacggaaaaggcactgatagtccgtggcatttggataccttgaaactaccagcagaagaacgcagaaaagctagaagcttaacatttcaaggcattgctaatgctatggctttgcaatggggtggtgatgttcgtcatttagccatgagggaagcggtatga

SEQ ID NO: 1030 - DNA, 600 bp, Acinetobacter baumannii
tatggcaacgcaaatgggaatcagatttcttatatggcaataagagtaatgacaactctgtaccagaggcaattattgaagctactgaaaatcgccgaggtgaaaatgatcaagcctaaatgggggagttatcgtttttcagttgacaagaataagactggtaaaaaacggactaatagagatccatcaccacaaatcccagcatttttaattaagggccagagttatgaatgtgatgttaatacgctgcttagctgtagcgtaaacatcataccgccgtctatgaacaattattggcttgattctggaaaaaccagtaagcgtttaagtaagcgggctaatcattttgttgaggtgatgaagcgttttattcagcctcttcaatacaaaggcgatgtgcaggtcattatcgattaccacatgccagacaagaaagtacgagacatcgataatattttaaaaccttgccttgatgctttaaccaagtgcgggcttattgatgacgactctcaagtaaaaagcctttcagtaaacgctcgtccaattgtggcgggtggtcaaatcgatattcaagtaagaaaacataacacaggggcttaa

SEQ ID NO: 1031 - DNA, 879 bp, Acinetobacter baumannii
aagatgaacgcacatgtttcttatcaggtcgaaccagtagttcgtaaagatctcgattttcatttaaatgaagcacctcgcttttggtttaacaatgacccttttttaactcgtatgtttgatgcactcagcttaacctttccagatggagagcgttacttcattgaatgtgtgcgtatgttccgcgataaaattgatgaccctgaactacaaaaacgagttgcggattttattaaacaagaagctcaacacggtattgcacatgacaaaatgaatcagctcatgaaagagcaaggcatgcctgttgaccagttcacaaccacccttaaaaagattttccgctttgaactaacaaaacgttcaccacaatataatattgccatgaccgctgccgctgaacatttaacagcgttaatggcagaaaccttttatagccataaaaaaactttagaaaacgctcatccttatgttcgagcactgtttgcttggcatgccattgaagaaatggagcaccgcgatgttgcctttgatgtcatgaaacaggtgggagaagttccagagtcaacacggcgctttgtgcttgttttaacaaccgtactcatgttcggttttacgctttaccgtaccaatatcatgttgaaatgtgatggcttcagtccaagagaaagacttttgatgaaccttaaaggtttaccttggttctttggcaaaaatggcacattaacagctatgaaaaaacaatatatggattggtttaaaaaagattttcatccaagccagcatcctgttattcgtcagtatcctgtttggattgaaacactcgaaaagacaaatgaccctattgcagcgggtgaagcattttggcaagcaggtttataa

SEQ ID NO: 1032 - DNA, 1062 bp, Acinetobacter baumannii
aaaggacgcgccatgcaagaatttactatctcaaatggttacttctacctttggaatacgtatttaaaagaaaagggaatagattggcagacacttaatttaagtgaaattcaaacacgtcaagtccaaaatattttatccgcttctatagatgctcaatcttctttagacctttttattgaacttttagagataactgaaacgcgattacatgtgactaatttggctttagagatggcagcctgtattacccctgccaactttggggtcttgggttatatggcgtccagaagtgataccttaggtcaagtggtggagtatattgcaaagtttcaccggttggtcattgacggcgcacaggttgtccctatacaaattgaacaggatgcttccaaaattcgcctatattggcctttggtcgacgacagtaatattctactgagtgagctgaccttggctgcaatggtacagcttgctaaacagattgcccctgtacatgagtttcttttacagcatgtagagttcgtacaccgagcgcgtggggcagtagttcactatcaacgtttctttcagtgcaaattatcatttgagcggccttactatgcattaacttttgcaagtgaaagtttaaatgttcgccctcaacatgcagatccaactttagtgcaacttttggtgaaacaagccgaagaagctttagttcagcggaaaatacatgccgatttagttcagcaaatacattggatcgtacaggaatactttaagcataagcagcaagcgcccaaaatagaagatattgccatcgagctgaatgtttctgttagaagcctgcagcgccaattacaggcattaaatacttcacttaaattaattttagatgctgagcgtatgaaacgctgcgagatattgttaagtcaaaatgaaagtctgactgcaattgccgaccagttgggttattcggatcagtctgcactggcaagagcatataaaaatttaacagggcaaacattattaactcgaaaaaagcaattacaactcatccagaaaaatgcaacgaaatag

SEQ ID NO: 1033 - DNA, 573 bp, Acinetobacter baumannii
tctaggagcgcattcatcatgaacgctaaagtacaaattcaattacaagagcaattagtccctttctataatgctactaattatttaaatgcttataaaattgcatatgaaacggctactcaacttcgcactctactcaatcaaattagtaagtctgcaatcttcgttaaaacctatgctgaagagcataatttagataattcaatcttcatagaggttgaaaatttaatcgcaatctcgcttcaactttccaactcttatgctgatacatgtaacgctgtgattaaaagacatcgtaaagcaccacatgatcaatacgacgctggtgatctaaatgaagcttacgcacttgctcatgaatatacgacctggttagaaactttaatttctaaaattagaatagaagttaagttggttaaagaagcagtaaaagatgtcattcacagctctgtctttgcgacacttgaaagtttaattaatattgctgagtactttgctgaaatcaatgttaatactttttctattgaaagtgaaaagtatgaagctgaatttgaggtatctaaaaatggataa

SEQ ID NO: 1034 - DNA, 1368 bp, Acinetobacter baumannii
atctatttagcttcacatttagcccaagttcaacttgggcttttttgtatttctattggcaaaaatcatcacctgactggtgcgcttatcgtcattgcgttgccttttaaaaccagtacactcaaaacacaacaaagtttaagtaataaaaaaggaactgttatgagcgaggcttatattattgatgccattcgcaccccacgcggaaaaggaaaaaaagatggctctctttacgaagtaaaaccaattacattactgacgaccttattaaatgaattacagcagcgccatcaactcgatacctctaaagttgacgatattgttttgggctgcgtaacaccaattggcgatcaaggtggtgacattgccaaaacagcagcgattgcagcaggttggaatgatgatgttgctggggtacaaatcaatcgcttttgtgcatcaggtttagaagcagttaacatggcagccatgaaagtccgctctggttgggaagatttagtggttgctggtggcgttgaatcaatgtcacgcattccaatgggttctgatggtgggccgtgggctttagatccagaaacaaatcttaagtcatcatttgttccacaaggtattggggccgacctcattgcaaccttagatggctatagccgtgaagatgttgataatttcgctgtgaaatcacaacaaaaagctgcggcagctcaatcaaatggttatttcgaccaatcagttgtgccggtaaaagatcacgcaggtgtggtaattttagagaaagatgaatttattaaaggcaataccacactcgaaggactaacgaagctcaacccaagttttgaaatgatgggccaaatgggctttgatgcagtcgctttacaaaaatatccagaagcacaaaaaataaatcatgttcatcacgcaggtaactcatcaggtattgtcgatggagcagctgtagttttattagcttctgaaaaagctgtcaaagaacaaaatttaaaaccacgcgctaaagttttggcgactgcactggttggtaccgacccaaccatcatgctgactggtcctgcccctgctgcacgcaaagccttggaaaaagctggtttaacaattgatgatattgacctatttgaagttaacgaagcatttgcagctgtcgtgatgcgttttataaatgaacttaatgtacctgctgaaaaagtcaacgtaaatggcggtgcgattgctttaggtcatcccttaggggcaaccggtgccatgattttgggtacattacttgatgagcttgaacgtcaaaataaaaaacgcggtttagcaacgctctgtgtcggcggtggtatgggtattgccaccattattgaacgtgtataa

SEQ ID NO: 1035 - DNA, 351 bp, Acinetobacter baumannii
cgaattaaagcacctcaatcgcgcacaccaagcaataggggaagtttcatgagcacacaatttcaatctcaagcagattttaagcaaacaagccaagtccaatcgttttatgagccagcaatggcggttgttaatgagttgatggctgttaagaaatctaaccttaaaagtaaaggctacgatgagaataacgctgctattacgaaagaagagttgcgccaatctttaatgcgccgtttacgtataagccatttcatggcctctcaaatagtcaccagtttgtctaaatctggtcatatccgtgagtttgggggttatgttgctcctaaggcggtgagtaatgacaagtag

SEQ ID NO: 1036 - DNA, 318 bp, Acinetobacter baumannii
aactgcaaagctatcagatattttgaacatctttcgaggtggcaagtcatgatcgaattgttatttcaaaccgttgctgttttagcttatctcatttgcggttttcgtattgcaacctttagtcatggtggaaatttccaccgtggctattccttctttgcagcaactttaattgcagcatttttaggccaatcggtgcatatcttattttttaaggatccagttacgctttgggatgcaatctttgcaatccttcttgcagtactcatctggcgaacaaaaggtaatgtggccaaactcatttggagtacgacatga

SEQ ID NO: 1037 - DNA, 4539 bp, Acinetobacter baumannii
gcaaaagaagcctttgctatgaaagaaatattaaaaactttaactgaagcaatgacgctacctgaagatagctattctgaacaagatgctgagtttcttgagatcttcattgaagaaattgaagagatttttgttgatttgcaacctttgataaataaatggatgcagtctgagaatattgctacgctcactgaaattcgtcgtcatttccataccttaaaaggttccggaagaatgattggcgctaaatcttcagctgagcttgcgtggacagttgaagatacactcaaccgggtaatcaaccaaagcttacaattaacgccaactatccagagctatgtgcagttagtatttaagttctatttccttaaattagtagataattttaagcaaaaacgagcacataccttagatttcagacctcttattttattaggccaacaactacaacaacagcaaagtttagaaccagctttagaagagcttttacaactttcaaatacgcttacggccgaaacagtgactggtcttgagctaggttatatcgaacaagattcgttagccgagccaatcattcaaactacacatactgaaattgaaataaatctagatgaaaccttgaccttatttatggaagaggcagaagaacatttagccacgatccatcaattcttagatcaagagttacatcagtacgacagttataacgctttaatccgcgctttacatactttgcgtggtagttctgcaatggcgcaggtcgaaacaattttcgaggccagtaccaaagttgagcatttatttaaaatactgctgcaagaagagttatcttctcactctgaagaaattttattattacaagaatatcgtgagtttgttcgagatagcttggaactactatctagatatagttcaagtgaacagctcgaagcgagattgcagcaatttaatcaatcttgggatgcatatgttgagcaacatggtgaccgaacagatccgttaatgccttctcatggtttggtatcacaattattacaattagatgtttctgaattactggatgcagaattagattttgagaagggtattcgtaatgagtttcctgattatcttgaacgcctaagtgaacaggctaacttattactgcaacatacacattctcaagcaatgctgggtttacatgaatataccagccaactgaaagaaagttatgaagtactgcttgataaacctgcgttattacaatcagactatatatttgaaatttatcaaaaagcacatcaacagctcattcaattatttgatgctttagctgctggtcagcgagtgggtgttgttaagcaacatcaaagtattttagaagaattaaaactttatacgcagtacactccagacctatcaaatgacctgcctcagcaggattcgacatcttttgaaccaatatctaatattgaaccagagccagaagtagtagctactgtagagaatttctcagactctgcagactgggcggtattaggtcaaagtgtgcagcaagatcgacaatatatttcatctacacaagtgaatcgaaattttgatgctgatcttttagatatctttcttgaggaagctgaagaattacttgagggaattgataccgatcttaatatttgggtaggtgagcaagaaaactttgcagctctgaacaatctaatgcgttatttgcataccttgaaagggggcgcaaatatggttcaggcaacgtatcttggtttgattgcccatgaattagaaagcatctatgagcgtttaattcaaaagcaattagtggcaacttcagatttaattgattttattcgtttggttcaagatgacttggctgaccgtttacaaatcatgcgtgaacaacaactagattatgcagccccttacacaattaacgcattaaaacgagcgggtcaaaactctaacttccaacctttatcagtggttgacgcatttgatactgaaagtgagatattctctgagcaagaggtgatatctgaagtaataatagatgagataccagtagaacttgagcctgctcttgcagaattagaagctcatcacgatcaggtattcgatacagcggttaccgagttagctactccagttgaagtgattacctcggttacatcgcaagagaatagagttgcagctaatgaacaggacattgaggctgttgttgaacagacgttcctagaagaagctactgaattgttagaaatggctgagtcgctattaaaacaatggtttgaacagcgtacaaaccgtagtattttgcttcagctacaaagagccatgcacagtttgaaaggtggtgcacgaatggtgggtttagaagccgtacaagcaattgcctaccaactagaaaatgcttttgaacaatttgcgctacatcacttcaattcgaatatttatgatcatttattagaaagtgcgattgcatggttaaaagatgcaattttcaaccacaattatcagcatttcgatggattacagcaaagtttagaaaatattcaattctttgaaactacaatccagattccgactaagttaactagagcggacttgtttagctcagaaccagtgatgacctttatacaaggtgatggtacagagcctccaccaatgatgggtgcatgggagcaaacagagcgtctggatcagaataatgaaatgatccgtgtttcagccgacttaatcgagaaaatgattgatttgtctggtgaaaactccattaaccgttcacgaattgaaatggacctaagccagtttagccatacactagttgaaatggagttggcgattcaacgacttgccgatcagttacgacgaatggaaggtgagttagaaacacagattattgctaaacatggaattgaacattctcgttataccgactttgatccgttagagatggaccagtattcatctttaaatcaattgtcgaaatcgcttgctgaatctgcatcggacttggtcgactttaaaaatacgttatctgacaagatcagagataccgaaagtttgcttttacaacaatcacgaattcaagcggaaattcaagaaggtttaatgcggacacgtttggtcccattttcgcgtttattgccgcgtttacaacgaattgttcgtcagacatctacagcattgaatagacctgctgagcttttcgtaaataatacagagggtgagttggaccgcaacattttagaacggttagtgattccgcttgagcatatgctcagaaacgcaattgaccatggtttagaggaccgagcgcagcggcaacaagcaaataaaccggaaacagggcgtattgaacttaatattcagcgtcaaggtacggatgttgtggttgtctttagtgatgatggtcaaggcattgatgttgaaaaagtacgtcagaaagcactccttgccggattgatcaagccagaacaagacttagaacagcaagacatactgcaactcattttccatccgggtttaagtacagcagagcaagtcactcagatttccggacgtggtgtaggtcttgatgtcgtgcagagtgatattaagtctttgggtggacatgtcagcgttgaatccgtctatgggcagggaacaacatttacgattcgtgtaccgactacagtagcggtaagtgatgccttaatggttaaagtggcagatcaacaatttgcgattccacttgctcaaatcgatcgaattattcgagtgtcaccagcctctttagagcagtattttgaaagtcctcaagaactatttgagtatgaaaatagacgttatccattacgttatctttcagaatttgttggcaaccaacccataccacgtttaaatggtgtgatgtattcattacctgtgttaatgattaaagccaataatggccaaactgtggcattacttgttgaccagttaattggctctcgagcacaaattgtagtgaaaccaattggtcaacagttctctagcattggagcaattgcaggcgccacaattttaggtgacggacaggtctgcttaattttagatggacaaaatattgcgcgacaaattcagtcaactcagcgtcataaacaacttagtgaagcagtgtatagacaccgagagtctgatgaacgccgcctcatcatgattgtagatgactcagtaactgtacgtaaggtcacgtcccgattgcttgaacgtcaaggctatgatgtggttacggctaaagatggtgttgacgccatagagcagctagaaaatattaagccagatttgatgctacttgatattgaaatgccacgtatggatggttttgaggttctcaatcttgtacgacatcatgatattcatcaatacatgccaattattatgattacatccagaacaggcgaaaaacatcgtgaacgagcattctcgttaggtgtaagtcaatatatgggtaaacctttccaggaagaagagttactagagaatatcgatgctttacttgtagcgtctgacagtgaggtcaaatcatga

SEQ ID NO: 1038 - DNA, 912 bp, Acinetobacter baumannii
tgccacggagcacatatgcacgcttatacggttgagcctttatatgttccatgtgatcaggaaatgatcgcagctgacttttatattccaaaaacaaataataaatctgcggtaattatcatggcacatggttttgccggattgcgtcaattcaaactcattcaatatgcccagcgttttgctcaagctggctatgcggttattttatttgattaccgatattggggtggaagtacaggtaagccccgagagatgatttctatcaactctcaactagaagactggaagaccatgatccaatatgcttctacgtgtaaatttatagataaccgaagaattgtattgtggggaacatccttaagtgggggatatgctttaagcctagcttctgaattaaagaatattcaggccattatggtacaaattccatatgttgatggtgcggaaacagcaaaattatatccactacagcgttatccccaagctttaaagttgtcgagccaagattatatgggttcaaaaatgggccttaaccctaaaaggttgcctgtggtagatcaatataaattgtgctttatgccaacagcagatagctattatggttatttatcgattgtgaatccggattattactggagtggagaagtcccggcacgcgtgttttttaatttgatgcgttatcacccaattcaactcgtacgtcagattaatattccagtttcatttattgcggctcagcatgattctttgattccaattgagtctagtcgtgaagctgcgactaatattgctccttttgtgagttatcatgaatgggatatgaaacattttgatatctatcacggttcatggtttgaaaaagcagtgacgacccaattagaatttttacatcagcatataggagtgatgtaa

SEQ ID NO: 1039 - DNA, 438 bp, Acinetobacter baumannii
atttcgggagctaaggtgtcagaagcttataccaaaccagaaggaattttatccttacaaacgattgccatgccagcagatacaaactggagtggtgatgtgtttggtgggtggatcgtgtcacaaatggacttggctggagcaattcacgcggagcgttttagtcgtggtcgctgtgctacgatttccattaatcagatgacctttttggttccggtaaaagtaggctttgtcattagctgctataccaaaatcctaaaagtgggtaatacctctattcaaatgcaaattgaagtttgggatagccatgatgactctcgtgccccaattcgtattactgaaggggtctttacctttgttgcagtagatgtaaaaggcaacaaacgtcagattcctgaggaagcgaaacagaaatttcttatctctcaagaatcgtaa

SEQ ID NO: 1040 - DNA, 663 bp, Acinetobacter baumannii
gtttggttggctgggcaactggcgatttatggggtgttgtacttccttggtggtctattacgtttaatcattagtcatcaagttacattcttcatcaactcactttgccacatgttcggtaaacgtccttataccgatgaaaactcagcacgcgataacttctggttagcgattgcaacttggggcgagggttaccacaactatcaccatattttccagtacgattatcgtaatggtgtgaaatggtggcaatatgatccaacaaaatggctcatttggacatgctctaagatcggtttagcaaagaacctacgtcgtattccaagctttaatattaaaaaagcagaattggcaatgaagtttaaatatgctgaacaagacttggctatttatggtcatgatgtaaatgccgacattagtcaaatgaagcaacgtattgctcaagagtatgaagcatttacgcatactttaaatgactgggcgaaactcaaagaacaagagttacaagcaaagaaagcagcaatggctgaaaagattcacaaaatggatcacaagttaaaagttgatttccaattgcttgaacatcgtttgagtcatcaccgtgagtgtttagaaactttaatgcgtaacattaaaaagaacacaaacgtcgtaccagactaa

SEQ ID NO: 1041 - DNA, 225 bp, Acinetobacter baumannii
ttgattatggcaatgcgtcctgacgttcgtcgacatgctttagtcgtgattgtattttctctcgcacaatggtttttcatgcgctatatccttgcgaatgaattatttaaccttacaacaaatcaacgtattctttatttctgcgtaagtagtttagtcggtgcattacttatttttgttgcgctgatttatatggtcttaaaaggaaatgcggataaaaattaa

SEQ ID NO: 1042 - DNA, 693 bp, Acinetobacter baumannii
ttgtgcgtggccgtcacgaaaacttatttgtcgttgagttttcacaaccaattttgccagtacttgagcaatatggtcagttacctattccgccttacttcaatcgtgaagcagaagaaattgacactgaacgctatcaaacggttttccataatccagaaaaaattgccagtgtggctgcccccaacagcaagcttgcattttgacgaagagttgttagcagagttagaccaaaaaggtgttaagaaaacgtttgtgactcttcacgtcggtgcaggtacttttatgcctgtacgcactgatgacattacaaatcatgttatgcacagtgaatggtgtgatgttcctcaagaaactattgatttaattttggcaactaaagcacgcggtaataaagtgattgctgtcggtacaactgcaacacgtgctttagaaagtgcagctcaagcgcatggcggaaaaatcgcagcatggactggtgatacgcaaatctttatttatccgggttatgagttctgcatcgtagaccgtttaattactaacttccatttacctgagtctaccctgctcatgttagtttcagcattgtcaaatagagaaaatattttggctgcttatgaacatgccgttaaagatcgctatcgcttctttagttatggcgatgcaatgctgattgataaattagaagtttaa

SEQ ID NO: 1043 - DNA, 645 bp, Acinetobacter baumannii
gaattaagggcaaaaggacagcaaactgatacaaaaaagttagtagatccggttaaagcggatgcagataaaaaagctgctgaagcgaaacgcttagctgaagcggataagaaagcggctgaggcaaaacgtcaggcagaagcagacaagaaagcagcagaggctaaacgccaagcagaagcagataaaaaagcagctgaagctaaacgtcaggcagaagcggataagaaggcagcagaggcgaagcgccaagcagaagcggacaaaaaggctgctgaagctaaacgtcaagcagaagcagataagaaagcagctgaagcgaaacgtaaggcagaggccgagaaaaaagctgaagcagagaaagcacgtgagttgcttgaaaatggtgataaaaaatggatggtacaggttgcattggctgctaaccaagcaaatgcagatgctgtagtctctaaattacgtgcaaaaggctataaggtcacgacgagcccaaccagtaaaggtatccgtattatggttggtcctgcaaaagatagagatacggcagatactacacgtaagaaaattacttctgacgccagtttaaatatgaagtcagcttgggtgattgactgggtgcctttagatcaacgtaagtcagattaa

SEQ ID NO: 1044 - DNA, 972 bp, Acinetobacter baumannii
atatataatttaggtgtctctttcgtttttattattaattttatgattaagcaaaaaaatattattattgggtcagctacaggatacaacgctgacctgatctcttcttttgtatattctttgggaaagacagactttgatggcatattgactttaattatatataaagagcaaatgacagagtttgtgaatgcattctcagacgtcaaaaattttaaaattgaatttaaagtttcaactattggtaaatttaaatcaaagtcaaagtattcaggtatttataaatataaatttgtgaaaaatatctttaagaaaattattgacttaaccgtaaacgaagaaaaacccgaaacaaagataaaaggtcttaaaatcacaggttatcctcatgtgagccgtttctttgaatataaagaaattgtagaaaaccatcctgatgcttcacatgtattgctaactgatgttcgagacgtttttttccaaagtaatccttttaagaatcttggcaaaggtttatttgtcggaatggaaaatccagactttacgataggtactgagcaatataaccaaaagtggattttggatgcatacggtgagagtttttataaccttgcaaaagatgagcaagtctcttgttctggcgttactattggggatcatgaatcaattaaagtctatatcaataaaatgattgacgaattctgtaaacagccatatcaaaaaatgtctaacagaatttatgatcaagccatgcataataaattattaattactaatgagttggtagaggtaactcgttgtcagccatttgaatctattattgtaactcttggattatatccaatagagcaaatttctattaatgatcaaggttttattattaaccgtaaccaagaaatcattcctattgtccatcaacatgacagacatccggaactgattcagttatgtgataattatattggaaaataa

SEQ ID NO: 1045 - DNA, 279 bp, Acinetobacter baumannii
atgacaaatttcttcatattttttattatcgttttcatattatcactactcatcttgtggatgatgttggattatcaattcaccagatatattcgtacaataaaagttgctcagctaggaaacatggatcctagttcagttctcactgatgaaatacgaatcaatcaaaattcagaatcgacatcaaggggtacaaaaatgtggctatacccagcccttatcggattaatcattggtgtaatgatcagtggttcattattcctctatgtctttggataa

SEQ ID NO: 1046 - DNA, 2130 bp, Acinetobacter baumannii
actaatttttatgctgtgaatgaacagcgtatttttctggggagaagctgtatgggctttaaacttaaaaagaaaagtggcaatcgcggtgctaccggaaaatcgagtgtcaattttattgtaaaaatccagtcaaaaattgagcagtttgccagtttatttggggaaagtgaaaagtccaagcctatcctttatgcagcgctgttatgtttagtatgtgcgttaatttcattagcttatctattttataatgtacctcgtcataaccagttaattcgaagtcttggtgagttacgtctgttatctcaaaccatttctaaacaagcaactgaagcaacagagtcgggttctcaagaggcaatcacaaagttacagcaatctaaaaaagactttgatgagaacttacttgaaattgaaaatattcacggtaagtcgaccgatgaatatcaaaaagttgagaaaatatggggtgaggtttcaaaaaatattgatttgatttcatcacatcaacgagtacttaaccagttatatgataccaacatctcgattagtgaaacggttccagagattcaggcagaatataacttgatggtcgaccaaatggctcgccaaggtttgccaagtagtcaggtaattattgctaaaaaccaggtatttattgcagagcgtattttacgttcgattaactcggtgttaagtggtacggacggaaatgtatcaactagtgactttagtgtcgatattgagacttttggtacttatttaaatgctgaactgaatggtaatgccgagttaggtgttgatcgtattgctgatccggctttacgtgaatctttagaaagtattaagtctgaatatgacaaagtcttaaaatctgctgctgcaacggtattaaaaaatggtagccagattgtcaatgttcgtcaggcttcttctcagattttcgctaaatcggatgtaatgttggaaagtctaggacatttatctgatgttgcaagaaagaactggctcaccttatttttaggtgctgttcttattctttcattaggcggactaattttctctgtattcaagttaattacactacgtagtgtaatggataagcaacgtgttgctcgattacaggaagaatatgaccgtaaccagaatgcgattttacgtttacttgatgaaattgccgatttggcggatggtgacttacgttcatatgcaactgtatctgaagactttacgggtgccattgccgactcgattaacttcgcaattgaccaactgcgagatttggtttcacgaattcatgaaacctctcaggaagttgcacgctacacacaagatacgcaaagtattactaaccagttagcagaggcatcagaacatcaggcgcaagaaattgcaggtgcttctactgccatgaatgaaatggcacagtcaattgaccaagtatctgccaacgcttctgaatctgcggaagtagcacagcgttcagtacaaattgcatcaaatggtgcacaagtggtaaatcgttcaattgaaggtatggatactattcgtgagcagattcaggaaacttctaaacgtattaagcgcttaggtgagtcttctcaagaaattggtaacatcgtatcgctcattaacgatattgcagaccaaacgaacatccttgcattaaatgcagcaattcaagcatctatggcaggtgaggctggccgtggtttcgccgtggttgccgatgaagtacaacgtcttgctgagcgctcagcatctgcaaccaaacagatcgaaacactggttaaaacaattcagaccgataccaatgaagccgttatttcaatggaacaaacaacgacggaagttgtacgtggtgcgaatttggcaaaagatgcgggtattgcactggatgaaatccaaaaagtatcgggtgacttggcaaaactgattgcgagcatttccgacgcagcaaaacttcagtcagcatctgcgagtcacattgcaaccaccatgacggttgtacaagaaattacttcgcaaacaacaacggcaacgtttgatactgctcgctccgtatcagagttggcgaatatggcagagtcattacgtgagtcagtaacggactttaaattacctgactaa

SEQ ID NO: 1047 - DNA, 1293 bp, Acinetobacter baumannii
cgtaacctttataaacaaagacataaaaggttcgtaaacatgaaaacgcataaatctttgatggtttcctgtttatccgttttatcaattactctttttgttcagcatgcacaagctgctgctgcatttgacccaaatggttcttggatgttgggtgattggaacgggcaacgtacagcgttgcaagcacaaggttatgatttttcttttggatataccggtgaatatgccggtattttagattccaaacaaacatctacacacggtagtgcttatacagggcaacttgctttaggttctcatttggacctaggtaaaattttagggtggcaagatacagaagctcaaatcacattaacttatcgtgatgggcaatcgctttctgaacattctccagcattggctgggcaccaaagttctgttcaagaagtgtggggccgtgaacaaacttggcgtttaacagatttatggatcaagaaaaaattccttgatcagaagttagatgttaaagtgggccgttttggtgagggtgaagactttaatagttttgactgtgatttccagaacttggcactttgtggttcacaagtgggtaactgggtaggcgatcagtggtataactggccagttagccaatgggcaatgcgtgtcaaatataacttgcaacctgatttatatacacaagtgggtgtatatgaatataaccctgaaaacttggaacgtggcaaaggcttcaacctaagtacagatggttctcacggtgcaattattccagcagaagtagtttggtcacctaaattaggtgtgcaaagcatgcctggtgaataccgtttaggttattactatagtactgccgatgccaaagaaattgcagattcaactaaaacatctcataagcaaggtgtttgggtaactgcaaaacagaaattattccagccagctgatcaaactgaccgtggtttaacagggtttgtgaacctgactttccacgactcagataccaacaaagttgataacatgcaaaatataggcttagtctataaaggtttgctcaatcaacgtcctcaagatgagttggcacttggtgttgctcgtatccatatcaatgatgattggaacgatgttcaagccaaagaatacgacaccgaatataataccgagctttactatggtattcatgccactaactggctaactattcgtccaaatgtgcaatatgttcgtcatgttggtgcattaaaaaatggtgataacacttgggtaggcggtattaagttctcaactgcattctaa

SEQ ID NO: 1048 - DNA, 186 bp, Acinetobacter baumannii
atggtgatttataataatttgtatcgaaaattgattattgtttttagtccttgctttaccccaagcaaggattttttttatttaaccttcttagctttatctattcgggcttgttccctctttaaagcaatggtcgctgtctttttagttttatatattttgatgagctttaagggattgctctga

SEQ ID NO: 1049 - DNA, 483 bp, Acinetobacter baumannii
tcgttaccttatagcttagaaggattaaatatgggatataaaaagaagttttttgaaccgattacaggaaccagtattaaccgggctattgatctatgtaaaagcattccagaaaaattggaaaaatttcaggaagatattcgttatttggattccaatcagcttttccagaagcagtttattcatcagttattagttatagtaaatgagcttgaggaattaaatcaattgctattaattatggcgaagccaaaagatatatatttttcctctttaaagacagcattagcatggatcagcaatatatccaatgctttaattattacggagtattatctcaatcctgagaataaatataagcgtctattgaacaagcatacgtttggttttgaaataaatttaattttaaagaaagtggactctgtcaaacaaattctagaacgtataagtaagggagatcccgttaataggagaattcattga

SEQ ID NO: 1050 - DNA, 609 bp, Acinetobacter baumannii
ataatgaatttacttcctccaaataccacagcttttgaaaagaaaattgttgagactacatccaaaacaaccgagctaaataccaacttatcaagcttgattcgtattgatgacgctcctgcagatttcttatctattttagcttggcagttttcagtagaccgttggcaagatgattggccagatgaagtcaaacgtgcacaaattaaaaactcaatcaaagttcatacatataaagggactaacttcgcacttcgttcaattgtagaaagtttcggttattcattaactgttcatgaatggtggcaggaaagtccaatgaatgaaccaggcacatttcaaatcacgatagaaacgaatggaagagcacttacagaaaaaacttctaaaacacttgttgaacttcttcacgatgcaaagccgttaacacgtgaacttaaaggtattgagattaatgtcatcaatattgaaggcgaaacaaatgttgcctgtggctgttacagcggtgaagacgtaacgatctaccccaaagtagatgatcctaactctttaatctatccaatttttgctttttatgagcacgaaacaaccagtatttatcccaaatag

SEQ ID NO: 1051 - DNA, 1023 bp, Acinetobacter baumannii
aaaatcctctatggagatttactaatgtccgacagcaaagtgcaggcatttacattcggtgacgctgaaccggtgatgaatggccgtgacttatcacaattttatgaaacatggttatgtggtaattattacgagccacatatcagtatgaatgctttggcgaaatcatttaaagcgatgccttatttgtcgactgcagtgttttataaaaagaatcaactggtatcatcatttatcccaaataaattgatcaagtcttcagagtttgaacgcattgcatttgattatttagtttttggtaatggttacctgcaacagatcgataatcgtttgaatgaaccacatcactatgacggactcatggccaaatacaccagacgcatgaaaagatctaatgaatttttacaattgctgaatgggtttgaagaacatatttttaaacctggtaccgtttgccacatcaaaggcattgatgtcgaccaagaaatctatggtactcctgaatatatcgctgcgcttcagtcagtttggttgaatgaatcggcgactttattccgtcgcaaatattataacaatggatctcatgctggcttcatcttgtatatgactgactcaggtattgatgatgatgatgtggagggtctgaaacaggccatgaaagattcacgtggtccaggtaactttcggaatttattccttcatgcacctggtggaaaaaaggatgggttgcagcttattcctatcagtgaattggctgctaaagatgaattcttgaatattaaaaacgttacacgtgatgatgtacttgcatcccaacgtaccccaccacaattactcggcatcattccatccaatgctggtggattcggatctataagtgaagcgcgtgaagcatattggtattccgagattgttccacttcagaatttatttgcaaacacagtgaatgagtgggcaggtgaccagatcatccgtttcaaagagtttagtcagcttcaattcaaacaagaaaaaccacaatga

SEQ ID NO: 1052 - DNA, 198 bp, Acinetobacter baumannii
gacagattatatatacttcaaaagtctataattttgtttattttatatgcgctgataatgttactacatcaaaaaaatgctgttactacatcaaaaaatattgagagaaatagctgttatttctctcttattctcaatgaaaaaacctatgattatttttctaaaataacatctgctaactgttcagcaatttcttga

SEQ ID NO: 1053 - DNA, 1371 bp, Acinetobacter baumannii
ttgaggatatatggagttctactcaatatgtatccttattctgctatggctaagaaaactattccgctatccgactccaaatgcactggtgcaaagccgcaggaaaaggattattccttatacgatggtcatgggttgattctattcattcgtaaaagtggctcaaaagtatggcgatttaaatataaaagagctaatggtaaagatggcttaatgactttgggcaacttccctgctttaagtttaaaagctgccagagataagcgccgtgaattggagacactattagctaatggaatagatccaattgaatacaacgaaatacaaaaggctaaactagacaataaatataattttgaatctatagctcgagaatggcatacagcatataaaagtactggacgttggggaactgaaacagcagaaagggctcttaagaatatggaagagtatgttttcccaaaacttgggaaaaagcctattgatgcaatcaagccaaaagaactaattcaagtaatcaaaagtattgaagacttaggttataccgaagttgtaaaaaaaacccggcaacggctaacaagtatttttgcatttgcaatgtcgaaaggatttattgaaagtaatccagcctatggtcttcaagatattttcatcctttcaaagaaaaccaaacatcatcctcaattaccattagaaagattgcccgagttacaagctaaattagcttccgacactggtcatccacttactcggctatgtgttgaatttgccttacatacttttgctcgttcaagtgaaatcagatttgcaaggtgggaagagtttgattttgaaaaagctatttggaccattcccccaactagagattttgtagaaggttataaatactcttatcgcggtgcgaaaatgaaaacacctcatttaattcctctatcaaaccaagcactagctataataaaagaggtctacaaatacagcggacacactcaaaatgtttttcctaaaaacggtgatccgcatggctttatgagtgaatcaactatcaataaaactctacgccgtctcggatatgatacaaatacagaagtttgtgggcacggctttagaggtatggcctgtgcagccctaattcaaagtaaactattccagaaagatgctgttgaaaaacaaatgagtcatcaagagcgtaataatgtacgacttgcatatacccataaagcagagttcttagaagaaagaaaaacaatgctcaattggtggagtagttatttagatgtgactaaagaaacaagtattagtccatatgattatacagcacagattttaggtgaagagatcatacaatttaagtatgcaaaattgatgaaataa

SEQ ID NO: 1054 - DNA, 381 bp, Acinetobacter baumannii
cgaaagtcatacccacaccaacaaaaaaacgaggttcatatggcaggatggtacgaaattacacaagcgaatgatggacaatatcgctttgtacttaaggctggtaatggcgaaattattttaaatagtgagctatataaagcaaaagcatcagcagtcaatggtattgagtcagttcaaaaaaatagtagtgacgatgcgcgatatgatcgtttaactgcaaaaaatgggaaaccttacttcaatttaaaagctgcaaatcatcaaattattggttcgagccagttttatgccagtgaagcttcacgagataaaggcattgaatcggttaaaaacaatggatcttccacaaccattaaagacttaacagttcaggcgtaa

SEQ ID NO: 1055 - DNA, 888 bp, Acinetobacter baumannii
aatattacataccacacgttatacttgattaatccagtatatctgttaattctgcgagttggcatgcctgagttacccgaagtcgaaaccactaaaaccagtttatttcccttattgaatcaaaaagttctaagtgttgaagtacgcaatcctagcttacgctggcctatcccagataatgttcagaaacttgttgggcaacgtctcattgggttaaatcgacgttcaaaatatattttggcagagtttgaacaagatcaaatgctctggcatttaggaatgtcaggtagttttcgcctgtgtcaaccaaacgatgaattgagaaaacacgatcatctcattattcaatttgaagatcagcagttacgttaccatgacccacgtcgttttggctgtattctttggcttaaccctgaaactcaaggcaaactcatcgatactttagggccagagcctttaagtactgactttcatgcagaatatttagcttctaaactcaagaataaatctgtcggcataaaaattgcactcatggataatcatgtagtggttggtgttggcaatatctatgcaactgaaagcttgtttaatgttggcattcatccagcacagcccgctggtgatttaaccatgcaacagattgagaaactggttgttgagattaagcgaattttgaagtcagcaattgatttaggcggctcgactttacgagactacagcaatgccatgggtgaaaatggttattttcaacagactttactcgcttatggtcgtgccggtgaaatgtgtgttaactgtgaaaccacattagaaaacttaaaacttggtcagcgtgccagcgtattttgcccccagtgccaaccgcttaaaaagctgagaaagccttaa

SEQ ID NO: 1056 - DNA, 2073 bp, Acinetobacter baumannii
atatttaaatacgaggttaagtctttgaaatctattttacttaaaagtgctcttacgattgcacttatgtcttctgctaatttggtaaatgcggaattagtgacaacttctcaaatcaaaaaaatatcaggtatagatcaacaatatattgattcttctattagtgaaaagaacgatttttatgctcatgtaaatggtatttggttaaaaaatactgaaatcccagctgataaagcaaattggggtgcttttaatcagctccgtgagttatcaatcagtcaagtacatgggattgtagaagagctatctagaaaaaaatgggcggatggtagtttagagcagaaaatagctactttatatgcgagctttatggatgaaaaaggcattgaaaagcaaggtattatccccctacaagctgagctaaatcaaattgatagcttgaaaaataagaaacaaatagcagttttaatggcccattttgctcgtattaatgttaatagcccgattggcttaggcattgaacaggatatgaaaaaatctaccgaaatggtggccggattggagcaaagtggtttgggtctacctgaccgcgattattatttaaaagatgataaaaaatttattgaaactcgtgcacagtatttaaagtacattgaaaaaactttatcacttgcagaagattcacaagccgcgcaacatgctcaggaaatcttaaaacttgaaactcagttagcacgaatacagtggagcaatgtacaaaaccgtgatcttgcaaaacgctacaataaatacaaactcgcagatttgtataaattgacccccgcatttgattggcaaggttatctaactgcaactgaattaaaaggaaaaattgatactattcaggtaaatcagccagattactttcagggcttaaatacaattattcaaaatacacccttagatatatggaaagcttattttaaattgcatttgatcaataatttttctccattactaaatagcgcttttgtagataataaatttgatttttataacaagacacttcgagatattactgaacaagaagcgcgttggaagcgtggtgtacagcttgttgataaggtgctgggagatggtatcggcaaactttatgttgaaaaatactttcctgctgagaaaaaacaacagatggaattattggttcaaaatctgattcgtgcttatgaccaaagcattacagaattggactggatgagtcctgcaacgaaaatacaagctcgtaaaaagctttctcacatgtcaataaaaatcgggtatccaaaaaagtggcgtgattattctgacctgcacatcgctaaaaatgatttagttgggaatataattcgcgcaagtgaatttagataccaatatgaacttaataaattaggtaagccggttgatcgtgatgaatggtatatgaaaccacaaacggtgaatgcctattacaatccatcattgaatgaaattgtatttccagcagcgatattacaaccacctttttttaatataaacgcagacgatgcagtgaattatggtggtataggcgctgtgattggccatgaaattagtcatggctttgatgatcagggtagccagtttgatgaattgggcaatatgagaaactggtggaatgctgaagatcaccagcattttaaagctaaaacacaagcgttgattgaacaatataaccgttatgaaccgattgctggttatcatgttaatggtgaattgacactaggtgaaaatattgcagataactctgggttagcaattgcctataaggcctatcaaattgcattaggcggtaagccagcccctgtaattgatggacaaactggggagcaacgtttttatatggggtgggctcaagtttggcgtgcgaaaacccgcgaagctcaagcgattatctatttaaaaactgatcctcactctcctgataaagtacgtggtaatggagctttaatgaatcaaaaaccattttatgaggcttttaaaataaacgaagatgatcagatgtatttaccaccagagaaacgggtaaatatttggtaa

SEQ ID NO: 1057 - DNA, 570 bp, Acinetobacter baumannii
cgggataaatacgcccgttttataggatcgagtatggcagcgaatggatttatcgagttacttcgtttgtctaaacggggtaataagaattacgcttcagttcaaaatgaagcacagcgatggtcaggaattgcttttgaaatgagagggcaatacttcgtcgcaccacttggggaagtgtcagaagttatctatccaccgaaatatacaccagttccaaatactcaaagttgggtcaagggattggcaaacattcgtggaagattactttcggtatctgatttggctcattttatttcagggcaacggagttcattttcgtctacccaaaaagtgctgtgtattagccatcatgaccagtatgtggggttggttgtggatcaggttttggggattcagcactttaataaaaaaagttttttttctgagagttcagacttagaggaaaacctaaaagaatattgccaagggtattttcaccaacacaatcaacattggcatgtctttttatttagtcggttattgcaaaacccacactacatgaacgcatcgacaaaatttataaactaa

SEQ ID NO: 1058 - DNA, 1179 bp, Acinetobacter baumannii
ttaagcaaatattctaaaacaatgtcatgttcagccatttaccttgatcatttcggcaatttaacatgtaaaaattgcttttacactgttgtaaatcgccaatttatttttttagacggtcatttaggtcaatttaaagtgaacatcaaagagactgaaggattcaatatgagtcgcgatacgattagcatccacttcgtgaatgcggctttgacaggcgtaaagcgccttggcatggatgtcgagacgttactttcacatgtgggtatcgaagcggaattattacgtcaacctaaagctcgaatctcaccagaacaatacactcgttttataaaaatgttgtggatggtcacacaggatgaacacgttggatttgacgtacaaccgcgtcgtctgggcacttttgccattatgtgtcagttgattattcacgcaaaaacattgggccaagcccttgaactgtcatctcaattctacaaattatttggcgatgaatggtctgtaactctagagcgtgacaaacatgaagcacgtctagttcccctcattccaaaaactttagatccagaccatttcattactgaaagcatgctcatgatttggcacggtctagcatcatggttgattgaacgtcgtttgccattagaacgtgttcattttagctatccacgtcctgcacatgccgatgaatatgatgcattattttttgcaccagttatgcagtttgatgcaccacgtactgaaattacctttgcagctgattatcttgatttgccaatccgccaagatgagaaaacgctagaagaattcttaaaagcagctcctgctcagcttttagtaaaattcaaaaacaccaactcgctaacttctcgtattcgtgaagtgctcaaaagccaaattggtgaagaaatgccaacgcttaatgacgtggcatcaatgttgtatttatctccgcaaaccttacgccgccgcttggctgccgaaggtaaaagctaccaaggcgtaaaagatgccctacgccgagatgctgcgattcacttgttactcaaccctgagttaacacttgaagatgttgcccaacaagttggctttagtgaaaccagtactttccaccgtgcatttaaaaagtggacgggtgtaacccctggcctatatcgccagctacatggttatcactaa

SEQ ID NO: 1059 - DNA, 327 bp, Acinetobacter baumannii
gggatgaaatatcaaatacaaccaacacaagtaccagatgatctttcaggctgctggtttcatcctgatattgaacagcatgacactattggagaccacgctgagttttatacaaaagaacaatgggcacaactgcaaaagaatcttggtatttcaatactaattgaacgttttgattatatggaaatcgaggaaatacccgatgaagactccggtgattggtctaaatggaaaccaaaagcaccaaaacaaaacttgtttttaatagcagcttttgattctgaggatggccccattctttggtgggcaaatccgaatcaaagttaa

SEQ ID NO: 1060 - DNA, 360 bp, Acinetobacter baumannii
cttttaggatatttccaaatgaatcaaattgatcaagcgattaaccaggaacaaattaaaaacccaaatgaagaagtggtgactttagaagagccaattcgtatgggcgaccagatgattactcaagtcaccatccgtaaaccaggtgtaaaagcattaagtggtaccagtcttcaggctatttaccagcatgatgtagatgctctttgtaaagtactaccacgcgttacttcaccagcactgacacctcagcagatctaccaaatggaccctgtagattttgccaatttaggagggcatttggtcacttttttgtacccgaaagccttacagaaggaaatcaaggctcagacagcttag

SEQ ID NO: 1061 - DNA, 1815 bp, Acinetobacter baumannii
atgcttatgtattggcttaatgagccaatggataaagcacttaataccccgacaaacttgacctttgataaccgtctcactgccaaatttttgtattggatggggtggcgaatcagctcgattgcagaattcttaaaagaaaacgataaaaatgtgcatgcatggaaagctcgtgacgaatgggaaaaagatgcaccagcagggcgtgttgcacaagccttagaggctcaacttgtaaagctgatcattcttgagaaaaaaacaccaggtgatttcaaggaaattgatttgctcatgcgccagctggagcgtatggcacgtattgacaagtattccaacggtgggaatgaaaccgatcttaatccaaaacttaaaaacagaacttcaggtccacgaaagccaactgctaaaaatcaactgacagaagaacaaatagaaaaactatgtgaagactttgacgacggtttatttgaatatcaaaaagtatggtaccgagcacgtgaacaacgtaaccgtgctgtactaaaatcacgtcagattggtgcgacattctattttgcacgtgaagcattgattaaagctgttactactggtcgaaatcaaatttttctatctgcctctaaagcccaggcacatggttttaaaacatacatcaaaaactttgtcatgcaatctattgagattgatctgcaaggtgatccgatttctatcacattgccatgtggtaatacagttcagctgattttcttgggtaccaatgcaaaaacagctcagtcatatcatggcgatttgtattttgacgaatttttctgggtgcatggctttgctactttgaaaaaagttgcatcggcaatggctgcccaaaaacaatataaaaagacttatttcagtacaccttccagtaaaactcatgaagcacacgcattctggacaggggacgcatttaataaaggtcgcaccaaagaaaatcgagttgagatcgacaccagtcatgcaaatttaagagacggtgcattatgtggcgacaaaatgtggcgacatattgtcaatattcaagatgctgaacgccaaggctgtgacttatttgatattgaagaattaattgccgaaaacagtcctgaagaattcgcaaatttatatatgtgtgaatttgtcgatgatggtcacagtgtttttccactgtccgtcattcagccgtgcatggtcgattcatgggaagtatggtccaaagattttaagcctttggctttacgtccattcggaaataagccagtttggattggatacgatccagcagaaagtggtgacagtgcagggcttgtggtcattgcaccacctgaacctgattatcctaaattcagattgcttgaacatcatcaattcaaaggcatggactttgccagccaagcacaatacatcaaaaaattaacgaccaaatataacgtcaaatatatcggcttagacaagtcaggtatgggtactggtgtggctcaattggttcttgatttcttccctaatttaacgaccttcaattatagcgtcgatgtaaaaacacaattggttatgaaagccatggatgtgattaacaaagaacgttttgaatttgatgccggatccactgacgtggccatgtctattatggcgattcgcaaaacactgacagcttcacaaagacaaatgacatttgaagcctcacgtgcagaaaacattggtcatgctgatttggcttttgccattttccatgcgtttgctaatgagcctttaacccttgatgaccaaacaaaatctaaaaaatcctctatggagatttactaa

SEQ ID NO: 1062 - DNA, 195 bp, Acinetobacter baumannii
tatttttttcaaaaaaagaaagctatttcacactttaacaacatatttgcttacaagaaaaatatgactttaagtttactttcagctttaccagtaagcaataaaaaaccgctaaacgaatttagcggtttttctttttcatttaagaaaaattatttatcacggttacgtttacgttcgttttcagtcaagtaa

SEQ ID NO: 1063 - DNA, 783 bp, Acinetobacter baumannii
aatatttttcataactcaatgcgcccaagccttttgccaggaacacccatgaccgttattccgactattgatatcgttgatgctctcgcggctgaatatgcagctaaaagtccgcgcgagattctagaacttgcattaagccaacaaggtgagatcgcaatttcgttctctggagcagaagatgtagtcttaattgatatggcttcacgtttaggtaaacctttccgtgtttttagtcttgatacaggccgtctacaccctgaaacttatcaatttattgaaactgttcgtaagcactacaatattaatatcgagatttgtttccctgatgcggaagctgtgcaaagcatggtgaatgaaaaaggcttatttagtttctttaaagatggacatcaagaatgctgtggcatacgaaaagttcaacctttacgtaagaaactggcgaccttagatggttggattacaggtcagcgtaaagatcaaagccctggtacacgtacggaaattccagtggtacaagctgatgcaggcttctctggtccaggtaagcaactcattaaatataatccgcttgcgaactggtctagcgccgatgtgtggagttatatccgcatgatggaaattccatataaccctctacacgagcgtggttttgtttcgattggttgtgagccatgtacacgtccagtacttccaaatcaacatgaacgtgaaggccgttggtggtgggaagaagcaacacaaaaagaatgtggcttacatgcaggtaacttgaaaaaatag

SEQ ID NO: 1064 - DNA, 543 bp, Acinetobacter baumannii
  unsure (531): Identity of nucleotide sequences at the above locations are unknown.
atgtcaattcataaagagctgcatattttaaaaacagatgaccatggcgagtttgctttatgggaagttgctaaaagcgagaataccctgataaaaaaagaagcaattttcttatctcatggtgctttttcagacaagactgtttgtatgggtattgcagattacttggcaaatcatggatatatctgttttattttagaatggcgagggcacggcacaagcccaaaaacagatattccatttaattttgaaactgttgcgttatatgaatataaaactgcatttcactatatttatcataattttaatatcgcctctttacactgtgtaacccatagtggcggaggtttatgcttaacaatgttcttgattaattatccagaatatttaaagaatatccaaagtattacttttatagcttgccaagcatttggagcagtaaataattctttggacttaataaaatctttttgggcaaaaatcattgttaaaggtttgggccagagataccaaggtaaaaaaaataaaaanggggaggagtaa

SEQ ID NO: 1065 - DNA, 291 bp, Acinetobacter baumannii
aaaatggatcttgaatggttagagaaacaacgaagagagctggagaagcgctttaatccagaacttcacaaactaaatgagtgggcaagaaaagtggagttagacgaactgcacaagcaactatcaactccgaaaatttgtaccgcagatattacaccaattaacaaaagagcattgccgcaagagctttggaaagaccgaaaaatcaaagagcttgaacaggagaataaagaacttagacgcaagttagcaatgcatgttttaacgtacagaaatggggaatcaatatga

SEQ ID NO: 1066 - DNA, 888 bp, Acinetobacter baumannii
ttttttaatcaggctaagatgtcaattcaaaccatatcttcaacaattacaagacttaataaagagcttgctgatataactcatagaatgagcttggagcataaaaaatctaccgacatatccaccaagattattcagattcaaacctccattactaagacgacaagtattagcacagtgaaatcaaaactgtctgagattagtagaaaggaacaagaacattctcgtatacaaataaaaatttcagagcttcaaaaaaagaaaactgacatccaaaacaagctgattaaagaaaatcaaaatttagcaaaagctgaagcggttgagcgtaaaaaaatagatgccttggtcaagaaacagcaaaaagaagagattgaacatcagaaaaaactaaaacgtgaaattgagagtattaaggtctctacccaacttacaggtattagcacatcaccatatatcgatatgacgcctgaaccagaatatgatttatttatttcccatgcttcggaagataaagaggattttgtaagaccacttgccgaaacattacaagaactaggtataaaggtttggtacgatgaatttagtttaaaagttggtgacagtttacgaagaaaaattgatagtggtcttagaaactctaaatatggaactgtagtactttcagcagacttcatgaaaaaagaatggaccaattatgaattagatgcattggtagcaagagaaatgaatggccataaaatgatattaccaatatggcataaaatatccaaaactgatgttattaactatagccctaatcttgcagataaggttgcactgaatacatcaattagtactattcaagaaattgctgaacagttagcagatgttattttagaaaaataa

SEQ ID NO: 1067 - DNA, 1314 bp, Acinetobacter baumannii
atgtttaatcagatcaccaacaaactaaaagacgcagctgagtcatatcagtctgaaactgaatatcctttcccaatttatcgcctagaagtagatggtaatgacatctcccctctcgttgtcgaccgtttaatttcacttactattaaagacaatcgtggtcttgttgtggactctgtcgacattgatcttgatgattctgatgggcaattagaaattccacctgaaggcgcaattatccaagtgtggattggctggtcaaatacaggcttggtcgacaaagggaaatacaaagttgaatcagtcactcatcgcggtgcaccagatatattaagcatttcagcatttagtaatgatgtatctgaaggtttaaaacaaaagcgtgaacgtagctttagtagtaaaacaatccaggtaatttttgaaaccgttggtgctgaatatgcccttaaaacaattgtgcatgacacactggccaaacgggtaatttcatatattgcgcagaatgaaagtgatgcaaatctgattacccggatagctgatgaacatgatgctattgctaccgtaaaaaatggccatttaattttattgcctcgtggagccagtcaaaccgtttccggattaccacttcctacggcccaaatttttcgatcagatggagatggccacaattacacgactggtactggtactgacagaatcacgggtgttaaagcctattattacgataccggtaaatctaaaaagttgtatgtcgtaattggtgacaatgaagacaatctaaaagagatccgctacgtccaccgtgacaaaaaaacggctgaattagctgctcaggctgaatataaccggtgcaaacgtgcatctcaaaaattgtcttatacctttgcctttggccaacctgaacttatcccggaacaagagtttgtattcaccggtttaaaaccacagattgatgacattgtatggcttggcaccaatgtcactcataatttaactgatagtggctttactacgaatgttgaactggaagcacagttgccgaatgctgatgatgtctcaactctttttgaaccagataaagagggagataaagtattaaggaaaaaaaataaaaaacggactggtcggaactatgctgactacaccggagtaatcgttttttatcgtgagaatggtaaagatctcaaacttacatctggggatcagagcaatcccttaaagctcatcaaaatatataaaactaaaaagacagcgaccattgctttaaagagggaacaagcccgaatagataaagctaagaaggttaaataa

SEQ ID NO: 1068 - DNA, 834 bp, Acinetobacter baumannii
tttttaaatcatggggttgtgcagcatttcttgcacgctgcaatccatccatcgtatcgtgatcggttagcgccaaagtatgcaacttcacatcgacagcagcttgcactagcaattccggagacaaagttccatcagaaatattgctatgtgtatgtaaatctatgccttgcatcttttatactatgccattcaccaaacctgatcagatactctaacatgaaagcactactggactttgttccattaattattttcttttatttatataagacagttgatccagccgatacacagcatcctttactcaaactgatcgggtctgctggcggtgttgataataataatattcttgttgctactaccggtttaattatttcaatgctggtagtgtatggtgcgttgttcatcatgcaaaagttccgtctagataaacagcaatggattgtgctgttcatgacagtcatttttggtggtattacccttatgttgagcgatgatttttacatccgcttaaaagccgctattttgaatctagtttttgcaggtgctttcttagtttcaccttggtttggtaaagaccgtaagcctcttattcaacgtttatttgatccaattttagccttaagcgaaaaaggttggaaaaatttaaactttgcttgggcagctatgtttgtcgtgatgtctggtttacatgttttctttgcgtttttattccacggcggaaaatattggggcgaatttactgcatttggtgacatgattgtcatgttttcatttatcattattcagttcattattttacgtaaacattttaagtcaccagatgcttaa

SEQ ID NO: 1069 - DNA, 243 bp, Acinetobacter baumannii
acccatgatcaacagatagggggagaaatgcactcaacacttgaaattaacagccacaagaaaatgacggctgaggaaatacttgaagaaattgaatatccacttgagaatctagaaaactttttgctagccatgactaaaatgaaagtggttgaacgcctagaagaaaaagagttttcggcaatcatcaacacacttcattaccaagtaagcaatattaagcgcgcagtacacaccaaatga

SEQ ID NO: 1070 - DNA, 390 bp, Acinetobacter baumannii
aaaatgagtcatatctcgcataatatactttttgagattttttttatgtctttgccaaactgtccaaaatgccaatcagaatatacatatcaagacggcgatttattaatttgtccagaatgctcacatgagtggaaagaaggggaagctttagtaactgaagagcaagaagtgattaaagacgctaatggaaacgttttggcggatggcgatagcgttactgtaattaaagatttaaaaattaaaggttcttcttcagttgttaaagtcggaacaaaagtaaaaagtattcgtttagttccagatgcaagtgatggtcacaatattgactgtaaaattgatggtattggtcagatgaagttaaaatctgaatttgtaaaaaaagcttaa

SEQ ID NO: 1071 - DNA, 2631 bp, Acinetobacter baumannii
tattatctccaaaatccatattatctactcaatcttcggctatacttcgttacaagatctccatcatatttacattattcgaccatgtttaaaaagtttttatttcaaattcattggtttctgggtattagtgctggcctcatcttatccattatgggtgttacaggcgcaatttattcttatgatcagcaaattttaaaatgggtaaatacagatagttatgttgtgcaagtacaaagctcgcctaagcttacccctgctcagctttaccagcatttcacaacaatccagcctgaaattaaaattaatagcattacaattgccaaagatcctaccgcctcatctgtagtaaacattgaaaaagaaggcgaacgacgcggctacaatatgatggttaacccttatacagctcaggtattaccagaggtacaaggtcgtaagctacttttattaatacaacaaattcaccgaaacttaactgctggtgagttcggtaaacaaattaccggtgcttgtgccctaatgctcatatattttgttttgagcggattatatttacgctggccgaaaaagcactctgcacgtcaatggcttgctgtcaaacccaaacttaaaggtcgaaattttatttgggatttacatgctgttgtaggtacatgggttattgttttttatcttctttttgcatgtacaggtctatattggtcatatgactggtggcgtagtggtatgttcaaagtattaggtgtagaacaacctaaaatgcaaggccatggtggatctgggcgaaataaagatcaatttcctaaaattcaactagataatgctcaactgattaccgcactcaaccaaacttggagtggttttaataatcagattggacgtgattattcgactttaacagttaacttacctaaaaaagatgatggaaaaattgaattaagttttgtagatgcaacgccacaacacgaacgtgcacgtaatcaagctgtctataactataaaactgccaatattgaaaaaatggagctttatgaagataaaaagcttaatcaaaaaattatgagcagtatgttacctgtgcaccgaggtagtttcttcggaccagtttatcaatttgtggcgatgcttgcttctttagccatgccattattctttgttaccggatggatgctttaccttaaacgccgtaagcagaaaaaacttactcaagcggctcgccagtctttagcaggccattatatcgatcaaaatgctaagccttggttaatcacttatgccacccaaactggagttgcggaacaactcgcgtggagtactgcaacgagcttacaagaggcgcatcaaccagttcaggttaaatctgtacaacaactaaccgaagttgatttacagcaacatgaacaaatattatttgtgattagcacctatggtactggagaagcacctgacttagcttctaattttgctaaaaagttattaaaaactaatttaagacttcaacatgtcaaatatgcagtattagctttaggttctaaggaatatccggatacttattgtagttttggccacacagtagatgaatggcttaaaaacaatggtgccaaagccctcttcgatattatagaagtagataatgcaaatccgacagatattcaaaactggaatcaggcacttgtaaaagcaactaaactagatttgcatgctgttaatatcgaaaaagtgtttgataattggacattacaacaacgggatttactcaatccaaatagtctaggtcagcctgcctacaatattgaacttactgccagtcatgaagctgtatggcaagctggagacattgctgaaatacaaccaggtaacagccctgaacgtattaataagtttttacagcatcatcacattcttaaaaatgcggtggtagactcgctacaggtttctattgaaaaggcactttggaataaagatttaactggtgaaattgaaccatttgccaatctggaccatttactagaacaacttcctaccctaccaacgcgagaatattccattgctagcatcccttctcagcaagtattacgtctagttgttcgtcaacaatatgatgagtctggtgatttaggtttaggatcaggttggctgactcaacatacagaaattaatcaaaatgttgcactgcgtatccgtaccaatgagtcttttcatttgattgatgataatcgtccgattatttgtattggtaatggaacgggaatcgcgggtttaatgagtttacttcatacacgaactcgccataactatactgataactggctaattttcggtgaacgccaacgcgctcatgatttcttctatgcatcaactattgaagcttggcaaacgatgggaatgttaaaacgacttgatcttgcattctcacgtgatcaagaacaacgtgtttatgttcaagatatcatccgacaaaatgcagcagagttagtcaactggattgaacgtggtgcagttctttatgtttgtggaagtattgaagggatggcaagtggagtagatcaagcacttattcatattttaggcgaagaacaagtcgatgagttaagacaacaaggccgttatcgccgtgatgtttattaa

SEQ ID NO: 1072 - DNA, 513 bp, Acinetobacter baumannii
gaattcaaccatttaaggagcgtgcatatgcttaatacagctctacctgtgctttataaagatggcacgattgcagataatacttatcaaatcattgctgaagatggtgtgattcctcaaggtgacgttgttttaacaacagcacagctagatcaactggctaacattcaaggtaaaaaagctttgtatgtgactgtgaacgattcaccagaagatcatacattcccacttagtgaacttgatgcaatcttcattgagtttgcgggttttggtgatggtcgtggttattcattcgctgcattattacgtcgccaaggtttccaaggtgaactacgtgcaacaggtgatgtatttaaggatgtcttaaattatttaaaacgttcaggttttgatagttttgtcatcaaagaaggtaaagatgtgcaagaagctgctgctggtttgcaagactttacccatccttatcaagcctcaacagctgtgccaaaagcaagttatcaaactggtgcttaa

SEQ ID NO: 1073 - DNA, 1929 bp, Acinetobacter baumannii
ttatgtttacaccaaacgtcgacgtcagtggtaatcctgagcgacttattaaaccgaatgaacaaatcaaatcgtatacaaactgctgagctggattgggaatctattgatggtattgaagttcccatttccaaacaatttggtgatgtctatttttctaaagataatggtctgcttgaaacacggcatgtatttttaaatggcaatgacctatcagaacgattagccaatttacaagattttgaatatttcagtgtaggagaaaccgggttcggcactggtttaaatattcttgcgctctggcaactatggcaacaagttcgtccaaataaccacagtcatttacatgcaattagcgtcgaaaagtttcctttaagcaaagctgatctcattcgtgctttaaatgtatgggatgaacttaaaccgctttccaaacaacttattgagcaatatcccttacctcttgcaggctgccatcgtttaagttttccagaagagcgcttcagcatcgacctatggttaggagatgcacaagatatttttccaggtatggtaaaaacgaaggcagtgaatgcttggtttctagatggttttgcgccttcttgtaatccagacatgtgggaacaaaatgttttaaataatattgttcggctttccgactatggcactacctttgcctcatttagtgtagctggtgtcctcaaacgtgggctaaagactcacggaatcgatatttctcgtcctcgcggttttggacataaaagggaaatgcttaaagccatttggaaagcacctgtaagtgaagaaattttatttgaaccagttagcgatactttccattttactcagcagcgtatcgccataattggcgctgggattgcaggtttaagcacagcttgggcatttgctcaacgtgggcatcaggtcactctatttgagcgtacagcgccgttatcgggtgcttctggcaatccgttggcattgcttaatccgaaactatgcccaattgaacaaagccatgagcatctcatgactttaagctggcaacatgcattaaatttctataaaaattttcaagcctttcgcccgattcaaatacaacaaatggctttaaaaaatgcacaagatcttctcgatcttactaatcaatatcctgctgatattgtcacacagcaaacaagctcacttgaatcggactatccacacattatattgaccgaagctggagcagtttctccgcaccaattacgtgatgaaattttgcaacatccaggtattgaactgaaaattgccaatattacgacacttgtttcttttgaaaataaagttcaattaaaaagtggtaatgaaactactttagaggctgatcatgtcgtggtgtgctgcgccagagaaagtgctgctttatttgaaaattatccgctattaaaacctatacgtggacaggtgagctgggttgataattcttttgcaaccttacctttacacgaagcctatagctatggcggttattgtatgcaactgaatacgtctgaacttattttaggggcttctttctacccaaaccgagacgatcaagaagtactgcttgatgaccatgtgcataactttgaattaatccacagcgtttttcctcattatgcaaaacaattaccgccagtcgaacaatggcaaggacgagcatcagttcgcgctcaaagtccagattattttccagttgtgggaaaaatgcagaaggaaagccgtatttctacttttgcaggtttaggctcaaagggctttttatttgcgccgctttgtagtgaagttttagtggcccaaattttaggtgaagcttgtcctgttcccaaaagcctattacagaaattagatgcccaacgttttcaaaagaaagttaaacctaagaaaccttattttaaatctcaatag

SEQ ID NO: 1074 - DNA, 603 bp, Acinetobacter baumannii
aacagtttacaatttgttatttgcactatgaccgcgaaaactttatatgcttatacgcttcagcctgttccttacgaggtatcagaagctgagcaacgtaatgcacaacttcttatctggcgcagcaccaataaaatcagcacaaaaatctgggcgattatgggcgtaattttagcccttgcgattttaggtcttatctttatcaagaactattctacagtgatttgctgggttgccattgtctgtgtagtactttattaccttggccgtaaatatggtttggaatggtatgttaagcgtaaaatgaatgagtttcctgtgcaggaaatcaagggtattcgcttaggtgtacaacctcacggtatcgtaatgcgccagcaaatgggcttacaagaaggcgttggaactatcggatggaaaaatatctatgaatggtacaacacccctgactttattttagttaactttaaagtaaaagatcctaaaggtcaggaacaacaaggtgcatatatattgcctaaacgtatggactctaaaaacttttctttcaatacaattcgtaagcatttgaaagaaagtgtaggtgaaccgaaaactttataa

SEQ ID NO: 1075 - DNA, 609 bp, Acinetobacter baumannii
gcacacatacagaagcggcaacttctgtatgtgccacacaatcaccggagagcaattatgcaaaacgattctaacgtagaaacaacccaagcggaaatcaaaccatttccacgtcaactaatcagcgatatgtgggattcaaatgtcacttttgacactatccttcatattcctacgcttttggcatctagttcagaacaagtatctgataaattccaagaatttcttgatgatgcatatgaagaatggcaaagctccttgctacttgaacagtgcccagctcttaaatcaacattaaatgaaatacgtgaaaataatgacataaaacattatgcaggcgaagttttgcaggacttccaccgagcttgtggtgattttgaattcttaattgagatcgaaatcagaatcccttttaactttagatttgataaagacggtaaatatcaatcaaacagtttaggtggctcattccgtgtgcaatggattttggcaaaaaacatggtcgatgctgctcaatatgcaataaaaattgctgaagaacttcactctgtagaagaagccaaagcacgtaaagaacaaggcttggaggaaaattctaatgaatcatga

SEQ ID NO: 1076 - DNA, 1209 bp, Acinetobacter baumannii
ggatatcaacactcaatgttcaaatcattttttccatcaccacggtatttctttatatctgcggttatttggatcgcgcttaatatggtgctttggtattctggtggtagtacatgggggagtttcattggattccatcagggttaccatagtgaacaattaccaattggtgttagccgcttctggtctccgacttttatatggttttatctttggttcctagtttctacagcaatttttgcagggttttggagaattatttctaatcatccatggcaacgttggtcagtttggggctctgcttttattttatttaatatctggtttggcgtgcaagtcagtgttgccgttaatgcatggtatgcacctttttataatcttattcaagcaatgctagatcatggtggcggtgatattaataagctatatagcggaacagttacttttcttttaattgccatggttggcgtgactttagccgtgattaatgcattttttgctagccattatgtatttcgttggcgtacggctatgaatgaatattatacagagcattgggcgaaacttcgccatattgaaggtgcttcacagcgtgtgcaagaagacaccatgcgttttgcatctgttttagaagatttaggcgtaaacttcataaaggcaattatggtattgattgcatttttacctattctatttgaactttctaagcaggttaaagtattacctattgtaggagaaattgatcattcattagtatgggcagcaattgtatgggctatttttggtacagttctactcatggtggttggtattaaattacccggcctacaatttaataaccagaaggtagaagctgcttatcgtaaagagttggtttatggcgaagactatgaagaacgggcacagccaaagacattaaaagaattattctcaaaagtcagatttaattattttcgattataccttcattattcttattttaatctggttagtatctggtatctacaattagatattttatatagcttggttgttttatttccgtctattgcagcaggtaaaatgacattaggcttaattacgcaaattagtaatgtctttgataaggtccgtgaatcattccagtatttaattacttcatggaaaacaatcattgaactactttcaatttataagcgtttgagaacatttgaagatactttaaattaa

SEQ ID NO: 1077 - DNA, 753 bp, Acinetobacter baumannii
ttgggcaaacaaaataaatttttaagcagaatattgctggggaatatgaatacttctattaaaaattggccagaacaagaacggccaagagaacggttattacaacaaggccctcaaagtctctctgactctgaactactcgcgatctttcttcgctcaggttcacgtcaacattcagcagtagagctcgcacgtttactgattcaacagtttggtagtctaaacgctgttttcgatgcatcttacaatgaattagctcaatttaatggtattggagctaccaagtattcccaattactggccgtaaaagagcttggacggcgttatctcgactatcattttagtcagactgagctaagccttcattcttctcatttagttctagattatttgcgttacgaattaaaaggtgaaaaacaagaagtctttgccgtactttgcttagatgccgagttgagaaaactacattttaaaaagttattttttggttcagttcaacactgcgctgtttcagtgaatcaaaccttacgttatgccttacaacagcacgcttgccaattagtaatagcacataaccacccatttggttccccacagccctctctcgaagatattaaactcacacagcaacttgaacaggcctgtcagcttgtcgaaattcgtctgctggaccattttattatctcgccagaaggtagcttttcatttgctgaacaacaactgctcaaccctacctcaatagccgttcaatga

SEQ ID NO: 1078 - DNA, 372 bp, Acinetobacter baumannii
aacaaggaacataaattaatgaatcagctttttgtatatggaactttatgccctaataaagcaaatgctcatattttagagcagattggtggtaactggacaaaagcgagtgtacgaggagtgattcatattttagattggggaccagacaaaggtttaaaggccttagagttagatccagaagcagattgggtagaaggctatttgtttagcacagaaaagttagcagaaaactggcaaatgttagatgattttgaaggctttcaataccaacgcgtgaccgcagatataaaattagaatcgggtgagtatgttaaagcctggacatatcaaatcaatatgcaggctaaagcttctcacaattacaagtaa

SEQ ID NO: 1079 - DNA, 1284 bp, Acinetobacter baumannii
gcgccactgcaacagaaaggtatcctgttcgtgagctttgatttaagtgttattcctcataaaaacattgttttagctgttacaggtgggattgctgcctataagagtgccattttggtccgtcgtcttaaagattatggttttgacgttcgggttgtgatgacacacggggctcaagcatttattacacctctaacttttcaggctctttcaggaaatcctgtacataccgagcttttagaccctgaggctgaagctggaatgggccatattgaattggctcgctgggctgatttattactggttgctccagcaagttgtgacacattagctaagtttgctaatggtttggcagatgacttactcagtactttatttttagcaactaaagcgcctgtgtgggtcgctcctgcgatgaaccagcaaatgtgggctgcaaaagcaactcagcgtaatttgcaaactctggttgaagatggcgtgcatgtgattatgccagatgcaggggagcaggcgtgtggtgatgtaggcttaggccgtatgccggaaccagaagaaattgcaaggcaagtggcgggttatttccatcaagcccaacgtgcaattgctgaaaaatttgggttgttggcaggtaagcgagttgtaattactgctggaccaacccgtgaagcgattgaccctgttcgttatatctcaaatcatagtactggaaaaatgggctttgctttagctgcggcatgttatgcagcaggtgcaaaagttacgttaattgctggtcccgtaagtttagatactccaaacggtgttcaacgtataaatgttgcttcggctcgacaaatgttagatgtcagtatggagtcgcttgagactggctgtgacatctttattgcgacagcggctgtagctgattatcgcgttgccgaagtggcagagcataaaattaagaaagcaggggatgagctgaatgtttcccttgtaaaaaatccggatattgtggcaacgattgcagctcaggaaaaacgtccatttatggtgggctttgctgccgaaacgcagaatgttgaagaatatgcagcagggaaactcgttgctaaaaagctagatatgattgcatgtaacgatgtttctcgtgctgatattggctttgcttctgatgaaaatgcgatgacagtattttttgctgaaagttaccatatgaaaaaacgtgagttagagaaagcatctaagcaagaaatttctcaacaattggttgaagctatttcggatgcattacgccgtaaataa

SEQ ID NO: 1080 - DNA, 369 bp, Acinetobacter baumannii
tggaagctgcaaaaacagcaagcgaggtttcacatgccgtttgaatggattaatcaaaattatggtgttaaggccgagatcggactgtgtgtaaacgttgatggcaagccggggattattgcgaaggattgcgggaattatttgggcgtcaattttgatgaggataaacccggagttatccgcaattgtcatccaacttggaaggttgaatatcttggaatgggaaaaattcgccaaatgaccgcaggtcagaaacgataccaagagtttttaaatgctgattggtttgacggcaactttgctcaatggcttggggtggataaggagtcaagagatcgccgcgaatttgcaaaaagatatggttactag

SEQ ID NO: 1081 - DNA, 1236 bp, Acinetobacter baumannii
atgattcagcaacaggtaaaaaatgagtttccaacattagaagatatacatgccgctgcagagcgtttagatggtttagttgttaaaacaccttttgttttttcagaaaccatttctaaaaccttaggggctaaaatgtggctgaaatttgagaatctacagtttacggcttcgtttaaagaaaggggcgcactaaataaacttttgagcttatctgaacaagaaaaacaacatggtgtaattgcagcttcagctggtaatcatgcgcaaggggtcgcttatcatgcacagcgcacaggagtcacggcaactattgttatgccaaaatcgacgcccaatgtgaaggtgcaacgagtacgtgaatacggtgcacgtgttattttgcatggccaagacttttcggaagctgctgctgaaatgcaccgtgtggcacaagaagaatctttaaccattattcatccatttgatgatgctgaaattattgcgggtcaaggaaccattgcgctcgaaatgctggaagctgttcctgatttagatatattggtcgtacctattggaggtggtggtctcatttctggtattgcgattgctgcaaaaacgataaatcctaaaatcaagattattggggttcagtcggttgtttatccaagtatggcgaaactgctttgtaactatcaactcgcggtttcaatgggttcaacggtagctgaaggtattgctgttaaaactccgggtgagctgaccacacaaattgctaagcattttgtagatgatattgtggtagtcactgaagatatgattgaagaagcgattgcgctattactcaacattgaaaaaacagtgtgtgaaggggctggcgcgactggaattgctgcaattatgtctcgtcccgatctctttttaggccataaagttggcgtggtgttatctggtggcaatattgatacacgtgtaatggtttcagtattacagcgacacttaactcgtactggccgtatggttcgtattcgcgttgaattaccagataatccgggtgccttagcgcgtctaacagcaattattgcggagcagggcggtaatatttatgaacttcgacatgcacgctttgcagcaacaagccgtgctaaagaaagtgcggtgagtgtcgatattgaactaaaaagcgctccagatctggaaccattaattcaggctatgcaacttgaaggctatattgttcgtaaagaagagatttaa

SEQ ID NO: 1082 - DNA, 2457 bp, Acinetobacter baumannii
gttttttggcacatctttccgataaaaatgatgattgataagaggtggtttatgaatcaaccttcttcaagatcaggtttaacgacttttaccgtaattattattgggttattggcgttattcctgctaattggaggtatttggctcgctacactaggcggttcaatttactatattgtagctggagtcttacttctcattgttgcatggcaactctacaagcgcgcttctgctgctttgtgggtttatgccgcattaatgctaggtactattatctggagtgtctgggaagttggaacagacttttgggcgcttgcaccacgtttagatattttaggtattcttggtttatggttattggttccggctgtaactcgtggaatcaacaaccttggatcaagtaaagttgccttatcttcaactttagcaattgcaatcgtgttgatggtttattctatcttcaatgatccgcaagaaattaatggtgaaatcaagacacctcaaccagaaactgctcaagccgttccgggcgttgcagagagcgactggcctgcttatggtcgtactcaagctggtgaacgttattctccattgaaacagattaatgaccagaacgtaaaagatctgaaagttgcctggacattccgtactggtgatttcaaaacagataatgactctggcgaaacaaccaatcaggttacaccaattaaaattggtaataacatgtttatctgtacggctcaccagcaattaattgcgattgacccagctacaggtaaggaaaaatggcgttttgatccgaagcttaaaacggataaatcgttccagcatttaacttgtcgtggtgtaatgtattacgatgcaaacaacacaactgaatttgcgacaagcttacaaactaaaaagtcgacttcaactcaatgtccacgtaaagtctttgttccagtcaatgatggacgtttagttgctgtaaatgctgacacaggtaaagcatgtactgactttggtcaaaatggtgaagtgaatttacaagaattcatgccatatgcttatccaggtggttataacccaacatctccaggtgttgttactggttcaacagtggttattgccggttcagttaccgacaactattcaaataaagagccatcaggtgttatccgtggatatgacgtaaacactggtaagcttctttgggtatttgatactggtgcagcagatccaaatgcaatgccaggtgaaggtacaacctttgttcataactcaccaaatgcttgggcacctttagcatacgatgccaaacttgatatcgtttatgttccaacaggtgtaggtactccagatatctggggtggtgaccgtaccgagttgaaagaacgttatgcgaactctatgttagcgattaacgcttcaacaggtaaattgatttggaacttccagacaacccatcacgatttatgggatatggacgtaccgtcacaaccatctttggcagatattaaagacaaatctggtaaaactgttccagcaatttatgtcttgaccaaaacaggtaatgcctttgttcttgatcgtcgtaatggtcagccaattgttcctgtaactgagaaaccagttccacaaacagttaaacgcggaccacagactaaaggcgagcattattcaaaaactcagccattctctgatttgaacttggcaccacaagataaattgactgataaagatatgtggggtgccactatgcttgatcagcttatgtgtcgtgtgtctttcaaacgcctcaattacgatggtatttatacgccaccatctgaaaacggtactttagttttccctggtaacttaggtgtgtttgaatggggcggtatgtcagttaaccctgaccgtcaagttgctgtaatgaacccgattggtttgccattcgtgagtcgtttaattcctgctgatccaaaccgtgcgcaaactgcaaaaggtgcgggaactgagcagggtgtacagccaatgtatggcgtaccttatggtgttgaaatcagcgcattcttatctccacttggtttaccttgtaaacaacctgcttggggatatgttgctggtgtagatttgaaaactcatgaagtcgtttggaaaaaacgtattggtacaattcgtgacagtttaccgaacttgttccagttaccagctgtaaaaattggtgttcctggtttaggtggttctatttctaccgcaggtaatgtcatgtttgttggtgcaactcaagataactacatccgtgcgtttaacgtaacgaatggtgagaaactttgggaagcacgtttaccagcaggtggacaagcaacaccaatgacttatgaaattaatggtaaacaatatgttgtaattatggccggtggtcatggttcatttggtacaaaaatgggcgactatttagtggcttatgcattaccagataacaaataa

SEQ ID NO: 1083 - DNA, 270 bp, Acinetobacter baumannii
gtaggttttttggtgtcatttatgactactccacatgaagcattcaccaatgctgtgacttttgcagggagcatctcagctttagctcgaaaaataggggttacaccttgggctgctagcaaatggaaccctgagaaaattccagaagatcgctgtttaaaaattgaggaaattactcagggtcaagttaaggcagaacaactacgaccagatatcaactgggaatatgttcgcaagaaccttaagaagcaaaaccaatccgtgagctaa

SEQ ID NO: 1084 - DNA, 429 bp, Acinetobacter baumannii
ctctctcttaatctagctttagatcaagataaaaaggaatactccatgaaaaagcctattgttctcgtactttcaacattaatgttgggtatgtcggcaactgcgatggccgattcaaatcatcgttgggataactatcacggtaaagaccataatcgctatgaacagcgtcatgattatcgttatgaccaccgcaatgatcatagagctcctgtttggtcacattctgagcgtggcaaccattatggccgatatgtagcctttaagcgcggtgatcgtattcctgtggaataccgtaatagccgttattatgtttcagattggcgtgcacatcgcttatatgcaccaccacgtggataccactgggtgaaaactcctaaccaatacttattggttgactcgaaacatcacatttatcgagttcgttaa

SEQ ID NO: 1085 - DNA, 321 bp, Acinetobacter baumannii
gaaagccttaattttttggaggaagacaacatgcaaacagcaattgtccgacatattttagtcaaagataaagacttagccgaacagctgaaaaagaagctacaaagtggtgctgactttgccaaacttgccaagcaatactccacctgtaattcggcaaaacgtggtggtgaacttggtgaagtcaaaaaagggcaattggtgcctgtcattgacaaagtagtttttacagctgctgaacgtgtgttacaaggtccaatcaaaagccagtttggctatcatctcttagaagttaaattcagaatgactggcttacgttga

SEQ ID NO: 1086 - DNA, 627 bp, Acinetobacter baumannii
tatggtattaactatcacactttaaaaatgaaagaaatgaataaatttttacttaaggtattaatgtctttagcatgctttagtgcatttaattgtatcgctgtggcagcttcagaatttgatatagctgatatctttaactctgatgggacacctaaagaaggatctatcaatggagttaaatttatttcagctaaagagaatggattactaactttagccctatttgatagtgagtcgattccaaacaagagcggtgataattactggtttttaagctgtaactcttacaaagataattataatatgaatgcagttatatgcggagcacagagaggggaattcaaaattttgttgggctcgttaggatatattattgaaatggaaaataagccaagaggtgggggacgctatatagtggcatttgataaggagcctagttttgaggcaacttaccgtattgttgataaggtcgaagttaagaaattcttagccaaaatgatcgattcaaaaaagatgcagtactcttataaaaatgagaaaaataaatatatttctaatgaaagaaaaattcagaatacaggcctaacaatttctctcctcaaggatatgagagattattattaa

SEQ ID NO: 1087 - DNA, 582 bp, Acinetobacter baumannii
aatatgtctaaaaagattttaatgttggtcggtgactatgctgaagactatgaaactatggttcctttccagttcttaactggtttaggttataccgtgcatgcggtttgcccaaataaaaaaaacggcgaacatattgcaaccgctattcatgattttgaaggtgagcaaacttatagcgaaaaacgtggccacaacttcgcgattaactatgatttcgatgccgttaataccgaagactatgtaggtctagtcattccgggcggtcgagcaccagagtatttacgcatgaatgaacgtattatcgaaattgtacgtgaatttgatagagtaaaaaaaccaattgcagccgtatgccacggtgctcagttactcgctgcggcagatgtgttaaaagaccgcctctgctcggcttatccagcatgtgcagccgaagtaaaattagcaggtgggcaatatgcagacattgctgtaactgatgccgttaccgatgggcatttggtgactgctccggcttggcctgcacatccagcttggttagcacaatttgtgaaagttttaggcgctaagattagtatctaa

SEQ ID NO: 1088 - DNA, 1482 bp, Acinetobacter baumannii
aaattttataatgctttgagtttatgtatgtcagaagaactacttattaatgtcacacctatggagtgtcgggtggcattaatcgaaaatggaactgttaatgagctgtatgttgaacgtacagttaaacgtggacttgtcggcaatatctacaaaggtaaagttgtacgtgtgcttccgggtatgcaagcggcctttgttgatatcggtttatccagaacggcctttttgcatattaatgatatggtttggccacgttcacagccaactccaaatgtgtttgaactacttcatccagggcagattcttaccgttcaggtgatgaaggatatgctcggtactaaaggcgctcgcctgagcacagatctttcaattccttctcgctatttagttcttatgccatatggtaaccatattggtgtttctcagcgcattgagtctgaagaagagcgtgatcggctacgtaatattattgagagcattcaggcggagcataatttacccggtagcgtaattgttcgtactgctgctgaaggggtagatgaagccgaaatagcacaagatatgtgctacctcagtaagttatgggaatatattcagcgtaagcaagttgatgtggcagtaccttccttaatttttgaggaactaccgctaccgcaacgaattatccgtgatctggcaagtgaagaaaccgcaaagatttatgtcgattcgagagagattcatggaaaactgcgtgagtttgtagatgagtttgttccgaatatgcaaagtcgcctgattcattacccgggtgagcgtccattatttgatctttacaacgttgaagaagatatccaaaaagcactgcaaacacgtgttgctttaaagtctggcggttatttaatgattgaccagactgaggcgatgaccacaatagatgtcaatacaggctcttatgttggtggccgtagccttgaagacactgtctttaagaccaacatggaagcgactcaggtgattgcgcgtcagcttagactacgaaatctaggcggcattatcattattgattttattgacatgcaagaagcgattcatcgtgaagaagtgatgcgtcaatttgaaaaaatgcttgaacgtgatcatgccaagaccaaaatcacacaggtttctgaacttggtctggtagaaatgacacgtaaacgtacacgtgaatcattagaacacttgttatgtgaatcgtgtccaacgtgtcaggggcgtggttttgtcaaaactgcagagacagtgtgttacgaaatatttcgagagatattacgctacacccgtgcatttgagtctacgagtggctttactgtcgttgctcatccatccgtgattgaccgattattaacagcagaagcacctgcagtggcggatttagagcattttatcaacagagttattaaatttcaggtcgaaaatttatatacgcaagagcaatacgatatcattttaagttaa

SEQ ID NO: 1089 - DNA, 657 bp, Acinetobacter baumannii
tcaaaaaataaacttatgagtaaatcggtgttagaaacctacgacccaaaagaagaactttttaatgcctacagccatggcgctggtgtggttatggcagtagttgcctctgtctttttaattataaaaggatcttatctttccactgcccagtggataggtttatgggtatatgcttttagcttaattctcgtgtttactagttcgactctctatcattttgcacaaacacaaaatttacgttactggtataaaaaactcgatcacacggctatttattatttaattgctggaacatataccccgttcttaagtattgctatacctacacaaaaagctcatattttacttattgcgctctggagcattgctgcaattggtacacttttcaagttagtttttattcaccgttttcagaaaatttcgctacttgcttatgttcttatgggttggcttgccgtttttgtaatggatgatatgcgaacctatttaagtaaagatactttgatgttattgattactggaggtttagcttacaccgttggagcattgttttacgcgttaaaaaaggtaagatatacccatgcgatatggcatatttttgtgcttttaggtgcaggtgcacactttcttgctatctattggtacgttgtttag

SEQ ID NO: 1090 - DNA, 771 bp, Acinetobacter baumannii
gttatgaataaaattccatgtagtgtttatattgtcactttaaactgtggtgcttggttagagcgaactttgcaaagtgtcagtgagtttgatgaagttattattttagattcgggcagtactgataatacttatgaaattgcaaagcgctttgaaaatacagaaatttctcaccaagactggcagggttatgctgggcaaaaaagtttagctttagctaaatgcagaaatgattgggtgcttaatttagatggcgatgaagtcttatctaatgagttaaaacaagaaattgttgagaccattcaacagaacaggcttgatgcattaatcactccaattaatgatgtatttttaggtgttccgaacagtaaacacactaaaaaacatgcaaaagtgcgtttttttcgtaggtctaaagggcattatgaccttgccaataaagtccatgaaaatgtgattgtagacggtaaaacgcagcgtgctcaacacgatatttaccattatggtgagtcgagcattttcgttaaagtcgaaaaaaataaccaatattccaacttaaaagcattagagaaataccaaaaaggaaagtctccaagcattgcaaaattggttttggtgatgccagtgacttttatgaagtcttattttattcgccgtagtttcttaaatggttggcgtggtttcgtaaatagtatgattaatgcattttatgcatttctaaaagaagctaagctttttgaacagaccatgaataaagataaaaataagtag

SEQ ID NO: 1091 - DNA, 561 bp, Acinetobacter baumannii
ctctgtgataaaaagaacagattgtttattggagctagacctatgtcacgtcatctttatgctattgctcgccgtaagttttcacatctgagccgttcaatatgtgtggcggcgactgtactgggcgcaacacaaattgcgatggctggtccaacagttgatcagctcagtgattgtttagttaaagcaacaacagcttcagataaaaccacggtgctccaatggacatttacagctttagcggctcatcccgatttaaaagcatttagtaatgtaacgcctgagcaaaaagatcagttagatcaaaaactggctcaggttttacagcggataattgtagagcaatgttctgctcagaccaaagctgtaattcaggctgaaggtgtgaaggctgttggggaggctttccagcagttaggccaaagtgcgggtgaagatattgttaaagacccagccgttaaacagcagttgcagggcacattacgctacatcgatttaaataaattggtgacaacgtttttaacaccagaaatttggaataagttgggaattacaagataa

SEQ ID NO: 1092 - DNA, 345 bp, Acinetobacter baumannii
gggaagggtaaaaacaccagcgggccatggtttaactggaatttaaagcaaaattttattagtgaatttaaaaatattgattataaaaaacatatgagctctattagagtcccaatatattctattagcggaactggcgataaatttattgcaccagttaaaggatgttataaatatttaaaagcttttaaaaatcaagataacgtatttcgtgaatttggttgctctaataataacttggaaaattattcccatagccgaattgttttaagccaaaatgctgctaaggaagtctggcccactatattgcaatggatagataagaactcaaaagaagttctataa

SEQ ID NO: 1093 - DNA, 1140 bp, Acinetobacter baumannii
tactggggtaaaaatatctcaggggccaataaatttaggctgagcttgaacaacaattgttatctctggaggatatccatgaaattgagtcgtattgcacttgctactatgcttgttgctgctccattagctgctgctaatgctggcgtaacagttactccattattgcttggttacactttccaagacactcaacacaacaatggcggtaaagatggcgagttaactaacggacctgaattacaagacgatttattcgttggtgcagctcttggtatcgagttaacaccatggttaggtttcgaagctgaatataaccaagttaaaggtgatgtagacggtcttgcagctggcgctgaatacaagcaaaaacaaatcaacggtaacttctatgttacttctgatttaatcactaaaaactatgacagcaaaatcaagccatacgtattgttaggtgctggtcactacaaatacgagattcctgacctttcttatcacaacgatgaagaaggtactttaggtaatgctggtgttggtgctttctggcgcttaaacgatgctctatctcttcgtacagaagctcgtggtacttataactttgacgaaaaattctggaactatacagctcttgctggcttaaacgtagttcttggtggtcacttgaagcctgctgctcctgtagtagaagttgctccagttgaaccaactccagttgctccacaaccacaagagttaactgaagaccttaacatggaacttcgtgtgttctttgatactaacaaatcaaacatcaaagaccaatacaagccagaaatcgctaaagttgctgaaaaattatctgaataccctaacgctactgcacgtatcgaaggtcacacagataacactggtccacgtaagttgaacgaacgtttatctttagctcgtgctaactctgttaaatcagctcttgtaaacgaatacaacgttgacgcttctcgtttgtctactcaaggtttcgcttgggatcaaccgattgctgacaacaaaactaaagaaggtcgtgctatgaaccgtcgtgtattcgcgacaatcactggtagccgtactgtagtagttcaacctggtcaagaagcggcagctcctgcagcagctcaataa

SEQ ID NO: 1094 - DNA, 1536 bp, Acinetobacter baumannii
ataactttcaatcaattaacccatcttccctattttgaatgtaaagaaattttactcatgactgatttacatcgcttatcaattcgcgaacttgctgaaggcttaagccaagcgaagttttcatctcgcgaattgactgaacattatttaaaacgtattgctaaaattgacccgcaagttaagagctatgtgacggttactccagaacaggcacttcgcgaagccgatgctgccgatgctgcattaaaagctggcaatgcaactgctttaacgggtattcctcttgcccacaaagacatcttttgtaccaaaggcattaaaaccactgctggttcaaaaatgctcgataacttcatttcaccttacgatgcaaccgttgttgaaaaaactaaagcagctggtctggttactttaggtaaagtgaacatggatgagtttgcgatgggctcaacttctgagagttcatatgtcggtgcaacgagcaacccttgggcacttgaccatgttcctggcggttcatctggtggttctgctgcggctgtagcggctgatttagcaccatttgctacaggtaccgatacaggtggctcaattcgccaacctgcttctttctgtggtttaacaggcttaaaaccaacttatggtcgtgtatctcgtttcgggatcattgcttatgcatcatcattagaccaagcaggcccaatggcacgctctgctgaagactgtgcttacctgatgaatgtaattgcaggtcacgatgctaaagactcaacttcggttaaaaaagaagtcgatgattacgttgcaaacctaaataacacatctgtaaaaggcttacgcattggtattcctaaacaatactttaacgttgcaggtttagatgctgacgtaaaagcacgtgttgaagagtctttgaaaaagcttgaagaaatgggcgcagcgcttgttgagatcgacctcaacatgactgaagcttatgtaccaacgtattacctcatcgcgccagcggaagcatcttctaacttgtcacgttatgacggtgttcgctacggttaccgctgtgaaaacccagctgacttgatggatctttacaaacgttcgcgttcagaaggtttcggtccagaagttcaacgccgtattttaattggtacatacgcgctttctgcgggttattacgatgcctactatgtaaaagcacaaaaagttcgtcgtttaattcaacaagacttcttaaaagcttttgaaaatgtagatgtaattgcagcacctgctgcaccaacaactgcctacaaaatcggtgcatctttagaccctgttgaaatgtacttaggcgatatctataccatcgcagtgaacttagcgggcttgccagcgattaatgctcctgttggttttgataaagataacttaccagtaggtttacagttaatcggtaattactggtcagaatcacaattgttgtcgattgttcaccaataccaacaaaacactgactggcacaccaaacgtgcggcaattgctgaggagaatgcataa

SEQ ID NO: 1095 - DNA, 282 bp, Acinetobacter baumannii
  unsure (163): Identity of nucleotide sequences at the above locations are unknown.
aggaaaatcaaaatgacaatttttgaagcactagcattaaaggttttaatttcaattgcactaggtttagccattggtgtttggatacttgggggatatatcaaaaatggcacaaaagcagaacaggaatttttaaaacgtcatgggattggttctcacttgntatggcaacgcaaatgggaatcagatttcttatatggcaataagagtaatgacaactctgtaccagaggcaattattgaagctactgaaaatcgccgaggtgaaaatgatcaagcctaa

SEQ ID NO: 1096 - DNA, 1398 bp, Acinetobacter baumannii
aatagcgccaatttgcgaaattgcggcgtatttactcccatgtccaatcaaccatcacaagaccgtcttgacctcgtttatgggctagatgaccgaccaaaaccgttcgtggcttttttggcagcctttcaacatttgcttgcaattattgtcccgattgttactcccggacttctaatttgcttagcattaggcgttccacgaaatgaaaccaatatgattttatcaatgtctttggtcatttcaggaatcgcgactttcttacaatgtaaaaaagtcggtccgtttggtgcaggcttacttattgttcaaggtacaagttttaactttattggcccgattatcggtattggcagtgcaatggtcgctgcgggtacaccagtcaatcaagttatggctgctatttttggtgttgtgattgcaggttcatttattgaaatgggcgtatcacaaattctcccgtgggtaaaaaagctaattactccccttgtgacaggtattgtggtactcctgattggcctaacgctcattaaagaaggtttgattagtatgggtggcggttatcaagccatgcaggaccatacttttgccagtgctgataaccttataatgtcgtgtacggttcttgctattattattgtcctaaaccgtattcgtattgtctggattaaaagttcagctattttaattgctttagtgattggctacattcttgccggctttatggggtatctagacttctctggtctaaaagatgcacccgtgattcaaattccgacaccgatgcattttggcttaagcttctcatggggcttatttattccaatggcatttatttatttggttacgtctttagaagcaattggtgacgtaacggcaaccagtaaactatcaaaccaacctgtagatggtcctcagtggatgcaacgtattaagggtggtgtgttagtaaatggtgcaaattcactacttgctggcctattcaatactttcccaagctccgtgtttgcccaaaataatggtgttatccaattaactggcgtagcaagtcgttatgtaggaatctggattgctgctttactcattttattaggtctattccctgctgtagctggtgtaatacaagctgttccacaagccgtattaggtggagcagttatggtaatgttcggcgctgttgctgcctcaggtattaatattctttcatcaattcatttagaccgccgtgctcttttaattattgcgatttcacttgcattaggcttgggtgttgctcaggtgccacaaattttggagcatctgccagaattatttaaaaatatttttagttccggcgtagcaacaggcggtattgcagcattaattttaaatgttgtactcccagaaacacataaataa

SEQ ID NO: 1097 - DNA, 951 bp, Acinetobacter baumannii
ttttataacaatttggagtgttccatgaatttggctgatcgtgatggttttatttggcaagatggacaattaattgattggcgtgatgcaaagattcacgttttaacccatactttacactacagtatgggcgtatttgagggtgttcgtgcttatgaaactcctaaaggtactgcaattttccgtcttcaagaccacacaaaacgtttgttaaattcagcaaaaatttatcaaatgaaagtgccgtatgatcaagcagcgcttgaacaagcacaaatcgatgttgttcgtgaaaataaattagcttcttgctatttacgtccactgatctggatcggttcagagaaacttggtattgcagcaacaaataacaccattcatgccgctgttgcagcatgggcatggggtgcatatcttggtgatgaagcaatggcgaaaggtattcgcgttaaaacttcatcatttactcaccatcatccaaacgtgaccatgtgtaaagcaaaagcatctggtaactacacgttgtcaattcttgctcaccaagaagttgcacattcgggttacgatgaagcaatgcttatggacccacaaggttatgtatgccaaggttctggtgaaaacgtattcttgattaaagatggtgttttacacactccagatattgcgggtggcgcacttgacggtattacacgccaaacagtgatgacgattgctaaagatcttggttatgaagttgttgagcgtcgtattacgcgtgacgaattctatattgccgatgaagcattcttcacaggtactgctgctgaagtaacaccaattcgtgaatacgatgaccgtcaaatcggtgcgggttgccgtggcccaattaccactgaaatccaaaagactttctttgatgcagttcaaggtaaaaatccaaaatatgaacactggttaacttacgtaaaataa

SEQ ID NO: 1098 - DNA, 1272 bp, Acinetobacter baumannii
aagaccaacaactcattgaacgatttatgcaaggagtccaacgtggatcagcaaaataatgtgattgactatacccaattcccagatgcaaatgggcatttcggtatccatggcggacgttttgtgtcagaaactttaatggcggcattagaagatttggaaaatctctattcccgcatgaaaaatgatgaacagtttttggcagaattcgaccgtgacctcgcctactatgtaggtcgtcctagtccactttattatgctgagcgatggtcaaaagagttaggtggtgcgcaaatttaccttaaacgtgaagacttgaaccatactggctcacacaaggtaaacaacacgattggtcaggcgttattggcaaagctttctggtaaaaaacgtattattgccgaaactggtgcagggcagcatggtgtagcgacagcaacaattgcagcacgtttaggtcttgaatgtgttgtttatatgggtgctgaagacgttaagcgtcaagcgatgaacgtttaccgtatgcgtttgttaggcgctacagttgttcctgtacaaagtggctctaaaacgttgaaagacgccatgaacgaagcgatgcgtgactgggtaactaatgttgatacgacgtactatgtgattggtacggttgcaggcccgcatccatatcctcaattggttcgtgacttccagtcgattattggtcgtgaagcgcgtaaacagattttggaacaagcaggtcgtttaccagatgcattagttgcctgtgtaggtggcggttcaaatgcaatgggcttgttctatccgttcttaaacgatgccaatgtgaaaatgtatggtgttgaagccgctggttttggtattgaaactggtaaacactctgcgccgttaaatgcgggtcatgtgggtgtattgcacggtaaccgtacttacttgatgagtgatgaacaaggccagattattgagacacatagtatctcagcaggtcttgactatccgggtgttggtcctgaacatagcttcttgaaagatatgaagcgcgtagaatacgtgccgattaatgacacagaagctctacaaggtttccgtgacttaactaaaattgaagggattattcctgctcttgaaagctcgcacgcaatggcatacgtttctaagcttgcaccaacaatgtctaaagatcagattattattgcgactgtttcaggccgtggcgataaagacttaatgacagttgcacgcattgatggcgtagaaatggtcgagatgtaa

SEQ ID NO: 1099 - DNA, 1995 bp, Acinetobacter baumannii
gcacgaaacaaccagtatttatcccaaatagagcataaaaatatggcagcactttatcattcacttttcactgaaaaaggtttggagctacttcgagagtcaattcaaaatggcactaaattaggtattactcatatgtcttttggtgacggtggtggggatttacctattcctgatgcttcattcactcagatgataaatgaagtttatcgagtccagttaaaccgacttgccccctcaagagataatcctaactggttagaagcggatggtgttattccctctgctgtaggtggttttaatattcgtgaagttggcctgtgggcagaggatgttatggtggcttatgccaattatccaccaacatataagccttcgggggatcaaggtactgctcaaatcaaaacaattcgtattgttctgcaaattgataatacggccaattttgaattaaaaatcgatgcctcagttgtaatggcaaccttacaatctgtagaagaagccaaactagaagcgatgaatcatgctgattcattagtgaaagaacaaatacgttatgtagataaccttaactctctgaatgacattgagaaccctcaagataaacaaatagtctacgtcacgggaatgggagagtttgaatacagcctgaccctaatgacatgggctcccaaacaacgttctgataatacaattctaactgccgaagggcgttttcaacgtgataaaaataaagattatttagatctaaaggactatatctttttagctgaaggaaaagactggactaaagcaattaaacaagcagaaacagatgcgtttaacttaaagatgggtcttaaaattccttctggaatctttggttattctgaagatattacatttagatgccatacatttggacagggtatttcaaatacatggcttcaaaagttaaagccttgttcagtaataattttaggtggttcattaagagatttaacggtcagtcctgagggttatcttgataacgatcaaagtgatggaattattgcagataattcagatagaaaattaatattgaatgttttaactgagtatcatggcggtaatggctttgtttttaaaaaaggtaacctttcaagatttataattcgatctagatataataaaggtaaaggagtgctttttacaccagatgcacctggtgataacaaggcagctcaattatggcttgaatgtactggtaataaaagatcaggatttttcatggatcatagtttagtaaatccatcttacaattcgggtaatcattttggaacgattatttcacaagggaatggagcagaccttgtgaatgatgacaaatatgatgtcgttctttcaggtaattataataatttaacaatttatacagaatatggtgctggttgttggcataaggatactttgaaaggttctagaatattttataccaatatgtcacatataaattggaaagatgaagctggagactcaaatgaagtttcatatataccaagtgcaaatggaacgagagtaatcaaatacggaaaatttcagaatgtagttgtccaaaatgaaaatggtcaatattcaggaaaattaacattcacgcatacagctaataataaatttgagtatattctcggtaactctacagcagaccaaaatatttactaccctgacaaactatttttaagaaaaggtaaaggtacttttcagcccatatttccaagagataatgttgttttaaattttggaaccattcctgccggaaggtctgttgagaaatctctctcattgttacagctaggcttaagctctgcaaataacactgttgttgttaacccagtcggcaatatcggggctggattattatggagttgttatattgattcaaatgacttggatcgagttgtgataagactatttaactctaactccatagatgttactactgctgattttccgtggaaagtttcagtctttttataa

SEQ ID NO: 1100 - DNA, 210 bp, Acinetobacter baumannii
caaaaggacaagcaaatgaaaattttagctgctacatattcgcatactcaaaataatgtaaaagaacatagccctgtctatgacctagatgcttatgaaaaacgtcagcgtcaattcaaacgtaaaaaactcctgaagaatcttttcgacactgccatatttgccagtgctgctggcttcactttctcaatgttgttttggggagcctaa

SEQ ID NO: 1101 - DNA, 1506 bp, Acinetobacter baumannii
cacattagcaagaacgtaagcggaccgagtatgaatgaacaactcaatgccacactgatgtcgtgggtacaattttttaatgaacctttatgggattttctggttattttcttgctggccgtcggtattttttatacggtcttaacaggagcagtgcaaattcgcatgttcttgcaaagtattcgtgttatgaaaagcagccgtacagaaggcgaagatgagcatggccttacacctttccaagcgtttgtaaccggtcttgcgagccgtgttggggtaggtaacattgctggtgtggcaattgcgatcgcaattggtggcccaggcgccgtgttctggatgtgggtaaccgctgtacttggtatgagctctgcttttatcgaatctactcttgctcaactttttaaggtgagagacagtaatagcaagcaattccgcggtggtccagcctactatattactcaaggtttacgtagtaaaacttttggtgtgatcttcgcgttagcattgatctttacttatggttttgtatttaactcagttcaaatcaatgcaattgctaatgcatcttcacatgcgtggggttgggataaagctaacctaattgcgcatttaggtggtgttgatttagaaatttcatgggttggtcttgctcttgttgtgatggttgcattggcaatctttggtggtattaaacgtatcgctaaattcgcagagatgtttgttcctttaaaagcaggtctttatctctctgtagcgttatatattgcattaagcaactatgcgattttgcctgatgttttaaaactgattgtgactgaagctttccactttaatgctgcggcaggtggtttcttcggtgctgccgtgtcaatggcaatgatgcaagggattaagcgcggtttgttttcaaacgaagcgggtatgggttctgcaccaaatgcggcggctgcatctgatgtaaaacatcctgtaaaccaaggtttggtacaaatgcttggcgtattcgtagatacattcattgtatgtacaagtacagcaatcatcattttagtttctggcgtttaccaagatgctggtttcgtcggtgttgaattaacccaacgtgcactagagactcaagtggggcactggggagctgacttcttagctgttctattattcttgttctgttactcagctgtattaggtaactatgcttatgcagaaagtaacgtacagttcattaataacaacccgaaagtcatgttcatcttccgtatttttgtattggtgatggtgtatttcggtgcaattggtagtgtgccattagtatggtcaatggcagacttgtttatgggtattatggctaccattaacttggtcgcaattttacttttaacaccaatggctcgtactttgttgaaagattaccgagcgcaattgaagcaaggtattaaagaacctgtatttaaaattaataaatatccagagttgaagaaaaaagtcgattcagatatttggtaa

SEQ ID NO: 1102 - DNA, 447 bp, Acinetobacter baumannii
cgaaggagcaaccatatgccgatcgctaagttgaaacgtgagaagcgtaaagatccattatggggaattattctctctataattgtggggtctgtcctcatgatctatccattatcttacgacatctcgggctggcgaccattgttcatgcttatgattatgttgttttgggttgtttgccagccaacatggtgtggggtgtggttcgcatttggaatggggatttttacagatctgttgcttgatgcacctttaggattaaatgcactgagttttgttattgtcacgtttattacccgatttttaatacgcgaacgccgtattttgacttttggtaatttatggacgattgctacattagtgattattgctcacttagcgtttatgtggggactcaaacgatggggggcattcatttttcgattgctcgacattggcaaccattga

SEQ ID NO: 1103 - DNA, 2148 bp, Acinetobacter baumannii
ggatatataaagatgagtgcaattcaatacgaaaaaaatgccgacaatattgtcattttaacgcttgactcaactggtcagtctgcaaataccatgaatgcagaatttcgtgactcgcttgatgaggtcacccagaaacttaaagcagaaacagaactttcaggtgttatttttcgctcagcaaaaaaaactttctttgctggtggtgatttagatgaactgattcaagttcaacctgagcatgcaactgactttttcaatatggttgagaagttaaaaggtcatctaagaacgattgaaacactaggagttccagttgttgcagcattaaatggcacggcactgggcggaggatgggaaatcgcattaagttgccatcaccgtattgcaatcaatgacccgaaaagcaaatttggcctaccagaagttaccttaggtttactaccgggcggcggtggtattgtacgtatggtccgtctgcttggtcttcaaaatgcatttccatttttaatggaaggtaagcagttcggtgtcgataaagcaaaatctttaggcttaattcatgacacagctgaaaatgaacaagaacttttagataaagcgattgcttggatcaaagccaatccaaaatctcaacagccttttgatgtgaagggttataaaattccgggtggcgatccaaaaactccggcagttgcacaagttcttgccattgcgccagccatgttaaaagacaaaaccaagggctgctatcctgctcctgaagcgattatggctgccgcagttgaaggtgctcaagttgatgtcgataccgccttgcgcatcgagtctcgctactttactcaactagcaacaggccaaatttctaaaaatatgattggcactttctggcatggtctaaatgcaattaagtcgggtgctagccgtcctgccgatattgcaaaatggcaagccactaaagtgggcgtgttgggtgcgggcatgatgggtgccggtattgcctacgccactgcaattaaaggcattcctgttatccttaaagatgtatctgttgaaaatgctgaaaaaggcaaagcttattctcagaaattgctagataaacgtgtttcacaaggccgcatgacggcagaaaaacgtgatcagattttatcgctcattacggctacagcttctgctgaagacttacaaggttgtgacctgattattgaagccgtatttgaaaaccaagaacttaaagcgaaagtcactcaagaagctgaacaatacttagcgcctaatggtgtaatggcatcaaatacatcaactctaccgattacaggtttagcgcaagcaagcaagaatgataaagcatttattggcctgcatttctttagccctgtcgacaaaatgcaattggttgagattattaaaggtaaaaacacctccgcagagacacttgccaaagcttacgactttgtacaacaaattggaaaaacaccgattgttgttaatgatagccgtggtttctttaccagtcgtgtgtttggtacttttattcaagaaggtatgcgcttacttgcagaaggcgtccatccagcgcgtattgaaatggcagcactgaaagctggcatgccggtgggaccacttgcgattcaagatgaagtgtctttaactttaacggagcatgttgcaaatgaaacacgtaaagcgctacaagccgaaggcaaagagctaccgaaaacaccagtagatgaagtgattcataccatgattcatgaattaaaccgtaaaggtaaagctgctggcgcaggtttctatgactatcctgaaaatggtaaaaaacacttatgggaaggcttaaaccgttggcaaaaagatcatgatatttctgagcaagatatgattgaccgtattttgtttgtacaagccttagataccttacgttgttatgaagaaggggtattagagtcagtgattgatgccaatgtcggttctatttttggaattggttatgctccgtggacgggaggagcaattcaattcttaaatcaatatgggattgataaagcacaaaaacgtgccgaagagttggctgccaaatatggtgagcgcttcacgcccccaacgttactaaaaactaaagctgagcagaagcaaaatattcaataa

SEQ ID NO: 1104 - DNA, 1062 bp, Acinetobacter baumannii
ataaagataaaaataagtaggcaagctatgaaaattgttcaggtattggcaactagcggtggagttggtggattagagcagcacacttttaaccttgttaatgagcttgctttaaaccatgaagtacatgtgattgcacatccttgctatgtagacaagtttagccaacaagtacattttcatgctatcgattttgcccgtagtcgttggaatatttttttactttggcaacttaaaaatcttattcagcagatccaacccgctattgttcatgcacaagcaggaaaagcggctgagctgattgcccgcattaagccatttttatctggtccaaagtttgtaacgactgttcatggtactaaaaagaataagtctgcttatttagcaggtgatgcagttattgcggtgagccaagcgctcacgcaaggcattccagagtctaaagcacacgtagtttataacggggtatatcctcagcccgtacttacaactgaaaataaagaaaaattgcttcaatcgattcaaaaagattttactgagctagacacaagtaaaaaagttgttatgtgtattggacgtctagaatcagtaaaaaatatcagtttattgattgagtcgatgcaacagattgatgccaatttatggattgttggtgacggttcacttcgagcaagtttggaaaagcaagtcagcgaattgaacatgcaaaatcgggtcgcttttcttgggtttagaactgatgcgcgtgatctggtacaactggctgatatcgtggttttatcatcagatcgtgaaggttttccacttgttatggtcgaggctttacaggccgataaagcaatggcttcaaccaaagtgaacggtgtgatcgagtggttgccagaacaatatctagcagaaattggagatactcaaggtttagcaaaagcgattgaatatgcccttcaaccagaggctcaaaatgactttggccctttgtatgcaaaagccaaggctgaactgactgtaccagccatggctgagcagacgcttaatatttataaaggcctgctgaaaacttaa

SEQ ID NO: 1105 - DNA, 456 bp, Acinetobacter baumannii
tacggagtaaacaaaatgatgatggcattagggctgtttgtattttcattacgaacagctgcatatcaagaattgcaacgtgttactagctggagacatccgagtaatagccgggttgggtctaccccagcttatcagtttactggtaaaggtgaggacactattaccctgaagggagaaatctaccacgaactgaccaacaaccgaattgtattagatcaagttcgtcgtatggcagatacaggtatggcttataccctaatcgaaggtactggcaagatttatggcctagtgattattgaaaatatggaagagacaaaaacctatttctttaaagatggtgcagcacgtaaaacagaatttaccctgacactaaaaatcgttaaggagtggaaaccaactttaataggaacgcttctaggcatggctggtggcgtagcaaataggttgatataa

SEQ ID NO: 1106 - DNA, 2649 bp, Acinetobacter baumannii
gatgaggtaaagatggattttttagcagatgatgaattaacgttaaatcaagaagatcctcgttttaaacctaaaagtgaacgcggtggaattagtgacggtgctttaggtgtggtttccggtgttgccatgggtactattgaggctgctactgcaccggatgccttgattcgtggtgacaagaaagcagcggctctaagagcacaaaaccttgagatctttaaacctgatgatctcggtggagttggtgagtttacttatggcctaaccaaagactttactcgtattggctggaacgccgtcactacactaggtacaggcggtgtacctggtttagctctaaactctggactatttgggtaccagacctttgaagcagaaaaatcagacttactgaataaaggggcagacataaaaacggcccgaaccggtggggctattaaagggattacagatgctctgggctttgctattcctacccatggtgttgctaaatcggtagtagctgatgctgtggctactactacgctggctactggagctggcgtagctggtgattatctggaaggttcatttcttgaaaacaatgaaaataaaaaggtcgctcaatacggtgaagcattaaaggaaaatgctttaagtccatccacattagcatcaaacggcgggatggcactcctactcaacttgtgggccaataaaggccgattgaggcctgagcaggtaaaagaacacggcaatgttgatacgatgaatgatgctgctcatgtacaagcgaaccttgagcatgcagaagggatgaatccttttaatccagaaaatgcaaaagaagccaattcacactttgatgcattggatagtgcaatggagagtgcattgaatgatgagttggtcagcttaagagcaccagtgagcggaacacccaaagcaatcgtaacgagtacaccagtggtaccaataacaggtacaccgaaagctattgtaagaccaagcgctatcaatactgatgaacataaagcgccagtaatagcggagcttttgactaatcctgtatttgataaaaaaccttggacaaaaacgattgttcaggaagcctctaaacggggtatcaatccagtggatgccttggtcatttctcatttggaaactggtggcacttttgatccaaagattcagccaccaatcgataaaaagacaggaaagccaatatcatctgctactggtttattccaaacccttgatggcacttttgcccgtatgggaggtaagaataagtttgatggtaatgatcaaattaaagcgggcctgaactactacgagcacaatgccaaggtttttcgtactcactttaatcgagatccgaatggcctagagctttactacctgcatttctttggtgagggtggtggaccagcatttttaaaggctaaggataatgagctttttgttgatgtggccacacgctggagtaaaggcaatcagaaaaagactgcaagacagattgcagaaggtatcacttcaagtcatcaattcaatggtatgaccgtaggacaagtaaaggccaaatacgaaaagcgctggaacgaaatcgcaagtctttatagtgatgttagtccagatgcttcagtaagatctactgaagtccgagggagcgaatcagagttcccacagtttgagtctgatataactgcgccacctgcttacaagtcccaatctgatgctgaaattgaagcaatgccttttgtactcagtgcagatgagcatagtgtgaagtcactccaggaagagtttgaagccctatcttctccattgaccaaggaggatctggaatacctcaaggctacggcgcattatcagtattctgaaggtggtgcttaccgaacgccgtatgttgaacctcaagtcgatttatctggtcccggtaatagcgctaaccgtaatttggatacattggactctgatctttaccagcttgagccagaacaacaacgcgttattcttccaggtccagaatcgaacactttagatatcaataccagaacatcagattcaaatattcagcaaaactcaattatcgcaggggtagataattggactccaaccagatcgcaaaactaccttaaacgagagcggtcaatggatgatgggggagttattcaagagctacacaatagtacttctaatacgacattccagcgccaagttaatcaagatggcaccattagcccggtaaaggctacacgtaatggaaatgacctatttgcccatcctgctaatggtaaagccgatagtcctgaattaactgcggtacagcataaagctactcaggcattggaacgggagttttggaagccaggtaaatctaaggttgatggtgcaccggacttaaccaagtctagtaaaggggaatacggtgcattcactgacacggcagacggcagggaagcagtttcaattctggaagcagatcccgatatggaagtgacctttacgcgtctggatgaaaacggggatgaggaaattgtgacgatgtcatcccgagatctattggactatgtcaaagagcaagaagaaatcgcaaaagatgaaattcaggcagtgaaagcattggcaagctgcgcattaagatttgggagtgaagcagcatga

SEQ ID NO: 1107 - DNA, 792 bp, Acinetobacter baumannii
atgacaccaaaaaacctacttaaagtagaaagcaatatactaccaaaaatagaattggtgcaactaaaaattgatagtaaaattctacccacagtagaaaagaagcctattttgatggaagacgctaaatacaaagactttgcggaccgactcaacgcattgatgaaggcaaaagactctccaattaaaactatcaatgagttaaaaaaggctattggtgtttcttatgagatggctcgtaggtatacacttggtacagctaaaccaagaattgaaaagctacaaacattagctgatatttttggagtagaaattagttacttagatcatggtactaagttagacaataatatcgatttatcagataaagttggtttcgaaggacgcagagttccagtaatctcttgggttgcggctggttcatttacaccgattgagacagttttgaaagatacggaaattgaagaatatttaccgccaaatagaagatgcggaaaaaatggatatgctttaaaagtagtaggatattctatggctccaacctttctaccgggtgatagaatttatgttaatccagacattcaaacattcgaccttaaaacagatgatcttgttattgttgcctgtgctggtgattcagaagctacatttaaaaagctaatcattgagggtgagggaactagcaaattcctagagcctttaaaccctgattggcccgataaaattattaaactttcagaagattgccgtttagttggtaaggtggttggtctatatagagatatttactaa

SEQ ID NO: 1108 - DNA, 216 bp, Acinetobacter baumannii
aagaagccaaagcacgtaaagaacaaggcttggaggaaaattctaatgaatcatgatgaagaattagttcaattctgccgttgtagaaataaacacttggttaaagatcgcttacgccaaccaaataaatctacctatgggctaatggatctggtgtgtccacgttgcaaagctcaaagttattacaaagttaatgaggtgaagaaaaatgtctaa

SEQ ID NO: 1109 - DNA, 522 bp, Acinetobacter baumannii
ccaaatacaaacattcttatgttctgtttttggctcagatctccacccctcaccaaaccgagaataaaaatgtctggattaattgctaacggtacattttcaaatcaggacgttgtaatcaatagtgatccgttctttccatcggtatcaagcaaccatgtccgtgaagttttgcgtttagattcaagtgttactaatcaacgtcttatttcagctatagaagcagctgtaattcatgttaatgaacaactggaaagtttactcagcaaagcccctacgttagtagaaattacaactaaacaggtcaatggaaagcctattgctgctgttttgtatttccgtgcagttgctgcagctgctggtgcagaactttgcgaacgttaccggtcttatgacactacaaacaacggtagccaaaaagctgaagaactgacaccgacgattgatgactataaacgtgatttgcgttttgccatccgcgatataaaaaaagtacgtcgactaaatgtggagttgttttag

SEQ ID NO: 1110 - DNA, 912 bp, Acinetobacter baumannii
cccgtaaaaaataaagcaatgcaacagaatgacttgacgaaaagtttggtagaggcttttttgtatttggctcctcaagaggggttatatcccactcatatttcaaatattaccctgatgagggtagatcattccacacagccggttgctgtattgcaagagccttccattgttttagtcattcagggtgtaaaacgggcttatatcggaaaagatatttttaagtttcaacaaggccagtgtttatttatctcaattgctattccttttgattgcgataccttggttgagcgtgaaccaatgcttgcaattgcgattaaatttgaacctcaaatgatggctgagctggcgactaaaatggataaagagcagcggccacttatagaagaccttgataacaaagagataaaactgagctgtggtttaaatattattgaaatgaactcggttatatctgatgttgctttacgtttgttgaacttacttcgttccaagcaagatactgcaatcttaggagagcaggtgaaacgagaacttatttatcgggttttacaagccggcggtggtgattttatccagaacctttcggctattatgagccgaagtggagtgatttatacgatttgtgaaattattcaaagagattattatcgtaacttaacggttcaggagttggctaaacaagcaggaatgagcgtttcgctttttcatcaagcttttaagaaagttaccaactattctccattacagtacatcaaaattactcggttacataaggcccgtgatctaatcctaaataaccaaatgggcgttgcagaagctgcctatgaagtaggatatgtgagtgcctcacagtttagtcgagagtttaagcggctgtttggagttccacctaaattatcaacaaactaa

SEQ ID NO: 1111 - DNA, 603 bp, Acinetobacter baumannii
aaagcgaaaaagtttatactaggcgcaatttttgcggtgtttttcctgaatatgcaactgtctgacttttcctttgaactacccgatgaacttattgcccgttacccactcgaaacacgtagtgcttcgcgtttattgcatttagatgctaagggccaatatcacgatcatatgttcacagatattattgatctgttcgaagaaggcgatttattggtactcaacgataccaaagtcatgaaggctcgactgaaaggaaaacgtgccacaggtggggcgattgaaattttggttgagcgtatgctgaaccacaccacagcgtattgccatattaaagcgagcaattcacctaaagcaggggctgagctttttgttggtgcggacaatattcccgtgattgtgcgtggccgtcacgaaaacttatttgtcgttgagttttcacaaccaattttgccagtacttgagcaatatggtcagttacctattccgccttacttcaatcgtgaagcagaagaaattgacactgaacgctatcaaacggttttccataatccagaaaaaattgccagtgtggctgcccccaacagcaagcttgcattttga

SEQ ID NO: 1112 - DNA, 1080 bp, Acinetobacter baumannii
agacatgaaaaaatgaaaaatatactttcaatttgttgtttggcagtaataaattcttatagttttgctcaagatataaaaggtatttcattttctcaccaagagtgggaaatctcttgtagtaatacgggtacctgtaaggctgcagggtatcaaaacgaagaaaatggtgataatcccgcttcaattttattaacacgtaaagcaggcccaaaacaacctgtacagattgaatttgctttgtctgactatgaacaaagcatacctgcaaaccagcttaaaaatatccatttttatatcaatggcaaagatttaggtgcggtgggtgtggacggtactgagctgccaattatgggtaagctaaacagctcgcaagtcaatgctctactacagcagtcgaaacagaagactgaaattgtatttaaaaatgcgcagcataaatggaaaatttccgatgcagggatgactgccgtattattaaagatggatgattttcagaagcgtatagggactattggtgctttggttaaaaagggtagtgccaatgaaaatcaagtacttatgcctgagccaaaactagatgtgaagcgtattaagacttcaaccaaaccttatttaactttacagcctaaaaataaacagtaccaagcaatacaccgtagtttgatagctgctaaaccgaatccgaaagaagacggcttttgtgaaggtatttatggtggtaacagtgatggagccgaaccacagaaaattgagctatataaattaaccaataagaaagttctggcgactacattgtgctggagaggggcttataacgaagggtatggggcatgggtactcgatgagtctttaaacggtaagcccgcgtttgtaactgagtccgcctcagattttgatagcggtattattagtagtgctcaaaagggacgaggcattggagattgctgggcaagtgaagaatgggtatgggacggcaagagttttgtgcatactaaggatatgtggacgggtatgtgtaaaggcttggcggcaggtggagtgtgggagcttgatcgcattgaatcagtcgtaaagtaa

SEQ ID NO: 1113 - DNA, 687 bp, Acinetobacter baumannii
tctaagagaaaaaatatgaaaactaaacttgctacactcatgttgagtttggcttttttcggttctgctcatgctgatgttaaaacacttgaacaaaatctgaagaaaaattatccagatctccctgtaaaaggtgtctatcagtcacctgtcgctggaatttatgaagtctatacaagtggtcgtattgtttataccaatcaagatgcaaaatacttttttgtaggcaatttagttgatatcaaacaacaaaaaaatatgacagaagagcgaattgccgaattgggtaaaattgatgttaaaagtctcccattaaatcaggcaattaaatacgtcaaaggtaaaggagagcgtactctttatattttcagtgaccctgattgcccttactgtcagcgtctagaacaaaatatggttggagtggataacgtaacggtatatatattcttatatccactgaccagcttacatccaaatgctgaaaaggtttctaatcaaatctggtgctctaaaaacccttcagaagcttggacaaattatatgcttaaccgtaaattgccagcggctagcaaaagctgtacaagtccaattcagaaaaatattgctttagggccagaaattaaatatagatggcacaccaactctgttcttacaagatggtcaaagaatctctggcgtaccaagtga

SEQ ID NO: 1114 - DNA, 903 bp, Acinetobacter baumannii
gttagtatgaatcaagaagtgaaatcagggaaagttcttagcccttcgacgccatggacacagcgtccagttccaggtattgaagttgcagatgagcaacagactctcaaagcaacatttactgagccaactattgagtgccctgaatgtcatgctttagtgacacgtacagcaatatcttttaatgcgtatgtatgtccacagtgtgacgaacacttacgaatgaaagctcgcgatcgcttaaactggttcttcgacaatgttgtggctgaattaggtcaagagttcagcgcgaaagacccattaaagtttgttgatagcaaaccgtatccagatcgtatgcgtgaagcgcaaactaaaactggtgaaacggaagctttaatcgccatgcaaggtaacttaaatggcgtagatatgattgcatgtgcttttgagtttgactttatgggtggctcaatgggtactgtagtaggtgaccgttttgttaaggcagctgaacttgcaattgaaaaacgtcagccattaatctgctttgcagcttctggtggtgcacgtatgcaagaaggtatgttgtcacttatgcaaatggcacgtacttctgctgcaattcaaaaattaaaagatgcaggcttaccttatatcgtggtgttaacacatccggtatatggcggtgtaacagcttctttagcaatgttgggtgatatccatattgcagaacctaaagcaatgattggctttgctggtaagcgtgtgattgaacaaactgtacgtgaaacactagaagagccgttccagcgtgcagaatatctgcttgatcatggtgtggtcgatcagattgttcatcgtcatgctttacgtgatactgtatctcgtcttgtatcaaaattgatgaacttaccttga

SEQ ID NO: 1115 - DNA, 456 bp, Acinetobacter baumannii
aagcccatgaacaacattcaggatcttgctctttatctgcagccattattggatcgattgtctccaggtgaaagggcaaaactggctaagaatattggacgagatcttcgtacaagccaacgccaacgtattacagcacaacaaaatcccgatggttcatcatatacagctagacgtacacgcttacgtgaccagaaaggaaaaattaaaagaaaaatgttctctcggattaaatccaatacccacttaaaagtattaagtaatagtgaatcaattgccgtaggttttattggacgtattaatcgaattgcgaaggtacatcaatacggattaagagacagagctaccagatctgcccctgatacagtttacccaaaacgtgaattattaggatttacagataaagaaattaatctggttgagtcatcattcattaagcacatcaatattaagtag

SEQ ID NO: 1116 - DNA, 216 bp, Acinetobacter baumannii
atgataatgaaaattaatattatctccaaaatccatattatctactcaatcttcggctatacttcgttacaagatctccatcatatttacattattcgaccatgtttaaaaagtttttatttcaaattcattggtttctgggtattagtgctggcctcatcttatccattatgggtgttacaggcgcaatttattcttatgatcagcaaattttaa

SEQ ID NO: 1117 - DNA, 831 bp, Acinetobacter baumannii
aaagaaatgaagaaattacttatcgccagtctaattgccatttcaagttcatcaatctttgcagcagacactacgatatctgcagctaaaaacgatgtatttaaacaggctgagcagctatacgcagcaaaaaattatcctgctgcttttcaagaagtccaacgtcttgcacaaacaggaaatgctcaagccatctataacttaggctatatgacacaaatgggccaaggcactgccaaagataatgccaaagctctgaaatattatgaagatgcctcaaataaaggttatgctcaggcgagttacacgcttgcacaaatttatgagactggtgaattaggtgttgccaaagatagcaataaattcagtcaatatattcaaaaggcagcagctcaaggttctgatgatgcaactgtcaaaatagcaaccattttatttgcacagaaaaaacctcaatctcatcaaattgctttacaaaagctggcgcctttgattagaaaaggaaactaccctgctattcaagtcaaagcgctttatgatattagccaaggggttgaaaataaaaatcctttaatgaaacgccaaggcattgaagctttacaaacaattgcccaaaagggttatgcacctgcatctatggctttagcaaccatgatggcgaatggcaatatcattcctcagaacttgcctcaagcaaaacagatctttactgagcttgctaaacaaaatgttcctaatgctagagaatctttagcttcggtcgaaaaaattattgctgagaagaataaacaagctgccgccgctcctacgcagccagctcctaaaaaatag

SEQ ID NO: 1118 - DNA, 2778 bp, Acinetobacter baumannii
acgactgagaaaaaatttattcatttgaccaagcaagatttagagagtttatccatgttggcaagtctgatcggaggtatcttcggtacaaaaaatgagcgtgaactcaaacgcatgcgcaaaattgttgagcaaatcaatgcgctcgagccgacgatatcagctttaagcgatgcagacttatctgcaaaaactccagaattcaaacaacgttataacaatggcgaaagtttagataagttactccctgaggcgtttgcagtttgtcgtgaggcagcaaaacgtgtaatgggtatgcgccactacgatgtccagttaattggtggtattaccttacatgaaggcaaaattgccgaaatgcgtaccggtgaaggtaaaacccttatgggtactttagcgtgttacttaaatgcattaagtggtgaaggcgttcatgtcattactgtaaacgattatttggcacaacgtgatgctgagttaaaccgccctttatttgaatttttaggtctaagcattggtacaatttattcaatgcaagaaccagcagaaaaagcagctgcctatctagctgatattacctatggtaccaataacgaatttggttttgactacttgcgtgacaacatggtgttttctttagcagaaaagaaacaacgtggtttgcactatgccattatcgatgaagtcgactcaatcttgattgatgaggcgcgtacgccattaattatttctggtcaaagtgaagattcttcacacctctatactgccatcaatactattccaccaaaattacgcccgcaaaaagaagaaaaagttgccgatggcggacatttctggattgatgaaaagcagcgttcagttgaaatgactgaaattggttatgaaactgtagaacaagaacttattcaaatgggtttgttagcggaaggcgaaagcttatattcagctacaaatctaaacctcgttcaccatgtttctgcggctattcgtgcgcacttcctattccaacgcgacgttcactatattattcatgacggtgaagtcgttattgttgatgagcatactggccgtaccatgccgggccgtcgttggtcagaaggcttacaccaagcagttgaagcgaaagaaggtttggctattcaacctgaaaaccagactttagcaacaactactttccagaactatttccgtctttataaaaagctttcaggtatgacaggtactgccgatactgaagctgcggaaatgaaagaaatttatggcctggacgtcgttattattccgacacaccgacctatgattcgtaatgaccagaacgatttaatctatttaaaccgtaatggtaaatataacgcgattattcaagaaattatgaatattcgtcagcagggtgttgcaccaattcttattggtacggcaacgattgaagccagtgaaattctatcgtctaaattgaagcaagctggtattcatcatgaagttttgaacgcaaaacaacatgagcgtgaagcagacattattgctcaggcaggtagcccgaatgcagtaacaatcgcaacaaacatggccggtcgtggtacagatattatccttgggggtaactggaaagcgaaacttgccaaacttgaaaatcctacccctgaagatgaagcacgtctaaaagcgcaatgggaacaggaccatgaagatgtattgcaagcaggtggcttgcacattattggttctgaacgccatgagtcacgccgtattgacaaccagttacgtggtcgcgcgggccgtcagggtgaccctggtgtttctcgtttctatttatctcttgaagatgacctcatgcgtattttcgcaggtgaccgtgtcgttgccatgatgcgtgcaatgggacttaaagaagacgaagcgattgaacacaagatggtaagccgttctatcgaaaatgcacagcgtaaagttgaagcacgtaacttcgatattcgtaaaaacttacttaaatatgatgatgtgaataatgaacaacgtaagatcatttattcacaacgcgacgaaatcttagctgaaaatactttacaagaatacgttgaagaaatgcatcgtgaagtaatgcaggcgatgattgctaactttattccaccagagtcaatccatgaccaatgggatgtggaaggcttagaaaatgctttacgtattgatttaggtattgagctaccagttcaagaatggttagaacaagatcgacgtcttgatgaagaaggtttggttgaacgcattagtgatgaagtgattgcgcgttatcgtcagcgccgtgcacaaatgggtgatgaatcggcagcaatgcttgagcgtcatttcgttttaaattctcttgatcgccattggaaagatcatttggctgcaatggattatttacgtcaaggtatccacttacgtggctatgcgcaaaaaaatcctgagcaggaatataaaaaagaagcatttaacttgttcgtgaacatgctgggtgtaattaaaactgatgttgtaactgatctgtctcgcgtacatatcccaacaccagaagagcttgcagaaatggaagctcaacagcagcaacaagcagaagcaatgaagctttcttttgaacatgatgatgtggatggattaacaggtgaagtgaccgcttctcaagaagcacttaatgagtcggctactgaacaacaaacgttccctgtacctgaaagtcgtaatgctccatgtccatgtggttctggtttgaaatataaacagtgtcacggcaaaatttaa

SEQ ID NO: 1119 - DNA, 465 bp, Acinetobacter baumannii
aataaggagaagacaatggcaacaggtacagtaaaattacatcgagtgtttaaggcaccagctgaacgagtttatcgtgcttttcttgacccagatgctttagttaaatggatggcacctcacggttttaccgcgaaggttcatagttttgatgcaaaagtagggggctcatacaaaatgagctttaccaatttctcaaccgggtcaacacattcatttggaggtacttatgttgagctcgttcccaatgaattaattcgttataacgaccaatttgacgacgcaaatttacctggcacgatgcaggtcaccattacattaaaaacagtattggtcggcacagaaatacacattacccaagaaggaatacctgaagttattcctgtggaagcatgctatttaggctggcaagagtctttatctttattgaagttgttagtagaagccgacattccagatcaataa

SEQ ID NO: 1120 - DNA, 669 bp, Acinetobacter baumannii
gtgacttacctttcttttttggggaattttatgaataagcggatgaaatatgccttttataggaactgcttgtctgtatctataggcattgcctcttgcggagcactgtttttctcttccccaacgttggctgccaatgcagctcctaaagctgtctggtatcgttattatgatcagcatggtattgcgaatattagtacatccgtaacgccggctcatattcgctatggatatgaagcactcgaccagaatatgcaggtcattaaaagaaatcatccttataattctgaagccgatttaaatcagtcctcacagcgtgcattatcagctcgatatagagaagaagataacaaattaaaaagagcatatagcaatagtaaaactgcgacgattaaaagagaccaagcattattggcaattaaaaaacaaataaattatcagcaggaccaactgagccaattacaacaagacaaaattttatttaagcggcaagaaatggaatattttcgtaagggtgaacaagttcccgaaagacataaaaccttgattgaaaacaatcttatgaatattaataaggttaaacaaacacttgaaatactttcgaaaacctataatcgcactaataaagattatgaaaatattatcgaacgtttaaaaaagcttgaataa

SEQ ID NO: 1121 - DNA, 1134 bp, Acinetobacter baumannii
atgaagtttgaaaaattaggtcagtcgggtcgtgcccgtcgtggtcgtttaactttagaacatggtgttgttgaaacccctgtttttatgccggtggggacttacggtacagtcaaaggcatgctgccacgtgatattgaagatattcaggcacaaattattttaggtaataccttccatttatatttgcgtccgggccttgaagtgatcaagcaacacggcggcttgcacgactttattaaatggaataagccaattttgactgactctggcggcttccaagtatttagtcttggcgctatgcgtaaaattaaggaagaaggtgttactttccgttctccgattgatggttcaaaagtctttttatcgcctgaaatttcaatggaaattcagcatgtattgaactctgacattgtcatgatttttgatgaatgtacgccttatcctgcgacacatgaagaagcacaaaaatcattacagctttctttgcgctgggcaaaacgctgtaaggctcatcaccacgatgaacttaaaaataaaaatgcgttatttggcattattcaaggcggcatgtatgaagacttacgtgatgagtctttaaatggcttacttgaaatcggctttgacggttacgcaattggcggtttgtcagttggtgaaccaaaagaagagatgatcaaggttttagattatcttccaaacaagatgccgcatgacaaaccacgttacctgatgggtgtaggtaaacctgaagatatcgttgaagcggtgcgccgtggtgtcgatatgtttgactgtgtaatgccaacacgtaatgcacgtaatggtcattattttgtcactgatggtctggtacgtattcgtaatagtaaatatcgtcatgaccaaggaccacttgacccacactgcgattgctatacctgtaagaactttactcgtgcttacctgttccaccttgagaagtgtggagagatgttggcgtctatgcttggtaccattcataacttacgttattaccaacgtttaactgaaggtatgcgtgatgcattagacaatggcacttttgatgaatttgttcaggacttttatgcccgccgcggattagaagttccaccatgccctgtcgatgaataa

SEQ ID NO: 1122 - DNA, 570 bp, Acinetobacter baumannii
accatgcctgacaacatttcagataggagaagttgtgtaatgaaaatacagcgattgagaaaaaagaatagcattgatattgcaaggaaattgccattgaaatgtcttttcatcgcaatcagccttgtattggcagcatgtcaaagcacgccgcaaccaaataatcacaaaggccaagtaaaaccaacacatcgtgtacaaacgccagttgtgaaaaagaaagtgagtccagatggtattcaagatatagattggcaaattacccagataaatggtcataaggcaaaattttttaaccagtggccaactctttcattgaactctacagtcaaaacagtaactggtcatacaggctgtaatcgtgtttttggacgatacacttttgatttcagccaaaagaaacttgatatggaagttaacgcaggtcattcgagttgcgatggcgcgttggctcaagaagcagaattggtcgactctttacaacgtattaaacgcttccagttagtaggtaataccttatatctacttgatcaaagcggacagcgtttgattcaggccgagaaaaaataa

SEQ ID NO: 1123 - DNA, 1335 bp, Acinetobacter baumannii
attttaactgatataaggacttatatggagtcaacctctgcgactgctgctcctgtagtagccaccaattcgaaaacacgggttttgtttgcaagtttagtcggtacaaccattgagttcttcgacttttatatctatgcaactgctgccgttatcatttttccacacctatttttccctgccagtagtggtagtgccgcagtcttacaatcacttgcaacttttgcgatcgcctttattgcccgtcctatcggtgcagcactatttgggcatttaggagatcgtataggtcgtaaagcaacattggtggcagcattgctcactatgggtatctcaaccgtatgtattggcttattaccaacctatgctcagattggaattgtcgcaccgttattgctcgccttatgccgtttaggacaaggcttaggcttaggtggtgaatggagtggtgctgttttacttgctacagaaaatgcacctgaaggcaaacgtgcatggtatggcatgttccctcaacttggcgcacctatcggttttattttagcaactggttcatttttacttctaagtgctgctattcctgagcaagcattcatgcaatggggctggcgtattccttttattgcaagtgctgtcttggttattgttggcttatacattcgtttaaaacttcatgagacccctgctttccaaaaggttttagataagcaaaaagaagttaatattccatttaaagaagtggtgacaaaacacacgggcaaacttattctcggtacaattgcagcaatctgtaccttcgttgtgttttatttaactacagtattcgcacttaactggggaacaaccaaactaggctatgcgcgtggtgagttcttagaacttcaactgtttgcaaccctttgctttgcagcatttatccctctttctgccatttttgcagaaaaatttggccgtaaagctacttctattggtgtatgtattgctgctgcaattttcggactgtttttctctagtatgttagagtctggaaacacacccattgtgtttttgttcttgtgtactggcttatcaattatgggcttgacctatggtccaattggtactgtcctttcagaaattttcccaacctcagtacgttatacgggttcagctttaacgtttaacttggctggtatttttggtgcttcttttgcaccacttattgcaactaaacttgctgaaacatatggtttatatgcagttggttattatcttacagcagcatcacttttatcattaatcgcgtttttattaatacgcgaaacaaaaaatgtagatgtaaataatcagatttaa

SEQ ID NO: 1124 - DNA, 501 bp, Acinetobacter baumannii
caatcagctgattttagcctgtggttcgtttcatactttagaagcgatttgggagtatttggaagaatgtcaatgaataacaaacaacgctggatgggtggcgttgttttattaggtggtggtgttttattggcagcattacttctaaaaggaaatgaagaaataaaacaggtagatgttcaaccccaaacttcaacatcaccgaaattacaagctaaaccaaagcaatcagcacaagaagggcagatggtacagctacagccacttgcagttgatgttgaaacagaaaaacgtcttcttgaagaacagcgccgttctcgtgaaaaagctgtagcagaacaagaggctcgtgctgctgaattcttggctatgcaacaacaggcacaagcggatgcagctcgtaaagctgctgctgaatatgccgcgattaatgctcgccgagctgctgcacaacaaagttccgataatattcctcctgaaatcccgggtagtgagaattaa

SEQ ID NO: 1125 - DNA, 1155 bp, Acinetobacter baumannii
caaatggctgacggagcaagcgcaaagtcgctaccaaaaggcgtgcggattagatcaggagcaatccaaatctattttgagcgaaacaagcaagcctacaacatcacgttaccacaccccccgactgcggaaggtattagcgcagccgctaaaattagaagccaattaattacaaaggctgagtggggaattttaaccgataaagatattgctgaggctaaaggagaaacgattgataaaaagcacctcatcctcaatagcaatgaggtgctttttcaagaagtagcacagaagtatttgcgccagtgcgaggcgaatttagactctagaaagggttatgtaagaattctgaattgtcactggatgccacactttgcactaagaccaataaatcaaatcactaatgatgaaataagagatttgattatcgataaaaacttcaagacagccaaaacccttaataacagcttaatacctttgcgcggtgtatttgagacggcaatgaatagcaagttgattttggataatccaatgcatggcattgagaataagaggatccagcaagctatacctgatccttttagcagagcggaaatgaatgctttgctgaaatggcttgatgtaaatcttgagggcacaaaccgtctttactattggtattacgagcttgctttttggtctggatgtcgcccttctgaactttttgctttgcgctggaatgatattgactggttcaatggaacaatgcgaatcagtaagagccgggtacggggttatgagaaatcggtaacgaaaactcatacagtacgggatgtatatttgaatgacagatctacacgcgccctaactgaaatacaaaagcttgggctaagtagagactatgtgatgatttgccctgaaactggcctacctttctatgatgaaagaccgccaagattcaggctaaatgaggcaatgaaggcttgtaggattcgtcacagacctgcttataacgctcggcatacctatgcaacaatgatgcttatggatggtgtgaaccctgtgtttgtagctgatcaaatgggtcatagtttgcaaatgctaatgaagcgctatgcgaaatggatgcacggcgacaagaataaaattgagatggctaaactcaacacatcttga

SEQ ID NO: 1126 - DNA, 1680 bp, Acinetobacter baumannii
agtaaaaatgagagagtgcttttgaacgttctacgtgttcccatagccttgcggttatttttaacggttttgcttaccacgctgttaattgcaactgcgagtttgagtgttctgcactggacgatgcaaaagaactttgccaaatatgtagccgatgttgaaatgcaaaagctagatcggctcattactaatctgggaaatgtatataccgtttatcatgattgggggaatgcgattcaggcgcaaatcttacaaattgaaggaacggcagcaccagatgattatgaccgtctttcccagtggtggttacgccgccaatatgatattgccattcagcagcattctttcgatgaacacactctcattaatatttctccagatgcgggaacggtaaataagaactctatttttagtgatgaagaactacgtacgcttgagcaaaacttaccttcggaatatcaaccgtttgaaggtttaagattcccgctaagtgcaaaccagtttcgtccaagcgatgataaaaacaaatcaaaaaaaggaagcctcaaagacattgagacgcaaaatggtaagaagcgttttattgctttaccagaccggctgggcttaagttctcgtttatctttatatgatgccaaacaccagttcgtagtgggtgaaccgccgtcttcggatcagatgtcttatcgcccgattatggtcaatagtcaggtcgtaggttatttaggtctaaaaccagttttagataaagaagatgcattaagtattaatttcttcagtaatcaaaagcgctatttacttttaatttatgccttaacattactgtcgagtttagttgcagcacttttaatggcaacttattttaaaaagccaattcagcgtctattaaatgcaacaaatgagttaacaaaaggtaattatcaacaccaagttgtgattaaacgaaatgatgagttaggtgatttatctactcaattaaatcatttagctgaaattttacatcagcatgaagaatcgcgacgtcaatgggttgcagatacctctcatgaattgaaaactccattggctgttttgcaagcgcagattgaagcgatgcaagacggtatccgaaaggcaacacctgaacatcttgatgccatgatgcgacaagtttcgagtttaaagaaattgacacaagatttgggagacttggctcaggctgatgctcaacaacttaaatgttatttgagttcggttaatccttgggaagttatactgcaagaagtcgaaaatttcagacctaaactcgaacaagcagggttagaaattgaggtggaaggtgaaggtgcttctttattgttagaccgtgatcgatttaaacaaattattgttaacttgatcggtaatagtattcgctataccgaaacaggtggaaagattcatattcatacaagtcaaacgcctcaggagtggactttatatgttgatgacagtccatttggtttaagtgatgagcaattatcacgtttaggtgaacgtttttatcgtgtcgatgattcgcgtacgcgtagtacaggtggaacaggactaggcttagctttatcttgtaaaattgcgcaggcgcttggtggtacactcagttttgaacactcaccattaggtggtttacgttgtgtactgacctttaaaaagcagagttaa

SEQ ID NO: 1127 - DNA, 768 bp, Acinetobacter baumannii
catttgaatgaaatgaaaaaatatttaatcagtattgaatctacgaatagtgaacgtttaaaaaagttgtactctcaagcaacattttacaaatatcgcgatgaatttaaacaatttggggtaattgggaaaaatttaagtgttagtgagtattttcaacaaggggtagcaggcaagaagaaaccgatgacgcctggtgaactaggctgtgccatgtctcatattgctgcattaaaagattttttaagctctgatgaagaatatgccattatttttgaagatgatgtaatcgaacgttttgaaattgattttcaagatttagaaaaacacattcgttctttgaattttggtccttgctttttcctaagcttgggcggtattcaaatgaaaatatgtaatcgggttcgaggaaaacttttacctgaagaattgtataaccaaaaaattcttaaagtggattacgattatcttgaaaaacttgcttatgcttatgcatatgttgtagatcgaaaaatggcacagatgttggtcgactatcatcaaccgataaaaatttacgaccattggcaagaccttgtagggcgtggtgaatttagtttttatgtcagtttcttattcgatcatcccattattgagaacaatgatgctttaagctatttggagaaagaaagaagtttagtcggttcacattctcaagacgatagtgattttttgcgataccttagagttaaattaaagaaatatatacttaataaatatataatttag

SEQ ID NO: 1128 - DNA, 315 bp, Acinetobacter baumannii
agatacgatgacatgcctttttttgttctaagctgtaccgataacgaaggaactctagagaaacgtttagcagtacgtcctcaacatatcgaacgtttgcaaaaacttgatgatgaaggtcgtctagttgctgctggagcgatgccaaaagaccctaatgacccgcaagctggtttttatggcagcaccatgattgtagagtttgatacacgtgaagctttagatgaatggttgaaagaagaaccatttttgaaagaaggcatctatagtcatgttgatgtcaaaccatttaataaagcatttccaaaagggtaa

SEQ ID NO: 1129 - DNA, 198 bp, Acinetobacter baumannii
agcgtctgccttacaagcagaatgtcggcggttcgatcccgtcagcgcccaccaagcctttacgttaagatctcaagtgcagcggtagttcagttggttagaataccggcctgtcacgccgggggtcgcgggttcgagccccgtccgctgcgccacttaagacttaacatcgtttaccccacaattgcgatattgtga

SEQ ID NO: 1130 - DNA, 636 bp, Acinetobacter baumannii
ccaacgttggaagcattcatggaaatcgtatgcctagatcttgagggagttttagttcctgaaatttggatcaatttcgcaaaaaaaacagggattaaagaactagaagcaacaactcgtgatattccggattatgatgttttaatgactcagcgtctgaatatcctaaaacaacacggtttaggcttaaaagacatccaggaagttattgccgagatggggccactaccaggtgcaaaagagtttgttgaatgggtgagcaatcatttccagctggtcattttgtcggatactttctatgagtttgctcatcctttaatgaagcaattaggctggccaacaattttctgtcataaattagagacagatgaaaatggtatgattaccgcttataaacttcgccaacctgaccaaaaacgtgagtcggttaaagcactacatggtttgaatttccgtgtgattgcagcaggtgattcatataacgatacaacgatgcttggtgaagccgaccatggtttcttgtttgatgcgcctgcaaatgttattgcagagtttccgcagtttcctgcaatcaatggttatgatgcattaaaagaagcaatccgttcagtttcacaacgcaatattccggcttaa

SEQ ID NO: 1131 - DNA, 1197 bp, Acinetobacter baumannii
gaacaatcggagattacaacaatgactgacatcgtaattgttaatggtgctcgtactgctatgggtggttttcaaggatcactatcaggactaactgctcctgaattaggagcggtaacaattaaagaagcaatcgcacgagcaggtttacagcctacagatgtcgaagaagtcattatgggttgcgtactaccagcgggtttaaagcaaggccctgctcgtcaagccatgcgtaaagcaggtttacctgattcaacaggagctgtgacaattaataagctttgtggttcaggtatgaaggcggtaatgcaagcggctgatatgattaaagcaggaagtgctgaaattgtagttgccggtggtatggagtcgatgaccaatgcgccttatgtcttacccaaagcacgtgcaggataccgtatgggccacggtgaaattaaagaccatatgttctttgatggtttagaagatgctgaaactggtcgtttaatgggttcatttgctcaagatatggcaaatacacgtggttatactcgtgagcaaatggatgactttgcaattcgttctttaaaacgtgctcaaactgcgattactgaaggctatttcaaagatgaaattgtacctgttactgtttctacccgtaaaggtgatgtcattgtcgatcaggatgaacaacccttaaatgccaagattgataaaatcccatcccttaaaccagcttttgcaaaagacggtacaattactgctgcaaacgcgagttcaatttctgatggtgcttctgcactagttttaacatcgagtgaagttgcagcacagcgcggcttacaaccacttgcaaaaatcatagccactgcgtcaaattctcaacatccttcagaatttacaattgctcctgttggcgctattgaaaaagtacttaaaaaagcaggttggaatgctcaggacgttgacctttgggaaattaatgaagcttttgctatggtaacgatgtgtccaattgatgatttcaaacttgatccagaaaaagtcaatattcatggtggagcatgtgcacttggtcatcctgtcggatcgacaggttctcgtattattcttacgcttattcatgcgcttaaacgtactggtggtaaaaagggtgtcgctgctctttgcatcggcggtggagaagcaacagctgttgccatcgaaattctttaa

SEQ ID NO: 1132 - DNA, 189 bp, Acinetobacter baumannii
atcagtggttttttttacagttatatctcgtacacaaagtcatatttaatctgtaataaacgctatatactaaatttacggttctataattctaataagagctcagttaagggcttcttagaaaaaagcatgaggcacaacgagttatgcgtccattacaccctattgattttatttttctatcactag

SEQ ID NO: 1133 - DNA, 852 bp, Acinetobacter baumannii
ttaaaacaactcggcaaggagggtcgagtgagcattgatgcaacaagatgggcttggactgctccagtaaataactcatcacagcgtctcgttctgctttcattagcagaccgggctggtgaagatcatacagcgtggccgagtatcgatcgcttggcaaaagatactgttctagacaagaaaacagttcagaaagttcttatagagctaatcaatcttgatctggtgaaagatactggagagcgtacaggaccgacaaaacgagtacgtattctcaagctaaacggcgtaaaagggcgcggagaatcaacccagaatcgggatatttcaagtgctaaaaaggctattaaatctaaacctaatcaatccgaaaacgggaacattcaacactcccaaaaacggaatgattccaaaaatgggaatgatcccgaaaacggtgcattgaataaccccaaaaatgggatgttaaacgatcccaaaaacgggatgcagaatctatcagggaatctaccaatgaatctctctcaagaacataagtggattcctgatgtagatcagttgataacaaagataaagatggcaggtcatggcaacaatatagacctaatctttggcctacctagctttgaattcgagttgagtgcattcaattcttattttgataatagcggactatctgacagtaaaaaactacataagttcacggcttggatcgtagacaagtttgatcgctacaaaaagcagaatccagaatatggcagtcagtctccgatcggacagcaagctattactgctcggccatttatcaatttgccgactaagcctaaaagcttattaggagatgctcaatga

SEQ ID NO: 1134 - DNA, 183 bp, Acinetobacter baumannii
tgcttaaaactgcaaacattattcacaggcttactacaaacgaaaaaaaagcagaacaatcgttctgctttttttataacacaaattaaattttgccgtgacactgtttatatttcaaaccagaaccacatggacatggagcattacgactttcaggtacagggaacgtttgttgttcagtag

SEQ ID NO: 1135 - DNA, 1263 bp, Acinetobacter baumannii
ctcctattttgggatgccttgggaggcagaatgaagaatttctatactttagaagaggtgttatctgcctcagatgagccattatctctcttagatattattgattattgccgaagaagcatgctgcatccgtgtgtatatcttgatggtaatttagtctgtatagaagaaactcgcgaacaccatagtgaggataaaagagattatcctgaacatgtagtggaggctaaatggcacgtaccatttcaaggatatgtttttagtcaggatctgattgagcaattacgatcaaaaaaccaaacttttaatctattaaaaattgatcaaattatatctcaatattctgaaataccacttaatgaaccagaacttaaccaatctcttcacgtatatgagcgtaggtatgatgatgacgttaaggattttttttggattagggatatgaaggatgaggaatacaaaggaattgaatattctaaaaaagagatagtgtttcatattgaagagttaaaaagaataaattttaatgatcctgataaaagaaagtttgacgccttacggcgtgaatacaatcatgaagaatataaacatctactattctcaaaaccatcattctcaattcatgaagcagcttcaattgtttctatgaataatccactattcgtagaagtttatcgagatcaaccgaatttcgttaaatactttcagcattatttacattcttataatttaattagctcatggtctgaagatggcattttaggtgaatcagaaatgatccctgctgaattattaaaagagactcttaagaaaaacaaaattcttatccagagttttaatgcgcatctaataataatggaagaaggtaatctcactgtcgagcacaaaagaattaatgagcaaaatgaagaaatagaaagactgagagaaactattaaaaacttaaatacacaaattgagcaattacagtcggaacaatcattagagccagtaaagtcatataacctactagatttaattctagacagcactgacaatgaaagatacgcgcctgatctagcttatgctattcaattatgggaatcagtttatgttactaaccccaaatcaggcaagcatagtaataaagcaaatatttggatcaaaaataatacaccctattccggcgatcgagatgatacgtatacgcgcagactacgagatataacatcaccgttaattggatggcatgatgatagaaaaaaattattaatcaacaattaa

SEQ ID NO: 1136 - DNA, 225 bp, Acinetobacter baumannii
aatatggaacttgtacgaccagaccaccctattgctcatgaagcctatgaaacagttaaagccatgacttgcgaatatattaagattgtggcacggacgtattcaaagacacaaactgaagctggctattttattagtggaattttcccatgtacgcccgatgatggattcaatcgtaaagaatggatttcaacatttgaagaattacaaggagtaaataaatga

SEQ ID NO: 1137 - DNA, 279 bp, Acinetobacter baumannii
gaaggaggctgtctaatgggattagctagattttctgcaaagctcaactacacctccgaatatggttgtgcatatcaagaaacgtataaacagagccaagacaatccggatgccaagaaagtttttttggatttggttgaacacttagcttggatgggtgcggttggtggtcaagcatccgaagttgttgaggcttttaataaaggtcataaacaaggcttagaacgtcgtaaagaattagataaacaagaggcggtttcaaatgaagatgttaaataa

SEQ ID NO: 1138 - DNA, 597 bp, Acinetobacter baumannii
cgtgtggtatgtaatatttcagagaatactatgtcagatattttaccattaagctggtttcaacgagaaacttcggaagtagcatatgatttaatcggctgcgtattatgtaagcgacagcctgatggacaagttatccgctgtacaattagtgaaacagaagcttatttgggcgttcgcgataaagcctgccatagctacaatgacaaacgtaccgcacgaacagaggtgatgtatcgccatggtggtagcatttatgtctatttaatttatggcatgtatgaaatgctcaacattattactcaaacagaaggtgtacctgaaggagtgatgattcgatcagcatttttaaatagtgcttcaactaaaaaagaatataagcttttggctggacccggcaaactgacgcgttatttaggcattgatcggactttaaaaggccagactttgggtgaagaatctggactatggattgaggcggccactatacagccagaagtggttttaacgccacgtattggaattgattatgccgaggaggcaaaagactggcctgaacggtattgctggaaagatcatccatcattaagtcgataa

SEQ ID NO: 1139 - DNA, 465 bp, Acinetobacter baumannii
aaacaacaatggacaataacaatgcaactcaatcactatctcaattttcaaagccaggcagagcaagcttttaatttttataaatcagtattcggcggtgaatttgccatgctgagccgctatagcgatatgccgcctcatgacggtgtcacgttatcggaagctcaaaaaaatttagtgcttcatgtttccctgccgattaacgaatacactgtactcatggcatcagatgtcattgatcaattctgtacaccaaatagtgtatttactcagggcaataatcattacattgcaattaaccttgaaaaagatgagcaagaaaaggcaaagcaactttttgatgccttatctgtaaatggcaaaattgaaatgccactagaaaaaacgttctggggcgctttatatggtgcttttactgatcaatttggtgtcaaatggatggttaactgccagttagatacttaa

SEQ ID NO: 1140 - DNA, 702 bp, Acinetobacter baumannii
aaggaaaaatggcccatgaaacatattatgttggttgaagatgaagtcgagttggcgcatctagtgcgtgattatcttgaggctgctgggttcgaagtaagcatgtttcatgatggtcaggatgcttacacgagctttcaacaacgtaaacctaatttaatgattctggacttaatggttccaagaatggatggtttaacgatttgccgtaaggtacgtgaacagtcagatttaccaattattatggtgacagcacgtaccgaagaaattgatcgtgtcttgggtctaaacatgggggcagatgattatgtgtgcaaaccttttagtccaaaagaactggttgctcgtgtgcaggccgttttacgccgtttagaacgtaaggctgagccagagcaaaatgattctttccgtattgataaagcacagcaaagaatttggtatcaacaaaaatctttaagtttaacgccaacagaatttcgcctacttgagttatttttagaacatgtggggcaagtttattcacgtgcacaattattagatcatattaatccggatagctttgatgtggccgaccgagttattgatagccatattaaaaacttgcgtcgaaaaatcacggaggtggccgaaactggtaaccgtcatgagtggattcaagccgtttatggagtaggttaccgcttcgaatatccagaagaataa

SEQ ID NO: 1141 - DNA, 432 bp, Acinetobacter baumannii
gaaggtgagtggatgtataaagttatagcgggtagttggacgcagtttgaggaagctgcaaaatacatccgtgaacaagtctttattcaagagcaaggcattgcgcccaaagatgaatgggatgatttcgacagcactgctgtgcactttatggtgtatgacaaagagcagcctatcgctacagcacgtttgttgccacagcatagcgtagggcgtgttgctgttttaatgctttatcgaaagcagggtataggtaaaattctaatgcagcatattattgaatatgcgcgccaacatcaattgccttatttaaagctttccgcgcaaacctatgtgacagctttttatgaagctctaggttttaaagtgcagggtgaagtgtaccaagactgtggtattccacatattgatatgactttagcgttaagttga

SEQ ID NO: 1142 - DNA, 642 bp, Acinetobacter baumannii
ctccagtttcggggtaatgttctgaccgacattatccccttttttatgttcaggatatacatcatgggacaccgtttaagcaaaatctatacacgcacaggcgattcaggtaccacaggtttaggcgatggctctcgtgttgctaaagatgatctaagaattgcggcactgggtgatgtcgatgaactaaacgccattattggtgtgctccgtgcacaaattacagctagccaagtggctaataaagctgattgggacaaaagcttgagtctgattcaacattggctttttgatttaggtggagaggtttgtattccaaattacaatttgcttcagccggtttgtattgaatttcttgaaaaagaaattgaccgtatgaatgaagatttgcctatgctgaaagaatttattctaccttctggttctttatcttgcagttatgcccatcaagcccgtgccgtttgtcgtcgtgcagaacgatctctcatgtcagtgcaaactcgtgatcaaaatattcaagccactgcccttcaacttttaaatcgtctatctgactggttatttgtcgcatcgcgtgctttacagcgtgctgaaggcggacaagaagtcctttggcaaaaaaatattaatgagatgatttaa

SEQ ID NO: 1143 - DNA, 876 bp, Acinetobacter baumannii
aagaaaattcgaataatagtggttaaaaaaacgatgacgactgcattaaatggacttaaagttctcgatttctcgacgctcttacctggacctttcgccacaatgtatttagccgatatgggggcagaagtcatccatattgaatctccatcacgtccagacctcattcggattatgccgccctatgcaaatgggcaggcgactgcacatagttatctaaaccgaaataagcagtcgattgttctcgacttaaaagatgctgcaagtattgatctgattaaagacaagatttctgagtttgatgttgtgattgagcagtttcggccagatgtcatgcgccgtttagggctggactatgccacccttgcagaaattaacccgcgtttaatttattgttcaattacaggttatggccaaactggaagttataaagaccgggctgggcacgacattaattatttagctttagctggtattgctgggtatagcggccgacaagatagcggtccgccaccgcttggtattcaggttgccgatattgctggtggttcattacatgcagtcattgcgatcttggctgctgtagttgaacgcagccgtagcggtataggtcaatatattgatatttccatgacggactgtgttgcgagtctaaatagcatggcagcttctgccacacttgctgcacaagttgaacaggctcccgagcaggggatgctcaatggggggattttctatgactattatatgacgcaagatggccgttatctttctatcggtagccttgaaccacaaattgcatgcccaattaagttttcacgttcgcaaatgagatattcctttgtaggtcaaaaacttggcgaagggcagtggtga

SEQ ID NO: 1144 - DNA, 897 bp, Acinetobacter baumannii
aatttaatgctaaatcgcctaatccaaaaaaaatggtacaagtaccaacaagcaaaaaaagcaaaaacttttgactctcattggtatatgcgttttggctggttagaacaaccttttacaacacttgagcaattagattctctctttgaaatccattctcctggaaagtttacctttgccgatagcttttatgctcatgaaaatggacgacattttattttctttgaagaggtggatgatcaacatccggtaggctttctttcagttttagaagtctttaaggatggcacttacaccccgcccgaaactattttaaaactcgattaccacctctcatatccttgcgtctttaaaatagatagcacttggtacatgattccagaatcttctgccaacaaaactattgagctttggaaatgtactgattttccaatgaaatgggaaaaacattctaatctgatcaagaatatcgaagcagttgatagcacccctttttatcatgagggcttatggtatctttttacctcaacgcgtcgtgattgtaaaaagtttggtgaccgtttagatttgttctttaccgaagatattttaaatcctaactggcaagaacatccaatgaatccggtatgccgaggcagtcagcagttccgtatggcaggcaaaccttttatttataaagggcaactggttcgaccaagccaagattctttaaaacgttatggcggcaatatcgaattaaaaacgattactcagcttagtccagcagcttatgaagaaaaattactagaagtagttttaccaaattggaatcaggcagatgacggttgccataccattaatgtcgaagataatttcgtggtacttgatgccatccgccttacaccaaaaaataattaa

SEQ ID NO: 1145 - DNA, 318 bp, Acinetobacter baumannii
gtcgactaccgcgcgtcgacaaatcatcatttttcatactttttcccagaaaagcacttgattatcaccataaatagtactaaattagagttactgtatagccaagtaactataaatggtgattttcgcatgaacaagtcaattgatcaaactaagcaacacacagaaaccactatggtccgttggacaaaagatcaacttgagaccattcgtaatgaggcctttcaacaaagaaaagctccagctgtgttcatccgtgaatttttattggaaaaccatcctgcatttaaaccaaaaaaaacggatgagcgattgtaa

SEQ ID NO: 1146 - DNA, 1362 bp, Acinetobacter baumannii
gagcgtctacgcttccgttctaaagtaaccaacttgattcgtaactatttagacgatcatggtttctcacacgttgaaactccgattttaacccgtgcaacccctgaaggtgcgcgtgactatttagtaccaagccgtgtacaaaatggtagcttctatgcacttccacaatcaccacaattgttcaaacaattgttgatggttggtggtattgatcgctactaccaaatcgcgaaatgtttccgtgatgaagacttacgtgctgaccgtcaacctgaattcactcaaatcgacattgaaacatcgttcttaaacgacgatgacatcatggatttgatggaaggcatgactgttaaattatttaacgacttgcttggcgtaaaatttgaaaaattccgccgtatgccatacagcgaagcaatgcgtgattatgcatctgacaaaccagacttgcgtattccgttaaaactcgttgatgttgcagacttaatgcaagaagttgagttcaaagtatttgcaggtccagctaaagaccctaaaggccgtattgcagcacttcgtgtaccgggcgcaggttcattaacacgtagtcagattgacgaatacactaaatttgttggtatctatggtgcaaaaggcttagcgtacattaaagtcaatgaaatcgaaaaaggaattgaaggtcttcaatctcctatcgttaaattcatcgaaccaatcgtaatgcaattgcttgaacgtgttggcgctgaaaatggcgatatcgtattctttggtgcggacaaagctaaaattgtaaatgatgcaatgggtgcacttcgtgtcaagatcggtcatgacttgaaccttgcgacttgtgagtgggctccactttgggttgttgacttcccaatgtttgaagaaactgacgatggcaaatggacttctgttcaccatccattcacattacctaaatctagtgtagaagacgtgaagagcaatccaggcgaagcactttctgttgcttacgacatggtattgaacggtactgaagttggtggtggttcacttcgtatttacacattagaaatgcaaaaagcgatttttgaagcgcttggtatttccgatgaagaagcagaacaaaaattcagcttcttactcaatgcgcttcgttacggtgcacctcctcacggtggtttggcatttggtcttgaccgtttagtaatgcttatgactggcgcgacttcaattcgtgatgttattgcgttccctaaaacgaaaactgctgaatgtccacttactcaagcaccggctcctgttgaagcaaaccagcttcgtgacttgggcatccgcttacgtgaacaacaaaagaaagaagcttaa

SEQ ID NO: 1147 - DNA, 1368 bp, Acinetobacter baumannii
ggggatgaacgcatgatcgatttattttctatcccggttgagcaatcagtgcttgttacattgctaacggtcgaacaaggcgctggtgagtatatcgattcacttgaggtttctgacttctattcagaccgtcaccaaatcattttcaaacacatcaaggagcagcacgaaaaaggcgaaggacataacgagattttaatctgggaattaattcgctctcatacgcttgaagttaagaccgtaccagagcaatacatgattgagctaatgtctggcgcagtcgtttacacaatgcttggcagcttggttaaaaaacttaaagatttctctactcgccgtaagatccaagagttatcaaaaaatatcggtgtggttgcggttgatacggttagctatagcgctgaggcagctttagaccgagttcagacgttggtatctagccttgatggtaattcgcatgaaaacaaaaccatgtctgcaggcgatctatcaaaacaggtcttggcaaacattcttgataagcatgaaaagatccacgctggtgttgaggttaagcgcggcattaaaactggtttctttgagttagataacaagcttgattgtatcgatcaaactgacttggtgattattggtgctcgtccttcgatgggtaaaacaacactggcgcaaaacatcttgagcgatgtttcagtgaatcaaggtgaaccagctctgtttatgtctggcgagatgaacaaagagcagatcatggaacgcctcatttctggcataggtcaaattgaacttaagaaaattcgctctggccgctttcagtctgaggatgcaggtttaattcaccgtgcaatgacgattattggcaacacaaaaatcgaaattaacgaccaaagcgcaccaagcctaagcgacatacgccgagaagcgcgcaaaatggtccgtaagtacgggaaagtgggtttgataatggttgactaccttcaaatcatgacaccgcctcagcgcacgggaaaccccactcaggagatgggtgatatttctcgtggactcaagaaacttgcaaaagattttaattgcccagttgtcgctttgtcgcaattaaaccgttcactcgaaaacagaccaaacaaacgcccaatcatgtcggatcttcgtgactcaggacagattgagcaagatgcggatgtgattttgtttatttatcgagatgaggtttacaacaaagaaagtaaagacgctggtattgcggaaatcatcgtaggtaaggctcgtaatggaacggttgggaccgtgcgattagctaccgacttggctagatcaacttttcttgatttggatccgcagtattaccacgcaatggaggaggcagtatga

SEQ ID NO: 1148 - DNA, 720 bp, Acinetobacter baumannii
aaatctatgcgcattattggtcatcgtggtgcacgccgagaagctcctgaaaatacattaggtggttttcagcacattaaaaatttaggtattcgtggtgtcgaatttgatattcgtcagctgcaagatcaagagttggtcgttattcatgatgataattttttgcgcacggcaggtgtcgaccaaattgtagagcactcaacattggctcaagcattatcatttgatcatcgtcaaaattggcctaactggccaacctctgaaccaacccctactcttacagatgttttaaatttacttgataactttgatcatattgaagttgaagttaaagctgtaagagatatggcattagcagaaaagttagttcaaaagcttgagactgagttacaaggtttcgagaaagtcgtgaccatcacaagttttgatcttcaaattctaaccgctttacgtgatattaactctcaatttaaacgcggattgttagttgaacttccggttggagcaacggcgattgaacttgctcatcaatatgggtgctgtcatattggctggcatgatcaacttgcaacagatgaaatgattcaattgtctcatcaagctggtttgaacattagtgtctggacagtgaacgatgtagaaagagcaaagagactacaggatttagatattcagggcttaattacagatattccaaccacaatgcttgaagctctttaa

SEQ ID NO: 1149 - DNA, 1125 bp, Acinetobacter baumannii
tgctgtatgcgcacaacgcatcttaccccttctactttttttaaattaagcttgatcagtctgagtttaatcttagctgcatgtaaccagcaagaagtaccaaaaacaacagcatctgaacctaaaaaaattgaactcattcctcaagatttaattcctgtaaaagaaggctcactcgccgctcaaaccgcttttacaggaactattcgtgcagtacaacaaagttctattcaagcccaagttagtgcaacagcgactgccgttacagccgatgtaggtcaaaaggtacaaaaaggccaagttttagttagattaaataatcaagacaacgctgcacgcttagctcaggcacaggctaatcttgcttctgctcaggcacaagcagaacttgcacgtaatttgatgaatcgaaaacaaagattgctcaatcaaggctttattgcccgtgtagagtttgaacaaagccaggtggattataaaggtcaacttgaaagtgttagagctcaacaagccaatgtggatattgctaaaaaagctgatcgagatggtattattaccagccccatttcaggtgtgattacgaaacgacaagttgaaccgggacaaaccgtttcggttggacaaacattatttgaaatcgttaatccggatcaattagaaatacaagcgaaactacctattgagcaacaatctgccttaaaagtaggtagctctatccagtatcagattcagggtaactcaaaacaattacatgccatactgactcgtatctcacctgtagcagaccaagacagccgacaaattgaattctttgcgagccctaaagaagcgattgattcattaagtattggtgcgtttattaacggtattattttgcataatgatagcaatcagggacaaaccattcctttagatagtattcaaaatctgcaacatgatccttttgtatgggtaatacgcaatcaaacaattcagaaagtcaaaattcgagtggttgagcaacgatacaacgaaaatatcgctttagttcagggtttacaaagtacagatcaggtaagtcgtatccagtttgaagattctgatatcaataaaaaagtgacgcttacaaccgaaaaaaataaataa

SEQ ID NO: 1150 - DNA, 387 bp, Acinetobacter baumannii
agttcaaagcgttcagctttgggattgagaagatttatgccagaaccaacaacctctacagcaaccattgctactctaagtgcagtgtcattgcttccatttataaatggtaatgcgttgctaggtgcagtacttggggcagcatttattgcaacttttgaaaaagatttaaatgcttaccaacgtattcgcaatatgttattggccactggtattggttatatcagtgcaccactcattacagaacatacattattaaaagctgatgcagttgcagcccttatcacttcaacactttgtttattcatattaatcaaggtagttgattgggttaaaactgcaaagctatcagatattttgaacatctttcgaggtggcaagtcatga

SEQ ID NO: 1151 - DNA, 576 bp, Acinetobacter baumannii
ataatcaggcgttttttattttgtatttactatttccattggcacaaaatttgtttaatttctaaacattctcatattaaaaaagattttactatgcctgatcccaaaaagtttgaaagaacccttgatcggtttggacattatgctgttgaagcttttcattatttagccttatttatcataggctgtatgattgcttggtctgctgctcataccgtttttgaaattctaaccgtcaaaaaatatgcatcaatcgatgacatcttattgttatttatttacctagaacttggggcaatggttggaatttactttaaaaccaatcacatgcctgtacgttttcttatttatgtcgccattacagccctaacacgtttactgatttctgatatccaacatgaccataaagccgatcttgatcaagtcattattactggctcaattcttattttagctctctctattttagttgtccgttttgcttcttggcactacccatctgttatgaaagaaaaacattcaaaaacacctacttctttaaaaacaccccaaccgcaagatgacgagttggcataa

SEQ ID NO: 1152 - DNA, 876 bp, Acinetobacter baumannii
tcagatatttttcaaatgacagatttttctcgcaatgcactggttgtagaaggtggaggcatgcgtggtgcctttaccagtggtgtacttgatgcttttctacaacaacggttcaacccttttgatttatatgtaggcgtatcttctggttcgaccaatgtagctaactacctggcaggccaacaaggtcgcacgttaaccttctatattgatcattcactacgtcctgaatttatcgattacaaacgcttctttaaaggtggtgatttactcgatttaaaatggatgtgggaaattggcgagcaagaacatcctctcgatcaacagagcctttttgccaaaaatccagatttttatatggtattgacgcatgctaaaactggtcatgctgagtatcttcgtgctggtaaagataatttgctaaatgcactgcgtgcttctagctcaattccggttttaactcgtcatcccgtcgatattatgggtgaaccctactttgatggcggcgttgcagatgctctacccgttcgctgggcggctcagcaaagtggtgtcaaaaagctattagttttacgtactcgtccgaagaactattttaaagccagtagccgaggcgaccaattccttgcgaaatatgcttttaaacaccattatggttttgcaaatagtttgcgtaaccgctgtgcccgttataatgcttcagttgaatttgttcgtagcagtaacccagaacagcaaattttagaggtatgtccaccgcctcttaaaaatatggcagggcgtttaacgacaaatccgaaaaagcttcgttacagttatgaagttggtttggaaacaggcttacaagccatcgaaaactggaatgcgatgaagtag

SEQ ID NO: 1153 - DNA, 1422 bp, Acinetobacter baumannii
gggcttcttagaaaaaagcatgaggcacaacgagttatgcgtccattacaccctattgattttatttttctatcactagaaaaaagacaacaaccgatgcatgttggcggattgtttttatttgaaatacctgaaaatgcccctgaaactttcgttcatgatttagtagaagaaattcgccaatctaaaagtattcctgttccacccttcaataaccgtttaaatggtctattttgggatgaagatgaagagttcgatatcgaccaccattttcgccatattgccttgcctcatcctggccgaattcgtgaattactggtttatatttcccagcagcacagctctttaattgatcgtgcaaaaccactttggacgtgtgacattattgaagggatcgaaggcaatcgtttcgcgatgtactttaagattcatcatgccatggttgatggtgttgcaggcatgcgcttaattgagaaatcgctgtcaaaaacaccacaagaaaaacatgtggttccactttggtgtgtagaaagtaaaagaacaaaacgcttaaaagtaccaaaaccaagcacaagtaagatcaaaagtattttaggtggtatcaaatcacagcttgaggtgacccctaaagtcatgcaggaattatcgcaaaccatttttaaagaaatgggtaaaaatcctgattacgtctctacctttcaagctccggtttcaattttaaatcaacgtgtaagtgcttcacgtcgctttgcagcccaatcttttgaattaagtcgccttagaaagatttctaaagcactcggtgtaacgatcaatgacgtcgtacttgctgtatgttctggggcattacgtgaatatctgattagtcacaacagcctgcctaaaaagcctcttattgccatggttcctgcttccctacgcacagatgactctgacgtgagcaatcgtattaccatgattttggcaaatttaggaacccataaagaccagcctctagagcggctcgagatcattcgtcgtagtatgcaaaattcaaagcaacgctttagccgcatgaccgcgaatgagattttaaactatagcgctgttgtttatggtccagctggacttaacatcatgtcggggatgcttcctaagcgtcaggcattcaatttagtgatttccaatgtacctggcccacgtgagccgctttattggaatggtgcgaaattagatgcactctaccctgcttctattgtcatggacgggcaagcgctcaatattacaatgacaagctatctggataagcttgaagtaggtttaacagcatgtcgaaatgctttacctaaaatgcaaaaccttttaacgcatcttgaagatgagattcaacggtttgaagaaattattgaagagaaacagctgaaacatcattcagcgagttag

SEQ ID NO: 1154 - DNA, 1389 bp, Acinetobacter baumannii
aagcttattaggagatgctcaatgaatacatcaatccacaacttacaaattgagcaagctgttctggcagcattgatgactgtagcaaattcatataatcaggttgaaagcttgctaactgaagaagattttcatgctacacgccacaaaatgatttttagcgccatagttgatctggattcaaaaaattcgccttatgatgccgtattggtaaaccaatggctagaaatgcatggatactcagaagctgctggtggtgagcaatacatcatgcagcttctaggtgatgcaccttcaagcttttataacctgatgtcgtatgctgagaaactaaaagatcttacgacttgccgcaaagttgaagcacaagcccataaggtcattcaaagtgcccgtagtttgaccgtaagtcgtggtgatttagttttgaatgcacagacagcctttgcggaaataagtacagaacaaggtagtgaaaaccttttccatattcatgatgccgcaaacaatacgtttgttgagatgcaccgaaaaatggaagctgcgattgctggcaaaacactaattaatggtattcagactgggatatatgaccttgataaaaagcttggtgatgttgagcccggttgcctaatggtagtggctgcacgtccagcaatgggtaaaacaacgatgcttcaactcattgcaaatcatgtagcagtcattcagaaaaagcctacccttatcatgtctggtgagatgccaaaagaacaaattgctatgcgtctctgttgtgccattgcaccagcagatattgggatagtacgcaactcccctcaccttttgcctaaagacgaatttacggcgtataccaatgctgttgtaatgcttcaaaatgtaccgatgtatatcaatgatacgtctcgcccctcgatagcgaatattagggaatctatccgtaaagtaaaacatcagtacggcgccgttggtgtggtgctggtggattaccttcagatcatgaagactacaaaacagtttgcccgagaagatttaaagattgcatacttcactggtgaacttaaagccatggccaaagagtttgattgcgtcatagtcctattatctcagctcaaccgtgaactagagaagcgtccaaacaaacgcccaatgctgtcggatctacgtgaatccggtgcaattgaacaggatgcagaccagatcgttttcttataccgagatgagatctataacaaggaatctcaatatcgaggtattgctgaggccatagtagggaaaaaccgccacggtgaaccgggtactgcgtacatgtatgctcaattgaaatattgccaatttacaaacttagaccatgaatcgcttaatcaaattcaaggagcaacaatatga

SEQ ID NO: 1155 - DNA, 786 bp, Acinetobacter baumannii
tgtgagaagctttcttttctaatgccttttacaatctcccatgcagttatcgcccctccactagctaaattgagccgaaatacgttacccattgccgccttagcaattggcagtatgacgcccgatctttaccgcttatttacaatgcaatcaggtatgctgactcatcaatggaaggggcttttctaccctaaccttgcattagggttattattctgtgtcatttggtatttactttaccgacctgtggtttaccgtttttttggtatccaacacgatttaaaactagattcttttagacatttttttagcttttttattggaatcataattgctctactcattggtatagcaacacatctcatttgggatgggcttacccactcagactttagaacttttatatttcaagactttttatcgcaaactgttcacttgtttggccgcccttatccattgcatcgccttcttcaactcggttcttctgctctggcattaccttttttaggctggatgagtattcattactatcagcgccataaacagcattggaaagtaaattataaaattaaaatttttgcttggtgtttatttactttatctacacttttaggcttattttcattttgggactatgctcgttatattccccatgaggtttggcattctgatacctattattttactggccgctctattaatgagtttatgcaaggttggttaagtacgtttagtttgggatgtctattattcttatttttagatcgacaacaaagaatgggttaa

SEQ ID NO: 1156 - DNA, 468 bp, Acinetobacter baumannii
  unsure (405): Identity of nucleotide sequences at the above locations are unknown.
acgcaagttagcaatgcatgttttaacgtacagaaatggggaatcaatatgaaagctgcaaaattaattagggataaaggctttaaatacgcaaaggaaattgttgattcagcaccagaaaacgcaaccgagtggaatgagggttatgagttccaatgtggtcaaagtgtagaagtcagcccagcagatcttgagaagtattttgtagatttggttgagcttaaacgtttggtggagtctttgggctatataagcagatggggcggcattgaacgatgcaaaaagctttacttcgaatcttcatttaaaagagaccagcacataaaagatttgaaacgatacattcgcgactacgaatcagtttatcaactcaaatgctcacatggttatgacgttgcatgcctnatctgtggttttggaacagttaatggcgagcgtgtttatcacaataaaggaaaatcaaaatga

SEQ ID NO: 1157 - DNA, 2769 bp, Acinetobacter baumannii
ggaaaagagcttttttatatgaatgcggagcagttacaaaaaacattgcgtgccagccaatatgctgaacaagttttaggattacatcaggctgttttagaacaagattatcaaatagatcaatttgctgcaccgctctcaacagaacaaatttaccaacttgtagacatcacgcttgatggaattggcgatgaaataacttggatgcgtgcgcttcgtatactgcgcagtcgtttaatgtttcgctggatctggcaagatgccaatcaactgacggatgtcgttacacttactcgtgaactttcagactttgccgatgcaagtatttgtgccgcaaaggcttttgctcgtgttgcattggttgctaaacacggcgaaccattaagttattcaggcaaagttcaagatttgattgtggttgccatgggtaagcttggggcacaggaattaaatctatcaagtgatatcgacctgatttttgcctttgatgagcaaggcgaaaccaacggtcgtaaatgtattgatgtacagcagttttgtattttgtggggacaaaaacttatttatttacttgaacatatcaccgcagatggttttgtgtttcgagtagacatgcgcttacggccttggggagatggctctgcattagcgattagtcatgcagctttagaaaaatatttaagtcagcatggccgtgaatgggaacgttacgcatggattaaggcacgcgttgtcactgggggtaaagaagggcaagacttattagaaatgacacgtccttttgtattccgccgttatgtcgattacaccgcttttgctgccatgcgcgatatgaaagcgatgattgagcgcgaagtattacgccggcatattgaagatgacattaaactcggggcaggcggtatacgcgaaattgagtttattgttcaggtgttccagcttatttacggcggttctaaacgtgagctgcaagaccgtcaatgtttggtcagtcttgaacatattggtgaggcaggcttgttagaaaaacaggccgtactagagcttgaagatgcttacctgtttttgcgccgtgttgaacatgcgattcaagccttgaatgatcagcaaacgcaactattaccagaagaaacagatttacgacaacgcattatagatactttgggttttacgagttggaatgaatttattgatgttcttaacgagaaacgccaaaaagtaaaagttcagtttaagcagctcattgaagacacaagttccaatgcagctaccgagaactttggacagttagagcagcagctagatgaagtgttagatgataatgcaaaaaatctgattcatgagttctggcatggtcatgcacttaaaaaacttccttccaatgccgtgcagcgtttaaaaacgttttggccccatttaattgaagccattttacagtctgaacaaccacaaactgcattattacgtttaatgccactgattgaatcagtcatgcgtcgaaccgtctatttggtaatgctgattgaaagtaaaggggcattacaacgcttagtaaaaatggcgacagtgagcccgtggatttgtgaagagttaacgcaatatccggtattgctggatgagttcttgtcgatggactttgaattaccaaaacgtaaggacttggaagactcattacgtcagcaattacttcgtatcgaaattgatcaggtcgaagatcaaatgcgggtacttcgcttgtttaaaaagagtaatgtgttaacggtcgctgcaagtgatgtgttagctgaaagtcctcttatgaaggtatctgatgctttgacagatattgcagaagtcagtgttaatgcaactcttaatttagcttatcagaccgtagcaaagcgtcatggttacccaaaagatgtcgagggaaaacgttgttcactcgattataaagcctttgctgtcattggttatggcaaggtgggtggcattgaactgggctatggttcggacttagatctggtctttattcactatctagatgaacaagccgacacggatggtactaagtcaataactggttttgagtttgctatgcgtgtcgctcaaaagtttatgtctttaatgaccactcaaacgcttgatggccgcgtttatgaaattgatacgcgtttaagaccttcaggtgaggctggtttattggtgacaagcctgaaagcctatgagcattatcagttgaaaagtgcatggctttgggagcatcaggcattagttcgtgcgcgttctattgcaggtgatgaagcgctttgccaaaaatttgaaatatttcgccgcgagatattgactcaatctagagatgaggcttatgttcgtgaggaagtgctgaaaatgcgtcagaaaatgaaagaccacttaggttcatcttctgaacaaaaaaaacatggtatttttcatttaaaacaggacgcaggtggtatcgtagatatcgaatttatggcacagtatgctgtacttgcatggagcgggacgaaacccgatctcgcccattattctgataatgtaagaatattagaagatgctgctaaagcagactgcttatccagtgaagatgccacagcattaattcgagcctatcttagtgaacgtgccgaaagccaccgcttagcccttgcgaatcaatccatgcaagtaagcgcagcggactggcgtagtacccgtgcggtcgtttgcaatttatggcaaagattaatagacccaaccgcctcggttgagttggatagtgaatga

SEQ ID NO: 1158 - DNA, 1485 bp, Acinetobacter baumannii
ctatggtatagtgaattttgcctcaaatatttagtccagcctatgcaatttaatccgctttattcatcgctcaatcctaagctttttcatatccagcaaccctctccgcttcgcggtgcaaaggctggacactttaatttagctttagccgaagagttacaatggacagatgaagaaaaacaggcttgggtagaaatttgcagtggtcagcgtaccttctcggaattctcgcctttggctatggtgtatgcaggccatcagtttgggcaatgggccggtcaactaggcgacggacgtggcttactcattgcgcagattcttaataaaaaaggccaaaccatagatttacatttaaaaggtgcaggccccacgccctattcacgtatgggagatgggcgagcagttttacgctctgttattcgtgaatatttagcaggacatgctttaaatgctttaggggtggcttctagtcacgcagtaggttttacaagctccactcaaggtgtacagcgtgaaaagctagaacctggcgcaatgttacttagaacatctgaatgtcatatccgtttaggccattttgaatggatcaatcaatatgcacctgagctattggccgagttcactcaaaaatgtattgaatggcactatccagaatgccaacaagaagagcaacctattttagcttttgctaaagctgtgattagaaatacagccattatgatcgccaaatggcagctggtcggttttgctcatggtgtgatgaataccgataacttaaatattacgggttctacactcgattttggtccatacggttttatggaacgtttccgaccaaattggattaacaaccattccgattaccaagggcgttacacctatcaaaaccaaccgagtattgcgcactggaacttatggacttggttaaataatctcattccacttgccgaacctgagcataaagagcagttcaaagcagcgttggccgcttgtctagaagaatttgagccgacttttattgagcattacaccactgggttgtgtcaaaaaatggggcttcctcattttcataaagacagtactgaatgcggcttaagctttttgcgtattctacaagcggagcagctcgattacacccaaagcttcattcgccttcaaaataaagaatacaaagctttacgtgatgactgccttgatattcgacaatttgatgcattccttacgcagtatcaaaacatccgtgaatatcaagatattgatgagcttgatgcaaacatgcagcaggtaaatccaatttatatcttacgtaaccatatggcacagcgagctattgaggcagcggagcgagatgattttagtgaggttgatcgcttattcaagctactcaaccatccctatacaaagcaaccagatttggaaaaaccggaagatttaggcccattaccaagcgatgtacctgatgtcgcggtgagctgttcttcttaa

SEQ ID NO: 1159 - DNA, 1113 bp, Acinetobacter baumannii
gtgcctcacagtttagtcgagagtttaagcggctgtttggagttccacctaaattatcaacaaactaaagtaaatcaacacgtcttaaatataaaccaaacatggagcatatcaatgaatcttccgacaaccatgaaaattgttgaaattacggttcctggcggacctgaggttttaaaacttcaagattcaaatgttccggtacctcaagctgatgaagttttaattgaggttaaagccgctggaattaaccgccctgacgtcttacagcgtatggggttatatccaatgcctaaaggggttactcaaatccctggacttgaagtcgctggagtagtggttgctgtgggtgagcaagtgcaacagtttaaagtcggggacaaagtttgtgctttaaccaatggtggcgggtatgcagaatactgtgcggtaactgcaactcaagtattgccaatacctgagaatttatcatttactcaagctgctgcgattccagaaacattctttacggtttgggcaaatctttttgatattggccgtttaaagaaagatgaaactgcactgattcatggtggtgcaagtgggatcggaaccactgctttagcgatttgccatgctttaggtattaaaacttttgctacggttggtagtgaagataaagttgaagcactctctgacttaaccacagcaattaattataaaacccaagattttgagcaggaaattttgaaccatactcaagaacaaggtgttgatgttattttggatattgtgggtggctcttattttcagaaaaacttaaatctattaaaacgtgatggccgacttgtcattattggctttatgggaggtcgaattgcaaaagaatttgatttacaaaaactgattttaaaacgtgccacaattacaggctcaacgatgcgagcgcgtaatagccaagaaaaagcacagattgctcaatctttacatgaacatgtgtggccgttattggcacaaggcaagtgtttaccacaaatctataaaacctatgctttttcagatgtacaaagtgctcatgcatgtatggagcagggcgaccatattggaaagatcgttttagagatgaatgcttaa

SEQ ID NO: 1160 - DNA, 540 bp, Acinetobacter baumannii
gaagactgcagcatgaaaaagccccatgctttacgtgaatatttgctaaatgcgattccggatctaccacaggatccggatcgcttactcatctttgctaatgacggtaaattaatgagtactgcagcaaatggatatagctttgaaatggcctatacactagatatgatcattactgattatgctggtgatgtcgatgtgtttggcgttgtacttttcacctggattatggacaaccaatccgaactcatggccaatttaaataaagtagaagaagccattacttttgaagctgaactcattgataacagcaaatatgatctgcattttaaaatacctttaactgaacgtgtcattgtgaaaaagaatgctgaaggtaaatttgagatctcatatcccactgaaccacaatatactgaattcggtccacctacagattttgaattaatagataaggatggatctacacttgcaacctggcgtacagctgatatgcaaggacgttcattggatatgccctttccaggtaaaagcccatga

SEQ ID NO: 1161 - DNA, 375 bp, Acinetobacter baumannii
tacagcataagaggttttattaaattttggagtgacgaaatgtcagagaatgttggtttcgcaggtcaaattggcccagaacatgtgggtcaagttgtagaaaaaggctttaaatctattattaataaccgtcctgacatggaaggtggtccagaacaacctaccagtgctcaaattgaagaagcagcacgccaagctggcctagattatgtttatcagcctgttgtagctggccagattactgaacttgatgttcgtacttttgcaaatcactataatgaacttccaaaaccggtcctcatgttctgccgtactggaaaccgttcaaataatctttatcaattagccaaacaaatggatttgttagacgattaa

SEQ ID NO: 1162 - DNA, 297 bp, Acinetobacter baumannii
atgactgtaagtgtggactcacttattgaaaaaatgcttcttaaattaatgaagcaaattgaagcaaaaccaattattccaattgaatgccagctttgggatgaacaggacattgcaaattactttaaatattctttggattacaccaaacggcatattatcagtaatgacaatttcccacctagtcgcgaactgccaacctctgccactggtgatcgcacagtatcacgttggaaagccacagatgtcataagctttgggatggcatttgataaaaccaatatcaaatatagttaa

SEQ ID NO: 1163 - DNA, 423 bp, Acinetobacter baumannii
tcaaattcaaggagcaacaatatgatgtttgtagataacagttgtatagactcgactgtatttaagaaatcacctgctgaaagatttaaaaatcttagaacccagaaaaaagtaaaggagttcttcatcaagcgccgaggctataaacgcccagatttcaaccgcatgattctagatttaggccgcttaggatggtcacatgagaaaatagcctttgtattaccaatatctggtgcatctactgtaagtgaatgggcacgtggtggggttcctaactatgaaaatggtgaagcatttattgaactttggaagagtgaaactgggattgaaagattcccacgtgaaggcgaatggcagacttataaatacaagcttggtcagcaagactttttagatgagttagacggcgttattgatcattaa

SEQ ID NO: 1164 - DNA, 378 bp, Acinetobacter baumannii
gtaatgacaagtagagctacaagagtgcagatcaaaggcgaggatccaaaatatccgatcgcatttgatgtggagcttattgcaccagtgcgtatttatactgcggttgaattagcagctatgccactctcacaaatgattcgttgtcgtgatgctcaagaggagttttacatcaacaacaaaaagctttcaggcagagcaaaagacataaaagatcgtcttgttgcaggtgagaaattaacacttgtgcttgaaaaaaaacattcaagagtaactcagacgtatttcattggcgaagagattgtgggcaaaagaattgtcaagcaactcgaaacacgccgttttatacgcctcccaaaagtggagggtatagcgtga

SEQ ID NO: 1165 - DNA, 309 bp, Acinetobacter baumannii
ttttgtgaaagttttggaagaaaattaatgaaaaagtttttatgtttaatgatttgttcactaagttttgttggctgttcaaatgaacctgaaccacaaataatgagtgcaaaatttaactcaatggaagagtgcttagcttcaatcaaaagtaaaactggtgaagctttagatccaatgactgataaacctgaacatgtatctggattcttgggtaaaacaggacttcaatttaattgtgaagttaaacatacaggtacggaaggtaattatgttgatggctggtatcaggaaaaaattacaaattaa

SEQ ID NO: 1166 - DNA, 522 bp, Acinetobacter baumannii
tataagagaagaaattcgatgtcccaatttaaacttgaagatgcagatattcttatcgatttagcaaatcaaactttaagcttacctaaacataataagttttacgtggtctctactggcaaaaatggaattggggaacaagaaaatacgggtaaaaccccacgtggatggcatcgggttgttaagaaatttggtatgcaatctcccaaaaatacagtttttattgcacggcagcccactggtgaagtctataacagtgaattagccgcacaatttcctgagcgagattggatattgtcacgcattctttggttagatggcttagaagagggctttaacaaaggcgaaggccacgacacgatgcaacgttatatctatattcatggtacacctgataaagaaccgatgggggttccaatgtcacatgggtgtattcgaatgcgtaatgaagaaatcattgaattgtttgatttagtctctgaagatgcattagtttatttgtctgaacaatctttaacctaa

SEQ ID NO: 1167 - DNA, 750 bp, Acinetobacter baumannii
tttatgttgagtccagctcgacgacatcgcctacaggctttggcagcgaaagaagctgccaaggctgatgaatttggtggtgtacgtccagacgcaagcgtctatcaattacaactgaccgaactcaaaaatgatattcatgtcttgcgttcaattcagtcacaagaaaaacgtgctgaagcaaaaaaagaattaattccaaagcatatgccatatgtgttgggcgtcgttcaatcgggtgcaaaagttgaacaagatgaagtgattacgacaatcatgttgtggtgctttgactgttgcttgtttgaacaaggtttaagtattgccgaatatgctttagaacagaacctaaaaatgcctgattcttttagccgttctactgcaactattgttgctgaagaaattggtaatgcagcgcgtattgcttataagcaaggcgaaatattcaaaataaatattttagaaaaggctcataagatcactacctcatttgatatgcctgatgaagtacgtgccaagttattagtggcattaggtcgatcatacttacaaagtgacttataccatttagctgttcttttccttaaatctgcaattgctaagcatgaaaaatgtggcggtaagcaagatttacaaaaagctgaaaagctattgaaagaacaatcaaaaaattcacctgaaccgatgctgaatgctgatggttcacaggtcgtcgatgatcaaggcaacttgatgtttcatccgacgtaa

SEQ ID NO: 1168 - DNA, 2532 bp, Acinetobacter baumannii
agcagcatgagagctgaatgtagagaacaagttgcaaaggcattaggtaaaagaaaattaagtgcagctgatagtaatcgtatttcatcactgtatatccgggcacaaaatactctggccagaacagatcctgattggatgtttaaaagtcctgctgaacgtgctgaagcgattgcgcagaaaactgctacggatctcgccgtccagatcgctaagaacaatcagaacattgcccgggatgccatcatcaaggctcagctacagaacgaaatctataaccatcctaaattaaacccggtccaagctttaatgcggaagattgcatacttctcggatcagagtggtatccagtctatagagaaacaatctcaagcattgcatagccgctggatgtcattggttgccgatgtgtttaccaagacacaagagcgctttggtatgtcagtgaacaaggcaatgactgacgacattatccgggtcatgtttggtggcaaatctgataatccagaaattacggcgattgccaaggaagtaagtgcagccctggaggaaatgcgtttagccttcaaccgggctggtgggaatattaagaagctcgataactttggctttatgacatcacatgatcagaagaaagtagccctaacagatcaatcagaatgggtgaacgatgcattggctggagtagatcgtaatcagtatgtcaaagagactggtgagttgatggatgagctggagcttaaatccatgcttgaggagatttataaaaccatctcaaccaacggcgctaacaaagacttactgatactgaataaacaggccaaagcaggggcatcgcctgtaggtggtcgctccaagatggcgaatcgtcaccaagagtccagggctttgcatttcaaggatggtgacgcatggctggcgtatcagaagaaatatggaacttatgatgaagcagggtttcatgagattctgaaaaaccatactcaccgcatgagtacagaagtggccatgatgcagaaccttggatccaatcctcgtaatacatttgagtcgttattggatgaagccaagatcaaactgaaagcagatccacagaatggcatgaaacatggtgagattgataagcaggctcatcgggccatgtccatgtataacactctggatgccaatacccgggcgattgattcaaccttaggtaacgttatgggtggattacgtgccttaatggttgcatctaaattaggtggcaccacgctgacgacctttggcgaccatgccagtatgaagaaggtcgctaatatgctgggcctgtcctataccaaatcgatcctccctgaatacatgaagcaattgaaacagggtgccacacgtgatgaagcattgcggtttggccttgggattaacgaaatggccggttcaatgacccgtttcggtgatgctgatattgtcagtagtgctaccaagtcaggccgctttaatgcacgtatgcaggcttttgctgcaacaactatgaaactatcaggactgaacgccgtcaccgcaggagcgaaacgagcgcttaatctggtgcatatgaataagcttgctgaaatgacccgtaaaacggattggaaggatcttggtgcagatgatcttaagatcctgcaggggaacggtattaccgaacgtgactggcagttgtggcagcagctggagccaagtaagcgtgaagatgggacggcggtactttcgcagaatgacttctttaatgcaccagatgatgtgattaagcagttcttgccactggacaagcaggacaatgctaatgcactggctgacttccggtataaagctgctatgaaataccagactcatatctttaatgaggagtcagtcgctattatcgaagcaggtgtacgtgaacgtagcatcattaacttaggtgaagccggaactatccaaggggaattgggccgaaccctattccagttcaaaggcttcccattggcttatatgttccgtattggtcatcgtgcctttgctcagggagatattaagagtcgggtgacgttcctagcttcgctactggcttatcaaactttagcaggtgcattgatcgttcagacccagaacttggccaatggtaagaatccagagcctgtatttacgattgatttctttggtaagtcacttcttaaaggtggaggactttcattcctaggtgacatcatgtctgcgctttcagatccaactggtcgaagtgcctcagactttatcagcggtccattattaggccagagtatgaagctgggtatgttgctcacaggtatggggaacaacataattgagggcaaagagtctactcggatgatggaagtggcaaatacattgaagagtaatattccattgcagaacctttggtacagtaagttggtagttgatcgtatgctgttttctaaaatgcagaatatgattgatcctgattatttaccaagaacacagcaacggcttgagaacttgggtaatagttactggtgggatttatcagaataa

SEQ ID NO: 1169 - DNA, 930 bp, Acinetobacter baumannii
attatttcgagtactcaacgtatgaatattgcctcaattaaaacatcctattttgagccatggttacagttcagtcacccaatggtaagacaattggcctttacaattgccagcccgaacctacttagccaacttccctgcagccttactattcgacatagttttcaattacatacagataaaaattgggaacaacattttcaaaattacttaccccgcctaaagcagcttgatgaagcaccagaacctttacttcaatttatgtctcggcttaagagcacacgcttaggtttacgttttgaaaatttactttggttttggctacaagaagatcaatatcatccttatcagttattaggccatagtattcaaaaaattgatggagcaaaaactttaggtgaactcgattttttagttttaaatcaaaatactcaagaaattgaacattgggaagttgctctaaaatattacctaggtgaaggtcaattaaatttagaacaatggattggtttaaatagacaagatactttaagtaaaaagctttaccactttactgacaaacaatttcaattttcaaaagctttgggttttaaagttcaccaacgtttcgctgtcttaaaaggacaactttatcttcctctaaatttacctcaaaaacagcctattcctgaatgggtaaatttaaaacgtcgcttaggtacttggggtacaaaaatccctaaatctgacttttaccgcttaaaaagacatgaatggctttgtcctcatcaaaaagcgagttcaaacactgcttattggtggactgatggcctatattgtcaaaatattaatgaaacccgattttatatgttcagacaccctgctttactaagcttaaaaccttctctcatcaaaaataacggtgttttacaagagaccacgtccttatag

SEQ ID NO: 1170 - DNA, 372 bp, Acinetobacter baumannii
gatgctaagagggttttcttcatttgccaagtgttgtttacatcaaaggagtgcacaatgatccgtaaacaagaaattacaacatttgagttcccagaaaatgctgttatctgggatgtccgtgattcaagtgcttatgcagaagggcatgttaaaggtgcggtaagccgcccaattaatgatttaaatgctgatattttgaaccaggtcgctgcggatcagccgatttatattttatgtggtggtggtagcaaagctcctcgtgcagctgagaaactagaaggcttagatgcctcgcgtgaatatgtcgtgctgatgggagggacgcgtgcagctcgtgacgcaggtttacctctagagcagggcgcataa

SEQ ID NO: 1171 - DNA, 903 bp, Acinetobacter baumannii
ataaacaagaggcggtttcaaatgaagatgttaaataaaagcgaagctaagcttgcatgggcaaacggcgaaccgcttcttataaacaataacggctggacagactttcaccttcttgagtggagcatttcagtatttgataaatatgaatttgccctaaaacctcgtgaaattaaaattggtgaaatgctggtccctgagcctattagagaagcaccgaagaaaggaactgtttgcttctccccttctattttgactgaaaaggcttaccagcagtttaaatggcgtgactctaagcaagataagttgcttcttgagcgtggcatggtccatttagatgagttcaatgtaattaagcatgcggttgctttggttcggataagcggtggtagttgcgtaatcaacttggatgctcagtctgacgattcagctattgaggtgagtgcggatattccagatccatcagaagttgagctttgtttaggtacgcattttaaagatggtgaagcgccaaaagaacaatctttggaattaacttctgaatcaaattatgaagttgaattgaaaagcctgttggatgaattggaaaacactacttcaccaggaagcgccaatgatttagttagtcgcacacgccactggagcgaagagcaacgcaaaccattattggatgcgattaataagcgcctaacaacttttactcagccacaagccaaagaaccgccatcactaatggttcaaatacaaacggctccagacttagcaaccttagatattcttgaggttgatataggtggcaaaccgcaagaaatccaaacgaaattgatggattttgtcaaaaaacgccgatttgagttgatggaagctgcaaaaacagcaagcgaggtttcacatgccgtttga

SEQ ID NO: 1172 - DNA, 522 bp, Acinetobacter baumannii
aatttaaagagggattcacatatgagtgaaatcaacttaagcccagaggctaaaacggcaatttacaaaatggttcaccagtcacagggaattacgccgcaagaaattgcaaacgtacttggtgactcatacaagagcgtactcaattacgcaaatccaaacatggaaacccatttaccaagtattaaaaagcttgaggcaatgattcagtttacccgcaacccggcattagttaaggcgtgggcacacatgcttggttttgtattggttcctgctaatcaagctgatgaaaaatcgcatgaagtgagcatcgttgaaaccttgctgcatatcaatatcaacaatggtcaagctaatcagcaagttcataacgttttagaagacggtgtggtaacgccagcagaattggcagacacggaagcgattttagaagaaatggagaatcacattcatcaacttcgacaagctcttaaggcagcagcttcaaattacatttccaaatcacaaaaagaaaaagcttga

SEQ ID NO: 1173 - DNA, 843 bp, Acinetobacter baumannii
cgaaactggagaagaagcatggctaattttatctctaatgcatttatgctgcctaatgaccttgttgacaaaggtttcatggcccaaatgagaggggcggctttaccgtgctatttgtacattgttcgcaaaacacgcggctggaataaaactgatgatgatataagcatttctcagcttgtggagggtacaggatacaaaaaagatgcggttttagctggtattgatattttgctcggattaggaattattgagaaaattacctatgtaaatcgtccgtcaaattacactttaactgacaatattattgctgtcggaaaaaccgacaccgagcaatctgctgtcggaaaaacagatagcgaaaccgaatctgctgtcggaaattccgacaccaaaagtggttctgctgtcggaaaaaccgacaagttgctgtcggaaaaaccgacacacaataacaatataaaaacaaatacaaaaacaaaggggaatttttcagaagaatttgaaattttctggaatgcatatccgacttgcaaacgtaaatcagataaatctggaacctttaaaacttttgaaaaatacactcgagtaatttcacttgaaaaactcatcgcaattttgaacgcattcaagttggattcccagtggatcaaaaacgatggtgaatatatcccagcaccttcggcatggttgaacaaaaaacattgggaaaatgatttctggttgaaagctgctggtttagttgagcaacaaccacaatcagcagaaacacctgaatacgcaaatccacaacgccgtcacatcccaacaatgccaaaacgctttaaggggatgaacgcatga

SEQ ID NO: 1174 - DNA, 1218 bp, Acinetobacter baumannii
cttatcatttttatggggataatgatgaaacttactcaaggggtatgtggacttactttagctgtttttttatcagcttgtggtgggggtggtgatggctactataatcaaaactcagactcgggttcaacgacaacaccaactacaccttcaaccgatcaagaacttgctaattctgttttaaatagtgtaaagcaagaaggaaaatatttatttggttcatatgatcttaataatgaaagcttatcaaaaggttatatcgatcatgcattagatacttttgcacaaggcccgctcaagttaactttagatattagaaaagtggaccttactaaatataatgatcattatcgtgaaaaatgttttattaatagtactacagattatcgcgcttgctacgtatttaaaggtgaagaaattaaatccttacttacaggttataatgattgggattttgatattacagcagatgatttaaagaatattaagcttgcttctgataatatttctccaaatttacaggaatatcaatctaataccagaatttatatttttgagaatgaaaataaggataaaaacttccaggatgtgactattactggagcctttgcatatccattccaacagtcatggggacttcaacaaactaaacaaaaaagatttgtcttaattaactcaaccacaagcgattataaaattactacaactaccatggtccaagagccacagacaggccagccaaatgaaaaagaagttaccacaggcgcaatgagcgtatataaagataatacctcaactgatggcgatctctatgtaatccaaggtggttctggtttcaatgtacttatcaatgataatcctaatgttcctttcgcagaaccaatatcatttgttgtaaactcaactcctggcaatacgaataacgcaacatatagagtgagattaggtaagaatcaagtattaagcttaccaaatattactggtattgaaggaagtagagttgagaatgaggctccaacgacgaatatacagaagtttaatggtagtatttatttagaaggacaaaatatttttacttttaaacaagatttgaatggaagtactttagactttaaacatgtaattaatggcgtaagtattgaaggtcaatctactaatcaaaatggagttgtttcaactaccttaaaatcaccattcgcgcaaaaatttacattttaa

SEQ ID NO: 1175 - DNA, 219 bp, Acinetobacter baumannii
tggttgattggacatgggagtaaatacgccgcaatttcgcaaattggcgctattctaatcgagatacctatctttacaaaacgaaatacagactattggaaaatttttttgtcaatgtcaataaactgtcactactcaagagtagtgtttttctgtataatttgccctcaaattttaggcgtttcgaattttcatgtcagatatcaaaaatctccgtaa

SEQ ID NO: 1176 - DNA, 675 bp, Acinetobacter baumannii
cgtttatgtggggactcaaacgatggggggcattcatttttcgattgctcgacattggcaaccattgatgacaagtatcttaacctggcctgttgtctattattgtttagcaaaatggcgcatttagttttagcttctagttctccgcgtcggagagagttgttgcaacaactgggcttaaattttgaaatctatagccctgatattgatgaatctgttcatgacggtgagctggttcaccaatatgtagagcggttagcgagagaaaaagcccaagctgtattaaacatttttccagattcagtgattattgctgcagatacgagtcttgggctggatggtcagattattggtaaacctgactcaaagcagcatgcctttgacatctggaaacaattatctggtcgttggcatgatgtattttccggaatttgtattgcaacacagcaacaaatcttaagtcaggtggtgcagacccaagttgagtttgcatctctaactacgcaagatatggaagattactgggccacaggagaacctgtagggaaggccggtgcatatgcaattcaaggaattgcttcacaatatattcccaaaattcaaggaagttatagtaatgtggtagggcttcctttgtacgaattttcacagttattcaaaagagtgaagacataa

SEQ ID NO: 1177 - DNA, 213 bp, Acinetobacter baumannii
tttagcggtggtcatttgttagtttccaagtttgtagccgagtcgatgcattctgttcacccaaatggaaatatgttcagtggtgcgatgaatttattttatctgaagggtgctttctctcatgtaaccttcaaaggcttagtgctgggcatgatgttgcttaaacttgtgacggtaattgctattcaagtgacattaaaagtttttccttaa

SEQ ID NO: 1178 - DNA, 1257 bp, Acinetobacter baumannii
cattcgctaggtttttttatgcctattcggacaataaataagagaataattatgggcatacaaaagatattaaacgaagaggcacaatatggtgtccccgttaaaattttcactcaagacatagatagtgaaagtattgagcaactcaagaaaatggcacaactgcaatttatatattctcatattgctgttatgcctgatgtgcatgttggaaaaggtgcaaccgtaggcagcgtcattcctaccaaacatgccattattccggctgcagtgggagtagatattggctgcggaatgaatgctattcgtttgagcctgaaagcttcacaacttccagataacttaagccgcttgcgggacgccattgaacggaaagtaccggttggatttgctttgcacaaacaagtcaaagcgaaagcttctagcattattccacttgaaaaacgcttagaacctattattaaaaagcatccgggtcttgtccgaatgcttcgtcagtttgaggcaacatggcaaaaacagttgggcactttaggcggcggtaatcactttatagagttatgtattgatgaaaatcaagatatatgggtgatgctccattcgggcagccgaggtcttggtaacgtcataggtacttattttattgagttagccaagaaagaggcacaacatcgctttgggcacgtgcctgataaagatttaagttattttgctgaaggctcgcaaagctttaatgattatgtagaagcagtagagtgggctcaagaatatgcttttgaaaatcgtaaagaaatgatgcgattaatattagaagcaattcgccctcttctaccttcttttcaaatgacgaaagaagcaatcaattgtcaccataactatgtgagtcaagaaacacactttggtgaaaacctttttgttacaagaaaaggggcaattcgagcaggtttagatgagttaggaattattccaggttctatgggagcacgctcgtatattgttaaaggtaaagcaaaccctgaatctttttgttcctgttctcatggagctggccgcaaaatgagccgaagcaaagcaaaagttctttttaatcagcaggacttgattgaacaaacacaagggattgaatgccgtaaagacagtgatgtagtcgatgaaattcctagtgcctataaagatattgatgaggttatagccaatcaggcagatctcattgaagtcgttcatactcttaaacaagttttatgtattaaaggttaa

SEQ ID NO: 1179 - DNA, 375 bp, Acinetobacter baumannii
attagatcaggagcaaaaaccatgcgcggaataaataaagtgatcttggttggaatgcttggtgctaacccaattcctaaacaatttcaaaacggtggctcctatgctcagttttcaattgccacttcagaaaaataccaggacaaacgcactggagattggattgaaaatactgagtggcatcggattgtggctcacaaccgcctaggtgaaattgcctgtcaatttctcaaaaaaggttcaaaagtttatatcgaaggctcattacatacccggaaatggactgaccaaaataatcaagaacgttacgtaactgaagttagagccattacatttcaatcgctcgatagcttgccacaagcaaacccggtttaa

SEQ ID NO: 1180 - DNA, 828 bp, Acinetobacter baumannii
ataattcaaggaaagcacaaccctatgtcacgtcttgccacccgttttgaaaagctgcagtcccaacaacgtaaagcgcttgtatcttatgtcatggcgggtgatccacagccacaagtaacggtgccgttacttcataaaatggttgcggcaggagtagacgtcattgagcttggtttaccattttcagacccgatggctgatggtccggtaattgcacttgctgctgaacgcgcacttgcggctgggacgaacaccttagatgcgctgaacatggtaaaagagtttcgtgagcaggatcaggaaacacctgtagttttaatgggttatcttaatcctgttgaagtgattggttacgagaagtttgtttcttatgcgaaacaatgtggtgtagatggcttattacttgtggacttaccaccggaagagtcaaaagaatttggtgcaatcttgaaacaacatgatatggaccagattttcttacttgcaccaacttcaactgatcaacgtattcaacacgtagcgaatcaggcaagcgggtttatctactatgtttcactcaaaggtgtaacaggtgcagcgactttggatacttctgaagcggctgcacgtattgaaaaaatcaaaggtatgactaacgttccagttggcgttggtttcggaattagtgatgctgcttcagcgaaagcgatgggtagtgttgcagatgccgtgattgtaggtagtgctttcgttaaatcttttgcaacgttggcagctgatgaagctgttgaacagacggtgaataaagtcaaggagcttcgagcagcgctcgatgagttagtatga

SEQ ID NO: 1181 - DNA, 855 bp, Acinetobacter baumannii
aagatgcaaggcatagatttacatacacatagcaatatttctgatggaactttgtctccggaattgctagtgcaagctgctgtcgatgtgaagttgcatactttggcgctaaccgatcacgatacgatggatggattgcagcgtgcaagaaatgctgcacaaccccatgatttaaaaattatttctggtgtggagatttcaagccagtggtcgcgaccaagcacgaaaaaaagctatggcgtgcatattgtagctttaaatatgcaagatgaagccccaattttagaagcattagaacaacaaaaaagaattagagcacaaagagcagtagttatttgtgaactattaaaaaagtgtattggctttgatatttatcaagatgttctcgataaagttgaaaatcaaccagaccggattaccagaacccatattgctaaagccttagttgaaaagaatgtagtgagccgtcctcaacaagctttcgatcgttttttaaaggaagggaagcgtgcttttgtaaagtttgaaggattgggtttgaaagagaccattgaggttattcataacagtaaaggatttgcagttttagctcatccaacccgttatgatttatcggctacaaatacccggtatttgattgagttatttgcaagttgtggtggagatgcggtggagttgccgcctccagtagatcctttatctactcgccaaatgattgatcgtatgattgaacagcatcatttggctatttcaattggtagcgattttcatggtgaaaatatgccgtggattaaattaggaaatacccctaaaccaacgagtaaccagcaaggcatttgggagcgttttatctaa

SEQ ID NO: 1182 - DNA, 615 bp, Acinetobacter baumannii
gaagttagagggcataatgagggaataacaataagaggagtaaaaatgacaggcttattcattttcttggggattttcgttgtactgattgcttggggcatccacattcgcaataacattgtgcgttatttcaatgcgaccaaacgcgcttgggctgaggttgcaaatttcgaacgccagaaagtaaaaacacttgaagcactagaaaccacactcaatcaatatactcagttcgagaagtcaactttagaacaagtaactgctttacgtcagcaaattctaagtttgaatgtcgatcatactgatattgctcaattacaacagattgaaaaaatgagtaaggagctaatccgtagcctaaatgtggtggttgaaaactatcctgaactaaaagcagatacgctctatggcaaaatgatggatgatattcaggaacaaaacgaaaatgtcggcgcggcaatcagcatttttaaccgcaacgtcgaagtatttaataatcagattgaagtgttcccaaataatattatcaatacgatgactttatctaaaaaaacaattcgtccttttcgagataatttggctactgacaattttgactataaaccgaacttttag

SEQ ID NO: 1183 - DNA, 1221 bp, Acinetobacter baumannii
ggtttttttatttttaaatacccatcccttagagattcgcctattatatcggactatatttcacctcatcagtacgcaatttccggtatgaaccactcagacactctctcgcttagcttagaacttttacaacagccttctgttacccctattgatcatacttgccaaactattatggctgaccgcttagctaaagttggcttccatattgaacctatgcgctttggagatgtcgataatttatgggctcgacgtggaaccgaaggccctgtattttgttttgctggtcataccgacgtagtaccaacaggacgtttagacgcttggaattcagacccatttgcaccagaaattcgcgatggcaaattatatggtcgtggttcagcagatatgaaaactgcattagctgcaatggtagttgcatctgaacgttttgtagcaaaacacccaaaccataaaggttcaattgcttttttaattacttcagatgaagaaggtcctgctgttaacggtaccgttaaagtcatcgaaacactggaaaagcgtaatgaaaaaattacttggtgtttggttggtgaaccatcaagtactcataaattaggtgatattgttaagaatggccgtcgtggttctcttaatgctgtattgaaggttcaaggcaaacaaggtcatgtagcttacccacacttggcacgtaatccaattcatgaagcatctccagcgttagctgagttgtgccaaacagtttgggacaatggcaatgagtatttccctgcaacttcattccagatttcaaatatccatgcaggtactggcgcaaccaatgtaatccctggtgctttagaagttacttttaatttccgttattcaaccgaggttacagcagaacagcttaaacaacgtgttcatgaaattttagacaagcatggcttgcagtatgaaattgtctggaatttgtctggcttaccattcttaactccagtaggtgaattagttaacgcagctcaaactgctattttaaatgtgactggtactgagactgagctttcaacaagtggtggtacatctgatggacgcttcattgctccaacaggtgcacaagttttagaactcggtgttctaaacgctactatccatcaaattaatgaacatgttgatgtacatgatcttgatccattaactgatatttatgagcaaattttagagaacctacttgcttaa

SEQ ID NO: 1184 - DNA, 1473 bp, Acinetobacter baumannii
gtcttttttatgcgtatttttcagcgaattcatcaaaagttaaattggtcaggacgtcgttatatggcggtcatactttgcgttgttgctattgcatatcttgcatcggcaatttatcacacagtgaaaccattgccgcaaggaattaactttagtggcaagctcagacatgccgatgttaaatttttagccgataaaacgtatattgatgcgaatgggcaacaacaggttgatcagcacatctttgatgaaatcttgaaaatgattgatgaggcaaaaaccacaattgtggtggatatgttcttatttaattcagaagtaggcgattcaaaactaaagcaaagaccattgatgcaagagctcactgatgcactaattagtaaaaaaagacaaaaccgtcaaattcaggttgttatgattaccgacccgattaattcggtatatggtggactaagccctgaacactaccgtcaattacgccaagctggtgttgatgtcatcgaaacgaatctggcacctttacgtgcttctaacccattctggtcggggttttggtacatctgttgccaaaatattggcaataatccagagaaaggctggttacccaacccatttggcgatgaaaaaattacgctacgtagttatttgaacttatttaactttaaagcaaaccatcgtaaaactattgtcgttgataccgatgcgggttggaagtcattggtgacctcagcaaacccgcatgatggtagttcgcgccattctaatgtggcattgatggtaaatggagccacagctactgatgtactccaaaccgaagctgctgttgcgcaaatgtcaggaagtagttcaccatcacttattttaggcgattttgaaaaagacgttagcaagcctcaagttcaagtgctaactgaaggggcaatctatgaagctgtattaaaattaattaatacggctaaacctaaagaacatcttgatttaagtatgttctatttgtctgaacgtaagattattaaagctctaaaaagtgcccaagaacgtggcgttattgttcgtgttttactcgatccaaataaagatgcgtttggtagacaaaagaatggtatcccaaaccgtcaggtagcttcagagttacatgctgctggcattccaattcgttggtgtgatactcatggcgagcagaaccatagcaaaatgatcttaaaatataatgctcaacaagctgagttaattgtaggatctgccaattttacagcccgtaatttaaaaaattataaccttgaaacggatatgttggttgtaggcaaagttcaagatcaagtctttaaagatgctcagaattacttcaatacttcgtggtcaaacctacaaggtagacagatgagcgtggattatgcgaagtatgccgatgagtctaaagtgaagtattggatttatcgttttatggaatggtcaggtttatcgactttttaa

SEQ ID NO: 1185 - DNA, 900 bp, Acinetobacter baumannii
ggagcttttatgcatattgtctatgtctctgatggtaaagcagggcatcgctcacaagctttaggcttgtttcaggcgatgcaaagacagcaggcaaatgtaacttttgaagaagtctctattaatgacttgcctgttatgtccttaatcaaagcgcttttttcttcaaaaaaatctctatttcaacaggcgcccgattttatatttggtgttggaagtcatacgcattttcgtgtctggttgctcggtaaaattttcaaaaaggctaagaccattattttaatgaagccaaatttaccgacggtttggtttaattatgctgtgattccagagcacgacggtattcctgcgaataatcgagtgattgttacgcgtggggcattaaatcccattcgtaatgaaaaacgccatcaagcttctagaattttaattgcattaggtggttcatcaaaacggcatcaatggaaccaagaaaaagtattattaagcgtgcaaaagattgttgagaataatccggatgccgaaatcattctaacgacttcacgtcgaacaccagcagagtttattgatattttaagacaacaaagttttgcccagcatttacaaatatttccggttgagcaaacacctcaaggctggatttttgaagagatgcaaaaagcagaagctgtatgggtaacagaagatagcgtttctatggtttttgaagcacttactgcgggttgtcgcgtaggggtcatagcaatcgatcggttgaaagacgatagaattacgcactcgattgatcaaatgatagaatcacaactaatttcacagaatacttgtgtcgtacagttgccacaaccttatgcttttaaagaagcagaccgtgtggcaacatatcttttagcgaaaaattaa

SEQ ID NO: 1186 - DNA, 1284 bp, Acinetobacter baumannii
agttattttatttttaatcctataccctttaaactttcactttatatgagtcaccattttttaggtatatcagtgtcggttttctcctttgagcaagaacagcaattctttcatgaaatcaaacaaatgcttaatcagcagacttttgaacgtttgattttgagccaatataaaggagagttgacacagctggaaaaaattactttccgtgttgtggagctacatggaaaaaaacaactttccgcgctatatcatcataccacccaagatgtgactaaaaattattcattcgaagatggcttagaacagattgcagtgctgattacgcaatgcaaacaagcgaatttatttgccactcatcaagaaatccagcttaaaaaaaataagaaaaaagccatgcttaatatgggtaaaaaacacagcgtgactaccgttccaactgtacaagctcatgatcgtgagaaacaacgttatgtacagcagggtagtgcatttttaaaagagcttggcattacagatgagaaagctcaaatcattccaagcatggctcgtaaatggaagcagattaataaatttatcgaaatttttgcgagcgcatatgagcagattgatgctgagcaaaaagagttaaatattgtcgattttggttcaggaaaagggtatttaacttttgctttgtatgattatttacaagaacaacaaaaggttccgctcattacgggtgtagagctgcgccgtaatttagtggaattttgccagaacgttgcagacaaagtacattttaatcatttagacttttttgaaggtgacggtcgtagttatcagccggaaaagctggacgttatgattgctttacatgcttgtgatattgcgcctgatttcgctatccatacgggaattcgtttaaatgcttcaatgattatgtgtgcgccgtgctgtcacaaagagttgcgtccacaactacatagccctgaagttttacaaccaatgctacagtttggtattcatgcgggacaacaagccgagatgttgaccgataccttacgtgctttacttttaaaagcatatggctatgaaactaaagtttttgagcttgtatcgcttgaacacaccagtaaaaataaaatgattttggcgactaaacgtaaaaacgtgacacaacctgatgtcaagattatggctcaaattcaagcattgaaagaaatgtatggaattaaaaaacagactttggaattgttattacaagaccagctgccgatcgaaaatattggctgcaaatgctag

SEQ ID NO: 1187 - DNA, 198 bp, Acinetobacter baumannii
aagtattttatttgcagccactacttttttcctaacgtgagtatggagaaatcatacctgcgtaaaaaagtcggtattatgcagaaatttaaaattttgtgtatgtttttcattaaaagtttatgctacttaagattattttttatacaaaaacatctgttttgtactgtttttaaacatattataccttttttctaa

SEQ ID NO: 1188 - DNA, 840 bp, Acinetobacter baumannii
ctaactttctttgagcaagttatggaaaattttgaagttataaaagcactgtttctaggctttgttgaaggcttaactgaatttttacctatttcgagtactggtcatttaattttatttggtcatattatcgatttccattcagatggtggtcgtgtctttgaagtagtgatccagttaggtgctattctggcagtgtgttggttatatcgtcagaaaatcattaacttaatcaaaggtttttttagtggtgatgtcgagtcacgccattttgccattagtgtcttaattgcttttttcccagcagtgattattggcgttttagctgtagactttattaaaagtgttttatttagcccaattgtagttgcgattgctctgattgtcggcgcgcttattattttctgggttgaatctaaacaatttgaacataaaacggatgatgcgaccaagatcacgtttaaacaggcgcttttagttggtctggctcaatgtgttgcgatgattcctggaacctctcgttctggtgcgacaattgtaggcgggatgtttgcaggcttgtctcgtaaagctgcaacagagttttcgtttttccttgcaatgccgaccatgctaggtgcagcaacatttgacctaattaaaaatgctgatgtgttgacttcagacaatatggttaatattggagtgggttttgttgcggcatttattgctgctttattggttgtaaaagcactcgtactcttcgttgagcgtcatacattacgtgtatttgcgtggtatcgaattgtattaggtgtaattatcctaattgctgctatgttctttaacttatctgcttaa

SEQ ID NO: 1189 - DNA, 1014 bp, Acinetobacter baumannii
atattgcttataagcgagaaaaaaatgcgtaacgatacacgtaaaaaatttaatcatagtttggcaaaggttgctgaactaaacggtgttgagtctgcacaggtgcaattcactgtagcaccagcaccggcacaaaaaatggaagaaaaaattcaggcttcaagcgaattttttcaaaagattaatgtcgttcctgttgaagcacaaacaggtgaagcgattggtttatctgtcaattcaacgattgcaggtcgcaccgacacatctggcaatggcgaacgaaatccaactgatccgactggttttggtgtggacaaatacgaatgtaaacagaccaattttgatgtcgcgattacatatgcaaaacttgatgcttgggcaccgtttgcagacttccatcaacgttggacaaatgccgttgcaaaagcaattggtttagaccgtatcatgatcggtttcaatggtacctctgctgctgaaaccactgatcgggttgccaatccaaaactgcaggatgtgaacattggctggttgcaaaaaatccgtaccaatgcacctgatcgtgtgatgtcagcagtcaccgttggtgcagctggcacatataaaaacttagatgctttggtagtggatgcagtcaatgaactcattgatgaagtacatcaagatgatacggatcttgtagtgatctgtggacgttcactcttggcagacaaaaacttcccaatggtgaatgatgcgtctgacaataccaatgtattggctggtcaagtattgttaagccaaaaacaaattggtggtttacctgcagcacgtgtaccacacttccctgacaatgcacttttgatcacgtcttttgacaacctgtcaatctactatcaaaaagatgcaaagcgtcgttacattcaggaaaaaccaagcaaaaaccgcattgaagattatcaatcttcaaatgaagcgtatgtgatcgaagcatacgaaaaagttgcattggttgaaggcatcacaattcaataa

SEQ ID NO: 1190 - DNA, 432 bp, Acinetobacter baumannii
atgagtattattcaagaatttaaagaatttgccattaaaggcaatatgatggatttagctattggtgtaattatcggtggtgcttttggcaaaatcgtagactcgttagtaaaagatatcatcatgccgcttatcactgtaattactggtggtggtgttgatttttcgcagaaatttatcgtgttaggtgcaaatcctaataacttacaatctctagatgccttacaaaaagcaggtatcaatgtattaacttatggtaacttcctgaccattttaattaacttcctgattttggcttgggttgtgttcttaatggtgaaattattaaacaaacttcgccgtgataagaatgagccagaagctccagctgcaactccagaagatatccaattattacgtgaaattcgtgatgagttgaaaaaacaagcttaa

SEQ ID NO: 1191 - DNA, 747 bp, Acinetobacter baumannii
ggaataattatgacagctcttatttttgatactgaaacccataaattacatggtgacattattgaagctgctgcaatggaagtagtttttcctcaaatttcagcagatattctaattattccaaccatgtttgatttcaccaaacgttataaaccaagtgaacctatttcactcggtgcaatggcagtccaccatatcgttgatgaagatcttgtaaagtgtccatcattcaaaacatttaaatggccaaaagagaatatccagtatttgattggccacaatattgattatgacatcgaggcagtaaaaagagctggtgcagatacaacaggaattaaatctatttgtactttagctatggctcgctacctttggccaacattggaagcccataacctaactgcactggcctatcacataagccgagaccgtaaatcgacaagacgtggattaaagaatgcacattcagccttgaatgattgcaagacaacctatggacttttacacaccattgttcaggaaaaaaacataaagagttttcaagaactgtacctcttttcagagaaggcccgaatccctacccatattttctatgggaaatacaaaggttcagctattgcagatcttgatatgcatgccctcgcgtttttagctcgtaaaacagaggatcaataccttttaaaagcaatcgattatgaactattccaacgttcaaattctgattttacaaatgaattgccttggtga

SEQ ID NO: 1192 - DNA, 1224 bp, Acinetobacter baumannii
aatatcgttatgtctgaacaaacagcccagcgtcaatattctattggctggattatgttgctcgctttactcacggctttagggccattatccattgatatgtacttacctgcgttgcctcaaatggcccatgattttggggtgagtacacaaatggtagcaaacacattgccggcttatttttttggtttagccattggacaactggtatatggacctttaagcgaccgtattggtcgaaaaaagcctctttattttgggcttgcgctttatgcagttgcaagcttgttctgtgtgctcgctacaaatgaatggagcctaattgctgcccgtattttacaagccttaggtggttgtgtgggggtggttatggctcgtgctgctatacgagatagattagatgtccaaggctcggcacaagctttttcaagcatgatgatcgtaatgggcttagcacctattttggccccgatgattggggcctggatattaatctggtttccgtggcaagcgatttttattgcgctttcaattgtaggggcaatctgttggctatgtgtacatttcttttttaaagaaactttggcagttgataagagactcaagttatctctatatcaagtggctaccttatatggtgctattttcaaagatgcaagcttccgtttacctatgtttgcaggatgtttaacaggtgcagcattattctgttatatcagttcagctccagccgtttttatggaccaatatggcttaaatcagcaagagtttgcttatgtattcgggctcaatgcttttggcattatgttaatgtcatctttaaataagcacttaaccacacgtgttgaaatcactaagcgcttaaaagcaggttcaatggtacaagtgacaggtgcaagcattgtgttgattgctggcttaatttctgcagcacctttatggctagtaatgttaggactgttcttagcaatttcaggaattggtttaactggaccaaatgctatggctctagccatgtcaaagcaaggtgctcgtgcaggaacagccagtgcaattatgggcagtatgcaatttgcttgcggtctattgggtggagtactgcttaacttccttatttggtctgcatcactcaatatgggagtgatgatggtgttatttacattaagtggttttattgttgttttaaaagcgattcgacaagcaaaaagccaatcactctcttga

SEQ ID NO: 1193 - DNA, 246 bp, Acinetobacter baumannii
acttcttatattttaattgtttgcgccagccttttaggacttttccataaggagttttataaatataacgttggacatgaatggtggacggtacagattcaaaacgcccataacgaggctgtccattttcttgaattaaatccatttacccacttccatatgaatattagatttcaaatgacctatcccacagtcaaatatgtattttcccaaattgttgcagcaaaatcgccttttattaaatga

SEQ ID NO: 1194 - DNA, 378 bp, Acinetobacter baumannii
ggtttatatatgcgaacattgttttggcgaactctggtcgtgatttttatcacgcttggtattattggagcaattttaccaggcatgccgacaacagtgtttcttattctggctgcttgggcggcctcaaaagggtggcctcagatggatgcgtggttgttaaaccaccccaagtatggaataaccctgcgggactggcgagcaaatgggacagtaccgcgtaaggcaaagtggattgcaaccattatgatgaccgcaagtggtattctgatgctgtttacttcggcgccttttggggtcaagatttttaccgatactaccatgcttgttgttgcaatttggttatggctacgtcctgagccaaaattaaaagattga

SEQ ID NO: 1195 - DNA, 195 bp, Acinetobacter baumannii
atccatcatattgcctttaatggcaaattctttaaattcttgaataatactcatctaaacatctccagatgtaggggggaggaacacatcatatttttcttttttcactggcctcttatccgtctagatagtactcgccatgatattgataatttaatatttttttcaaaaaaagaaagctatttcacactttaa

SEQ ID NO: 1196 - DNA, 306 bp, Acinetobacter baumannii
actatgaatatatttgctgagttatgctgcttctcaacacctaaaaatctttttttcaataggaaatttccaaactatttagctccagacttcaaccgtatggttgtcgatttgaaaaatctaggttggacacttgagaagatcgcatatgtattgccaatatcaggggcttcctctgtcagagaatggatctgtggaagtttcatgaaatatgataacggcgctgcatttgttgaactttggatgcatttgactaataaaacagaaaaagaaatacctcgaattaatcgttaccttatagcttag

SEQ ID NO: 1197 - DNA, 2739 bp, Acinetobacter baumannii
atgtcagatatatcaagacgcatagatgaccgtcttaaccagatcttcaaattcaaaagagttggagaatggtacagacaaggcatctgcccacagtgcagcagaaaagaatgctatacccatgcgataaaacctcgcgtggtgaaatgtagccgtttaaataattgtggttatgaagaacacgtcaaagatatttgcgaagacttattcaaagattggtccaaagaatttcctaaaactgaagtaaaccctcatgcagctgccgatgcgtatttacgtcatggtcgtggcttggatattgcccctttaaaaggtttatatactcaagatacctttagcaatgaacaaaaatatcctggtctttataccggtactgtccgtttcaaattagctgaaggaatttattgggaacgttttatcgaccgtcctgaacgttttggacgtcaaaaagcaaacttcattggtaaatatgagggattgtcttggtctacagtagatctggatgatctttgcaatgctccttcattttggattactgaaggtatttttaatgccattgcattaatccaatctggtcagccagcaattgccaccatgtctactggtaattatccatctgttttacttaaacagattgcagaccgttgccatgagttgaaaaaagacaagccacgtctgatctgggcttttgataatgacaaagccggaaaggatgcaattagaaaattccacctccgcgcacttcaggaaaaatgggcttcttcagctgctctacctcctcatcaggtcaaaggtaaaaaccttgattggaatgacctgtttatgcacgacttactacacagtgaagaacgtgccaagtatcgtcattatggtgaattactcattgcagaaacggctgaacaagctggtctattgatctacaactttaaagaaggtcgaaccaagacttttttctttaatcacaatttccgtctgtactggttcaacttagattacgacaaatacgctaagcgtatgaatcagattgaagaagatccaagttttgatgccctactcgatcaacaaaagcgtgagcaagctttacgtgactgtgcagctgtcaccgaaatctgcaacgctcagattgatcccctttattttgaacgtaacgaggttacgggcgaagcctggtattacttcaacgttcaaagccaatgggcagaaaagaaaactcaatttaccccaagccaaatcggtagtcgtagcaaatttaaagatgcaacgatggaagtcatggctggtgcaatgtggaccggtaccgatcaacagcttgaattttttatgaagcgtaagacggaacgtttgaaggaagttaaaactaccgattacataggctattcaagtgaatatgaaacttacatattcccaaaacatgctgtgcataaaggccaagttatccccattaatgaacatgattacttcaaaattaaacgtcttgaactcaagagtttagcgaagtcccctgtcattacattaaatccgaaaaaagaatttaagcctttttggtggaaagacttttaccgggtacgtggcagtaagggattaattgccctggcatggtggaccggtacatattttgctgagcaaattcgctcaatacatagctcatacccattcattgaaattattggccaagctggtgccggtaaatcacgtttaattgagttcttatggaaattaagcggtcgtaaagagtacgaaggctttgatgcaaataaatcaaccaatgtggcgatttatcgtaactttgcccaaatctctaaccttccagttgtgttgattgaaggtgaccgtaacgatgcacaaggcaatagtgtcaaacaagcaaagtttagttgggatgaactcaaagatgcttttaacggccgagcaattcgctctaaaggcctaaaaaccgctggtaatgaaacatatgaaccacctttccgtggtgccatcatgatttcacaaaacagcgctattgctgcatctgaagcaatcttgactcgtacattgcacctttcattcgaccgcaaagggcaatcactggaaaccaaacgtattgttgatgcactggaccgtattgaactagaagaagcatgtacttacatgactcattgcctacgcaaagagaacgagatacttacaacgtatcaggaacgcttaaaaagccttgaagatcaataccacagtgtaggcattacacatacacgtattgccctatgtcatgcccaaattgcagcactcattgaagctattgctgagcatgtactcaatggctatctggactacgaagaagtggctccagcacaagaaatgctgatggaaatggcgcaacaacgtgtggaccaacttaatggtgattgtcaggaagttgaacaattttgggaagcttttgaatacctgcaaagtggtagatctgccccattcagtcttaatcatcatgataacgatgctcagactatcgccatcaatttaaatgaagtctacaaagtcgctgcccagcagtaccagaaacttcctgaaattacgttgatgaaaaacctgctgaaatcatcacaaaaattcaagtttatcgaatctaaccgagctgttagctcaagccgttttccaacagatgctgcaaaaaatctgaatgctgacaatgaaatgtcagaccgacgcagaacagtgaaatgttggattttttctaaccctaactatggagcaccacaagcatga

SEQ ID NO: 1198 - DNA, 945 bp, Acinetobacter baumannii
gcaggcctctttaagtattcccctttcaattggatctgccttatgagtgttgattttaattctttaccaaagccaaattttgttgatgtaattgactatgaagcaattttttcagaacgaaaagagtattttatttcacttcatccagaagatgaacaagaagatgttcgtaaaactttgagtcgtgaaagtgaaccagtcaccaagcttttacaagaaaatgcttaccgtgaaatgatattgcgtaatcaaatcaatgaaaaagctctggccactcaacttgcatttgctaaaggaaatgacttggatgtttggggagcaaattttgatgtaaaacgtttggtgattacaccagcagataattctgtcacaccaccagcccctgcagtttatgaagaagatgaagattttcgttatcgtattcaaaagaaattagatgcattaagtactgctggcccagaatcagcgtatgaatttcatacgctttcagcagatagccgtgtttcacatgttaaatgcagttcaccagctccagcccatgctcttttaacaattctccagcgtgatacagagaataatgcatctactgaggaactaaataagattgtttataactatgtttctgctgaaaaaaagcgtcctacaggtgatcgagtacaagtccaatccgcagaaattgtcagttatgaaatagaagctgttcttgtcactaaaaatgtgcctgaaacagatccagttttatcagcagctcaagctaatactgttgcttataccaaagaaccaaagcgaattggtaaaggtgtctttttttcagatctctattctattttaaaagtttcaggtgttgaacgtgtagagcttatcagcccaactgcagagatccaccttaataatttccaagcagcttcttgtacagccattcgtcttagcgtgaggaatgaataa

SEQ ID NO: 1199 - DNA, 366 bp, Acinetobacter baumannii
gataaagatatgaacatacaaattaaaagaatttatgaggatgtaagcggtgatgatggaaagcgaattttggttgaccgactatggagtcgagggattagcaaagaaaatgctcatttagatttatggttaaaagaaatagctccttcaaccgaacttcgtaagtggtttcatgcagagtccgcagaacactgggatgagttcaaacaacgttatttaaaagaactagaaacaaaccccgcagtaaaagagttattagaaatcgtttcatatcataaagtcacacttttatattcggctaaagatgtggaacataaccatgcgattattttaaaagaatacttattagaaaagagcaaaaattaa

SEQ ID NO: 1200 - DNA, 498 bp, Acinetobacter baumannii
agaatctgtatctgtgctaccattagcatttttcaagctaggtcaattgctgtgtctgaaatcagttttgaacgtcttcatcaatttttctgcaaagttccaagtgtacaagaagcccgtatcatggcttatggagcagatggcgaacatgcttggtggtttaagttcagtattgatgtagaacaccctctcgcatggcaaaccgttcaagaactcgggcatgttttaaattatctgtcgacgaatgagcgtttacctactttattctttcctgtatctccaccaccttacatgaatggtgaagcaaaagattttttatcatgggttattcagtgtaatcaccctgagttttctccagatgtggtttgtgattggcttgaagcgcgtttgccgaatcctgtagatgatgagtcgcagtggaaaattaagacggatttgagtgaaatagagaagttagatgataaggctttggatcaattgattccgcctactgcttaa

SEQ ID NO: 1201 - DNA, 300 bp, Acinetobacter baumannii
atagacttcatttctgtgcttctacagcacattcgagatatccttatgtccgataaaaattcttccgaatcagcaattttaggctggaaatttgttctaatcgtcggtgttttaagtgcgatcttccttggctttttctatttagcaatgagtaatgagcctgactatatgccaggagcacagcgcaaagctcaacagcatgaaatgcagcaaaaagctgagaaatcaacagatcagcaaactcagcatgacaatatgcctgaaatggacatgcaagaacatcagcattcacatcagtaa

SEQ ID NO: 1202 - DNA, 651 bp, Acinetobacter baumannii
ggatttatcatgacattacgattaggcgacacagcccctgattttcaacaagaatcaagcgaaggcactattaatttttatgattttctaggtgatagttggggcattttattttcacacccggccgactatacgccagtatgtacaactgaattgggttatacagcaaaactaaaagatgaatttgaaaaacgtaatgttaaagcaattgctttatctgtagatgatgttgagtcgcacaaaggctggattaatgacattaatgaaactcaaaatacaacagtcaattttccaattattgccgacaaagaccgcaaagtatctgagctatacggttttattcatccgaatgccagtgaaacccttactgttcgttctttagtgattattgacccaaataaaaaagttcgtctaatcatcacctaccctgcttcgactggtcgtaattttaatgaagtcttacgtgttgttgactcattacaattaaccgataagcataaagtggctacaccagcaaactggcaacaaggtgaagatgtggtcattgtcccttctttaaaagatgaagaggaaattaaacaacgcttccctaaaggttatactacggtgaaaccttatttacgcctcacaccacagcctgagcaagattaa

SEQ ID NO: 1203 - DNA, 474 bp, Acinetobacter baumannii
ggtcaaatcatgaaaggtagtgtaaatacatcattgatcgctaatatggaccaacaagagctacagcatcttattacggtttcaactggttttattgacgcttatattattgaatgtaacgatcaggtacctatgctattgccacaaaacattgtgttgtctgccatggatgtaaaaaatggcgtaaaacatattgaatggcatgatgtgaagctaccggtctactcagtacataacgcaattgatcaacatgcagcagcattagtgattgaaggggaagatattagccaacgttttgcattaatctgtaaaactatgccagtttctactcgtctgcgtatttctgaaattgtcgatgaaatggatgagcatgaggctgaacaatatccagcagtatttaaatatgtgcgtatgcaagatcaacgctactatatacctaacttaaaatatattgaaaaatcacttggcttataa

SEQ ID NO: 1204 - DNA, 1470 bp, Acinetobacter baumannii
ggaatctccatgagcgaaacacatgctcctgaaaaactccagcgtaagcttggggctcgtcatctgaatatgatcgccattggtggttccattggtacaggtcttttccttgcttctgggtcaaccattgcaaatgcaggtccaggtggggcgttactcgcctactccctcattggtattatgatttactttttaatgaccagtttaggtgaacttgcgacacacacaccaacatccggtgctttctttacctatggaagccgctatgtcgaagaaggttttggtttcgctctaggctggaactactggtacaactgggcaattacggttgcgtttgaactcgttgccgtacagtttattatgaaattctggttcccagatgttcccggattctattggagcgccctctttctcgtcattatctttatgattaatgcgatgaccgtaaaaggatttggtgaaagtgaattctggttctccatggttaaagtaattgccattgttgcctttattattattggtatcgccatgattattaagattatgttgacaccaggagtagcaacttttggcaactggacttataaagaggcaccattcgtaggtggtttacaagccatgattggggtagccatgattgccgggttctcatttcagggaaccgagatggtgggtgttgcagcgggtgaatcaaaagatccgaagaagacgattccgcttgcaattaaacagattttctggcgaattttattattctatatcttgtgtattttcattatcggcacccttattgcctatgatgatccaaacttattacaagcagcagcaacagaaaatattgctctttctcctttcaccttactttatgaaaaagtaggttttgcttttgctgcaagtttaatgaatgcagttattttgactgctattttgtcggcaggtaactcgggcatgtactcttctacccgtatgttatttgatatggcgcaacaaggccgtgcaccaaaatggtttgcaaaactcgataatcgtggtgttccaatgaatgcgttatatgcaaccacattcattgctgcattctgcttcttaacgacttttatcggtgaaaagcaagtctttaactggctcctcaatatgtcaggaatgtgtggtttcattgtctggttaggtattgcaatttcgcattatcgtttccgtaaaggttatattgctcaaggttataaattagaagatcttgcataccgcgctaagtttttcccattcgcaccttggtttgcctttatcctctgttctgtcattattttaggacaaaactaccaagcggttttaggcggtaaaattgactggattggcttactttctacttatatcagcttgcctttattcttagtaatctggcttggatataaatggaaaaataaaactaaattaattccttacgatcaaatggatgtaaaaccagagcaagattaa

SEQ ID NO: 1205 - DNA, 1464 bp, Acinetobacter baumannii
aaaaatgtcttgaagttcaaggaaagattaaaaatgaaattaaaacatctgagcactgcaatgattttagcaacgctgcctgcaactggggtttttgcagcagctttagatcgctctggacagtcaatgtctgcgttcttccaacctggcaattactttgaagcaggtatttctgttctagatcctgatgtagctggtaaagaagctggatctagtgccacacgtcgtgatattggcgatatggcgaatgactactacttcccaagtgctgcattaaaattacaaattaatgaccaattttctttcggtctactctacgatcaaccatttggagcagatgcagaatattcaggtaataacgtattcgtttctcagccaggttctgattctgttttatcagccactgcgattgatgggattgtcactaaaaaagcaactgaagctttgcaagcacaaggtttgcctgttaatgaccaaactttagctttagcaaaaggtcaagttttagcaagtcctcaatttaaacaacttgctggcgctcttgctgcggcaaataattatttaggtaatggcggaactaaagttaaagttgatacacaaaacttatcttttgtatttggttatcaaccaactaaaaactttaacttctatgcaggccctgtattacaaaccgttaaaggtaatgtaagtttacgaggtcaagcttatagcctttataatggttatgatgctgatattaaagaaactaccggtgctgggtggttagcaggggcagcttatcagattcctgaaatcgcacttagagcatctgtaacttatcgttctgaaattgatcataaagtggatattaatgaaaatctatctttattgaatttccctggtcttacttcagtacttactggtttagaagttccagcatctaaacttcaggcaattaactcatctggtaaaactacaatcacaactccacagtctgttaaccttgattttcaaacaggtatcatggctgatacagttgcgtttgccaatgtacgctgggtgaactggaaagatttctcaattcagccatataaatttggcaaagtctcagaagctgtaggtggtcttgttggacgtccaaatggcttcaacctagtggaatattctgatgatcaatggtctgtgaacgctggtgtaggccgtaaacttaatgataaatgggctggtaatgtctctgtaggttgggactctggtgcaggtaatcctgtaacaacattaggaccaacagaaggttactggaacgtaggtttaggtgttcaatatagccctactccacaaactttcattgctggtggtgtaaaatacttctggttgggtgatgctaaagctcaaacaggtgcacaagcaggcagtgatcaatatgttgcagacttctctgataacgatgctatcgcttacggtttaaaacttggttataaattctaa

SEQ ID NO: 1206 - DNA, 504 bp, Acinetobacter baumannii
ggtaatcccatgtctcaatccaatcgtctattaaaactggtaaaagcaacttcaaaattccctaaaggtattcggagtacgctttggagcaaggcatttggccgcattgtgccaatggtgggtacagcaaacattcgctatctggaagtaaatgtaaatcatgtgacggttcgcttagaaaatcaaaaaaatatgcagaaccatattaaaggtgtccatgctgcggctatggcgcttttggcagaaactgcaacaggttttctaacgggtttacatattccagataaccgtattttattaatcaaatcattacatgttgattatttaaaagtggttgaaggtggtttaacagcaacagcgactctctctaccgaacagcaaaaatatattgctgatcatgagaaaggtgaacttgttattccagttactgtcattgatgatgcaggtaatgaaccgattcaatgccaaatgttatgggcatggttacctaaacgtaagaaataa

SEQ ID NO: 1207 - DNA, 1653 bp, Acinetobacter baumannii
ccatacgccatgtatttatataccgatttcgatcagcagctgattaatcaacgagttgctcagttccgcgatcagacagagcgctatttagcgggcaaactttctgaagatgaataccgcccattacgtttgcaaaatggtttatatgtgcaacgttatgcaccaatgctacgtattgctgtgccgtatggcttaatgaactcaaaacaattacgtaaaattgctgaagtatcaactcaatatgaccgtggctatgcacacgtatctacgcgtcaaaatattcagctaaactggcctgctcttgaagatgtgccagaaattttagctgaactcgcaactgtacaaatgcatgccattcaaaccagtggtaactgtattcgtaacacgactactgaccagtatgcaggtgtagttgcaggtgaaattgctgatccacgcccaacatgtgaattgattcgtcagtggagtacattccacccggaatttgcattcttaccacgtaaatttaaaattgccgtttctgcacttgaagaaaaagaccgtgcagcaacagcattccatgatattggtgtgtatatcgtgcgtaatgaagcaggcgagatgggctacaaaatcatggtgggtggtggtttgggccgtactccgattattggtagtgtcattcgtgagtttttaccacgtgaagatttaattgcttatttagaagcagttttacgtgtttataacttacatggccgtcgtgataacaagtataaggcgcgtatcaaaatcttggttaaagcattaacgcctgaagtatttgcacagaaagttgaagctgaatttgaacacacacgtgaaacattaaaaattcagccagaaatcttgaaaaaattagacgaagagttcacgccgtttgattatcaagatttagaagatgaagactttacagctttatttgctgagcatccaaaattcaaacaatggttcaatatcaatacgcatgcacataaagtaaagggctatcgtattgttacgatttctttaaaacgtgcaggcatcgcaccaggcgatatgaccactgaagaaatgaacttcattgcagatctcgctgataaatatacgtttggtgaacttcgtacgactcacgaacaaaacattgctttagcagatgtacctcaaaaagatttgttcgatgtatggcaagcgcttgaacagcacaacatggctcgtgcgcatatcggctttattaccgatattattagctgcccgggtggtgatttctgttcacttgcaaatgcgaaatcaatacctattgctgaagcgattacacgccgttttgaagatttagataaagtttatgatcttggtcatttagacttaaatatttctggctgtatgaatgcttgtggtcaccaccacgtgggtaacatcggtattttaggtgtagataaaaaaggtgctgagttctatcaaattaccttaggtggtaattcagaccatgatgcttcaattggtgacatcttaggaccatcatttgcagcagaagccgtacctgacgtcattgaagaagtattaaatacgtatcttgatttacgtattgaaggtgagcgtttcgttgatacatatcgtcgtgtaggaattcaaccatttaaggagcgtgcatatgcttaa

SEQ ID NO: 1208 - DNA, 1023 bp, Acinetobacter baumannii
gagatgtacatggaccctagaagtgaagtgatattaagacaacaagactatttaaaaggtagggtcttgttaattaatgcaccgaatgacgccctagtcagtcaattatccactgagattgatgcatcagtctggacgtggaattatgctgactatcagggttttataaatgcaggcgcaacagcacatttctcggttgagtttccatcacaagagtttgatcaggctttaatttttgttccaaaatcaaaagaacttttaaactacatattgcatgtagtgatgagccatctgaaaactgaccaatcagtttttttagtaggtgaaaaaaaaggtggtgttgaaagagctgctaaacaactacaaggctttggaaaaatacttaaacttgatagcgctcgacattgtcaattatggcatttaaaaattgagaaaattgaaaagatcaaacctcttgaaagctggttaaaaacctatactgttcaagtaaatgagcaagaacttaccatttgtgccctacccggcgttttcagccaaactcatttagatgtcggcactgccgttttactcccttatctaaatcaggtgaaatcaggtagaattgccgacttcgggtgtggagctggaattatcagttgctatttggcaaaagcaaattcaagtaatattatccatgccctagatattgatgccttcgctttacagtcaacggaaatgacttttagtcgaaatggaataggttcagaccagttgagattgcagcctgttacaggaattgcagacgccccaacagaacttgatgccattgtcagtaatcctcccttccatcagggtattcataccaactatgatgcaagtgaaggactctgccagaacgctaaaaaacatttaaaggcatcaggcgagctatggattgtagcgaaccgttttttaaactatccgatcttaattgagaagcactttggtcagtgtgagattaaaactgatcttcaaggctttaaggtgttatatgcctgtgcataa

SEQ ID NO: 1209 - DNA, 750 bp, Acinetobacter baumannii
ctctccgacattccactaaaaactaatcttatctttaagagtaaagacactatgaatatcctgattgttcatgctcatccagaacctctgtcttttacaacttccctaaaaacgacagcacagcaaacctttaaaaaattgggccatcaagtagaaatttccgatttatatgcaatgcagtttaatcctgttgcctctaaggaagattttttagaactcaatcaacctgattattttaactatgcattagaacagcgaaatgccacaaaacaacaacttttggctactgatattcaagcagaaattgacaaagtaaaacgcgcagatctaattatcttgaactttccactttattggacttctgttccagcaattttaaaaggctggattgatcgtgtatttgtctctggacttttttatgggggtaagcggttttacaaccatggtggcatggcaggtaaaaaagcaatgctctgtttaacactcggtggtagaacacatatgtttggggaaaattctattcacggaccaattgaacattatctatcaccgattcaacgcggtactttggcttatactggctttgaagttcttcccccattcattgcctaccatgtaccttacattagccaagaagcacgtgaaactattcttgaggactatgtcacttatctcactcaccttgaccaacttgaaccattaaaatttcctaaacttgaagaatttgatgaaaagttatatcccctctaa

SEQ ID NO: 1210 - DNA, 765 bp, Acinetobacter baumannii
ggtttatgcatgatgtggtttttgtacgttgcggtaggcctgctagcacttgctgcactgttatatgtgctgggtaattatacattctggcttccgtttcgttcgagtaaactacctcgcattgtgatgttacatcaggtcactcctaaagatgctgcttctggcatgaatatgcctcctgaaaagtttgaacaactcttaacgttgttaacgcgtaaaggtgctatcttttgctttgtttctgagcttgaacaatatcgtaatcaaaagaatgtggttgctttaagttttgatgatggctttatggataattatctttatgcctatccactactcaaaaaatataacgcgaaagcaactatttatttagcaacgcaaattgaaggtattgaaaagcttactcatgagcaaatccatgaaatggctaactctggtttaattgaatttggtgcgcatactcaacatcatgtgaacttacttaaacttgatgaccaaaccgcttatgacgaaatgcttcagtctaagcgtgatgttgaagcattagttgggaagtgcccgagttttgcttatccatttggtcgatttaacgaaaagcaccagaaaatggcccaagaaattggctttaaaaatgcagtatcgactcgtaaaaaaattgaagcctatgaagctgttaaccaatttaatattccacgtgtcagcacgcatggcgccatgaatgctttacagatgcgtatcgcccttgctaaaggacgttataagttatga

SEQ ID NO: 1211 - DNA, 1482 bp, Acinetobacter baumannii
ggagaatgcataatggctgaagctcaaaagttgaaattgattgacggttgggaagtcgttattggtattgagattcatactcagcttgcaaccaattctaaaattttctcaggttcatcaactgaatttggccaagacccaaatacacaagcgagtcttgtagacttggcgatgccgggtgtattgccggttttaaatgaaaaagtggttgaactcgcaattcgttttggtttagggattgatgcttacatcgaccaagcttcagtatttgcacgtaaaaactacttctatcctgactctccaaaaggctatcaaattagccaaatggataacccgattgtgggcttgggccatatcgacattcagcttgaagatggtacgactaaacgcattggcgtaactcgtgctcaccttgaagaagatgcgggtaagtctgtgcacgaccaatttgaaggtatgtctggcattgacttaaaccgtgctggtacgcctttgcttgaaatcgtttctgaaccggacatgcgttcagttgaagaagcagttgcctacatcaaagcaattcacacactagtacgttggttaggtatttctgacggtaacatggctgaaggatcattccgtgcggactgtaacgtgtctttacgtcgtccgggacagccattcggtacacgctgtgagctcaaaaacctcaactcattccgtttcattgagcaagcgatcaatgttgaaattgaacgccaaatggaaattttggaatggggcggcgaaattgaccaagaaactcgtttgttcgatccaaataaaatggaaacacgttctatgcgttctaaagaagaagcgaatgactaccgctacttccctgatccagacttgttaccagtaattattccagatgagcaaattgaggccatcaaagcaactatgcctgagttgccagcagcacgccgtgcacgctttattgcagactttggcgtaactgaatacgacgcacacgtacttacgctctcacgcgaaatggcggacttctatgaagctgttgttgctgcggctggtggtgcgaagcaaggtaaaattgctgcaaactgggtaatgggtgaattctctggtgctttaaataaagcgggcttagagttaacagactcacctgtttctgctgaacagcttggcggcatgattgcacgtattgttgacaacaccattagcggtaaaattgctaaacaagtctttggctttatgtgggaatcggaaggtaaatctgccgatgacattattgcggaaaaaggcttaaagcaagaaaccgacactggtgcaattgaagcgatcattaaagaagtacttgcagccaatgaaaaaatggttgaagagtacaagtctggtaaagaaaaagcctttaacggccttgttggtcaagtcatgaaagcctctaagggtaaagctaaccctgcacaagtaaatgaattaatgaaaaaattgattggttaa

SEQ ID NO: 1212 - DNA, 525 bp, Acinetobacter baumannii
ggttttttaatgtttaaatctcctggttttactatagttgagctcactataacactcgtaattcttgtgattatgtcagttatagccattcctttataccatcaatttatggcatctgtagaactaaaaaatacgccgcgcatactcacaattcatatacaaaaagccaaatatgacgcaattattaggcataagaatgttgttctttgtccaagttctgatcaattggtctgcaatacgaattgggataaccgcgtaatcagctttgtagataataaccgtaatctacaacatgatttaaatgaagaattattgacctctatagatcttaaccatcactacggttctatgaaattacaacgttttggaaaaaaacaaaatagtattatttttcaaggtagttctggattacccatcgagtcgaatggcagttttatctattgttcttatgaccagcttaaaaactttaaattaattcttagcaaaatgggccatgtgcgcttagaagagcttaaaaattgttag

SEQ ID NO: 1213 - DNA, 996 bp, Acinetobacter baumannii
atggatttaattcaagaaaatggacagcctcgttatgggcgttttgaatctgtaccgtccaccattcatgtccaacgttatatttataaaactccttatggaaaagtcctaaaaggctggcgcaaacaattaaaatataagaagtttaaattctgtggcattcaacataaacattatagtattggtctggccattgcagatattggttgggtcggacacggttttttctatatctatgatcatgaaacagggcaagtcattgagtggaacgctattcagccgttaggtcacaagacttatcttgatgaacagcctttgtttaatcaaagttatttttctaaatcgccttatcagttcgatattcagcatgccaatggtgtgcgatacattcgggtaactaaatatggggaaatttgtctgagcgcccgtattttctgcgccggaacagatattttaagcttgtgtacaccaacaggtatcaatggttggacctatacccaaaagcagaccactttggctgtagagggaatgttcattaataagcaaaatcaagttgtacaatttgatgaaaagacatttgcttcacttgatgatacttgcggatttttacgtcctgaaacagcttggttctggctctcatgtaacttctgggatgaacaggggcgtcgtattgggttaaatctggcctctggtgttaatgaaagctttggtaatgaaaactgcctatggattaacggagttttatttccgctcacagacgttttatttgaaaaagtaaatgatgaactttggcaaattagttctctagatcaaaaacttaatctacaagtgcatattgggtggtgccgatatgaaaatataaacttaagaatgattggcagtcagttcaatcaatggcaagctaaaattagcggcacgattgagcatgagacaaccgatataatcaattgcaaagaacaatacggtttactagaacaacattatgcaaaatggtaa

SEQ ID NO: 1214 - DNA, 195 bp, Acinetobacter baumannii
ggcggcataatccgaatgaggtctggacgtgatggagattcaatatggatgacttctgcccccatatcggctaaatacattgtggcgaaaggtccaggtaagagcgtcgagaaatcgagaactttaagtccatttaatgcagtcgtcatcgtttttttaaccactattattcgaattttcttttatattagttaa

SEQ ID NO: 1215 - DNA, 342 bp, Acinetobacter baumannii
agtcctgttttacccaagaatccagatacatgttcaggtttatcagtcattggatctaaagcttcaccagttttacttttgattgaagctaagcactcttccattgagttaaattttgcactcattatttgtggttcaggttcatttgaacagccaacaaaacttagtgaacaaatcattaaacataaaaactttttcattaattttcttccaaaactttcacaaaatcatcttcagtcaaaatacgaatatttgcaccatctttttgccacttcaatgcttgttcaaacttacgcccataactcatatgtgcccaatgaggattacccttattacatatga

SEQ ID NO: 1216 - DNA, 2460 bp, Acinetobacter baumannii
agtccaccaatggcagatttaaaattagaagtcctatttaatgcagttgataaattatctggccctataaaaacaatcgttggtggctctaaaaccttatcagatgcctttaaaaagacttcatctgaactaaaggcactagaagcccaacaacgcaaaatttcaggcttcagacaacttaaagaacaatctgaaaaaactgctcaggccattgaacagaataaggaaactcttaaacagctcaaaacggctatgaatattggtgcccctactgagcaaatggttaaagatctcgcacgtgctgaagcagcacagaaacgtctgaaggcagctcaaaaaaaccaaggtactgaaatgacggctttagtccgtgaacttaatcaggctggtatcagtgttgacaacctagctgatgatgaatctgagctgaagaataaaatccatctcaccacaatggaaattaacaaacaaaaagaatctttagaacgtcaccagaaagcccagaagcaatatgaacaaatgcaaggacgtatggccaaagcttcagatctggccaagaagggcctaatggttgctggtgctggagcagctgcaatggctattccggtacacctagcaattgactatgaatctgcaatggctgatgtgaaaaaggtcgtcaattttgaaacccctcaacagttcaaaatcatgggtgatgacattatccggttatcaaccaaactccctatggctgccaaggatattgcagctattgttgcagccggtggccaatctggaattgcaaaaaatgaactacttggatttgcagaatctgcagtaaaaatgggcgttgcttttgacatttctgctcaagagtcaggtcaagctatggcagaaatgcgtacagcttttaaaatgtcccaaacagaagtcgtctcacttgctgacaaaattaattacctgggcaataacactccagctgcagcaaaaggcatcatggatattgttcaacgtattgggcctctcggtgaagttggtggttttgcttctggatctattgcagcacttggtgccaccatccggggaatgggtgttgcagaagaaattgccgcgaccggtatcaagaatatgatgcttgctttagttgctggagaatctgcaactaaaggtcagagagctgcttataaagatctaggcctagatgctggccaagtcgctaaagatatgcaaattgatgctgaagccacaactttaaaagtaatcaaatcaatttctaaattagataaatataaacaggctgcaaccttaaaagagctttttggatctgagtcattaggttcaattgcaccattgcttaccaatatggaggcgcttgaaaagaacctatcaatggtaggtgataaatctaagtatgctggttcaatgcaagctgaatatgccgcacgtgcagcaactacggccaataatattcagttggccaagaaccaagtagcaggcctagcaatcaatattggtaacgtgcttctgcctccaattaataccatgcttggtaaattcactgctgtgatgacagttgttcaagattgggcatcacgcaacccggcattagcctcaacactggtaaaaattgctgttggaggtatagctattattgggattataagcgctttatcacttggagttttagcgttacttggtccacttgctatgctcaaaatgaccttttccacattaggcattgggtttagtgctttaggagcaattttctctccagctggtttagtcatccttggcgttattgcagccgtagctggagctgcttatctcatttataagaattgggaacctatcaaaggattctttgtgggcatttggaatacggttaaaactgccttcaatggtggtattactggagtatcagccctaattattaactggtcccctattgggcttttctatgctgcatttgcaaaagtcttgtcctggttcggtgtggaactgccagcgaaattcacaggctttggcgcaatgattttaaccggtttaaaaaacgggattatgtccaaaattggtgaagtaaaagcagctctctccggagcagtcacaggcgtcattgataaggccagaaacatcctgggcatccactccccctctcgtgtgtttatgggcattggtgattacacgatgcagggcatggcattaggtatttctcagaaccataacttacctgttagagccacacagcaagctacgcagaatgtaattggtactggtaccacagcaaaggttacaccagtgacaccgatccgagcacagcgtggtggcagctacattagtaatgacaccatacaaatcacaattaaggcagagcacggacaaccggttcgtgaaactgcacgtgcgttacgagctgaaatggtacgtctccaacaagaagaacgcgatgctcgtcgtagattcttaactgatacggagtaa

SEQ ID NO: 1217 - DNA, 522 bp, Acinetobacter baumannii
gaggatacaatgccaagcttgtttatggtgatgttgggcgggcgtcatgcacgtgctaatacagaagttcatgatgtggtcatggctgtaggagatactttggaagaagtttatcctcaacttaaacaagcttggtttggtgaggctcaaggattacatattgatgcttgggctaagctctcaggagttagttctcaaggacagaactatcaaattcattttacagatgctgctccacaaccagatgatttaaagttatatttaattaatctaggtggatataatgcacgtgaattcggtgaacttcatcgttatgagtttgtggtggcaccgaatgcggtagttgccaaacaattaggtaaacaatttatagaccggcagtggcaaaaagcacatacagaccgggtcattgatattgatgactgtttagcgatagattgcgtggcaggccgttatattcatttaataaaaggcgattttgctgcaacaatttgggaaaatacatatttgactgtgggatag

SEQ ID NO: 1218 - DNA, 339 bp, Acinetobacter baumannii
gaaattaaaatgagcttgttcatttctactgcacatgcagctccagcagcagcccaaagccctggccttttaccaaacattttgatgattgttgtattcgttgcaatcttctatttcttaatttggcgtcctcaagcaaaacgtgcaaaagaacaccgttctttaatcgaaagcttgggtgttggtagcgaagttgtctttgctggcggtttaatgggcaaagtaactaaacttgaaggtgactatgcggttgttgaacttaaccgtggtgtagaagtaaaaattcagcgtgccagcgtaatttctgtattaccagaaggcactctaaataacctttaa

SEQ ID NO: 1219 - DNA, 1119 bp, Acinetobacter baumannii
gaattaaaaatggcaaaattatttgaaacgattaatttcgattcactacaactggtcaatagaattgtaattgccccaatgtgccaatattcggcaacagatgaaggcgaaattacctattggcatgaacagcaatgggcaaattacgcgttgtctggagctggactatgtattgtggaagctacagctgtacaggcggaaggtcgaattagttatgcagatcttggcctttggaatgatcagcaacgtgaccagatcaaaactttattaggaaaagttaaaacactttctcctatgccatttggaattcagttagctcatgctggacgtaaggcatctactgaaaagccttggttgggtaaaggccaaattgcaaaagatcagccacatggttggcaaacagttgctccaagtacaagtactttttcggttcacgatgcagcgccacatgctttaaccattgccgagattaaacaaattcaacaagactttgcagctgcggcaaaacgtgcagttgaagcgggctttgagctaattgaagtacatgctgctcatggttacttgctacaccaattcttatcaccaattgccaatcaacgtactgacgaatatggtggctctttagaaaaccgtatgcgtatgacgcttgaggttcttcaggcaattaaacttgctgttcccgaaggttatccgataggggtgcgtttatctgcaacagactggatggatggcaatgagcagtgggatattgagtctacggttggtttatcaaaagccttagagcagttaggcgcggcctatattcatgtctctagtggcggtttacatgagcatcaaaatattaccattggagcaggttaccaagttcctttcgcggaacaggttaaaaaacatgtagctattcctgtgattgctgtaggtcttattactgacccacagcatgctgaacaaattttagaaaaccagcaagctgatgccattggtcttgcgcgtgcaatgttatatgacccacgttggccatggcatgctgcagctacattgggggcaaaagtcaaaattgctcctcaatatttgcgttgccaaccacatggcttaaaacagctttttgattctttttag

SEQ ID NO: 1220 - DNA, 363 bp, Acinetobacter baumannii
agaataaaaatgttcgctttaatttcaaaaataaatcctggtgcttggtggttaatattcgctattgcgacggatgtactttcaaccttttattcagctaaaggcaatggattagttaataaaactgctcaggggattgctctagttttgtatattatctcttttgcatgtgctgctattgctttgaaatatatgcaagctggaattttatatgtgttgtggtctggggtgggggtattggcgaccgcttttctcgcaaagatttttcttgggcagaacattgatgtagcaggatggattgggattggttttattacagtcggcttaatgattattgcgcaatactctaatatcgatgtttaa

SEQ ID NO: 1221 - DNA, 2145 bp, Acinetobacter baumannii
ataaaggaaataagcatgtccttattacgcttagaccgactgcattactgtattttgatgagtatgggctgtatttctagcccacttgtttgggcagaagacttaaattcagacgttgccaaattgccaacattacatgtggaagcgacacgtactgacaccggttatttacaaacaccagcttcggttttccgaatcgaggcacctcaagtggatagttcttcacaagtaaatttaactgaagttgtgaagggcataccgagtttacagattcgtaatcgtgaaaattatgcccaagatttacagctctctatgcgtggttttggtgcacgttctacttttggtgtccgtggtattcgtctttatgtggatggtattcctgcaacaatgccggatggacaaggccaaacgtctaatatcgatttaagtagtctggaccatgttgaagttctaacaggacctttttcttcactttatggaaactcatcgggtgggacaattttaacttctactaaagaaggacaagggaaagactcaattgagctgagttattcgggtggtagccatgataaaagccgagtaggacttgtgctgcaaggtggggcaaaaggggcaaatgagccaagttatattattagctcatcatactttgataccgacggttaccgcgaacatagcggtgcagaaaaagtgttaaataatgcaaagctcagctggaatcttgatgatggtagtaaaatcaactgggtaaccaactatgtaaaaatccacgccgatgatccgcagggtctaacgcatgatcagtggaatgcaaatccaaagcaacaagttccatttttaaagcaatttaatgttcgtaaagatattgaacaaacccaaacgggcgtgacatggtctaagccgattaatgacaaaaatgaactctatgccatggcatatttaggcaatcgtcaagttacacaatatcaatctattcctaagtccacccaagatgcgagcataaaccatgccggtggagtcattgattttgaacgtaattattatggcgctgatttccgttggacgggtaaagagttacttccaaataccacgctaagtgtcggtgttgcacttgatgcaatggatgaagatcgtaaaggttttgaaaactttaatttagtaaatggtcaaccttcttatggtgtcaaaggtaatttacgtcgtgatgaagacaatactttatggaatatcgatccatatttacaagcttcatggcagttcttacctacatggcgtttagacacgggtgttcgctatagcaatgtccactacaaatctgaagataactatttaagtaatggtgatgatagtggtaagacggattacgataaagttttaccgtcggtcgctttaagttggcaaattttacctgaacttatggcctatgtaagttatgccaaaggttttgaaacaccaacttttactgaaatggcatatcgacctgatggtcaaagtggttttaattttgatttaacagcttcaacaagcgatacctatgaaacaggtttaaagtcacagaaccaattaggtgattttactttggcggttttccagactaaaactaaagatgacattgtttcggccggtaactcaaatggccgatcaacgttccgtaatgcagataaaaccttacgtgaaggcgtagaatttgcatggaataaaaagttatggcgagacttaatagcgaccgcaagctactcgtatttagatgcaacctttgatgctgacattccagcattaggaaatattgctcagatttcctcaggaaatgccataccgggtattgccaaaaaccaagcttatgcctctttggcatggcagccatcgcacggtctatatggtggcgtagatgtacagtatatggacaaagtatacgtgaatgataccaatagtgacgcagcaccgagctacagtgtaacctcagcaaatgttggttatgcatgggtaatgggcgattggaaagtcaatagctttgctcgtgtagaaaacctctttgataaaaaatatgcaggttcagtgattgtaaatgatggtaatagccgctacttcgaacctgctgatggacgtaactggagtgcaggtttacgtgtaattaaacaattctag

SEQ ID NO: 1222 - DNA, 1851 bp, Acinetobacter baumannii
gcgtttcgaattttcatgtcagatatcaaaaatctccgtaatatcgcaattattgcgcacgtcgaccacgggaaaaccacacttgtcgataaactacttcagcaatcaggtgctctcggtgaccgagcaggcgagattgagcgtgtcatggactcgaatgcgcttgaaagtgaacgtggtattaccatcttagcgaaaaacaccgctattacttggttagacaaacgtacagatacaacttatcgtatcaacatcgtggataccccgggacacgccgacttcggtggtgaagtagaacgtgtaatgtcgatggttgactgcgtactacttcttgttgactcacaagaaggtccaatgccacaaactcgctttgtgactcaaaaagcctttgcccgtggtttaaaaccaatcgtgattatcaacaaagttgacaagccaagtgcgcgtccagactgggtaatcgatcaagtatttgatttgtttgataaccttggcgcaactgatgagcaacttgatttcccaatcgtttatgcatcaggtttacgtggtgtagcgggtcctgctcctgaagagcttgcagaagacatgactccgttgttcgaaacgattgtagacatcgttgagccaccagctgttgatgttgatggtccattccaaatgcagatttcatcacttgactataacagcttcgtaggtgttatcggtgttggtcgtattcaacgtggttctgtaaaactaaatactcctgttactgtaattgacaaagaaggcaatacacgtaatggtcgtatcttaaaaatcatgggttaccatggtttagagcgtattgatgttgattctgcatctgcgggcgatatcgtatgtattactggtattgatgcacttaacatttctgacacgatttgtgatccgaaaaacgttgaagcattaccacctttatctgtagatgaacctacagtgtctatgactttccaagtaaacaactctccgtttgctggtaaagaaggtaaattcgtaacttcacgtaatattcgtgagcgtcttgaccgcgaattaattcacaacgtagctttacgtgttgaagatactgacagtccagaccgtttcaaagtatctggccgtggtgaacttcacctttcagttttaattgaaaacatgcgtcgtgaaggcttcgaattaggtgtatcacgtccgcaagtaatcattaaagaaattgatggtgaaaaacaagaaccttacgaaaacgtaacgtttgacgttgaagagcagcaccaaggcgctgtaatggaacaaatgggtcaccgtaaaggcgaaatgaccaatatggaagttgacggtaaaggccgtatccgtattgaagcaactgttccttcacgtggtttaattggtttccgttctgaattcttaaccatgacctctggtactggtattatgacttcaagcttctctcactatggtcctcttaaacaaggtactgttgcgaagcgtcaaaacggtgtgttgatttctatggttcaaggtacatgcttgggctatgcattattcagcttacaagaccgcggtcgtttattcgctaagccacagttagaagtttacgaaggtatgatcgtaggtattaactctcgttcagacgatatggttgtaaacccaactaaagcgaaacagttaactaacgttcgtgcgtctggtactgatgatgccttaactttaacacctgcaattgaattcacgcttgaacaagctcttgaatttattgaagatgacgagttagtagaagttactccaaaatcaattcgtatccgtaagcgttacttgactgaaaacgaacgtaaacgtaaccgtgataaataa

SEQ ID NO: 1223 - DNA, 1008 bp, Acinetobacter baumannii
tttgggagaataaaaatgaatgcacaggtgagtgttaccgatctatttagcagagaagaaatacaagagcttacagaaccttcagatgcatatggcgcttgggccgttgctagtacatgggctgttattggaggaacatttgccagcttaattatgatgtgggattacttaccgagttgggggaaattattagcatgtatgcttgctctagctgttttagctggccgtcagttatgcctcgcaattttaatgcacgatgcatcccataaaagtttattcaaaaataagaaaataaatgatttcgttggagattggttatgtgctcgcccaatctggaacgacctacaaaaatatcgtgtacaccatgttcgtcatcacgccaaaacatctacaccagatgacccagatctttctttagttgcaggctttcctgtcagtaaaaaatctcttactcgtaaattcttacgcgacttaaccggtataacaggattaaagtttagcttaggccgtgtgttgatggaccttgatgtcatgaaatggactgtagccaatgatcaaatctggttagaccgcagtgataaaaatttcgttgactatgcaaagagtattgcaaaaaacagtacaggcgctattgcaaccaacctattactttatggtgtttttaaagcatgtggtcaacaacgtttttattggttatggcctttggcttatttgactccatttccattatttttaagaattcgttcaatggcagaacatgcaggtatgcaaaccagcaatactgctttaaccaatactcgtaccacacgtgcaggttggattgcgagaagctttgtggcccctattcatgtcaattaccatatggaacatcatttaatgtcgtctgttccatattttaaattaccgcgtatgcacaaaatattaagggaacgtgggcatgtgcccactccaccgagctattttgaagtaattcatacactttcatcaaaacaagagttaacaaattaa

SEQ ID NO: 1224 - DNA, 447 bp, Acinetobacter baumannii
cagcttttgattctgaggatggccccattctttggtgggcaaatccgaatcaaagttaatttaatcattagatctgggaggggaatatgcccaaatgaaattttagaagctttacttgaacttggcttgacccctatagattgggttgatgcaagtcaattttcaaagctaacaggtattgaagagcaaaaactatttcataggcgcaaaaattggccggaggatctagtttgggccaagcaagatggcaatatttattattcgatcagaggctataacaaatggctgacggagcaagcgcaaagtcgctaccaaaaggcgtgcggattagatcaggagcaatccaaatctattttgagcgaaacaagcaagcctacaacatcacgttaccacaccccccgactgcggaaggtattagcgcagccgctaaaattagaagccaattaa

SEQ ID NO: 1225 - DNA, 1341 bp, Acinetobacter baumannii
atcataatgattataagtacattcttcaaaagagcggttccgaccaacaatgacaaaatctgtgaggcgggcatgacacagcgattagaactacatcaggtagagcagttaacagcttgtaaaatatcactattacttggattaaatgccgagcagaattatattgagcaatttttccggtttagtcttcgcctgttgaagtgtcaaaaagctttgcttacttttaatcaggaaccttatttttggcatcattgcccggatggcatgactgcaatttcctttaaaccttcaagacacctaaaacaatgttttgctaaacaacaggtgattcatcacaatcatccttcttatcaaaatttaatcaactatttaaaagagctaaatattgaatgtgggcgtgccttagctgtccatttggtgcagcctgaccagacatctatgggatttgcagttttcttcgatgatgatgaaacttgttttgaagatgatcaaattcagttgcttctcgattactgttctagttttatgcaacaagtcgagttgaagtttaattatgaagaattaaatgaactctatgagcagcaagtcgcgctgaactcgagtaaaacaaagttcttttccattatttcgcatgacttgcgggcaccatttcatggcttgttaggtttctccgaagtgttagctaaagaacgtgaaacactggatgagtcgagtattcaaaacattgccgattatttatacgacacttctcaatcgacctataacttacttgaaagtttgctgacatgggcaatggccgaaggtggtcgctttgtttatcacccaattaattttaaacttagacaagtgagcaatattgtttgtgatgtgctgcatactttggctttaaagaaaaatattgaattggtaaatgcggtttccgaagatttaaaaatctatgccgatatcaatatgatgacttccgtgatccaaaacttggtgtcaaatgcattgaaatttaccgatgttgacggttctggaaaagtattcattgaagcgaagcaggtgggtacaaatgtcgaaatcactgtacgtgatacagggcttggcatgactgaacagcaaatggcaaatttattccatccgcgtattacagcaagctttaaaggcactgctggggaaaaaggtgcgggtttaggtttgagcttatgtaagcgttttgtcgagattaatcaggggaaaattagtgtaacttcccaaaaaggagtgggaacgacatttaaagttttattaccttctgctcaagaagttcctgaacatcatgtagaacaacaaaatacatctgaagcaaaattggtttaa

SEQ ID NO: 1226 - DNA, 918 bp, Acinetobacter baumannii
aataaaatgattgttcgtgaacagcccagtatttttaaagttttattctcttggcgagggacgatattacctaaaattttgccctctttaggggtagtaatgctgatttcggcaatcattggtggggttgaatatattaacctctatcgttttccagaaattcctttagttggctttactttaattggtgtcgtactttctatttttttaggttttaagaatactgcatgttatgaccgctggtgggaagcccgaaaattatggggggtcctgattgcgacttcgcgacatttcgaccgtgactgccggattttaactcaagcccgccgtgaacgtgtcattcaacacgttattgtattcgccaatgtgttacgtgaccgtttacgccgtcaaacagccaaccccaccgagctaatacaaaccagtggcatgagccaacaagcacttacccaactttaccaacaaaataacgcaccgcaatatacgcttagccttattcaatgggaattattacaagcgcttaaagaaggggaaatttcagatattatttatgctcaaatgaataagaatgttgcagatctaagcgtcgtacaaactggctgtgaccgtattgcaaatactcctattccttttgcttattcagttttgcttaaccgtactgtttattttttctgttttatgttgccatttagcttaggatctttgcttggcttagcaacgcctttactggttggaattttggcttatacatttttagggcttgatgctttaagtaccgaaattgaagaaccatttggcacgcaaagtaatgatttacctttagatgcaatggtacgtagtatcgaaattgagcttttggggacacttggtaagcccacacctcctccaattcaagctcaagataacaatttgctctaa

SEQ ID NO: 1227 - DNA, 348 bp, Acinetobacter baumannii
actaaagccttaatttttgcatcttgctgttgcttgttctttgcgatttgttctgctgtaagcggttgtgttgaggttggtgctgttgtagtcgcgggtttagctacagttgcagaagtaggtgctggtttatcattctgtgttgacgctgcagttggaagcgttgctggtgtcgcagcaggttcaactgctccggcagttgaacatatcaaacacaagccaagaaagcttttggttgcaagctgcatgcgtttacccttttggaaatgctttattaaatggtttgacatcaacatgactatagatgccttctttcaaaaatggttcttctttcaaccattcatctaa

SEQ ID NO: 1228 - DNA, 672 bp, Acinetobacter baumannii
tttaggcagatcatgagccaatcaaaccaaaaacgtacacgagcaaaaatctgtggaattactcgtactcaagatgttcaggcagttgttgctgctggagcagatgcgattggttttgttttttttccgccaagcccaagacatgtaacagttgaacaggcccaagaattagcaaaagtaattccaccttatgtacaaatggtaggtttgtttgtaaatgcgagtgctactgaaattcaggatgtacttgattgtgttcccctagatgtattacaactacatggcgatgaaactccagaacaatgtcaggaaattgctcgccattgtaaacgtcgctggtataaagcgattcaggttaaacctgatttggatgtagttgctgaaattcaaaaatatcaggcagctggtgccagtgctgtattgctcgatgcgtggcatcctgagctcaaagggggcacaggacatcagtttgactggtctaaattcccaaaacttgatattccattaatcttggcaggtggtttaacccctgacaatgtcattgacgctattcatactaccggtgcttttgcagtagatgtgagcggaggcgtagagtccgcaaaaggtataaaagaccaacaactcattgaacgatttatgcaaggagtccaacgtggatcagcaaaataa

SEQ ID NO: 1229 - DNA, 210 bp, Acinetobacter baumannii
atgaaagagatctatgcaatccaatacgacactgttgacgcaatttgttggcgcgaatatggccgtagcactggtgtagttgaacgagtattggaagcaaatccacatctttcagaatttggtccattcattccaatgggtaccaaaatccaattaccagacattcctactccacaaaataaagttcaaagcgttcagctttgggattga

SEQ ID NO: 1230 - DNA, 768 bp, Acinetobacter baumannii
attgattactttctaaaaatgaaaaaactaaattttttattatggacaacattagtcagcctaaattcaactgtttatgcagaagtaaaaagctttacgcctcatttccccaaattttatagctctgctgcaacccgcaaagcagccaatcaattctatgctcttggagaggcaaaatttttaaacggcgttgcagtccctttttatggcgttacggcacaaaacccaatagaagatggtttacttaaaagttttgaaaaatgcacgcctaaaagctgtagttttaattttaaacttgatgctcaacatgccaagcaattaaagcttcttgcattacctgaagtaggtgtagtacttgttccacgtaactggcaagatgttcaagcaaatgcaggggcaaatggaactggttttgctctaatcatgagtccagatcagaagcaagcgataaagctttatgactctttattttgcgttggatgtggattacccaatgcaacgctttattttcctgaactattaaaagaaagtcttgaaaatgaatatggtggtttgaaagaccctaaaaaccttatcaatattgttcatccctctaaaaaagtcgctttttttagctaccaaattcctcaagtgaacaataaaacccatggtattgccaagtatgatgatgaagacacttttaactataaagagattcaagtcaccttagataagtcgcagcagtctctagttggccctatccttaatttttataatgcaacccattaa

SEQ ID NO: 1231 - DNA, 2004 bp, Acinetobacter baumannii
gtaaactactttgagaataaaatggtattaattccacgttcatcaggtcgaaacatgccgcgacctacattgcaacaacatacgcctataaccggactcggaagcattggtaaagctgttgatgatgtgcttgaagcgcgtaaagaggaaaaagataaaaaagagaaagctgacttcgctttacagtcctctaaaattggtgctgatatcaatgttgtagacagtgaccttactcttaaaatccagactggtgagcttccttatgaagaagcagtaaagcagcggcagcaaagtctggaatcaatcaagactcagtataagactgccgtaccaaaacaattcgagcaaagctttaataattactttgaacagcattcttaccagagtgcatccaagtatttgccaatcgcgcagaaatcagaacggcaacaggcaattgtccagctcaaggacatgcgagaaaactaccttaaaaatcccaatgcttctgaaaaagaggtctggaatggattagctctgtatgcgcaatccaaaggcttacctttggctcatgttcaggatacttttaatgagtacaaaaataaccgtgccagcaatgatgtaacgactttctaccaggcgaataaatcggacaatgaaaagctgactgaactctcaactcctgaagctgtaattgcaaaacatcctgatttaactcaagaacaggctgtttactggagtggtcgtgcactcactcaaatggatcagaataaacgtgcggctgccttgcagcaaaagcaattagatgatgatgctaaagatgctgttaatgaaatgaaagcagacattgaaactggattaattccaagtgaggcggtaatcaaggctcgtttggcacgtgtacagggaactcaaaaagagtctgagtttgttcaatatagtggggccttggttgaagtccagcagttcatgagactgggagcggatgagcgcgaagcttacctcagtaaaaagcggtcagaggctcaaaatacggcgcaagataatgctaaagatgtgagttggaagttaaatcttctatctagaactcatgacaatatgctgggctatgaaaaaaataattcagctctggcttactcgattaagactggccaagatctgacggtagtacccactaatgcaattttaagtggtagccctgaagcgattgcagctctatccaaaaatattaaatctattcacgccaacaatatattagatgggactgtagggtccttaaatcctttctctactcaacaacaatctgaattaaaacagttctgggaaaaagccagaccaggggacaaattgagtttgctcactagccttcataaatctagtgccggtaatgctaatgctgcacgagatatgattaatagtattgccggtgaaagtggtgcctaccgtttatctgcttcgcttaatagccgggggctgcaagacattgccggccagattattaccgggcaggatctattggataagaacttggtaaaggttgatgacaatgccctaagaacctataccgcaacctacttagctggcatcacttcaccaggtaaaccagactttcagatttatttggagtcagttaaagctaactatgcttatttggttcaaaagtccgagaaagtagccgattcaaagggaagcatattaaataaaaccatagatgaggatttgttcaataaagcaattctaaatgtaactggtggcaagttcacttcagggggatttttcggaagtaaatctgtagtactccggcctcataccgttagtgaaaaggcttttcgtgagcagctggaaagctttaactctcgtaatgccagaacctacggcggatctgataaagacttcttcttggatctgcctttagagcaagaccctaaaaatccatacgtctattacttcaagaatggtaccaagtacatcatggatgccaccgataagaagcgtcaaacacgtttaacatttaaagtgagatga

SEQ ID NO: 1232 - DNA, 654 bp, Acinetobacter baumannii
agattggttttgctatgtcgatttgtctttttaccttgtataacaaggtttctaggagcgctgccggatatgacttccgccccactcaaggccccaattaactggaccgctagcattaccttaattggtttaccaattcttgctgcaatcataatcccgatttatgcgtattattatgattttagtgtaagcgcatgggtaagcttattttttcttttagctttaagtagcatggggattactgctggttaccatcgtctttgggcacatcgtgcttatgaagcgtcgttaccacttaaaattcttttaatgattggcggcacatttgctgtacaaaacagtattctgttttgggcatctggtcaccgtacccatcaccgtcatgtcgacgatgtagatgaagatccatattcaattgaacgtggcttttggtatgcccatatgggttggatgatccgcgatcattctccatctgaaccagattttaaaaatgcaccagacttactcaatgacaaactggtgatgttccaacataaatactatgccttgatggtcgtagcagttcacgttggtattttaggtttggttggctgggcaactggcgatttatggggtgttgtacttccttggtggtctattacgtttaatcattag

SEQ ID NO: 1233 - DNA, 927 bp, Acinetobacter baumannii
tctgtggtttttcaggtaattttaccaattttgattttattattgatggggtactgtagtgtcctcattaaactggtaacacctgaacaaattaaggctctgagtgcatttgttattaaaatttctttacctgcttttttaatccaatctttagccaataaaaacttacaagatatttggcacccagcttattttattgcttatggtggcggctctttaatcttgttttttttggcttttatcctttaccgcaagtattttaaaaatagcctaacacatagtgcagtcatatcgatgggcgcttctatgtcaaatacaggttttatgggtacagcgattctaaccatgctaatggggagtcatgctgcaatctatatatctttaaccttaattatcgaaaatttattaatagttgctttaatgcttattttggcagaagcgggtttgcatcaacagcaacggcttttgcctttactgaaaaaaacattcattaatttacttaaaaaccctgtaattattgcaattttagttgggatgagctgcattttgctagatattcatctgccttcaaaacttggacaagccttagaacttttaggaagaacagcttcgcctctagcattatttgctattggtggcagcttggttggtattggtattaccgccgtgaatttccaaagtatattgttggctggatttaatgtcatccttatgcctgttgtgatttttgggctgttccttttactgccaaacgtgagccaagagatgttatatgctggcactttacttgctgcgctgccaatgccgatcgcttttggtatttttggtcaagcctacggtttaaatgaaagagcattaacccccttaatgattagtaccattattggctttatgggtgtgagtgggcttattgccttgtggtggtaa

SEQ ID NO: 1234 - DNA, 438 bp, Acinetobacter baumannii
atgattattgtatgtgcatcgtgcggtgcaaaaaatagagtaccagaggaaaaacttaccgctcaaccgagttgtggacaatgtcatcagccattactcccgcttgagccaattgagttaaatgaacaaaactttagcaactacatcacaaatagtgatctgcctattttgatagatttatgggcagaatggtgcggaccttgtaaaatgatggcgccacattttgcacaagttgcaaaacaaaatccacgtgtcatttttgccaagattaataccgaagagtctcctcgcttaagccaagcatttaatgtgagaagtattcctacccttgtattaatgaataaaaccacagaagttgctcgaatgagcggcgcattacgcgcgcctgaattgcaacagtggctagatcaacaacttcaattgaatttcgggagctaa

SEQ ID NO: 1235 - DNA, 2325 bp, Acinetobacter baumannii
cgctgggctgtttgttcagacataacgatatttcatttttcaatcatttgcatacagacaagcttacactgtctatcgtatgatttgtgcaacattggtgtagaaatacgcaaatcctttatcactcaggttgatcagcaaggacttcatttgaaatcttggtttaaacgcctaaaaagagcgacttataacacatcatttatgtataacgtgcggatgctgattgccttttcaggaactgcgttcgtgccttattttctaggacatcaattagcaacaattcctctcactttaggtgtggtcgcagctggtttaagtgatattgatgatcgcttttcagtgcgaatcatgaatttgatttacacctatattggtttcttcattaccgcagcttccgtgcaattacttttcccttatccaatgctttttgcgctagggctgattgcctcttgtattggctggattttactcgggtcattaggtcgccgttacgcaacaatttcttatggatgtctggttgtttcagtttataccatgttgggagttcatttatttgaccagtggtatattcagccagcgcttttggttgcaggagcagcatggtacggacttattgcaaccattagctttttattatttccggttcgccaacttcaagataaacttgcggcctcttatgcttcattaggcgactttttatttgccaaatccaatttgtttgatgtcgatatgactcctgcgagttatcagcaaagcatgattgatctttcattagaaaatggcaaattaataacgatttttaatgatcttaaaaccgcccttttaacccgtttaaagggtgaccgtggacaaaaaggtactcgccgtagcctacattattactttgtcgcacaagacattcatgaacgtgcagactctgcccatatcgactatcaaaaattagctaaaattttccagcacagtgatattttatttaggtttcagcgcattttggcaattcagggtaaagcttgccaagagctaaatgaatgtattttacagcgtaaaccctatatccataacaaacgctttaagcagagtttcgagaatttacgcttatctttagtaaagttaagagatgatcagcagtatgacttattgtgggtaaatgctctttttgccttataccgaaacttaaagtctattgactcacaattactcaacttagaaacggaacagcacattcagtctgacaaagtaaagcaggctgaaaaccaacttaaagatgatgatctaaaaggttggaatgatattgttgtccgaataaaacaaaatctaacacctgaatctgtactgttccgtcatgccattcgtgtttcgattgttctttttattggatatgtatttattcaaatgacccatatcgaatatgggtactggattatgttgacagctttatttgttagccaacctaactttaacgcaacaaaacgtcgcttacgtttacgtattgtgggtacattagtcggaattattgtcggccttagcatagtatttttagtaccttctgtggaagggcaattagtcatgctaattttgagtggcgtactgtttttcgagttacgtagtaagcaatatgctcaagcaaccgcttttattaccattttggcattaattaactttaatctggacggttcggcagtcgctgcagctattcctaggtttattgataccctaattggttgtgctttagcatggtttggtgtgacctttatttggcctgactggaaattccgtcgcctaccgcgcagcattcgacgctccttacaagcacaatgtaattatttagctgaagtggtaaaacaatatcatgaaggccataatcatgccctcaactaccgtattgtccgccgagcagcacataatactgatgcagaagttgcttcgcttatttctactttagcaacagagccggacttcgaccctactcgtaaatccgatatatttgaatttttatgcctcaatcatacatttttaagttatatcgctgcacttggagcacatcgagaaaagattcaggatcaagcagttcttaacgtattagatcaagcattagatgatatacaaggtgctttgttaagagatgaaatgcctgatcttacggcacaaaatatgctacagacgatacgtcagcgcttaagccaaaatgatgaagatgaccaaaaatcgctcattattttacagcagttatcgttgatgctcagtgtattaaatcgatttagtatgttaaaacaacggctaagtcatgatctggataatgatgctagcgaacttgcatcattataa

SEQ ID NO: 1236 - DNA, 186 bp, Acinetobacter baumannii
tttgaaaatgtaccgttagcaattaatccagacatttttattctcggtttggtgaggggtggagatctgagccaaaaacagaacataagaatgtttgtatttggtcagatctgcccctcggtgggtgcttggcactcgttacgtcggatgaaacatcaagttgccttgatcatcgacgacctgtga

SEQ ID NO: 1237 - DNA, 327 bp, Acinetobacter baumannii
ttaggtgatgttatgtctacatcggatgcacagcattcagcagatttaaatgcacaaacagtttcagcaatcgccaatcttgctcgattgtcgctcaatgatacgcaatctgctgaatatgctcaaagtctaaataaaattttaggcatgatggaaaccttaaaaggcattgatacggaaggcgtagaacctttaaagagtccttttgacaatcctcaacctttacgtgctgatgtggtaactgaaagcaatcatcgggacgaataccaagcagttgcacctgcaactcaagatggtttgtatcttgttcctcgcgtgattgaataa

SEQ ID NO: 1238 - DNA, 1050 bp, Acinetobacter baumannii
gaacgaaccgtgattctaaaacgactaattggcttgttttcgccggatctagccattgatttaggtacagcaaatacacttatttatgcaccaggccgcggcattatattaaatgaaccaacagttgtggcaattcgtcacagtggttcacaaaaaattgttgctgctgtaggtctagatgctaagcaaatgctaggccgtacacctgcgaatatttttgcaattcgtccaatgaaagacggtgtaattgcagattttgaagtgactgaaaccatgttgaatcagtttattggtaaagttcacgaaaaacgtttgttcccacctgcacctcgtgtagttgtatgtgtaccatgtaaatcaactttggtcgagcgccgtgcaattcgcgaagctgtatttaatgcgggtgctcgtgatgtacgcttaattgaagagccaatggctgctgcaattggtgctggcatgccagttgaacaagcatgtggttctatggttgtggatgttggtggtggtacaactgaaattgcaattatttcattgcaaggttgtgtctatgctgattctttacgtattggtggcgatgtatttgatgagcaaattatcaactatgttcgtaaagctcacggttgcgtaattggtgaaaccacagctgaaattattaaaaaagaagttggtatggctgtttctgatggtacgacattagaaattgaagtacgtggccgtaacctcgcagaaggtgtacctcgtgcaattaccgtaacttctgatgaaattactcaagcaatttctgacccgttacaaagtattgtaagcgcggtgaaatctgcacttgaacaaactcctcctgaactttcttctgatattgctgagcgcggtattgtgttgactggtggtggagcgttacttcgtaaccttgataaattattagctcaagaaaccggtttgccagttgttgttgctgaagaccctcttacttgtgtaacccgtggtggtggtaaagtattggaattcttcgacaacccgaaccatgacatgcttttcgtcggttaa

SEQ ID NO: 1239 - DNA, 189 bp, Acinetobacter baumannii
gatcttaacgtaaaggcttggtgggcgctgacgggatcgaaccgccgacattctgcttgtaaggcagacgctctaccaactgagctaagcgcccttaacgtcttcatcgtttgtgaggtgcattatagagaatctttaacaggtgtcaaacgcttttcgacaacttttcaaaaaaatgcgaatgaatga

SEQ ID NO: 1240 - DNA, 891 bp, Acinetobacter baumannii
attaggggcgttatggaattagatttaaatcgtataaattacaacgcaaatcaaagtaaattaggcaatttatttttaggtttttttgaaggtttatttttagatggccgagtgagacttcaagaaattgaagccttaattaaatgggtagaacaatacccggatgctgtaacagttccacattttgaaccactttatcaggtgttgcttaaagcagctgaagatcctcagtttttattggctaatcaccaagaagttcaaacacatttagatttatttaaaaactcaaagtattttaaagaacatacttgtgatgtccaacgtttacatggtgtattggcaggtttggcctgtgatagtgattatactgatgatgaggtactggccttaaatgcttggctggatcgttatgattatttgaaagatgacccaatctataaagaaataattgttgctttgaatcatgtacgtattttaaaccgtgtaagtggtgataccaaggaagttctgcgtttaacgttgggcaaatatatccaactcaataattttggtttacctcaagttagagtatccagtactgaagataataaaaatcctgacttctaccatggcaatgttgagctcattggcaagacaatttgcttaactggtgcatctgctcgttatagcaaagcagaatggaaaaaagttatagaatcacaagggggaatttttaaagatgacctcaccaaaacagttgattaccttgtcatatgtaataagggtaatcctcattgggcacatatgagttatgggcgtaagtttgaacaagcattgaagtggcaaaaagatggtgcaaatattcgtattttgactgaagatgattttgtgaaagttttggaagaaaattaa

SEQ ID NO: 1241 - DNA, 1164 bp, Acinetobacter baumannii
gtcttattagttaatttgaggtttaacccagcatctataattaaaataaaaatagtcttagtatttctatttatctctttcaatttaaaagataatctagagttagcactttatgataatcaacttattaccttgatgccaattgataccatacaacaaacacttcatataagacgtaaaaaaaattcacaggtctttcgtaatattgcccgactttgggatgctggacaaaagtcacaaacagatcaagaactcttaaacgcgttacatccatggggtgaagatcataaccttcgttttgtgaataccctgtcgtatttattaagtatttgcagtattacgacgctattatttggatatttttttcatcctcatattcaatatatttggagtctattatgggcatttttaactggtttcctcgcctatttgctctatgaaccgcaaaaacctttaactgaagttattcattatttagaacagcgtatgactgctttacgttatggcctaaagtttcagcagttaccagcttatcttccaatacaagcccaacccattttagtcttaagcaaattaaaacaacactttccactttttaaccgaggcaatgaagcgaatgaaattaccgagtttgcttcagtaacatggaatgacggcattacagatcatcaagtcctgctatttaaataccactatgtaaataatttacctattcttcaagaccagaacagcgataaaaaaatagtaaaagagattcataaagacttatggggcgcttttatttttcaaatgccagctttaggtattgctgcaagtaatcaacgttctcgcttttttgaaccatacttaagcgaatggcaaagtagcgacattctcattaaccaagaactgagtattttcggaaccgaccagcaccagttagctaaagaaatgagtccaagtctaacgttaaaacttcatgatttttttcaacattttaacggtgatttaatttatcatcatgaagagcaaatattatgttatctcggtgagcaagatctttttcaaaccaccagcaaacgtagtgaaattcatgatattccagcattacgtggacatttacgtaccatgaccatgccgcaatatgaaaaatttcagcaattcatgcttaatttaattaaataa

SEQ ID NO: 1242 - DNA, 192 bp, Acinetobacter baumannii
cacaggggcttaataaatatgaatgcagttacagcaagtcaaggtcgtaaacattttacagttgctattgattggaatgagcatccgattgaatggcatttggagcaatacgggtcatggttattgttagacggtaaggcggacacccatttttttctacaacgacggccgccatccaagcaatattcgcaa

SEQ ID NO: 1243 - DNA, 996 bp, Acinetobacter baumannii
cttgaaaaagttgagcatttaaggagatctatgatgactaaagtgactcaacagccttcaaaacaatatggtcgtccggatgatgcaaaaatcatcccgttcatgaagattgctaaacctgcagcaatcttctcgatccttattactttagcgagcattttctttattgcgaccaaaggtcttaacttaggtttggattttacaggtggtgtttcagctgagcttaactatgctcagccagcaaatcaggcagaagttattcaggctctcgacaaagctggttttaaagatgctgtagtacaaactttaggtagtaataaagacttacttgttcgcatgccagtacaagatattaaggttgaagatcttaataatgcgattaccaaagctgtgcaattgccaaacaatgcagcagaagttcataaagtggactctgtaggtggtcaggtaggtaacgagctttatgttcgttcggctggtgctgttgcacttgcgctgattttaatgttgatctatgtcaccattcgctttgagttcaaactcgcaatgggtgccgtgatgtctttattccatgacatcatcatcattattggtgcatttgctttattccaatggccatttgacctaacagttttagctgcggtacttgcggtgattggtttctcgcttaacgataacatcgttgtttcagaccgtatccgtgaaaatttccgtaaaattcgcggtgcaactccacgtgaaatcgttgatattgcgttaactgagactttacgccgtaccatccatacctcaatgacattattgctcgtagtacttgcaatgatgttcttaggtggtgatggcttacactggttctctgttgcaatgtttgtcggtgtctttgtcggtacttactcttcgatttatatcggtacagcatttgccttatggcgtggtcttaaccgtcaagacttcattgttcaggtcaaacctgaatttgaagatgaaatcccttga

SEQ ID NO: 1244 - DNA, 237 bp, Acinetobacter baumannii
aaatatatggttgtaattatgcttcaaataactccaattcgaattcaattcagtactgtatgccaattacttgatgtaacccgtgagtctcttcgacacactattcgtaaagaccccacgtttccaaagccaatgaaaatggggaccacaaaacaagctcccgttttctttgactatcaagagattgttgagtggcataacagcaaaaaaactgttgctgcagaaatggaggcttaa

SEQ ID NO: 1245 - DNA, 474 bp, Acinetobacter baumannii
cggtgcgcggtttacgcatccgtcttttcagccaatatagtttggataatcttcatcatgatgcgaactcattactgtggctctttaactgaagcccaaatcgaccagaccgttacattatgcggttgggtacatcgtcgccgtgaccatggcggtgttattttccttgatatgcgtgaccgtgatggtctcgttcaagtggttattgacccagatactccagaagcatttgcaactgcagataaagcacgttctgaatatgtattaaaaattacaggtcgtgttcgtcgccgttatgaaggtactgaaaacccaaatatggtgagtggtcaaatcgaagttttaggcaaagaaatcgaagttcttgctgcatctgaaactccaccattcccattaaatgatgacactattaacgtgtcagaagaacaccgtttaaaatatcgtttcttggacatccgtcgtccacaaatgtga

SEQ ID NO: 1246 - DNA, 597 bp, Acinetobacter baumannii
gcttcggcggtaccaaacatgaaaaatttttcacttattgcatttgcggtctgtttaagccttcaaggatgtatgcaacacgaaagtattgcccatgagcacagacctcacgattggggaaccttagtttctcaaactcataatttttatcaaattagcaatgatgttttccggagtgaacagcccgatgtagcaatgattcccgaattaaaacaccatcaaattgggactattattaacttaagagccaaagcatcagatgatttagtctttaaaaatgaaaactttaatcttgttcatattccgattaatacatgggcaattgatcgacaagatttattagaagttatgcagcaaatccagcttgccaagcaaaataatcaacgtgttttactacattgctatcatggttcagaccgtacaggggccagcgtcgccatgtatcgaattatttttgaaaactgggcaattgatgatgcagtgaaagaaatgaaacaagggggttatggttatcatattatttggaagaatattgaccgtttatttacccctgaaaatgtaaaatggattcaacagcaactgtcgaatccatcttaa

SEQ ID NO: 1247 - DNA, 264 bp, Acinetobacter baumannii
ttacctttttttaaggtaattaattactctttgattaccactaaattaccttttattattcttgtatttgtatatataaaacataaggttaaatataaaattcgtcaaccaattacctttattactcttttccgataccagcgcatactttttttaattatcagattttgccctagctttcattgtagatatatctcggataaaaatcaccataaaacgtacttattccaccttttttccacctgttttgattcattaccttga

SEQ ID NO: 1248 - DNA, 750 bp, Acinetobacter baumannii
agaaacatattgaatttgagattaatcatgagtctgctcgctttctcctcatatgcattaaacggtgtagatgcacaaaagtttttacaaggccaagtgactgtagatactgaacgtttagctgaaaatgaaacacgctatacagccatttgtgatcttaaaggccgcatccattttggcttgtggctaaaaaagaataatgcagaaagttttgacattattgtcactcaagatcaagctgaagaattcgcgaagcacattaaaaaatatggtgctttttcaaaaatgaccttaagtgaacaaggtgctgtattcccaaaagttgtgaatggccatactgagttcagctctacagaaactgatatttccgaatggcaaaaacaagccatcatgacaggtcaagcatggattgctcaagcgactgaacatgagtttcagccacaagaattacgtttacatcaacgcgaaggcgtcaattacgataaaggctgttacttaggtcaagaaattgtggcgcgcctttggtttaaagcaaaaccaaaacactggttgcatttagttcaaggtacaggtgatgcacctgctccagcaactcaactgcacaatgacgtagaagtggttaatagtacccaaactactgacggttatattgccttagttgttgcgaaacccgccgcccttcaagaattaggtcttcaagttttagatttaccagaagctttaagtggtgatgttgctagaccacaataa

SEQ ID NO: 1249 - DNA, 1029 bp, Acinetobacter baumannii
atgaaaatattgcatattgcaaattttggctttaataaacaaggcgcacatttttactgcacagaccgtaaaatttctgccggattaattgaaaatggccatttcgtttatgattttagtttccgtgacatggcgcgaatggggacaatctttaaaaccaaaaaattaggggcaaagtgggccaataaagaagtactcaaggttgttaataatattgagcctgatttggtgctgattggtcatagcgacttgatgagtccagatgttttaagacagattaaagaatcttatcccaatactaaaattgcattttggtatgttgacccgctttatcttgaaaacaaacttgactttgtcaaagcgttctctccatatttagatgctattttctgcacaacaggtggagaatatctccaaaagttaaaacagccccatttaagtgtggcttatatgccgaatgttggtcaccgcaatgtagaaacactacagcaattttcaaactcaaagactgacaaaacttttattttctgcggagttgtttataaagaacctgagcgtgagaagttcttaaaggatttggcagatgcgttgcaacaaggccatgtgaactaccaatattatggttgttttgaacaacctggtgtctatggtaaagcgtattataaagttctatctgaaacaaaaatgggactgaattactcacgccgtaatgatgtaactctgtatagttctgaccgtattgtacagctgactggtaatggtttactcacttttagtccaagaattccgggttttgagaagctctatactgagcaggaagtggtttactttgatgatcagtttgacttggccaagaagatccaattctttgatcaaaatccagagcaggctgaaaaaatagcgaaagagggctgggagaaaacacgtaaatctttcaatgctaagcgtattacccaatttatggttgaggtgacgtttaaacagcccctttcagaagattatgaatggtcacatgaggtttatgcatga

SEQ ID NO: 1250 - DNA, 315 bp, Acinetobacter baumannii
gttttatcattttactcccccattcacctgttcaataacacaatcgaaccagttgctttctttagtcacttcgtaacatatgaagtattgaatgcctatcctcaacctccaaatctctatcaccgcctctcgtttgtattcttattcaaaattcacacccatgctgaatgtgaaattttgccattacagagtacttatcaaaacaaggatacaaatggggatatattgacaaatacacccacaattaaaccttatatattaaagactacagaaaatagttcgagtcccgcagggcgcacacttttagtgaattaa

SEQ ID NO: 1251 - DNA, 213 bp, Acinetobacter baumannii
tattcccaattttgggattttgaacgatcccgtttttgggattttgaatgtacccgtttttgggatgcagaacctatcaatgaacctatcaatgaatcaatcatctctcttttaagagagcaccgtcttaattcaaggtcaaatcttcttccatattcaaaaaataaacttcaaaagcaacttgatatatgcaccaattttgcactggcttga

SEQ ID NO: 1252 - DNA, 1404 bp, Acinetobacter baumannii
gaattaaaattgcaagaatataaagatcccctgaatttaaatcagagttatagtttcgaagttttagttagaaataatgatacaaattttgcgggtaagctaaacctttcacctgaagggtgtactttaagaataatgggtgagcgagaatttacatcagattattatactattgaaacttttgaatgttacacatcaagaaatcatttcttattgtcagaagttaaatttaaatctggtagatttgcaagtcttaggttaaataatccacgcgatcgaggacggttttttgaactagagtttactgtgggctttgtaattaaagcgaatactaatacatcacttaaaaaggaggcgatatttagtggctttagtattgaagctgatatgattagaaaatggacaggtattacaaataaacaagaagatttattactgcaaaatagtggtagttcgtttccatctaatgctgatgatgatttgaaattatttgaaattccattggaaaatataggttttttatatctagcttatagtttaaatttgcatactgatattgatagtatgagttctggcgtaaaacttacaccacaattgggtgcacacttttttgagtgtaaaaatattagtttgttgctaaaagaaattaggaaaatatatgcattactttctttcttttggggagacgattttacaataaataatttaaaaatcaccttgccacatgtaagaggtggtggtgcttcgggttactacgcaagtaattatataactaacaataaaatgtctccaatattgccgttagggtttgatgtaaggagtcgctataattcttacgaaggtttgccattagatctatttcagaaatattataatttagaggatagtaaagttgaatattttattaaatatcttcgctataaaagaatgaaatcaaatgaagaaaaatttcttggatattttcggatacttgaaaggctagttcatactacaggcacatatgttgatgaagaaattttaaaaatattattggagcgatcaaaaaaatatttaattaaaaagttaaaaagccgtagtagtgatatcagaagtttgtgtaataagataattaaaggtaatcagggtaaatacgtaactcatgattgtatttcacgtttttttgatgagataccagaagagataaaagttactatgtcatttaaacgtagtgatatccaaggaatttgtaaactaagaaatgatatgacacatgcgaatgattatattgtaagtgaagaggatttatatcaatacactaagtttattcaccaattacttatttttgcattggtaaataagttactcggcatttctttggatattttaattccacttagtgatagatttaaattttccaacatttaa

SEQ ID NO: 1253 - DNA, 1428 bp, Acinetobacter baumannii
gagggtttttctatatattctatatatctatctctaaaaaacagcccattaagaatgttcgatcttattatcattggcgcgggtacggctggtattagcgcttataaagaagcagtaaaatacactaataatcttttaattataaatgatggcccttgggataccacttgcgcacgtgtaggatgtatgccaagtaaagtcttaatctctactgcaaaccgtatgcatgatatacaaaatgctcaagaggttgggctgagtgcttcagcagatattaatactgatcaggttatggagcatgtgagaaccttacgtgatcgttttactaaggccacagtaaaagatgtcgaacaatggcccactgaacataaaatttcgggtaaagctcattttattgatgcaaaaactattgaagtaaatggtaaacggtatcagtcaaaaagttttattttagcagtaggctctacacctaattatgatcaaagttggaaacaagaattaggtgatcgtcttattactacagatcaaatatttgaattaaacaccctacccaagtctatcgctattattggaagtggagtaattgccttagagattgcccaagccatgcatcgtttggatgtagaaaccactatatttgctcgtagtaaaagaatcgggatatttactagtcctaagctacaacagctcgctcaagaagaactgagtaaagagttaaattttttattcgagacattgcctcatgaggttaagtctacttctgatggcgttatattgaattataaaattgatgaaaaagaggaatctatccaaactgagtatgtgttatctgcaacaggtcgttcgagcttacttgacacgctaaagctagaaaatattgataaatcttttaaagatattaaattactacctgtaaatgcaaaaactaaacaattagatgactatccaatttttattgctggtgatgcgtacacctctacgcctttacaacatgaagctgcccatgaaggtaaaaaagttgtttataactgtttaaattatccacaggtaaacgcagttaagacacttactccattaggaattatatttagtcatccagaaatggcaattgtgggacaaagttataaacaacttaaagataatggagtagattttgttacaggtgaagcatcttatgaaagacaaggaagagctatcgtactcgggaaaaataagggtgctattgaagtttatatagagcgagaaagtcagaaattgcttggtgcagagttatttaccgaagctacagaacatatggctcatctattaagctggattattggagaaaagctaactttaaatgatattttagagaaacctttctatcatccaacactagaagaaggccttcgtactgctcttaaacatgctcgcagacagttgaaataa

SEQ ID NO: 1254 - DNA, 693 bp, Acinetobacter baumannii
aaaccattttcacaagctccaattgctgaaaacaaaaaaactctaacgcaaagtgttggcatgaatgctgacattaatcgtcgtcttgaaaatctgattcgcttcggaactatcaagaccataaatccgtctaaaccaattccccttgtcactgtagatcttgacgatatcgttacgcctgaaattcgcttttttaatgcacgttccggaaacgactcaacttgggatccaccctctgaaggtgaggaagtgatagttgtttcaccatgcggtgatatcggtccaaccagcatagttttttatgggctttataacaatgaataccctgccccatctgatgatttaaataaaaaaatacgagtatttgcggatggttgtgtgattgcctatgacgttgctgcacatcatttgtctgcagttttaccttcaggtgggaaagctattgtcacagctgatgggggtgtaacagttaatggtgacaccaccatcaatggaaatcttcagatcaatggaagtactgccatgacgggaaaccacaccgttatgggcagccagctcgttcaaggtagtagtcattcaactggggcatttagtactgaagcagatgttaaagctggagacattagtctcaaaaatcacaaaacatctggtgttcaacctggagatggagaatctggagggccaattccatga

SEQ ID NO: 1255 - DNA, 936 bp, Acinetobacter baumannii
gcaaatatttccatatcaaaagccatctcacccgatggctttttttacattaatgaatacacatggtttttactgttgagatcagttataacttcccaagagtttgtgcaaaaaacaaaaatcatgatccataaaattcatcatttaaaatgcggcagtatgtgccctgtatgtgcacctttatttgggcagaaaggctggaaagctgagattgtttgtcattgtcttttggtagaaactgatcgaggccttgtactgattgataccggatttggcctacaagattatctacacatgcaacagcgccttggctctttagtcaaacggttggggaaaattgaaccgaatcttgagttcagtgctattcaacaaattcagaaactgggtttccatcctaaagatgtgcagcacatttttgtgactcacctcgactttgaccatgcaggcggaatttcagactttccccacgccactgtccatgtgctagctactgaatacaatgctgcgcaactgcctaattttaaaggtaagcttcgttatagaactaatcagtataaacaacatcggtactggaactttgttgagtatcaacaaggtgaaaaatggtttaaccttgaaaaagtaaaaggtttccccctatttcaagatgaaattttaatggtgccattattgggccattctgccggacattgtggtattgcgataaaacaacaaaatcaatggttattattttgtggagatgcttactactcacacctagagctaaatccagcaaataaattaagatctcttagccttctagaaaaaacatttgcagaagacaatgaaaagcgtcttattaacctaaaaaaattacagcatctggctcaacatgagccaacgattgagatcatttgtgcacatgacccccatgagcttcggcggtaccaaacatga

SEQ ID NO: 1256 - DNA, 1095 bp, Acinetobacter baumannii
accatgatttccttttttatcgaattttatctagtaaattactgcatttatttggatagatgtttaatgcagccgatcgattttgtaatgatttgggtggactcaaccgatacgaaatggcagcagcaatatatatattataaatccaaagaaacaaaaaccaagattgatgagctcgttgatcaatgtcgttatcgtgactggaataatcttcattactggtttagatctgttgagaaattctgtccttgggtaaggaaaattcatcttgtaacctgtggtcattttcccgaatttttagtcaaaaatcatcccaaattaaatttagttactcatgatcaaattatagaacctcattgtttacctacgtttaattcacatgcgattgaaatcaatattcataaaatagaaggcttggcagaacactttgtttattttaatgatgacacctttattaatagccctttagaaccagagttcttttttaaaaatggtttaccttgtgatggtattcaattacaacctttgatggtggtaggggaagagaactttttaggcgcagttgctttgacggatgtcgcaattattaataaatattttgataagagaaaactctttcggagtaatccttctgcactttttaatcatcgatattcgataagtaataatttgggcaattttttaagcttatataatcgaaaattctcaagcttttatagtactcatttaccccaaccgtttctaaaatcggtgtttgaagaagtttggagaaacgaagagagctacttaaaagaagtatcaagtcatcgatttaggcaacctttagacgttaaccaatacctatttcgattatggcagttatgttcggctcgtttttacccagtaaatatatttcagcgtgggcagaactttaatttaagaatacaaaatcttcctgaaattaatcatgttattaagtatgagcaacttccacagatttgtttaaatgacgatgaacacgtggtcgattttgaaaaattaaaaacagaaattatccaaatttttgagcaaaaatttaatactgtttcaagttttgagaaaaagataacacattaa

SEQ ID NO: 1257 - DNA, 492 bp, Acinetobacter baumannii
actatgccttctttcgatattgtttctgaattagagttatttgaagttaatcacgctgtacaaaacacccaaaaagagattgcaacacgttttgacttccgtggtcatgatgtttctatcgaattaaatgaaaaaaataaagagataaaaatcagtacagaaagtgatttccagtgtgaacaagtttataacatgttagaaaatcacttttataaacgtaaaattgatgtgcaagcgcttgaccctcagaaagcaacagcatcaggcaaaaattttgtacaagtgattaaactaaaagatggccttgactctgatacagcaaaaaaaattaataaagccattaaagaaagtggcatcaaagtgcaatcatctattcaaggcgacaaaatccgtgtaactgataaaaagcgtgacactttacaacaagtgatggcttttttacgtgaacaacaatttggtctgccattacaatttaataactttaaagattaa

SEQ ID NO: 1258 - DNA, 1014 bp, Acinetobacter baumannii
aattgcaattcgaaaattaacgtcatagtgcaaagatgggccatgaaacagcttaaattgtgggttctcggactttctatggtgttggccgggtgccaaaccacctcacacttatctgccttaaaaccgcaaacggcagaggcatactcacgtttcgtcgatcagccttttgcacagcttaagaagcagcataagaaaccagtagttgcattagtgctaggtagtggtggtgcgcgaggttatgcacatattggtgttattgaagttttagaacagcatggtattcgtcctgatttcattgttggaaccagtgcaggaagtattgttggggcaatttatgcgagtggaaaaacgcctgatgaacttcgcgatactgcattgaaaatgaaagcggcagatgttcgtgacatcagtattggtttaaaaggtttctttgatggcaaaaaagttgaagactatgtaaaccagcaagtaaataacttgccgctcgaaaaaatgaaaattccgatgtatgtggtggcaacagagctaaagcatggcaccaaaactgtatttaattatggcaatacggggcaagccgtgagagcatcagcctcaataccaagcatgtttgtgccgactaaaattggtaaatctgaatatgtagatggtggtttagttagtccagtacctgttgaagtagcccgtgatttaggagccgatgtcattattgctgtcgatattctggctcaacccatttatacggaaacctccaatgtatggggactctttaaccagaatattaatattatgcaaggacgtttggctgccgaagaacttcaatatgcagatgtagtaattcaaccagatttaagagaaaaagcacatatttttgatgtaaaaggtcgtgaagcaaccatgaaggcaggcatagatgcagcaaatgcaaaactgtctgatattcagtttgcgattgatgaaaaaatagctgaacagaatctatctactgacggtttaagtgcgcaaacgcaataa

SEQ ID NO: 1259 - DNA, 843 bp, Acinetobacter baumannii
acacaggattcagaaatgaagaaatccaaatttttccgtgttgccgtagctggatccacgactgatggtcgcgtgattgaggcaacatggattcaacagatggccaaaaactacagtcaagatatttacatagcattaggtaatttagaacattttcgttcaattaatcctgatagtacttttggcacatatgcaaaagtaattgcattaaaggctgaagaagttgaaatcaacggtgctaaaaaatgggcattgtttgcacaagttgatgcatatgatgaattgattgaactgcataagcgtggtcaaaagttatttacttcaattgaagtaaacccaaattttgctgacactggagaagcatatcttgtaggacttgcttttactgatacgcctgcctcattaggtactcagatcatggagttcgcatcaaaaaatccagaagcaaacccatttgttggtaaaaaacaggataaaaataatttatttactgctgctgaagaagctgatctccaatttgaagatggccaagatgcaccagcaaaaggtctgttttctaaagttttggattggttaaagccacaacaagaacaacaagaaaatcaaaataaagaccaattcaaagaagttgcagactcacttgaagcgattgctaaaacatttggtgaaaatcaaaccaagttgaaaaaggtcgatacaagttattcagaactgcataacaagcattctaaattggaaaaagaattcaatgaccttaaagccaagcttgaaggtgaagaaaatccaagcacaccttctgcacctgaaaacactggcaacttctctgaacaaatcgagtgctaa

SEQ ID NO: 1260 - DNA, 894 bp, Acinetobacter baumannii
aaagagacctcgaccatgaaattaaacggcattattggctaccctgttactcccttttctgatgacaataacatcaatcttcctgttctaaaacaaatgctggatttgcttattgaaaatggctgcaacgcgattgcacctttaggcagtacaggtgaaagcgcttatcttgaatgggatgaatggtgcttagtcgcgaaaacttcaattgaaagcattaataagcgcgtgcctgtcattattggaatttcagaactcacgactaatcaagccatcaaaaaagctcaaatcgcgcaaagctatggtgcagatgcacttatggtgattcctgtatcttattggaagctaacagaccaagagatttttgaatattatcaagcaattgcccaagaaactactctaccaattatgatttataacaaccccgcgaccagtggtgttgatatgtctcctgaattaatcgtgcgcatgtttaataacattgcaaatattatgatggtaaaagaaagcagcggcgatattcagcgcatgcataaaatttatgagctatcaaaaggtgaacttccgttttataacggctgtaaccctctagctttagaagctttatgcgcaggagcaagcggttggtgtacagcagcacccaatctgttaggtcaacgacctcaacagctcattgaacatgtaaaaaatggcgaattggaacaggcccagaagtcattttatcagcaacttactctactacgctttattgtaagtggtggtctgcctaaaacgattaaagctggtttacaactaaaaggtgtcgctgcaggagcaccacgcaagccgttgaccaaagccacggatattgagcttaatcagttaaaacaactactttctgaaatagaaaactaa

SEQ ID NO: 1261 - DNA, 222 bp, Acinetobacter baumannii
aatttaaaatctgaggtaaaaatgaaagaactgtctgtctaccctgtaatatacgaccagaaagtagcatggggagatatggatgcttttggtcatgtcaataatgtgcaatattatagatatattgaaagctcacgtattttatatatggaaaatgtaaatatattgactccaaatataggcagagtaaaacttgaagtgcgacataaaccacctaattaa

SEQ ID NO: 1262 - DNA, 951 bp, Acinetobacter baumannii
ggtgtattgtttgaccagcccatgcttgaatttatgaaaaccttgaaaattgctacacgacaaagcccacttgctctttggcaggcagaacatattcgtgctcgtttacaggagcttcacccagatttaacggtggagttggttaagtttgtcacgcaaggcgataaaattttagatacacctttagcaaaaattggtggcaaagggttgttcgttaaagaattggaagcagcacttttagatggtcgtgcggaccttgctgtacattcaatgaaagatgttccgatggcattaccagaaggtttaactttggccgtaatttgcgaacgtgaagatccgttagatgcttttgtttcgaatcaatttgaaaaatttgctgatttgccgcaaggagcaaaagttggcacctcaagtttacgtcgtaaatcacagattttaaaacaacgtccagatctacaaattattgatttacgtggtaatgtcggtacccgcttagcgaagctagacgatggtcaatatgatgctattatcttggcgagtgctggtttaaaacgtttaggattggcagaacgcattcgccactgtatcgagccaagtgtaagtttgcctgcggtgggacagggcgctcttggtttggaatgccgtgcagatgaccaagaagtgttggctttaattcagccacttctacacccagagacagatgtatgtgtacgtgctgagcgagcattcaatgcttatcttgaaggtggttgtcaggtgccgattgcaggttatgcaacactccaagatggtaaaattcatattgaaggccgtgtaggtagtgttgatgggcaaacattattacgggctgagcttacagatgaagcgaataatgctcagcaattaggtgaaaaccttgctcggaacttacttgatcaaggcgctggtgatttattaaaggccctttactaa

SEQ ID NO: 1263 - DNA, 933 bp, Acinetobacter baumannii
aggaagttgtttatgataaataaaaaaccgcgtattccaagccctgttcaaattcctgaacatttaagctttttacaaggttttcgcgactatctggttgcacaaacagtcagtccgcatacgcgcaatgcctatttatctgacctgattcaatgtagtgaacttcataaaaaaaatagattgccagattggacgagcgatgacatttctgatgtcctcattgaacttaccaaagtagggaaaagcccacgctcaattgcccgttgcttatctgccctacgtcagttttataaatttctacgtgaacagaaattacgaagtgataatcctgtagctactcaccattcaccaaaaattggccgagccttacctaaagacttgtctgaagaagatgtagaagcgctcattcaggcgccagacattacaacggcgttgggcttacgtgaccgagcaatgtttgaagtcctttacgcttgtggtttacgtgtctctgaattactgaatttacgcctcgaacttattaatttaaaacaaggttacctgcgtattacgggtaaaggtaacaaagaacgtttagtgcctttaggccaatatgcctgcgattgggtggaacgctatttaaacgaggcacgtccacaactttataaaagttcaactgactatttatttttaacccagcacggtggaattatgagccgtcagaacttttggtatgccattaagcgttatgcgctacaggccaatattcaggctgaactttcacctcataccttacgtcatgcttttgccacgcatctacttaatcacggggcggacttacgcgtagtacaaatgttactgggtcatagtgatttatcaaccacgcaaatctatacgcatgtagcacaagtcagaatgcaacaattgcatgaaaaacatcaccctaggggttaa

SEQ ID NO: 1264 - DNA, 786 bp, Acinetobacter baumannii
aggccctttactaacgctatgttgtttattaatacccgacctgattcgcgtgcggctgaattaactcatgctttgcagaagaaggggtttcaggtcgagtctttacctcttttagaactggttgctcaacctttttcagaatcactctctcaactctatcagcagttaactggtgcacaagcgattgtagtggttagtcctactgctgttgatgtggggatgcagtatttaacacaaagtggtttaaaaatagatgagctaaaacatattcaatggattgcggtgggacaggcgacggctaatcgtcttcacgactatgggattgaagcgcatgttcctgaggttgaaacttccgagggaatgcttaacttacctctccttcatcgtatgcaaaaatcaggtagcgtagctttttggagaggtgaaggcggccgtcaatttatgatggaaactttgcaacagcaaggaattcagattttaaattttgttctatatcgccggcagtgtccgcaagcttcatattcgacattcaaacatctgacacagaattcaaattataatttagataaatggctcgtcttaattactagtgaggcgagctggaaatactggttagagctttgtttaaaaaataaggcacaacctgattgcgtatatttagttttaggaccacgcctttttcaacttgttaaagactatcgcgatcagcaacaagctcattttcacattattcaacttgaaaatttatcgccttcggggatgattcatcacattcaggcattataa

SEQ ID NO: 1265 - DNA, 663 bp, Acinetobacter baumannii
gccatgtttacaggcattattgaaagtttaggtaaagtagaaagcctgcaaagtgtaggtggcgatgtacgtttacgtattcaaaccgatttggatatgtctgacgtacatttgggtgactcaattgcaactaacgggatctgtctcacagtgattgagtggggtgataactggtatgcggctgatgtgtcccgtgaaagtttaaaccgcacgactttgggtaactggaaagtgggtcaacgtgtcaatgtggaaaaagcgatgctgccgaccacccgctttggtggacatattgtaagtggccacgttgatggtgtaggtgaaattaccctagtacgtgaagatgctcgctcaatttattttgaagtgactgcgcctgtagaacttgctaaatatctggcagagaagggttcagtaactgtagatggtattagcttaacgattaatcatttacgcggtaatattttaagtttaaacctcatcccacatacagcagagcgtactaatattggaacgtggcaagtgggtagcaaggtcaaccttgaagttgatgttttagcacgttatatagaacgcttattactaggtgataaagctgctgaacagaaaactgaatcaaatattagtatggccttcttagctgaaaatggttttttaaaataa

SEQ ID NO: 1266 - DNA, 1335 bp, Acinetobacter baumannii
tcaagatatacgcttaaggttaatccctacgcaagagaaagtatgaattcagagccttcggtataccacaaacgtcgtcatgcagcccgcacgacagacgaatatcttttccatcagcttgtcccgtacttgggtaacaagcgccgattgctccacttgattttagaagctctggaaatcacagggacgctgaatagtaagaaaaagaaccccccgatttttgctgacttttttgcaggcagtggagtggtttctcgtttagcacgtcaaaatggataccgtgtcattgcaaatgactgggaaccttatagtcatgctttaaatcatgcaattttagcgtgtgtcgatgcacctgcttttaaagagttgggtggctatcagaaagcgattgattatttaaaccgcttacccgaggttaaaggctgggtaacacacaatctttgccctcgtaatgatgatgtctatgatccatctcgtgaccgattattctttaaacgtcgcaatggtatgcgtatcgatgcgattcgccagcaaattgcaacatggcaagcgcagggtgcaattaatgatgtagaaatgagtgctttgcttgcgccattactctattcagcaagttttgtgagtaatactagtggtgtatttaaaagcttccatcaagggtggggcggacgtacacaaacagcgttagagcggattgaatcactactttggttaactccgagccgtttctgtgagattggcgaccgtaaacgccctgctgctgaaatgtggtgtgtagatgctcagcatctagcaaatcaaatgagcggttttgaagtagatgtagcctatcttgacccaccttataatcagcatgcttacagtagtaactatcacgttttaaatgcgttgacgttatgggatcaagtcgatttaccaccgccagatacgaaaggctataagagtggtattgaccgtgcatggcgtaaagaacgtccaagtccttataactcttctaaacatgcaaaagatgcgtatgaaaaattactttcaaccatcaatgcacgttatattctgaccagttattcgaccgatggtaacattgagccgaaagatttactgatggccaatctggaacgtggaaaagtgactttacttactcaagatgttccacgttatcgcgtaagtaaacaacgtcagtcagagcgtgcacgtgtgcttgagtttattgtgattacagatactcatgccaaaccagggccaccgttacgtcaattgttaggccagctttaccacttcgccgagctaggtggtgtagatacatcaggtaatagtacacagctcgcactttggtaa

SEQ ID NO: 1267 - DNA, 669 bp, Acinetobacter baumannii
aatgtaaatactgttgagcaaaggagaactgtggtggcattaaatgtcgggcaagattttaaaaaaagatggttaaatgcgcctgaagctgtccgtcatgcttatcaacaggatttggctcgtatttgtgatttattagagcctcagacccctattcaactgtgggttttaaatgacgaaaaagcgcagttagaatcacaacaaaatattgaaaaggcatatgctgacttaaaggcagagttaatcgagcaagcgcgaattcgtcgccagcttgctttagaaaaagctcttgcagataagcgcgcaaaagaagcagcttatgctgctgaattacaagctgacgaagttcgtaaatttagtgaacaaacggaagctttgcaggctttacgcagtcatttagaacaagaagttgctgaacatactgcacgttatcagaaaaaccctgaaacgccagcaattgactattcttctggtgcaaaacttagcattactgacgatcaaatcttatctgagcttgaaagtgtacgtgttcgcctagaacttgaagctgaaagcttaattgaacaggcagtaacagttttccgtgccaaactgcatgctgcggctcaagaagaaattgaatatattttaaagaattctaacttttctgatgaaaaaatagaaaagtaa

SEQ ID NO: 1268 - DNA, 459 bp, Acinetobacter baumannii
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaaatagcaaagcgtttaaagacatttcctgatttggatcaaacaatgaatgtaagccatacaacgatttattcaacgatacgagcattacccaagggtgagttgaaaaaagacttcttatccgtcttcaccacgagtgcggcatccgactag

SEQ ID NO: 1269 - DNA, 864 bp, Acinetobacter baumannii
cttataaaaactggatgtattgatccatccagttgttttttattctgccttcacctacttaatttggtcaactggactggagaagagatgaagactgcttctgtaaacaaacacgacttgatgcaacacgcacagcaagacatgcaaaagtggattagcgacttagatttaacagaccgtcaaaagcttgcactgacttgccgtattttatttgatcatgggcatgacgctggtttagcgggtcaaattacatgccgtagtgaaaataaagaaacctttattactcaacgtttcggtttaggttttgatgaaattactgcttcaaacttgcttgaggtgaatcaggacttagaacccatcaatcaagaaggcatggcaaacccagccaaccgtttccacacatggatttataaagaacacccagaggtgaactgtattatccatacgcatcctacctatgtagcggccctgtcgatgctacagattccgcttatgatttcccaaatggacgtctgcgcactttacgaagactgctcatttgtaggccattggccgggagttcctgtaggtaatgaagaaggtattttgatttcttccgctctgggtaagaaccgtgctgttttgttgtctcatcatggtcaattggtcacaggaaaaaccattgaggaagcatgtaacttggctcttttaattgaacgcgcagctcaactgcaacttttagccatgtcttccggacaaatccagcctatcccccacgctttggcagcagaagcccatgattgggtgtctactgataaacgcaacaaagtgaactttgcttactacgcacgtaaagctttgaaaaaacattctgactgtatttaa

SEQ ID NO: 1270 - DNA, 1440 bp, Acinetobacter baumannii
gccaccatgaccacatcttcaaatccccctaattcagcagccccaaaccaaacctcaggtatgtggggtggtcgtttttctgaagcgacggatgcttttgtagccgaatttaccgcctctgttcaatttgaccagcgtttttataagcaagacatcgctggttctattgcgcatgctaccatgcttgcgaaagttggcgtactgacagaagcagaacgagacgacattattgaaggtttaagcaccattcgtgcagaaattgaagctggaacttttgaatggcgtatcgatcttgaagatgttcacatgaacattgaatcacgtttgactcaacgtatcggtattacaggtaaaaaacttcacactggccgtagccgtaacgaccaagttgcaactgatatccgtctttatctccgcgacgaaattgacgacattttaggcttattagagcgtttacaaaaaggtttgttgggcttggctgccaaaaatgtaaatactattatgcctggctttacacacttacaaacagctcaaccagtaactttcggccatcacttgttggcatggtttgaaatgttagttcgtgatactgaacgtcttcaagactgccgaaagcgtgttaaccgtatgccacttgggtctgcggctctcgctggtacaacttacccgattgatcgtgcttatacagcagagttactaggctttgaagctgtatctgaaaactctcttgatgctgtatctgaccgtgattttgctatcgaatttaatgcagcagcatctttaatcatgatgcatttatcgcgtatgtctgaagaacttattctttggacttctgcacagtttaaattcgtaaatattcctgatcgcttctgtactggttcttcaatcatgccgcagaagaaaaaccctgatgttccagaactcatccgtggtaaatctggccgcgtatttggtgacttagttagcttacttacgcttatgaaaggtcaaccactggcgtacaacaaagacaaccaagaagataaagaacctttatttgatgccattgataccgttcgtggttcactcatggcgtttgctgacatgatccctgcgttagttccaaatgttgaaatcatgcgtgaagctgctcttcgcggattctctacagcaactgaccttgctgactacttagtgaaaaaaggcgttgcgttccgtgatgcgcatgaaattgtaggtaaagctgttgcattaggtgttgctgaagaaaaagatttatctgagttaacacttgagcaattacaacaattctctgacctaattacagcagatgtatttgataaagctttgacactagaagcttcggtaaatgcacgtgatcatattggcggaacttcaccaaaacaggttgaagctgcgattgcacgtgcccataaacgtctagaacagttatacgcttaa

SEQ ID NO: 1271 - DNA, 1413 bp, Acinetobacter baumannii
ggttgggggacacgaatgaaaaaaatgcttatggcgctgagtttaaccggcgcacttttgggtggtactgccgcttgggcagaagagactgtaacaacaccaacatctgaggttacagcaacatcaacgtctgaagctcctgcaacaattgcagcggcaccagcagctgaggaaactccggccgctccgacaccgactgcaaaactcgataccggtgatacatcttggattttaatttcaacagctttggttctgttgatgacaattccaggcttggcgttattttacggtggtatggtccgtaagaaaaatgtcttaagcactatgatgtttagcctttctgctgcaattttagtaagtttgctctgggtgattgcaggttattcaatcgcgttctctggcacaggtgcatactttggtgatttgtctaaagcaatgctcaatggtgtcgcttttgatgcactaagtggaacaattcctgaaagcctctttgttattttccaaatgactttcgccatcattactgtcgcaattttgagtggctcgattgctgaccgtatgaaatattcagctttcatggcattcattgcaatttgggtacttgtggtttatgcgccaattactcactgggtgtgggcggcagatggctggttatttaaagcaggtgcattagatttcgctggcggtacggttgtacacattaactccggtgttgcaggcctagttgctgcttatatgcttggtaaacgtattggtcttggccgtgaatctatggcgccacataacttaactttaactgtaatcggtgcaagtttactttgggtgggttggttcggctttaacggtggtagtgctttaggtgctggtgcccgtgcaagtatggcaattttagtgactcaagttgctgccgctgctgctgcgttctcttggttggtagtagaacgtatgatccgtggtaaagcttctgtattgggcggtgcgtctggagctgttgctggtttagttgtgattacgcctgcagctggttttgttggtgtaggcggagctttagtaatgggccttattggtggtgtagtctgcttctggggtattacggcacttaaacgcttacttaaagccgatgatgctttggatgcgtttggtttacacgctgtaggtggtattgtcggtgcgattttaactggcgtattttatagtgatgaaatcattaaggcagccaacgtagcattagcaccaacattcgctggtcagttgtgggtacaagtcgaaggtgtgcttgcgacaatggtttacagtggtatcgcaactttcattattcttaaagtgattgaccttatcattggacttcgtgttaattccgatgatgaacgtatgggtctggacttaagccaacatggcgaacgtattgaataa

SEQ ID NO: 1272 - DNA, 921 bp, Acinetobacter baumannii
atcgagaatgccaacatgattagccttattaaaaatagtagttatggtggcactattgcaattttagtagcctctttcttatggggaaccacgggcacagccgcagcatttgccccaacactcggaccacttgcaattggcgcggttgctatggggggaggtgggcttttacaggcattgattgcatctcaggccattcgggaacaccgacaatttattgggcgaaatatttctattattcttttaggtgttgtggcagttgggatatatcccctagctttttattcttccatgcattatgccggaattacgattggtacggtggtttcaattggttcggctccactcattgcagcagttttagagcgattctttgaccgtaaagttttatctaaaacgtggttcctaagttttgtgttgggtgttgtgggggtaagtttattatctatgggcgaaagccacgcagcacaagagagtacaaatgaatggaataaaatttttggtatttttcttgggctggtagcgggtgcaacatattcactttattcatgggctgcaaaaagattaatagaccgaggtattgctgctaaagctgcaatgggcatgattatgggtggtggggcagtcatcttgcttccaactttattaattacaggtggtgggttactgcaaagttcaacaaatttacttgttgctggctatatgatgctgattcctatgtttttgggttatttgctttttggtttcgggttaaaaactgtaaatgccagtaaagccaccactttaactttatttgaacctcttgttgcagcgatttttgcgattgttttggttggcgaaagtgtctcatggattgggtgggtaggcatgtttttgattttcatttgtattttgatgttatcaaagcctgaaaatacataa

SEQ ID NO: 1273 - DNA, 894 bp, Acinetobacter baumannii
aaatttatcgccttcggggatgattcatcacattcaggcattataaggattcgtatgagaaaacttgtttctatcatcattttgctgggcattgcttgggtggctaagctcagctacgatatgtggcaaatttctcgtaccgttcctgaacttcagcaaagcttgctgcaatctgaacagcaatatgccaatttgaatgatcaattggttgctttacaaagacaaattcaaaatcaaccaagtcataattctaaaacaacgcctttagcaacgactgaaattgttcaaaccggaattgcaccgaccgtattaattaaacaaaaattagagttaatccagtttgcaattgaccaacagcaatttatttatgctgtagatcatctaacccaataccagcaaaccctaccacaatatggaattgctcctgcattacaacacagcttaaatcaggctcttgagcaagataagcaggctattcaacagtttgtacttgctcaaaatcagcgacatcaactcattgatgatttactccagaatattgataaaaatattcagcaagccttaaaacagcctaaatttgagatggaccaatccgaggctgtgtcatggtggaaaaaatggttccgtattgagaaagtagaaacgccgtctattaatttaatgaaccgaagtgtagtgcttaaagaagtccaattaaggctgttaattgctgagcaagctttaaaccaaggaaaaatggctgaatatcaaaatgagttgcagacagtaatgcaaaaactaaatgaattacctgatgcgactagccaacaactcaaaacccgtattgctaaagtggcacatttatctgtagtgcctgttcctaaattatcgacacttggtctaatcggctcataa

SEQ ID NO: 1274 - DNA, 219 bp, Acinetobacter baumannii
ctagcatccgctgcagaccaatttaaacttgcagtaccagtactccctgaagacgggttattgacgagttctgcaaagcttgttgaactcaaactaagcaaaatagacatgcttagcacatgcattaaagactttttagaatttttcacggcacaatactcgactcagggtgacacacatttgcgcttactatcattatgccttacatttgagatataa

SEQ ID NO: 1275 - DNA, 231 bp, Acinetobacter baumannii
aagctttcagcggttatcccttccgaacatagcttcccggcgatgcgactggcgtcacaaccggtacacccaaaggtcggccactctgggcctctcgtcttaggagcagatccttttaaaattcccacgcccacggtagaatgggaccgacctgctttaccaagttttaaacccagcttggcgacctttttaaatgggcaacaacccttcccttgggaacccgctttaacc

SEQ ID NO: 1276 - DNA, 228 bp, Acinetobacter baumannii
tattggtcagcttcacatatcactatgcttccacatccaacctatcaacgtcctagtctcgaacggctctttagaggacataaagtcctagggaaatcttatcttgaggtaggcttcccgcttaaaagctttcagcggttatcccttccgaacatagcttcccggcgatgcgactggcgtcacaaccggtacacccaaaggtcggccactctgggcctctcgtcttag

SEQ ID NO: 1277 - DNA, 414 bp, Acinetobacter baumannii
gtacgaatggctaaagttagcttttatctgtttgaaaccagtgaagaacggcaagtcgatagtgcttgccgtttatgtcgaaaaattttactgaagcattcacaaatctggtggtattgcccagatgtgcagttacaacaaacacttgatgaaaaattgtggagctttgatccgaccagctttattgcccatggcgttgatcaggtagatgcagcagtatgtatttcggctaaacaaccttctgaacaaggttggctggtatttaattttaacaatcatgcacttgaacaagtgaatcattttagccacattatagaaattgttgaaaataatgaagcagccaagcaaattggccgagaaaaatttaaaatgtatcgtcgtttaggtatagaacctcgaacctttaaattataa

SEQ ID NO: 1278 - DNA, 1464 bp, Acinetobacter baumannii
gcaatcacggcagccatgaaatttacaacttatacaacttttcctgaacaaacatctaatgaatctttgtggattttagttgattcagaacagctacaaagcaatctcaatacatatcaaatcaataatctagaaagtattcttacagcaactcaatttaaagccaacttcaatgaaacgttgccattatttggtcaacttagcactcagccccatagccaattactcggtttaggaaaagcagctgaacttcaagcagctaagttagcaaaattggcgcaaaccattatcaagtcggcgcaaaataaatttaagcatatcgcaattgatattgctgcgttacctgtcgaataccattatttatttgcattaagcttaactcaagcagcttatggttatgatgagtttaaatcgaaaaaaaatgaatttgtgttacaacaagttgatttaattagctcacaaaccagccttgacgaaaatcaactcgctttagtacatgccgtacaatctggtcagtcttatgctcgtgacttaggaaaccgaccaggtaatatctgtttccctgaatatctggcagaacaggcgttagctttagctgcagaattcccagacttacttaaagtcactgtcttaaatgagcaacaaatggctgatttaggcatgtatgcatttcttgcagtcagcaaagggtctgagcgtccgggccgtattgtgactcttgaataccaagcacagcttgaacaagctcctgtcgtacttgttggtaaaggcgtaacttttgatacaggcggtatttctttaaaaccagggcttggcatggatgaaatgaagttcgatatgtgtggtgcagcttctgtactcggcacaatccgtgctttatgtgaggcacgtcttccaatccatgttgtgggtgcgattgcagctgcggaaaatatgccttcaggtaaagcaactcgcccaggcgacattgtaacaaccatgagtgggcagaccgttgaaattttaaacactgacgctgaaggccgtttggtcctttgcgacaccttaacgtatatcaaacgtttcaatccggcagttgtgattgatatcgcaacattaactggtgcttgcgtagttgcgttaggtaaagtactgagtggtttattttctccggacgatactttggcagctgaactccaacaagctggtgagcaatcatttgaccgtgtatggcgcatgccagtgattgatgattatcaggaattactggactctccttttgcagacatcgctaacattggtggaccacacggcggcgcaattacagcagcctgtttccttgagcgttttactcgtgactatcgctgggctcatttggatgttgctggaacagcatggttatcaggttcagcaaaaggcgcaactggtcgtccagtaccgttacttatgcaattcttggctaaccgtgtaagtacgaatggctaa

SEQ ID NO: 1279 - DNA, 1140 bp, Acinetobacter baumannii
tgcaatctttttaagcgttataatttgagcaatatcaatttcgataaaaatataaagatgaaaaaaattctaatgatgagtatgtgcagtgcactacttttagctggctgcaataaaacctcacagcaagatcaaactgtatctaaagagcaaaaatcaactgcgcaaaaggccaccgaacagcgagacagtagttgcttgcaaattatggtagccatgcacacgattaatcagaacagtaaaatagaagacttaaatcaaattaatgaaaagcttaaaaactgtgttccttcgttaaaaaatgaggaacagcttaagctaattgatgcatcaacaaccatgtatcaacgttttcttaaacaagactacactgacaaaacagctagagcttttgaagcttttggttatgccgttttagaccaaaaacaaagagaccctaaaaaggtcatacaaagccagaagaaattattcgatcaactgagtccgcgtgaccaatatttaattcaacacgaaggccaagcctatattgagctgctctatcaaggtgaaggtatgtttacttatcgtcgccagccaaactacttagttgatgttttttctaaggctttacccgctgaccagaaagaatttttatctcgtatggcaaaagacaatcaagacattttctataacgatggtgctttggctgtttcatggaaagagctcactgaacgtgctttattttgggaaaagtttattcaaaaatatccaaagagttattttattaatgatgccaaattactctttaatgaatatcgatacttcattttctttggtctagataatacgccagtatcggatgaatatgcctcgaacacatggtttgaccctgatgcacttcagcaaatccgctttttatcaactcagagccaatcaagtttagcgaaacctgcccaacaatttcttaaatttattgccacccctgtcgatgagcgcaataagcaatttaaaatagatttaactgatgaaaatgggcaaaagaaatctacctatcagattatgcatgaacaacttgagcagctattaaaatttgattcgccatggaatactcaaagctaccgagactgccatatagatgcggtttgtatagatacaaattga

SEQ ID NO: 1280 - DNA, 264 bp, Acinetobacter baumannii
aggaggttgtatatgcttcaatatctgattattgcggttttagtgatttggagtgctgttgttgtttttaagaaagtatttccaaaaacagcaaactcggccttttcagcactatccgttttttgtgaaaagcagggttgggcaactttagcaaaatggctgaaaccgaaaatgacttttggttgtgcaggtggctgtggctgctcaagtgaagataaacccactaatacagttcaagaaattaaaccagttaaatggcaataa

SEQ ID NO: 1281 - DNA, 789 bp, Acinetobacter baumannii
tgtgaacttcatattaatactgagttttgcatgaccaagctggcaaaaaccttttctgcaccacgctacaataccctcattgggattgttttagcttgtgttatgggggttctcacttacttcggtctgttctaccagcaaaaagctattgctcaagattacccaattcaaggcttcgatgtctctcaccatcaagaaaatatcaactggaaaaaaatatctccccaaaaatttcagtttgtctatttaaaagcaactgaaggtggtgattataaagatccaaaatttcaagaaaactggttaaaagcacgcgaacatggctttcatgtcggggcttatcatttttatcgtttatgtcgtgatggtaaaacacaagctgaaaattttattgcaactgtacctaacaaagctgatgctcttcctcccgttattgatctggaatatgacagcaactgtattaattcccataccaaagaacaattacttaaagaaataggcatcatgcatgacagcttaaagcatcattatggtaaacagcctatcttttatatttccaaaactttttaccacattgtattaataggtagtttccctaatacacctctttgggtcagagattacgaagggaaacctgagctgaaagacaagcgaaaatggctcttttggcagcatagtaatcaaggtaaaattgaaggcatgaccaagccagtagacttaaatgtttatgaaggttcagtcaaagaatggcaccaatttttacagcagcaaggcatcgtgaaagcacaataa

SEQ ID NO: 1282 - DNA, 1416 bp, Acinetobacter baumannii
aaaagcattcaaaacagcaaagtgctaacatttttgccattctgtcgattgataaattgtggggcaaaaatgttaatacaacgtggtggattaaaagttgtagcaggcttgggaatatcaggtgtttctgctgtaaatttcctgcatgaacaaggctaccaagttgctgtaacggattcccgccccacacctcccggacacgatcagattccggctggtgttaaaaccagttttggtcagcttgatcaagaattattattacaagcagaagagattattttaagcccaggccttgcaccacaattaccggaaattcaggcagctattgctaaaggtatttctgtggtgggcgatatccagttattgcgccgtgccactgatgtgccgattgtggcgattacaggttccaatgcaaaaagtactgtaaccactttaattggcttaatggctaaggatgcaggtaagaaagttgcagtaggcggcaaccttggtcgaccagcgttagatttacttaaagatcaaccagagttactggtccttgagttatcaagctttcagttagaaaccacctctcacttaaacgctgaggtagcagtggttctcaatatgagtgaagaccatttagaccgtcatggaaatatgctggggtatcatcaagcaaaacatcgtattttccaaggcgctaaaaaagttgtatttaaccgagatgatgcgttaagccgtccacttgttccagatacgacaccaatgcaaagctttggtttaaacgcaccggatttaaatcaatatggcgttttaagagatgccgacggtacgctttggcttgctcgtggtttacagcggttaattaaaagctcagatttatatattcaaggtatgcacaatgtagctaatgctttagcttgtttagcattgggggaagcaattggtttacctatggagtcaatgcttgaaactttaaaaaaatttaaaggactagagcaccgctgtgagtacgttaaaaccgtgcatgatgtccgttattataatgactctaaaggtactaatgttggtgctacacttgcagcaattgatggcttaggtgctgccattgaagtgaaaaaaggtaaggttgcacttattttaggtggacagggcaaaggacaagatttttctcctttacgttcttctatcgaaaaatatgccaaagttgtggtattgattggtgaagatgcgcctgtcatcgaacaagccattcaaggcgcaactaaaattttacatgcagcaacgcttaaagaagctgtcgagctgtgtcaacgtgaaacacaagctgaagatgtggtattgctatcaccagcatgtgcaagttttgatatgtttaaaagttataatgaccgtggtcagcagtttgttgcctgcgtcaattcgttggtttaa

SEQ ID NO: 1283 - DNA, 1185 bp, Acinetobacter baumannii
atgctgcaacacaatatatataaagctttttttgttagcgtattgatgtgttgcagccagctcgcttttgcagctcctgttgtaaaagaaaaattatcgcctctgcatgctgatgccccagaatcagaagaaagttatgcagaagtgcctattgagtctattcaacagtttgtacaaatatatgggatcgtccgtgataactatgtcgatgaaaaatcggacgatgctttatttttacaggcaattaaaggtttagtcagtggtctagaccgttactcccgctatttgtcagctgaagaataccgtcaactcattcaatatactgaaggggatcttgcttcagttgattttgtactaagccccgaatcacatgttcataaatggatgattcgtgaccttaagacgggttctgactcatataaactaggcttaagaaatggccaaactattttaaagattgataatcaggaacttaaaaatctgacacatgatcaggtgctaggtttgctttatggatcgataggctcgacgcttcaagtacaaacagaagagtcaaatagtccaattagtttagtccgtaataaaaagattgaaaccgatattgagcctgtgatgttgcacaatcaggtgttggtattaaaaattagagtatttcaacaagataccgccaatgagattaagcgtttaattgaagaaaatagttcttcgcgtttaaaagcggtgttaattgatttaagaaataacccaggcggcttgttatctgctgctgttgagtcagctgatttatttttaaatcatggcattattgtctctacaaaaagtcgttcagaaggcaaccagcaatttcaggctttaccgggtaacgatttccaaaatataaaagttggtattttaattaatcaccgatctgcctcggcagcagaagtttttactgctgcaatgaaagagcatcaacgtgcttgggtcatgggtgaaaaaagttatggaaagggtgttgtgcaaaagcttttccctctaccaagtggggcagcgctacaaatgacagtctcacattactacacaccaaatggtaatatgattgaggggcaaggtattcagcctaaccagacttatcccttacccccagaaatgaaagaagaagtttatctagatcgtgttgccgatctccttctaaaaagaaagtaa

SEQ ID NO: 1284 - DNA, 267 bp, Acinetobacter baumannii
actggcgagcataaggtaatacaacagtttggatatctcatgctagaaactctattacaggccatcttggaacaaattgacgagcctaaaaaagatttagaaaaaaacttacgtgcattattaaatgaaactgtcgagaaattagatcttgtctctaaacaagaaatcgaaagacaaaaaacagcccttcatttagccaatcaacgtttagaagcgctacaaaaacaagtcagtctattagaagaagctttaaagaataaaaaataa

SEQ ID NO: 1285 - DNA, 690 bp, Acinetobacter baumannii
ctttatcttaaaatacgcccaccgtttggcctgagggaaagggcaatgttactcaccgttatttatattattgcgattactgcggaagccatgactggtgcattgtctgctgggcgacggagtatggactggttcggtgttgtactaattgcctgtgtgacggccttgggtggtggctctgtacgtgatgtactacttggacactatcctttaacgtgggtaaaacatcctgaatatttagttttaacgtgttgtgctgcatttgttaccatcgttattgctaaatggatgcgtcatttacataacattttcttggtgctcgatgcgttaggcttaatcggatttaccattattggttgtcagattgccttacagatgggacatggttttgttgtgtcggcggtagcaggtgttttaacaggagtttcgggtggtattttacgtgacattttatgtaacgatgtcccgtttgtttttcgtcgtgagctttatgcaagtatttcttttgttgcagttatttgttattgggtctgtctggacttaggtttaagtttagaacttaccgttatttcaaccttagtattcggttttacgcttcgtttaattgccatttattttggtttggaaatgcccaaatttatttataaagatgatgatgcagagtcggcttcttcaaccgacgaacattaa

SEQ ID NO: 1286 - DNA, 2262 bp, Acinetobacter baumannii
tacacacttaaaataacgactgatttggaagataagctgactatgaccagccttgcgcatcatgcgacagaaaaccgctctgtagccgaatttactgaacaggcttacttgaattatgccatgtacgtcattatggaccgtgcattgccgcatatcagtgatggcttaaagcccgtacagcgccgtattgtctatgccatgagcgagctaggcttaaaaagcagtggcaagccaaaaaaatcagcgcgtacagtgggtgatgtacttggtaaataccacccacatggtgacttggcatgttatgaagccatggtactcatggctcagccatttagttaccgctatcctttaatcgaaggtcaggggaactggggttcacctgatgatcctaaatcttttgctgcgatgcgttataccgaagccaaactctcggcttatagtgaattattgctgagcgaattaggtcagggcactagcgaatggcaagataactttgatggttctttaaaagaaccgattaccttacctgcacgtgtacctaatattcttctcaatggtacaactggtatcgctgtcgggatggcgactgatatcccgccacataatttgcgtgaagttgtaaaaggcacaattgctttaatccgtaatccgcaaacctcggacgaaaaattagctgaatatattccggctccggatttaccaaccaaagctgaaattattaccccgccagaagaattactcaaaatccagaccactggtcgtggtagttaccgtatgcgagcagtatataccattgagaaaaatgaaattgtaattactgagctcccatatcaagtctctggttctaaggtaattacccaaattgctgaccagatgcaggctaaaaagctgccattagtcgttgatgtgcgtgatgaatcggatcatgaaaacccgacacgactcgtgattgtactgcgctctaaccgtattgatgcggaagcagtaatgagccacttatttgcgaccaccgatttagaatcaagctatcgtgtcaatttaaacatgattggcgaagatggccgtcctcaggtgaaatcaattcgtcgtattttgcttgaatggatcgagatccgtaaaaaaacggtaactcgtcgtttacagtaccatttaaaccgtattgaaaagcgcctgcatattttggcaggtcttttaattgcttatctcgatattgatacagtcattcgtattattcgtgaagaagaccagcctaagccagtcttgatggaacacttcaatattgatgagatacaggccgaagcgattttagagcttaaattacgtcatttggccaagcttgaagagatggaaatccgtcatgaacaagatgagctttccgcgaaagctgccattattcgtgaacaactcgaaaatcctgaatctttaaaaaacctgattatcagtgaattaaaagaagatgcgaaaaagttcggtgatgagcgccgttctccaattgttgcacgtgctgaagcggttcaaattaaagaacaggatttaatgccagctgaaactgtaacagtcgtgttgtctgaagcaggctgggttcgtgcggcaaaaggtgcggatgtggatgccgaaaatctgaactaccgtgctggggaccaatatttaagtcatgctgtcgggaaaaccaatcagcgagtttacttccttgatgaaacagggcgcagctatgccttgccaattagtaacttaccttcagcgagaggcttgggggatccattaagttctaaattatcaccagcaagtggcgtatcgtttattcaggtttatttagatgatgatgagtctgaattgattgctgcaagttcggcaggttatggttttaaaacgcaaaccaagcaattagataccaatgcgaaagccggtaagacattcttaacggttccggataaggcaaaggctttaccactcatttctgcccaaaacatgacgcatttggctgtactgagctcagcagggcgtttgttaattttagatttggcagagctaccaaatttaaataaaggtaaaggtaataagttgatacaacttgaaggcaaagagcaaattttatccatgacaaccctgaacttagatgaaataattcaggtggttgcaggtcaacaacatctcaaattaaaaggtgatgatctacaaaaatacatgggtaaacgtgcttcgaaaggtcagctcttaccacgtggatatcaaaaagcaaataaactgttgattcagagataa

SEQ ID NO: 1287 - DNA, 1590 bp, Acinetobacter baumannii
tcaagccctaaccaaatttatatgcaatttcccttaaattcatccttgtcccatacgatttttcgtttgggcacttggtatggcttataccgtcttattattgcggttagcctgaatattattttggttttaaccgatgcgcaaactgataacagtttgcagcaacctgccttatattcctacacactactcggctattcgctcttaagtcttgttcagctgttatgctttaaatttattgccactcaagccacgcgacagcttattttattttttattgttgatattatttgtttgagtttactgactttttctgtgggtgaaccaaatttacaactcagcttactctatgtaattgccatctttacctcggcgattttactcagcgcaagaatgtctttgctgattacattgcttgcggttatcgctgttatttaccaacgatttgtaggtagtctatttgactataacaatctaaatactattagtaatagcgctctcttagctttcttattttttgtggttcacagaattggccaaattgcagtgcagcgctttaaattacttgaagcactcacctttcaccagtcaattgaactctatcaactccaaaatattaaccgttatatcttagaacaaattgaagaaggctatttagttttagatgagaattacgacatcgttgtcagtaatcctgcggcctgttcactcttgggtattccccctcaatttgccaatgaaaaatatcctttagcaaagtggcatgccgatttatttgaaattttaaagtttggcgacttaaaagaaggtgaccgattcatttttgagtctcggctatcggcgtactccatcaacattaaagtgcaacaccttttggtcccacaacaaacgttaaccctgctcattttacaagatgcccaacaaatcaatcagcaagctcagcagcttaagcttgctgcgctagggcaactctcagcaagtattgcacatgagatccgcaatcctctcgctgcaatcgtacaagcaaatgagttactgaaagatagcgatccagaacaacaaaatactttgcgtcatatgattggcaaacaaaccaaacgcattgatagtattgttcaagatactttaggacttgctcgtagcgaaagaacacatcctatccagatcgatgtaagacacttcatagatacattgctcgaagaagatttatttgatgttaaacattcaattcaacttaaaatttcggatagttctttaaaatttttatttgatgaaaaacaattaagacaagtcatgatcaatctggtgagaaatgctttacggcataatgcccccgactcaccgtacattacgatcaacattcattcacagacaaataaaatttatattgatgtgatcgattacggtgaaggtgtttcaaaacgtgatatatctcaattatttaaaccattttttagtaccgaaattaatggaactggtttaggattatatttgtctcatagtttttgtgaggcgaaccatgcaaagctcacctatgtagagcaaaaacaaggggcatgcttcagaatagaatgcccaataatatattga

SEQ ID NO: 1288 - DNA, 1068 bp, Acinetobacter baumannii
aagcacaataatatgcgcaaaatcattcatatcgatatggatgccttttatgcatcggtcgaattgcgagaacgtcctgatctaaggcatctcccagtagttatttcatcgcatcacccgcgcgccgtaattgcagctgcttcttaccctgcccgtgagtttggcttacgctctgccatgtccatgagccaagcaagaaaactatgccctcaagttgttattattgagccaaattttgaaaaatatcgtgccatctcggctcaaattcatagtatatttcaacaatacaccactcttattgaacctttatctttagatgaagcgtatcttgatgtcactgaaaatttaaaacaaatcgcgagtgcgaccgaagtggctatgcatattcgggaagatattttcaggcaaaccggactgacagcctcggctggtgtagcacctaataaattcttggcaaaagttgcgtccgactggaataaaccgaatggcctgtttgtgataaaaccttctcaagtagccagttttattcaggacttacccttaaagaaaattccaggagtaggcaaagttactcaagaaaaactccaacagcttgaattgcatacactaggcgacttacaaaaaattgaagaagctgttttagttcaccactttggtaaatatggccaacagctttatttatacgctcaaggcatcgataaccggcccgtacaagctgaacgtgcccgacagcaaatttcgaaagaaaccacatttgatagtgactttactttagcccagtgccaaccctactggcatggtctagccgaaaaagtctggcaaagtttagagaaaaagcaactgaatgcccgaggcgtaaatattaagctcaaacttaagaatttccagactttgcaacacagtaaaagttttaaaaacccaattcattctcaacaagacctgattcaagttttattcttacttttaaatgagatgcatattcccgaaaacttccaatttcggctcattggtattggggtttatcaattacaaactaaagctgacgactttcagttgtctttatggtga

SEQ ID NO: 1289 - DNA, 1500 bp, Acinetobacter baumannii
tggaacaataagatgtctttttctaaaatttatactcggggacttttaggattacatgcgcctctcattgaggttgaggtgcatgtgagtcaaggcttaccctctctgactattgtaggcttagctgaagcagcagttagggaaagtaaggatagggttcgctcagctattattaacagtggatttcaatttccaactaagcggctgaccattaatcttgctcctgcagatttgcccaaagatggttcacggctagatttaccaattgctttaggcatcttaattgcctctggtcaacttccggaaaactgcacagaagactttgaatttattggagagttagctctagacggtcatgtaagacctgtgtcaggcgccttaactttagcaatggcatgccagcaagctcagcataaaatcgttttaccagtcgataatagccaagatattagccatttacctaatcttgagtgttatccggttaatcatttaaaagaggtgtgcgagcactttttaggcacacaaaagctagctcacgcacagccaagtgcccattcaaatgaaatgccctataaatttgatcttgcagatgttaaaggtcagctacgcccacggcgtgcactagaaattgctgccgctgggggacattccctgctctttaaaggaccaccaggcacaggtaaaactttattggcctcacgcctgccttccattttaccgccactttctactcaagaaactcttgaagttgcaagtatttattctatttcaaatacaccgcatacttttgggcagcgtccatttcgcgcgccccaccatacagcatcagcaattgcactggttgggggcggttcacaccctaaaccgggtgaaattactttatctcatttaggtgttctatttttagatgaactccccgagtttgacagaaaggttctagaagtcttacgccaaccgcttgagtcaaaagaaatcattatttcacgtgcggctcggcaaattacttatccggcgaactttcagctcattgcagcaatgaatccttgtccatgtgggtatgcatttaatcaagatagccgttgtcagtgttcaccagaaagcattaaacgctatcaaaaccgcatatcgggaccgttactcgaccgcatcgatttacatattgatgtaccgccattaaaagctcaagaactgcaagacccaacgcctgcagaagattctacaactgtgcgacaacgtgtgatttatgcttatgaacaacaaatgcaaagacagggtggtttgaatcaggcgctctcaccaaaacaactggaacaacatgccgttctcgatagtacttcacagcgaatgattgaaatggctcagcaacgtttaaatttatctgctcgtgcttatcatcgcgttttacgggttgctcgtactattgccgatttggctcaaagtgaggtcattcaaagtcctcatcttacagaagcactctcttatcgaggtaatcattcttaa

SEQ ID NO: 1290 - DNA, 639 bp, Acinetobacter baumannii
ggtgaaaataaagcaatgaatagcgtattaacaatggcagtaaatgattcaccaataacatctgtaaaaacaacacaacctcttattgcattatattgtggttcacgtgcaggaaataacccgatttatcgagaaaaggcaattgaattagccagcggaattgctgaacaaggttttggtttggtctacggcggggccagtattggtttaatggggcaagtcgcagaaagcgtacttgcacatggtggagaagctgtaggggtcattcctgaatttatgcttgattatgaagtggcgcatgcaggactgaccgagttgcatgtggtagaaaccatgcatgagcgtaaagccatgatggcagagcgcgcgagtgcttttatcgcgctacctggcggtttaggtacattcgaagaaattttggaaattgccacttggggtcaactcaaccagcaccaaaagcccatgattttatataacgtaaatggtttttataatgcgttaattgctcagttagaccatgctgtacaagaaggcttccttcctcttcagcatcgagctaaattaattgtatgtgaagaaatcgaccaaatttataacgtcattaaaaacttaaaaatgccaaagagatttgttgtttaa

SEQ ID NO: 1291 - DNA, 876 bp, Acinetobacter baumannii
agcttaagtaacaaaatttgtttaagtcatataaatcgtgcgttcattgtgggggagatcaaaatgatgaagtttgcacttaaagcagtaacattcggcgtactcacggcaggttcaaccatggttatggctgaagatgctccatctttttacggcatcaccgcaactggtagtgtggctgctactacagattatcgcttccgtggtattacgcagtcttcaaataatccagctattcaaggcggcttcactttctctcataagtcaggtgcttatgttgcgctttgggggtcaagcgtagactttaatacacctggtgtttcaactgaaactgatatctcgttaggttataccaacaccttaaaactgtcagacacacttgcaccgacttatgatgttggtgtgatccgttatggttatattggctctgattcaaaattcactaatccatacaatggtgacactggttttgactttaccgagttttacggaaaattaacgtttgcagattctttatttaaaggtgatgcccttagtgtcggcgtgaattattctaacgattactggggccactctgacgagttctggtattttaacgtgggttattcggcaccaattgcagacaccggatttactggacttgcttcagttggttataacaagcttaaaaacaaagattctttacttgtagttgctggtggaccaggtgaagatgatagctatattgattataaagtcggcgtaaactataacatcttgggtattgttgctgagctagatgttgtcggtacagatattagtacttctggcatgactgatgcccagaaaaaaccttatgacacaggtttagtgtttagtttaactaaaacattctaa

SEQ ID NO: 1292 - DNA, 192 bp, Acinetobacter baumannii
tcattattcaataccaacaagttcagttcattgcttgaacatgttgccatatatagcgtatttatgttgccagacgctagctttatctctgaatcaacagtttatttgctttttgatatccacgtggtaagagctgacctttcgaagcacgtttacccatgtatttttgtagatcatcaccttttaatttga

SEQ ID NO: 1293 - DNA, 1329 bp, Acinetobacter baumannii
ggttctttaaatatgctaaaagcacaaaaacttacattagcagttctcatttctgcggcaataatttcctcagctcaggcaagcgagcaaagtgaggcaaaaggatttgttgaagatgcgaacggttctattctcttccgtacaggttatctaactcgtgacaaaaaacagggcgcgaaagataccagctcagttgctcaatcagcaattgtaagtatcgaatctggctttacccctggtatcgtcggtttcggtgtaggcgttgttggtgacggatcatttaaaattggcgaaaacaaaaacgctggaaaccaaatgattccaaaacacaacgatggttcagcttacgaccactgggctcgtggtggtggcagcgttaaggcacgtttctcgaatacaacagtacgttacggtactcaagtactcgacttaccagtccttgcaagtaatacaggacgtatggttcctgaatacttcacaggtactttattaactagccatgaaatcaagaaccttgaggttgttgctggtaaatttactaaagaccaaatgtctgaccaaatcaataccgatgcggatgcttctggcagaggtcttgaccgtgcaattgtttggggtgctaaatataagtttaatgataacttaaatgcatcttattatggcttagacagcaaaaatgctcttgaacgccattatgctaatgttaactttaaacaacctttagcaaatgacagttcattaacttatgattttagcggataccatactaagtttgatgcaaatgcacacacttattcagcaactggaactgtagcaccaaattatgctgcggatggtatagctggcgaagaaaagaccaataatatttgggctatttcaggaacttatgcgactggtccacatagtgtgatgttagcatatcaacaaaacactggtaatgttggttacgactatggccaaaatgctgatggtttccaaagtatttatttgccaaactcttatatgtctgatttcatcggtaaccacgagaaatctgctcaaattcaatacaatgttgattttggcaagttaggcgtattacctggtttaaactggaccactgcatttgtatatggttgggacatcaaggttagaaatgtaactgatgatgctcaagaacgcgaattctttaaccaagtgaaatacacagttcaaagtggttttgctaaagatgcaagccttcgtattcgtaactcttactaccgtgcaagtgatgcttaccaaggcgcttacatcggtgataccaatgaatggcgtattttcttagatattcctgtgaaattattctaa

SEQ ID NO: 1294 - DNA, 660 bp, Acinetobacter baumannii
gatgaaataaatagatttcgtcctgatcgaatcatgagtattgtcgagcgtccaagttatacatctaaagatgtcgaagtaacatcacgtgaacctctgttcagtggttttattcaagttgaaaaagtcagccttcgacatcgtctatttaatcaatctgaatatactcctgtattgcagcgcgaacttgtgcatcggcctgaagcggctggcgttctactctacaatgatcaaaaacaacagtttgccctgattgaacagtttcgtgttggtgctttagatgactcccattcgccatggcaactcgaaattatcgcaggtgtattagatggcaatgaatcaccagaaagttgcattcgacgcgagagccttgaagaatcaggttgcgaagttcaggatttagaacatctatttagtttttacccatcagctggcgcctgttcagagttatttcatctgtatgttgccgaaaccaatttacctgctgtaggcggtgtttttggggtagataatgagggtgaaaatattcagctgcatttgtttagttatagtgaaattcaaacactactcgacagcggacgtttaagaaatgcccctgttattatggcattacaatggctggctcaacacagcaaaacgataataaatccgaagaggtag

SEQ ID NO: 1295 - DNA, 186 bp, Acinetobacter baumannii
catgaccaaaagcatccatatctccccatgctactttctggtcgtatattacagggtagacagacagttctttcatttttacctcagattttaaattttaaaaaattcgcatcattttcaaagattaggtttaactgtttgattaactcatcatcttcttttaaagttgatttaatacgcaaatag

SEQ ID NO: 1296 - DNA, 1152 bp, Acinetobacter baumannii
ggggatttgaagatgtggtcatggtggctcagtaaaataaaaaagagtatatcacttgccgaagctcaacaaacaaagttgttttctacagcatatcgaaatcaaaattcctcctatttttttacgaaaattgatcgttggcaacatttattagaattaattatcgcaagtaatgttttagctctggttttagctttggctgaagcacagtcttggcatgcgttaaacggctcacgtcttttacaatacatcgtttttattaactgggtgattttgtctttttttgccttggttgaacattttcaggatttttttagtcagctacagcaaaaatatgctttggtaattggctttgttatgctgcaagcgatagttgtggtaaccacgataataagcaatttttttcagttcggagttttgaaaaaaacatctgttatagcgcaggagtggagcatttattttaccaatgtccctttatatttaagttatggaatattattaggggccttttgtctgcgttatttatatgttcgagaacaatggttacaccaacaatatgcagaattaaatgcccgtattcaggcaatgcaggctcgcatccatcctcattttttatttaatagtctaaataatgtggtgagtttaataacgatagatccagataaagcagaaagtatgttaattagcctgtcacgactgtttagggcgagttttcaagaattaaaattagtgagcttgcatgaagaaattgagcttagtaaacaatatttaatgattgagcaaatacgtttgggcgagcgtttaaaagtcgaatggaaagtggaaattgaacctttgcaattaaaacaggtcactattcctttattgacattacaaccattattagagaatagtatttttcatggggtagagccaatgatgggtaaagcaaccattggggtattggttgaaatattgcaaaatcaggtcagtatagtcattactaacccttatacacacgatacaataaattcacggaaagggcatggaatcgctcttgaaaatgttaaacagcgcttaaaagcgtattatgggaattcagtgagattccaggtatataagggtgaggctttatataccactattatgagctatcaataccaatcaaaataa

SEQ ID NO: 1297 - DNA, 1566 bp, Acinetobacter baumannii
acaaaagagaaattgattatgacggatgcaactgctggcaagatccctcacgttctggtcattatggatggtgttggacaccgtgaagcgattgaagataatgcttttcttgcagcaaaaaccccgaatttaactgcaatgaaagcaaagcatccaaatagtctcatttctggttctggtgaagatgttggtttacctgatggacaaatgggtaactcggaagttggtcacatgaaccttggcgctggccgagtgttataccaagacttcacacgtattactaaagatattcgtactggtgctttttttgagcacgaagtattggttgatgccgtagaaaaagcaaaagcagcgggtggtgcagttcatattatgggcctactctctgaaggtggcgtccattcacatgaagatcatattgtggcgatgtgtgaacttgccttaaaacgcggtgcgaaagtttacttacatgcattccttgatggtcgtgacactcctccacgtagtgctcaaccttcattagaaaaattagacgctttattcgctaaatatccgaaccaaggccgtattgcaaccatgattggtcgctattttgcaatggatcgtgataaccgttgggatcgtgttgagcaggcttaccgtttattaacggaaggtgaagctgttcgtactgcaaatactgcggttgaaggcttagagcttgcatatgctgcaaatgaaaatgatgagtttgtaaaagcaactcgtattggtgagatcgctaaagttcaagatggcgatagtgttgtatttatgaatttccgtgctgaccgtgcccgtgaaattacgcgtgcgtttgttgaaaaagatttcgcaggttttgagcgtaaagttgtacagaacctttctaaatttgtcatgttgacgcgttatcaggcaagtattgatgcacctgtggcatatatgcctgaagagttaaagaactcgcttggtgaatatttatcttctttaggtaaaacgcaactacgtattgctgaaactgagaaatatgcccatgtgactttcttctttagtggtggtcgtgaagacgaatatccaggtgaaaagcgtattttaattccatcaccaaacgttgcgacatatgacttaaagcctgaaatgagtgcttatgaagtaactgatgagctagtcaaagcaattaactcgggtgagtacgacttacttgttgtgaactatgccaatggtgatatggtcggtcatacaggcgtatttgatgctgcagttaaagccgttgaagcagttgatacatgtttaggtcgtgtatacgaagctgtaatggcgaaaaaaggccatatgcttattacggctgaccacggtaatgttgaacaaatgcaagattatgaaagtggtcaggttcatactcagcatacaacagagcttgtgccttttatttatgtgggtccaacccaagcaacgattgcagaaggtggcgtgcttgctgatgttgcaccgaccattctgaacttaatgcagattcctgtgcctgctgaaatgcaaggtcgtaatctcattacattgtctgcttaa

SEQ ID NO: 1298 - DNA, 252 bp, Acinetobacter baumannii
gggaatcttgatgaacatgtccgcagactagggccttcacgttttgaaatggacttaaagtatctaaaagtgcatttgagttttgaagcttatggtggtcaatccattttgatttcatggcaaatgggtggtgatgacaagccagcaaaacaggatgatctgcaaattgttcaagtaaattcgctaaattttctaattgttccgaagacagatgaccatctacttttccctttactgcgctatttagcataa

SEQ ID NO: 1299 - DNA, 564 bp, Acinetobacter baumannii
tacgtgtatgatgaggaatgccctattatggcgaatgacaaccacaaccaagttttggatgaacatacagaagttgtagtagaaggtgataaagcttctgcaaaacgtgcacgtaaagtgaaacctaaaacttctgacgtaggctcaactgcaagtttatttggtattgcaccttatcaacctaagaaaaatgaagagtacatgtctgaaggacagctcgagcatttccgacaaattctgcaagcatggaaagctgaattaatgtctgaagttgatcgtactttaaatacgatgcaagatgaatcaactgcattgccagacgtaaatgaccgtgctacccaagaagaagaatttgcaattgaattacgtacacgtgaccgtgaacgtaaattaattcgtaaaatcgaacaatctcttgaagcgattaaaaacgaagactacggtttctgtgaaacttgtggtatcgaaatcggcttacgtcgtttagaagcacgtccaactgcaacgttatgtattgactgcaaaactttggcagaaattaaagagaagcaaaataacggttaa

SEQ ID NO: 1300 - DNA, 1326 bp, Acinetobacter baumannii
ttcaatgatgatatggagtgtgacgtgaaaccagttcgcctggcaatactcggtctaggtaccgtaggtggaggagcccttaaactactacaagaaaatgccgctgaaattaaacgtcgcaccggtcgagaaattcaaattacccacgttggaacacgtcgtcctcgtccagatcttgaattggaagggattaaacaaagcgctgacttacttgatatcgttcgtcaacccgatgtggatgtggttgtagaagttatgggtggtattcatcctgcttacgaaatcattatggaagcgatcaaacacggcaaacaagtcgtgactgcaaacaaagcattactcgctgaacatggtaatgaactatttaaagcagcagaagataatgctgtacaaattgcttatgaagcagctgttgctggtggcatcccaattattaaagtaatccgtgaaggccttgcggcaaaccatatcgaatggcttgcaggcattattaatggtacaggtaactttattttgactgaaatgcgagaaaaaggccgcgcatttgatgatgtattaaaagaagctcaagaactcggttatgcagaagcggacccaacttttgacgttgaaggtattgatgctgcacacaagcttacaattttagcttcttgtgcgtttggtattcctttgcaattcgataaagtctataccgaaggtatcagcaaaattactgcacaagatgtgaagtatgctgaggagcttggtttccgtattaaacatctaggcattgcccgccgtgctgaaaagggtattgaactacgtgttcacccaacacttattccagatgagcagcttattgcgaacgtaaacggcgttaaaaatgctgttttagttcaagccaacgcagtaggtccaacgctttattacggtgctggtgctggtgcaggcccaacagcttctgcggttgttgccgatgtaattgatatcgttcgtgatatttcttatacagaagatggcgcaggcacaattcctcaactggcttttgaagcattaacaaatatgccaattttaagccgtgaagaaatgaccacaggttattacatccgcttaaatgctgaagatcagactggtgtacttgcagatgtgacgaccatcttaagccgtgctggaatcagtattgatgccatcatgcaacaatctcgcttaaaagacctcattccaattgtgattttgaccgatccaatcgttgaatccaaaatggatgacgctcttgcgcaaattcaagcattacctgcaattcgtggcgaaatcgtaagaattcgtttagaatcgctcgatagttaa

SEQ ID NO: 1301 - DNA, 495 bp, Acinetobacter baumannii
gctatttttttatttgagaagtaccaaatgacccaacaaacttgtccatgcggaaaaggcagctatgcagaatgttgtgaacctttacatttaggcacagcaaaagcactcaccgcagagcagcttatgcgttcacgttatagtgcatttgcattgcagcagattgattatattgtgcaaacgacggctttaggacagcaaactgctcttgataaagaggctattgcggaatggagcaaacaaaatcaatggttgggtttagaggtggttaacgctaaagaaaaattagataaaacccatgcacaggtggagttcaaggcccattatcatgatggtaaaagcgctcaaattcatcatgaagtttcacattttgtatttcatcagcaacaatggttcttccttgatccgacggtcgatatgcaggtcaccatgaaacaaccttgtatatgtggttcaggaaaaaaatttaagcaatgctgtgcacaattcctataa

SEQ ID NO: 1302 - DNA, 1434 bp, Acinetobacter baumannii
gtttttggggaaatggcagaacagcaaccactggttttgcttgtagacgatgaagaagatttgtgccttttaatgcaaatgacacttgcacgaatggggattaaaacacatcttgcttatcgggttgaacaggccaaacaactcttcactcagtttcattacgatgcgtgtttaaccgacttaaacctacccgatgggagcgggatagatttagttaaacatgtctctcaaaattatactaatactcccattgccgttttaaccgcctacggcaatatggatattgcaattgcagcattaaaagcaggcgcttttgattttgtaagcaaaccggtcaaccaagtacatctagatcagttattacaaaaagccttgaatcggcaaaaagtagagcatgatgctaccgagaatgcgttagaaaataaattattaatcggccgttctctacccatccagcagctacgtattgcaattaaaaaaattgcgcgctctcaagcaccggtatttgttaccggtgagtctggaacaggtaaagaagtagttgctaacttagttcatcggctgagtaaccgtagtgaaggcccttttattgcaattaactgcggtgccattccaaccgaactgatggaaagtgagttgtttgggcataaaaaagggagctttaccggagcaactcaagataaacaaggcctcattttatcggcacacggtggcagtttatttttagatgaaattgccgaattacctttaagtatgcaggtcaaactgctccgtgcagtacaggaaaaaaagatccggcccgtcggttcagatcaggaaatcgatgttgatttccgtgtgattagtgcaagtcatcaagacttagatttattggttagacaaggtaaattccgtcaagatttattcttccgtattcatgttatggacctcatattgccacctctacgtgaacgtggcgaagatgtccttttactagccaatcactttattcagaaaatttgtatggattgggaaacgccacctaaacaattaacagaagcggccaaaacttatctgctacagcaacactttccgggtaatgttcgcgaattaagaaatatgattgagcgcgcaattaccttaagtgaagatgctacgatagatgtatctcatttacatcctgctcctctaagagcgaatatttctaatccttttgcttcggctgctcaaagcatacaaaccactgtggcagctcctcaagtcgtaaaaaaattaccaagtgaaggcttagaacgttatttagaaaatattgaaaaagatattttactcaatgcactcaatatgactcattggaatcgtactttagcagctaaaaaattaggaatgactttccgctctttacgctatcgtctgaaaaaatttggattagatacggagacagaacaggaagtataa

SEQ ID NO: 1303 - DNA, 1062 bp, Acinetobacter baumannii
gtcgagtattgtgccgtgaaaaattctaaaaagtctttaatgcatgtgctaagcatgtctattttgcttagtttgagttcaacaagctttgcagaactcgtcaataacccgtcttcagggagtactggtactgcaagtttaaattggtctgcagcggatgctagtcaacttttaaatgatgaagatgatgaaccgactccgcaaggttcaacttctgtaaccacaacattgcgtggcagtaatgcgccaagagttattacttctgcccctaaagttgctccaatccgtgatactgtgggttataacgcccagccgagtgttagtgcacgtgctgcacttgtaatggatgcacaaacaggtgaggtactttatagtaaaaataccaacgcatcagtgccgatcgcttctattaccaaattgatgacggcagttgtaacggcagatgcccgtttaaacatgtctgaagaaattacacttgagcaaattgattttgctggggctggcgggaaaaactcaagctcaacacttcgtgttggcgataaaatgaaccgcgcagaagttcttctgtttgctctgatgaagtcagaaaatccggcagcagcagctctagcgcgtacttatccgggtggccgtgctgcattcgtggcggcaatgaatgctaaagcgcgtgctttaggtatgaatgcaactcattattatgagtcaactggtttagatccgcgtaatgtatcttctgcgcgtgacttgggaattttggcgagtacagcatctcaatatggtttgattcgtcagttctcaaccacaccgacctatgactttaatttaggttatcgtgttcttaaatcaaataatacaaatgctttagtccgtaatggtggttggaatatcaacttatctaagactggttatattaatgaagcaggccgttgtgtggttatgcatactactgtgaactcacgtccagcagtgattgtattattgggtgaaccaagtacacaggcacgtaataatgatgcaactaacttgcttggttggttaagtaatttgccaaaacgtatttaa

SEQ ID NO: 1304 - DNA, 771 bp, Acinetobacter baumannii
agcttttaccgacacaattgtgcacaactattcgctcactatagaagaataggattgctaattttgtcattccattgcaagcttattttgctttatgtaacaaaaaacttgttttttgaaagaaaggaggtcttcttgattacagttttagttgtcgatgaccatgaactggtacgtacgggtatttgccgtatgttagaagatcatgccgatgttgaggtaattggacaagccgaatcgggcgaagaagcaattgctatcgttcgccaacaacatccgcaagtcgtactgctggatgtcaacatgccaggcatcggtggcgtagaaacaacccgtcgtttattacagacggctccagagacgaaagtcattgctgtaagcggccttgccgaagagccttacccatctttattattaaaagccggtgcaaaaggctatatcactaaaggcgcgccaattgccgaaatggttcgtgcaattaataaggtcatgcaaggcggtaaatattttagtgcagatattgccgaacaactcgcgagctcatatttatccgacactcaacaatccccttttgattcgttatcggaacgggaaatgcaagttgcaatgatggtcgtcaactgtattagtgcccaagaaattgccgataaactttttgtaagtgtgaaaactgtaaatacttaccgttatcgtatttttgaaaagttaggaattgatagtgatgtaaaactaacacatcttgcgattcgttacggtttgatcaagccctaa

SEQ ID NO: 1305 - DNA, 741 bp, Acinetobacter baumannii
atgaaggtgctaatttgtgatgacgagccacttgcagtggaacgattatcacgtttagtttcaaagatgggacatgaggttgtcgcaacagctcatcatggccaagatgccttggaacaggcacggcttcatcacccagatgtgattttacttgatatccagatgccgggtatgaatggtctcgtctgtgcggagcaattaagccaacttaatcctcgacctgccatagtgttttgcacagcttatgatcagcatgcattggaggcatttaagtcacaagcacaagcttatcttcttaagcccattgatcctcaagagctggagcagacatttaagcaattaacccagctaacgcaagcgcagctcagcgctttgcctaaacctgagcttttacaggatttaaaaacacaacgtcatcaaattgctgctaaaacctatcgtggggttgagctaattcctgttgaaaatatctattactttttagcagatcagaaatatgtcacggtacgtcataaaaatggcagtgtattgattgacgaaacacttaaagaacttgaaactgagttcgcagatcagttcatccgtattcaccgtaatgcattggtctcgattgcttatttagatggtttagagctagtaagttcgggccaatatcaggttcgcttacgtggcttagatgaaagactttccgtaagccgccgtcatttatctacccttagagaacggatacaccaactttaa

SEQ ID NO: 1306 - DNA, 339 bp, Acinetobacter baumannii
cgacacagccgttctttaaaaggttcacttagtaatttcacttgtagttatcaagcttggcttaaatttagccaccctcacattatttataaacacagactcagcaacaatcaagtgcagctcgtcagatttttaggatttatcatttttcattacactttttacataaaaaatgctcagaaatctcaccatatgatttatccactcactttaaaaataaaaaaggctcttaaacagagccttttttatcgttatccacgagcttttgattttggtttacttttaccaccaaatggtctcttttcgcctgtctcacgaggtggtagacccgtatgttga

SEQ ID NO: 1307 - DNA, 1620 bp, Acinetobacter baumannii
aatccacccagcacaggagcaggatcaatgatctttgaatggatgtctgatccgtctgcttgggtaggcctagcgacattaattgttcttgaaatcgtactagggatcgataacctcgtctttattgccattttggctgaaaagttgccaccagaacaacgtactaaggcacgtatagtgggtttaatactcgctttgggaatgcgtcttatcctcttagcttcaattgcttgggtcgtgacactcacccaaccacttttccatatttttagccatccattctctggccgcgatttgattttattgttcggtggtgtgttcttgctctttaaaggcaccatggaattgcatgagcggatggaaggtaaacaacttcataaagaagataatcctgttcatgctgcgttctggatggtcatcgttcagattgttgtgcttgatgccgtattctcattagacagcgtaattactgctgtaggtatggtgaaagaactgtcagtcatgatggttgctgttgtgattgctgtgggtattatgctgtgggcttcaagaccactcatggactttgtcaataaacacccaacagtagttattctatgtcttggcttcttgatgatgattggtttctctttggtggtggaaggttttggtttccatattccgaagggttatttatatgctgcgattggtttctcaattttagtcgaaatgatcaaccaaaccatgcgtcgcaaccaagagaagctagtgactactacagatttacgttatcgcacagcttctgcggttttacgtatgttaggcagtaaaaatagcggttctacttcagacgctcaaacggctgataaagaagatgtattggcaactcaagcttttgctgatgaagtctttgatgaagaaaatggcgcttaccatagtgtgcttgtacaaggtgtacttggtttatctgaacgtccagtaaagtcagtgatgacaccaagacctgagcttgaatggattgatttagacgaagaaccagaagttttaaaagaacgtttaatgtcgatgacacattcacgtttaattgttgctcgtggtgaacttgataatattgaaggtattgcgcttacacataaagttttaaatggctttattgaaacaggcgttatcgattttcaaaagcacttacgtgagccagttattgtgcatgaaaatgctcaagtgcttatggtgatggagcaattacgtcaggctcctttacaaatggcgattgttctaaatgaatatggttcaattgaaggtattgccacaccaattgatattttagaagcaattgcgggtgagttccctgatgaagacgaactagatgcagcagcagaaagtttagaagacggttcgttaatacttgagggttcaaccgatattcgtcatgtatcgcttttacttggacgtgacttagttgatgaaagtgaacaatattctactttatcgggctatttgttattccatttaggccgtttacctgaaaatggtgaaactgttgaagcggatggttatcgctttgaagttgtaaccatggaaggccataaaatcgagaaagttcatattgtttctatcgaacaggatgaatcgaaagattaa

SEQ ID NO: 1308 - DNA, 2439 bp, Acinetobacter baumannii
aatgatcggctttcatctttagatgtctctcctccatctgctagccgagattcgcaagccatgtctaccgcttatactatgcaaactgcgccaaaagcgttgtttgattacgacaaatattgggcgtcgtgttttgaaccagcgccatttttgccgatgtcacgagaagaaatggaccaactcggctgggatgcgtgtgactttattttagtctgtggcgatgcttatattgatcatccatcatttgtatcgggtgtgattggacgggtattggaagcgcaaggtttccgtgtcggtattattgcacagccagactggaccaatgttgaaagtttccgtgtattgggtaagccaacgattgcttggggagtgactgcgggcaatatggattcgatgatcaaccgctatacggcagatcgtaaaatccgttcggatgatgcatattctcctaataacgaaccaaataaacgccctgaccgtgcggcaacggtttattgccaacgttgtcgtgaagcattcccagatgtacctgtactattaggtggtattgagggtagtttacgtcgtattgcgcactatgattattggtcagacaaagtccgtcgttcaattttgatggattcaaaagccgatatgcttatgtatggtaatggtgaacgtgccattattgatgtgatgcaccgtttggctaaaggtgaaaaaatccacgagattacagatgttcgtggtacagcatttattattaataaacataacaaagcggctaaagcaaaatttgttgaaattgccagtaatgatgtagatacgattgggcgtgttgacccaattattaacccatatgtcatgactgaagatattgatggttgtgaaattgagaaagataaaggcaacacactagctcaatatcaaggttttcaaaaagaaattgttgcaaatccgattgtacgtgaaggcgaccaacttgatgaaaatactcagattgttcagctaaagcctgctcagtcaaaagcgattaaacacaagttacctccgcgagaattggctgtaattcgtttaccttcttttgaagaagtggcgaatgatcaagtactttatgcacatgcaaaccgtattttgcaccttgaaaccaacccgggtaatgcacgtgctttggttcaacgtcatggtgagcgtgatgtctggatcaatccacctccaattcctctaaccacagaggaaatggattatgtatttgatttgccatatgcacgtttgccgcatcctgcatatggagatgcgcgtttccctgcatttgatatgatcaaattctcggtcaatattatgcgtggctgttttggtggttgtacattctgttcgattacagaacatgaaggccgtattatccaaaaccgttcggaagattcgatcttacgtgagatcgagaaaattcgtgatacagcgccgaacttcaccggtattatttcagacttaggtggtccaacagcaaacatgtaccgtttgcattgtaaagatcctgaaattgagaagaactgtcgtaaaccttcttgtgtatatccgggtgtttgtcaaaacttgcataccgatcatgcacctttagtacagctttatcgtaaagcacgtgcgattaaaggggtgaagaagattctgattggatcgggattacgttatgaccttgcagtattgaaccctgaatatgtcaaagagctggtacaacaccatgttggcggttatttaaaaattgcaccagagcatactgaacaaggcccgttatctaagatgatgaaaccgggtattggtacgtatgaccgtttcaaacaaatgtttgatcgctttagtaaagaagcaggaaaagagcaatatttaattccttactttattgctgcacacccaggtacttctgattatgacatgatgcatcttgcgatctggctgaagaagaatggtttccgtgccgatcaggtacagacgttctacccatcaccgatggcaactgcgacaaccatgtattattcagggaaaaacccactcgcaaaagtggcgcgttacactgaaaatgtagacattgtaaaaggtgaaaaacgccgtcgtctgcacaaagcattcttacgttaccatgatccaaataactggccattacttcgtgaagcacttaaagaaatgggccgcgctgatttaattggtaattcaaagcaacatttaattccaacttatcaaccgaaaggggcggaaggagaatataaatctgcacgtaagaagaactcgactgttgcgggcgattcagtgaagcgttcaggtcaaacagttcaaaataaaaatcagcataaacgaccgcaaaaagggcaggtactgactcaacatacgggtctaccacctcgtgagacaggcgaaaagagaccatttggtggtaaaagtaaaccaaaatcaaaagctcgtggataa

SEQ ID NO: 1309 - DNA, 399 bp, Acinetobacter baumannii
tttatagggctatgtatgcaacaacctgatcaaaaagaattgttcgaggtcttagaaaagcaaaagaagaaccagcttcaggtagatcgtatattcaaaatagtattaccgatcgtcgcttttttactgagtgtaatttgtgcgaattttaattggcaatctacactgggtaccttcgtgatcttaacagtgacctttattgctgtgggtgtcaaaagacttcctttgtggcactggctcattgtgattaccatatattgtcttgtagataattacctcagttatggccaacttgatgtaactcacttacgtctacaactcggtaccatgttagtttttgtcggtatggtcggaattggtcgcccttatgtagatcgttggtttatgaaaaaccattaa

SEQ ID NO: 1310 - DNA, 1119 bp, Acinetobacter baumannii
ccttttggaagtattaatttgattattcggcgttatctcgtcaagcaagttgtctctacctcattggtggtcattgcattattgaccttaatcatgatgggtggtcgtctgatcaaatactttggtgtggcggcacaggggcgactagatgccagtatcttgtttagcatcattggatatcgtttacctgaatttctaaccctcattttaccacttgggttttttattggtttaatgttggtgtttggtcgtttatatgttgatcatgaaatggccgtattgaatggtagtggggtaagtcgtcatcagttagcgcgcttacttattccaatgacactggtttatatggtgtgtcagtccgtacttatgctttggatgacgccgtggggacttcgtgaattcgaaaaattaactacaacccaagcagtgcgtacagggtttgacttggtgcgaccaagagagtttatttcttctggaccttatacgatttatgcaggttcattgtcggaagatcgaaaaaaccttaaagatattttcttttatcagcgtgcagccaaagaaggcaagccagatgtcatgattttggcaaaagaggcgactcgtgtagaagttgcaaatgacaccgccaatgtcgttgatctcgttcaaggtcgtcgctatgaaatattcccgggacaaccaaaatatacacaagcagagttccagtcttatcgtctacgtttagaaaatgacaaagatgttaagtttgagagtggcgatgtagaagcactttccacatcaaaactattttctaaagcaaatgatccggtcgtaagaagtgagttgggctggcgcttatttggtccgtttaccattattattgccttgatgctatctgtggcattgtcggaagtaagcccgcgacaaggtcgttattatcgtcttattccatctatctttattttcgcgagtttgatcgtactcatgattgcaattaaaactcgtataagtaaaggagaactggatatttgggcttatccagtggctttattggtttatgcaatcgcagctgccttattttcacgtaagcagaaattagggccgaaaatcaagaaacagattaagcgagtgaaattataa

SEQ ID NO: 1311 - DNA, 375 bp, Acinetobacter baumannii
aaccttactggtgaaaagaagccgaaggaaacaaacatgaagcttgtaactgcaattgtaaaaccgtttaaattggatgatgtgcgtgaagcactctctgacattggtgtacaagggattaccgtaactgaagttaaaggttttggtcgtcacaaaggacatacagaactttaccgcggcgctgagtatgtggttgatttcttacctaaagtaaaaatcgaaattgcgattagtgatgaaatggtcgacgcggtaattgagtcaattacacgtgtggcaagcactggaaaaatcggcgacggtaagatttttgtgactaatctggaacaagtcatccgtatccgtacaggtgaaacaggaccagatgctgtctaa

SEQ ID NO: 1312 - DNA, 1476 bp, Acinetobacter baumannii
aaaacaactggatggatcaatacatccagtttttataagttatatggtccagatggggcgaatatgctaagaccttggcaaatacatttccgcattgatgaaagagaagaaaaaacggtttttctaaaactgaccaacttgattagtcaggaaattttgagtggccgtttagtacagggcactatgttgccggggtctcgcagcctgtcaaaagaattaggaattaatcgaaaaacggtacaagcagtttatgaagaattggaggctcaaggttggcttgtgactcggcctcgaaaaggcacatttgtggcagatgttttaccggaaaaaaagcctcaaatagagccaagagctgatcgaaaagttagtgataaaccaataattcaacaagttgctcagcagccccataacgatggtgtgccagatccgaggcttattccttatgaattgttttcgagggcctatcggcacgcactcattaaaattactcaaaaccagtacatgggatatggtgacccacgtggtatggctgaactaaggcaggctttaaaacaaatgttgtcgatggaacgttttatgaatgttgcggaagatgagatctgtgttgtacgtggaagccagatgggaatttttcttgcctctcgtgcattacccaatcggcagggtgtcatcgtcgttgaggaattatattacccatctgcttttaaagcatttcaatcaaatggctttcaagtggtttctgtcaaattagatgaacaaggtattgttattgaagatctcgaacggattttaaaagaacactcggttgcagcaatttatacaaccccacatcatcagtaccctacaaccgttaccatgacaatgagccgccgtcttcaactcttagaactttcaaaaaaatgggggttttacattattgaagatgactatgaccacgaatttcgctatgacagccggcctatgccacccttagcaagtttgcctcattctgagttggttattcatgtaggttcattgtctaaagtttttgcacccggtattcggttaggttacatcgtggcagctccaactatcattcaaaccattactgaagatattttattgattgatcggcagggcaataatattacagaactcgctttagcagatttaatgcaacgaggggagatcaagcgtcatattcgtaaaatgaaaaagatttatcagttacgtcgagaccatgcgttagctgagtttcaaagagtttttgctgaaagtattgagatacaaccgcctgcgggtggaatggctttgtgggtaaaatttcagaaatcatttactcaagatcagctcataaagctaaaagaactcaacattgatacagagcagaagtttaaacagaaagaatgtgctaatcattgtattcgctttggttttgcagctttatcagagaaagaaatcacctctctaattgagaccttaaatgaagctctttaa

SEQ ID NO: 1313 - DNA, 1902 bp, Acinetobacter baumannii
agcagaagcggaaaaaatcgaaattcaagtagaagaaggagtacccgcatgagtgatgcgttacgtattgcccttgtgggaaaccctaactgtggtaaaacctctctttttaaccatttaactggaactcgacaaaaagtcgccaactatgccggtgtaacggtcgagcgtaaagttggtcattttcagttaccttcaggccgttcggttcgagtgctcgatttgccgggtacatacagtcttaatgcgaccagtccggatgaagcaattactcgtgatgtctgtttaggaaaaatagcggaagaggggcaacaagacgcttttttatgtgtggttgatgcgaccaatttaaaattgcatttaggccttgtactcgaaatgatcgagttgggtcgcccaattttacttgtccttaatatgatggatgaagcgcgtcgtcgtggcatccagattaatactcaaaagttatctcaacgtttgggcgtaccagtcgttgaaacagtagctgtccgtaatgcgggtattgaaaatttattacatgctcttgatcaagaaaaatacagtgtgccacaaactgaactgagtggtttaactgggacccatcatcaaaaaatcgatatgatttttaaagatgttgttcattatgttgatcaggaagacaagcgtactgattttctcgatcgaattttcttacatccagtcttaggtctacttagtcttgccatcatgatgtttattgtattccaagcagtttttgcatgggcagcaccttttatggatggtattgaaggcttcttcggctggctgggtgaagtagtcggttctgtgattacacagccactactgcatagtctggtggttgacggaattatcgcgggtgcaggtggcgtagttgttttcttgccacaaattctaattttgttcttcttcattttagtactagaagaatcgggctatttaccgcgtgcagcatttttacttgataaattaatgtttcaagccggtttaagtggacgtgctttcattccgttactttcaagctttgcttgtgcagtaccgggaattatggcaacgcgtagtattagtgaccctcgtgaccgttttacaacgattatggttgcgccgctaatgacttgttcggcacgtttacccgtatatgccttgctgattgctgcatttattccagagaaaatggtctggggtattttcaatctacaaggactggtgctgttcggtctgtatatggctgggattgtgagtgcactgtgtgtttcattcttaatgaaatttttccaaaaagataagtctcaacacgctttactgctagagctgccgagttatcgtttccctgatttaaaaagtgtgggaatcggtttgttagatcgtgcgaagatcttcttgaagcgtgtcggcggcattatttttgcgctttctattttgctctggttcttgtgtactttcccacaaccaccagaaggggcgacattgcctgctatagattacagcttcgcaggtatgcttggacaccttatccagcctttattcgctccagttggttttaactggcaaatctgtattgccttaatcccggctatggcagctcgtgaagttgtggtcgctgcattaggtactgtatatgccttatcggcaactgatgaagatgcggtagcacaaggtttatctcatttaattagtgcagatggtacaggttggtcgttggcaacaggtttatcgcttttagtgtggttcatttatgcgccgcattgtttggcaacattggcaacagtacgtcgtgaaacaggttcatggaaacatgttgcagctatgactgcatatctgtttggtttagcttattttgcatcgtttgttacctatcagattgcttcccactattggggttaa

SEQ ID NO: 1314 - DNA, 831 bp, Acinetobacter baumannii
atccgaagaggtaggacggtgacttttcaagtctcaacactttcacaaaaaaatcatgtcatcatacaaattaccgatacacatttattggagtatccacagctagaatttgtggggatgaatcctgaagaaagtttccacgccattattcaacagatactaaaacaacatcccgaagctgatgcgattattcataccggtgacctcgcacaagccccaacacctattacctacaaacgttatatcaattttatgcaaaccttgggtctgccttttttccagaccctcggcaatcatgacaatgtcgaccactttcctctacataacgaaaaccatcaacaacctgtagttgtcgggttaggaaactggcgtgtgattatgctaaatagcgcagtaaagggaaaagtagatggtcatctgtcttcggaacaattagaaaatttagcgaatttacttgaacaatttgcagatcatcctgttttgctggcttgtcatcaccacccatttgccatgaaatcaaaatggattgaccaccataagcttcaaaactcaaatgcacttttagatactttaagtccatttcaaaacgtgaaggccctagtctgcggacatgttcatcaagattcccttaatatctggcaaggtatcgagtttttttatacgccttccacaagtgtacagtttaagccgtttagtaatgattttgcactcgaccaaaatgcaccgggttatcgttacattcgtctgaataacgatggtagttttgaaacaaaagtgtttcgccttgaaaatttcaaaacccgtataaacactgatatttcaggttattaa

SEQ ID NO: 1315 - DNA, 243 bp, Acinetobacter baumannii
ttatgcctgggctttaatgctgcagcgaaagtttactttaaattggatgctatatattttaagtatttgattttactatttttatatctttttatttttaatgtaaattccattttttattttacttcactttttctactttcctgtttaactgacaagcctataatgattcagaattattccaaatctaataaggatataacatgtctactgatccacaattcccaacacccaataatttag

SEQ ID NO: 1316 - DNA, 420 bp, Acinetobacter baumannii
agtcaagagggtattatggatattagtgaagtcgctaagaaggcaaaagtcacaacggctaccctacgtttttatgaagagaaaggactaattaaatcgatagggcggcaaggcttacgtcgacaatatggcaaacaagtaattgatcaactggcattaattgctttaggtcgtgctgcaggattttctttaaatgaaattgccacaatgtttgggcaagatggtaagcttgatcttgaccgtcaaaaactaaaagataaagctgaacaattagagcaaatggcaaagcgattacattttatcagtcagggattagaacacgctgctgtatgtcctgctgaaaatcatatggaatgtcccactttccaaaaatttttaaaagcagcaattgctggagaatatcagccaacaaaactttaa

SEQ ID NO: 1317 - DNA, 363 bp, Acinetobacter baumannii
agcatttttatgacggtaaaacgcttacacgtaacttcaagatattgtgaagtggcgatttcaggtaatttagtccatttagcagggcagctcgctgatgacaccagtgtggatattacagcgcaaactcaacaaactttggacaatattgatcgcttacttgctgaagccggaaccgacaaaagtcatatcctgtctgtcatgatttttctaaaggatattgataaggactatgcagccatgaatacagtatgggatgcatggattagcaaagagcatccacctgctcgtacctgtgttgaatctaaactttatgcacctgatgtacttgtagaaatgaccgttgttgcggtacttccttaa

SEQ ID NO: 1318 - DNA, 825 bp, Acinetobacter baumannii
gggttatctatgtcctttacccgatctcaaatttttcttgcctgtgctttggcttctagcctgttgttcagtgcttgttctaaagaaaacaaaccacaaaaagaagatgcgctcacagcgaccgcacctgctacaggggaagcttcaaccattattgaacgcaatgctaaacaacgtttaattgaaactttgcaaaaacaatttaagaatgcaaacatcaacgtcaaaattttagatattaagcctaccgaagttcctaatttatattgggttaaccttgaaggaatgacgtcggtttatacaacaagtgatggtaaatacctgattcaaggcgatgtcatccgtttaggcggtaaagaacttcataatatcggcgatagccttcaagcctcagaaaacaaaaagcatcttgctgctttaaaaaatgaagacttaattgtttatccagctaaaggcggtaaagctaaacatgtgatttatgtgtttaccgatgcaagctgtccttactgccataaattacatgagcatttagctgagattaatgagaaaggtattgaagttcgttacattgcatggccacgcggcgaacagtttatgccaactatggaagcggtttggtgtagtgcagaccgtaaagctgcatttaaccaagctgtacagggcattagtattccacctgctcaatgtaaaaaccctgttcgtgaacaataccaacttggtctaaacatgggcgtaaatggtacaccagctatttataatgttgatggtgagtacttgggtggctacttaacaccagatgaattgattaagcgattggataaataa

SEQ ID NO: 1319 - DNA, 591 bp, Acinetobacter baumannii
gtaaaagctatgaatgatagaacagcaagacagaaaattctcgatgcagcggcaacactgttttataacgatggcattaccgcaacaggaattaatacggttacggctaaagcagatgtagctaagatgtcgctttacaataatttttcttcaaaaggtgaacttgttgatgcctatattgctgcacgacatcaagagtggttagacctttatcaaaagcgtttagaaaaaacaaaaacagctaaagaagctattttggccgtatttgatgcctatcaagatcatgccgagtttgcttatgaaaagggttttagaggatgtgggctattaaatgctgcggcagagttcccagcgaatagttcaggacgaaatgctgtaagacagcataaagaacaagttgaggcgattgttgccgagcatttaaatcacttattaaaagattcacagcgtgttagctatatcgcctcacaactttcttttttattagaagggtcgatggcaagagctggtttagagggtagtagccgtcaacttcaattagcgagacaaatggcagaagatattttagatcgagaatgccaacatgattag

SEQ ID NO: 1320 - DNA, 1371 bp, Acinetobacter baumannii
caattctatatatggtcttgtccacctattctttccagtagagttaatcctatggatctggtttcacgtatacaaaatcttccaattggcaaatttcactacacgcttttatgggtagtgggtttaggctggatgtttgatgcgatggataccggcattatcgcttttattatgacaacccttgttaaagattggtcattaacacctgctgaaagcggttggattgtcagtattggctttgtaggcatggctataggtgcagtttgttctggtgccttggcagatcgttttggccgtaaaactgtatttgcgatgacaatggcaatttatagtattgcgactgcgttatgtgcttttgctccagatctaaagtggctattaatttttcggtttattgttgggttggggctaggtggtcaattacctgtagcagtcacactggtcagtgaatatgtgcctgctcatgttcgtggaagatttatcgttctgcttgaaagtttttggggattaggctggttagttgctgcactcatttcttattttattattcctaaatttggttggcatattgccttccttataggcggtcttccacttatttatattttagtgatttggaaaaaagtccctgaatctataccgtatttgattaaccgtggtcgtattgaagaagcacatgcactggtacaaaaactagaagctgaagcatgtgtgcaaattgttcaccatattgaagtcgtgcctgtggcgatgcgacaaaaagtttcatttaaacagctctggagtggtcaatttgctcgtagaagtttaatgctctggctaatctggtttggcattgtgtattcctattacggtatctttacgtggttgccgagtttattggtgaaacaaggctatgacattgtcaaatcatttgaatatgtattgcttatgattttagcgcagctaccgggctacttggcggctgcttggtttgtcgagcgtttaggtcgaaaaattacacttgccgcatttatcggtttttgtgctttgtcggcatatttctttggacaagccgacagtgtaaatagcattatgttttggggctgtctcatgtcattctttaatttgggtgcatggggagtgttatatacctatacaccagaacaatacccagccaatattcgggctttcgggtcaggctgggcatcggcaatggggcgtatcggtggaattgtcgcgccaatggtcgtgacacatatgatgattgctaaaaacggctttaatcacgtttttatgatgtttactgtggttttacttgccgtagctttagtgattttgatattaggtgaagagactcaaggtaaaagactagagtcgattgggctatag

SEQ ID NO: 1321 - DNA, 1203 bp, Acinetobacter baumannii
ggaggacatatgaagcatctcctgtgggtttactttttaattagcttagtccttttcgcagccttggctttattcagttatggctatggtatgggttatgtctatatttactggcggcaattgcaattgcaaacaaatgtatggggattagtctttacgtttattgtgatgagctttattgctcaggtgatatggctctggattaagcgttattcttctcgggaacaaagaaagagagagaatatttttcagtttaaaaatcttcatccgtatgaacaattaggtattgtctggttattagaggctgctgaagatcaacgggtatttatcgaacgtgtttttactcaatcaggccttctaaaaaatattattgatgccaaatttctagttttaagtggagattaccaaaaagctttagaggctttggatcaatccccaccaatggcttttgagttagcagaattacagcgtattgaaatattcttggcacaaaacgaagctgaacgtgccttaacccatcttgagtttttatatcagcatcagttatcgccatggcttgaagagattgagacagcatatcaacaacgtttaacagcgctttggggccagcttgctttacaacaaccatgggtatacttgcgttctatgaaatatggtttgttggacgctgaacatcgtgatttatggctacaacaacttcttcaacagtttgatcaagcttcaatagatgatttacaagcactgcaacagcgctatctggatttagagtcagaaattcaaaccagaccttatagcagtaaattgttatggttaaaacttttggcccgtatgccagaaatgagtattcagcatgaagtattaaccttgcatttactcaaagagcaattcgatccggacgtattttacttatggtttcagcaacaattgcttaagcaggttcctgactatgccgatgttgaagaaaagattaatcaatttgaatctcaatatatgaatttgccagttttaacatttgcaaaatggcatgtttacatggcaacaggtcgtcaagctgaagcagaaatattattaagtttataccctgataatattttaatgagctatttgcgtattaaatcaactttaaaagaagatgatgagttaatcaaacagttaaacctaatctttgaaaatgatgcgaattttttaaaatttaaaatctga

SEQ ID NO: 1322 - DNA, 1206 bp, Acinetobacter baumannii
gaatgtagtatggcaggcttagctcagaccacaatccagaaaatcaatcattggtatgaacggatattgccgaaatggccagcggaagtgacgccacgtaatgtcttgattttctgtgtggttgcattgttatgtatcggttcggtgatggtcgcatctgcttccatgccttatgctgaatatatgcatgaaaacccatttcactatgtgattcgtcatgggatctcaatcgttgctgctggtgtggtagcttatttaacctatcgaatatcactcaatacatggtttaaaaatacctttccactgtggttattaaccatggttctgttacttgcggctttggctgtaggttcggaagttaacggttccacacgttggattaaaattggtggttttaccttgcagccaacagaggttgccaaggttatgatggccatctttaccgcagattacgtagtacgccgtgccaaagaagtccgtacccactggaaaggcttacttcgtttaagtggtgttatggcaattacggtaggtttaattattgccgagcctgacttgggtgcgacggtggttattgtcatgatgatggtcggggtgttctttttagcgggtgcgcctccaacacaattcttaatcatgcttggtgcaattgtcacgggtattgtgtttttgattttatttgaaccttaccgtttccaacgtttgatttcgtttactgacccttgggcagacccattaggcgtgggttatcagttatcaaatgctttaatggcttttggtcgtggtgagtggtttggtacaggcttggggcatagtgttcaaaagctttcctatttaccagaagcgcatactgactttatgttggctgtgttaggtgaagaatttggtttctttggtatttcgattgtcattggtttatctttcttgatgctggcatgttgtatcaaaatcggccaccgtgccttgaaacatcattaccttcgtgcgggttatttggcttacggtattagtattattttcttactccagattttggtaaatgcgggtatgaacatgggcttaatgccaaccaaaggtttaactctgccatttattagttatggtggtacgtctttaatgatgtgtgcagctatgattagcttgatcttaaaaattgatgcttcaactcaagaagtgaaccctgagagggaagaatcaaatttctaa

SEQ ID NO: 1323 - DNA, 543 bp, Acinetobacter baumannii
cgaaagagtattgatatgagttacagcaatatcccagcaggtaaagatgcaccaaatgacatctatgtcatcattgaaattcctgcaaatgcagcgccaattaaatatgaaattgacaaagattctgatgcattgtttgtagaccgttttatgggtacagcaatgttctatccagcaaactacggttatgtaccaaatactttgtctgaagatggtgacccattagatgtacttgttgtaactccacatcctgttgctgctggttctgtaatccgttgccgtccagtgggcaaattaaacatggaagatgacggtggtatcgacgcgaaattaatcgctgttccacacgaaaaattatctccactttacaaagacgttcaggaatatacagatcttcctccattgttgattagccaagttgagcatttcttcagccactataaagatttagaaccaggcaaatgggtgaaaatcagcggttgggaaggtgctgacgttgctaaagcggaagtattgaaagcaatcgaagctgctaaaaaataa

SEQ ID NO: 1324 - DNA, 1008 bp, Acinetobacter baumannii
ggatataacatgtctactgatccacaattcccaacacccaataatttaggtatcgcagtttattcaaataatgcagaagctattggtaatactcctttagtacgtattaatcgtttgattaaaactgatgcaactgtattagccaaagtagaaagtcgtaacccagctttttctgtgaaatgccgtattggagctgcgctgattgcagatgcagaaaaaagaggcgcgttgaaagaaggcatgcatattgttgaaccaaccagtggtaatactggtattgctttggcgttcgtagcggcggcaaaaggttattccattactttaactatgcctgcaagcatgagccttgaacgtagaaaagtgttaaaagcactcggtgccaatttagtcctaacagaaccagcgaagggaatgaaaggtgcagttgatgaagctgtacgattagcaactgaacagccagaagtttatttcttgccacaacagtttgaaaacccagctaatccacaaattcatgttgatacgactggaccagaaatctggcaagcaacaggtgggcaagttgatatcttggtagctggtgtaggtacaggaggtacgattacgggtatttctcgttattttgaacaagttcagaataagccattgtactcagtagcagttgaacctgctgagtctccaattattactcaaacaaaaaatggtgagaacattacacccgcaccgcataaaattcagggaattggagcaaattttattccaaagaatcttgatttagatttggttgatgaagtcttaccagtgagtagtgaagaagcaattcaatgggcgagaaagtgtgccacccaagaaggtattttagtgggtatttcaagtggtgctgcattggcagcagtggctaaaattgcagaacgtcctgaaaatgcaggtaaaacaattgttgttattcttccagatagtggggaacgctatttatcttctgttttatttgaaggtttatttgacgaataa

SEQ ID NO: 1325 - DNA, 222 bp, Acinetobacter baumannii
gaaatggacattccgcatcagatttcaacgcaaattgagcaacttaatcaaggcgagcaatggaccttctcagcacaagaactttatatgagtcataacgactttaattcgctttcaatcttactcacacgagcatcggaaaaaggcgaattttcaattacacgcactcagcataataaaccttgggtcggcacacactcagttactctcaccaagcattaa

SEQ ID NO: 1326 - DNA, 777 bp, Acinetobacter baumannii
tgtgttttaatgctcaatcattttatccctgcgccatcatgttggaggcttcccttgagtccgagtaatccggtgttaagccatcatatttcttctcaatttaatgaagatttgcaagatgtgaacacaaagtttatgaccatgggtggcttggtcgaacaacaggttgccaatgcaattcattctttacttgatacagatgcgaacttagcaattgatgtccaatttaaagataatgcagtcaatcaatacgaacgtgatattgatgaagggctgacgctgattttggcacgtcgtcatccggcagcaattgacttgcgtatggtaattgccatgagtaaagccaatactgacctagagcgtattggggatgaagctgcaaaaattgcccgtattgcgcaaaatctatgtgaagagggcggttctcctcgtggctatatggaaacacgtcatattggtaaccaagtacgagtaatgattcatgacgcacttgatgcttttgcacgtttagatgcagatcaagcattacgtgtacttttagccgatgctgacatcgaccgtgaatatcagtcggcaacgcgtactttaatgacttatatgattgaagacccgcgtcatattgctcgtgtgattaatgtcatgtgggttttacgttctttagagcgtattggtgaccacgctcgtaatattgctgaacaggtcatttacatggcaaaaggctttgatgcacgccataccaaaattgaagaaattgaagcaaaagtacacgaaaagtaa

SEQ ID NO: 1327 - DNA, 1293 bp, Acinetobacter baumannii
atttgcttaattttttaccaactgtataaaatcatgagcaaaaaaactttaatcgcattattatgctgtgccagtttaggattgacggcatgtaacgatgataacgatcaagatcaaacttcacctactgaaaacgttaccgaaccaactctaatttcttttgctaagttacctgtagaaacttatgctgctggaccagactcaggggcatatgtgaaaggtgcaaatggaatttatcctccgtttaaaggtcaacctgtacagggattttctgctgcattaaaaaatgaagatggcagttatatggcaatggccgataacggttttggcactcaagataattcatcagactttttacttcgtatttataaaataaagcctgatttcaaaactaaaactaaaggcaccggtcaagttactgtacaaagttttatccaactgcgtgatccgtataaattaattccatttaatatcatcaatggtaatacacctgagcgtttattaacgggtgctgattttgacccagagtcgatgcagcgtactagtgatgggacttactggattggagatgaatttggtccatatttactccatttctcagcagatggtgtacttttagacgctccgattcctttaccaaatccattaaatccaactcaagaattacgttcaccacaaaatcaatttaataaagcacaaattaattttgtggaacctcttgttcaacaaagtggcggttttgaaggaatggcgatttcgccagatgggcagtatctttacccccttatagaaaagccaattaaatcaattcgggaaacagaaagacagttgctgatttctcaatttgacctgaagaaaaaagcgtatacaggaaaatattattggttccagttagacagtaaagcaaccaatattggtgatttccaactctttaataataatgagggtattattattgaacgtgatgccacgcagaataatttaggcggctataaaaaattaatccgtattaaattaaatgagtcaggccagctggtcagccgcgaagacttagtcgatttaattaaaattgctaacccgaatatgttgtatggcacagctagagcaggggatattggtacgggacaggtttttgccttcccatttgaaaccattgaagatgtaattattgaaaatggtacaacactgacggttttcaatgataataacttccctgggtcgacgggacgtaatgcaaagttggccgatgataacgagattattcagattcgtttaccaaaagctcttttctaa

SEQ ID NO: 1328 - DNA, 489 bp, Acinetobacter baumannii
gtcaaagtaattgaccctattaagtccgctatgcattgtccattttgcaacgccgcagatagtaaagtcatcgattcgcgtctagccgcagaaggctgtcagattcgtcgacgtcgtgagtgtgtaagttgcggtgaacgttttaccacttttgaaagctatgaagtggtgatgccccgtgtgatcaaatcgaatggaaaaaatgaaccgttcgatgaggcgaagctacgtcgttcgcttatgcatgccttacaaaaacgtccagtgacacaagagcagatcgagacggttctcagcgatattcagttgcaaattcgtcgtttgggtgagcgtgatgtgaaatccagaacgattggtgagattgtcatgcaatctttatttgcacttgaccacgttgcctatgttcgttttgcttcggtttatcaagattttcaggatgttgaagcgtttcgccgccaaattgagcaaatgcaacaacgtgaacactaa

SEQ ID NO: 1329 - DNA, 567 bp, Acinetobacter baumannii
atagttcaaattgagttttcatctatgcagttcaaaattatcgcagcccaagatctagatagaaatcaacgtcatcagattgctgagttatgtttttctgcttttgatgaagatccttggagtcaatatacttttatgcaaaaagctattcatgtcgttggtatattaaacaatcaaattgtctcgcatgccttatggacggatagagtttttaccataaatggtaggtccgatgtgaaaactgcttatgtagagtatgtgaccactgattacacgatgagaggtaaggggcttgcaacacaattattaaaatatttagtagagacattaactcatctggaatatgggcttgccgcattacaaccagaagatgaagcattttatgaaaaattaggatggactgtttggaaaggaaatttatctatcaaacaaaacacttgtagttatctaacggatgagtatgaaattatgctatatcctttaaatattcagatgaaagaccagctatcaaatagttcagaagaggacactatttgtgcagattggcgagaaggtgaactttggtag

SEQ ID NO: 1330 - DNA, 279 bp, Acinetobacter baumannii
ggatacaaaatgagtcgacaagtattttgccgtaaatatcaaaaggaaatggaaggattggacttcgctccatttccaggtgctaaaggtcaggaattttttgaaaatgtttctaagcaagcatggcaagaatggttacaacaccaaactacgctaattaatgaaaagcgtttaaacgtgtttgaaccagaagcgaaaaaattccttgaagagcaacgtgagaagttcttcaataatgatgagagcgttgaaaaagcggaaggctggaaaccagaataa

SEQ ID NO: 1331 - DNA, 540 bp, Acinetobacter baumannii
tctagcaaaatcattataaaaaacttaaaggatggacccatgtactatttaattacaatcttattactatttttgaccgttgttatggcggcgaaaagcctctcaagaaagcatcaacaagacagtgctttaaagcgccgtgccgtgttaagtagtcatgaacaaatgacattaactcgtttacagacagtattgcctaaatttactgtgttagctcatgtttcatttgatgcattattaacaacgaaatatgctcacactcgtcgcaaatatcaaaatatgacagctgactttgttgtgcttgatcaaaattatcaggttgttgtagtggttatgcttgaagaaagtggtttacgccgagcacatcaacaatatgagcgccgtttattacagcttgcgggctatcgtgtattaagttacagcactgtgccagattatcatgagttaagaagagacttattgacccctgaatcagagatggcaactttacatgcaacgcctcagctagaaagaatttcaaatgcttttgtaaagtcttaa

SEQ ID NO: 1332 - DNA, 1350 bp, Acinetobacter baumannii
acaatgaaaataaaattaatgcttgttgctggtttatggagttttacatcgtcgagttttgctctagatttagttgaaacttatgagcgcgcaaaactaaatgatccgacgtggcaagcgaatcaacaacagtttgaagcagatcagcttaatttaggcttagcaacaggcgctttactaccaacagttacattatctggaaatattacccgtaatcgacaaacggtaaagcgttcaaattttcctggtgttgatcaggaaggactttccgatgctttggtaagtaatacatcgactaccaaacaggctactttatctgcccgtcagcctctttttcgtatggatgcatgggaaggttataaacaggttaaaacttcggttgctcttagtgaaattactttaaaactgcaaaaacaagatcatgttttaaatgtagctgaagcctatttcaatgtattgcgacaacaggcacttaccgctgcatatttacaagaagaaaaagctttgcttgaacagctcaatatgatgaatgccaagcttaaagaagggttggtagcacgtagtgatgtgagtgaagcaaatgcccagtatcaaaatgccagagccaaccgtattgctaccaatgtgcagcttctattggctcaagagcaactatctgaatatattggtccttatcaagataagcttgctgtattgagaggtgattttatctttcaaaaaccttatccggcacagctcgatgagtggttaggattagcccaacaacaaaatttaaagattcagcaagcacgtttacaaaagcgatatgctgaagatcaacgtcgtgtggaaaaagctgcactttatccacagatagatgcagtggcgagttatggttataccaaacaaacaccagaaacgctgatttcgactgatgggaagtttgatcaggtaggggtagagatgaactggaacttatttaatggaggccggactcgaacttctattaaaaaagccagtgtggagttaaataaagcgcaagcccaacttgatgcggccattcgccgtgccaatgtcgatgtgaaaagtgcttttatgcaggtagataccgaccgagcaaaacttgaagcaagaaaggcagcaatggactcttcagcacttgtttctcaagcttcaaaagcaagttataacgaaggcttaaaaagtatggtcgatgttttattggcgcagcgtaatgctttttcagcaaaacaggattatcttaatgctcagtatgactatttattaaatgtattacgtttaacagcggctgtaggtcagctaggagaaaaagatctagttgaattaaatagctggttaacgtatcagtaa

SEQ ID NO: 1333 - DNA, 1086 bp, Acinetobacter baumannii
gcgagtgaaattataatgttagcacgtcgaatagtcgccaaatatgtgacgaaaaccactgcgctcgcaatgtttggtaccaccattgttttgtctgttttgcaaatcctgtttacttatctgggtgaattaggtgagctaaaacctgactataatgcatggcaagcttttatctatgtgttatggggtgcccctcgctatctatatgaaattttacctatctcggccttaattggcgctgtgattgggttaggcgctttagcatccaatagtgagctgatcgtgatgcgttcggtcgggattagcttatggcgtattgtaggttgggttatgcgctcagctttgctgcttattgttttatcttttgctctaagtgagtgggttgttccctatacaaatgagaaagcacaaagtgtcaaaagccatcgatcagttgctgctttaggtgaagtgaaaggctattggtcacgagaagggcaacgttttatttatattgattatgcgaactcacaaggaaatttaagagatatccaggtcgtagactttaacaaagactaccatttacagtctttaattaatgcagagcaaggaaagtttatccaggatggtcaatggactttacaaaaagccagccagatggacattcttacagatggtaattcgatactaaataatcatgatcagcagtctttaggtttggctctacagcctaaatatgtacacatggtgactttagaccctgaggacttgtctccaagtcagctgattagttttatgcgctatatggatgaatatagccaagtaccgaaaacttaccaattagctttttggcaaaaagtcgcttctccattttcactcattactcttgtattagtggcttgttcttttatttttggtccactacgtcaacagtcgatgggtttccgtttggtgatcgcactcttcattggtttaggcttttattatttacaagacttcttgggctacgcaagtttggtatacgcgccttcgccagcttggtttgtactcatgcctattattttaatgtttggtgccggaagttatttgctttatcgggcccgttaa

SEQ ID NO: 1334 - DNA, 1707 bp, Acinetobacter baumannii
ggattacgaatcggagataatggcattatggaaaagatttggtttgcagaataccaaaagacagggattccagaaacagtagcattgcctgcagaaaatacctcacttgttgatatttttgagcgtaatttccaaaaatttggttctcgtgatgcctttatctttatggataaagccatgtcatttaacgagttggagcttgcaagccgtaagttcgcgacctatttgcaaaatttggggttagcaaaaggtacgcgtgtggcagtaatgatgccaaacgtgctgcagtatcctgtagtggcattggcagtcttacgtgcaggcttggttttagtgaatgttaacccactatatactgcgcgtgaacttgagcatcagttaaatgactcaggtgcagaagtgctcgttattatcgagaactttgcaagtgtttaccaaagcattttgggtaaaactccagtgaagcatgtagttgttgcttctgtcggagatatgctaggaacactgaaaggtactttggtgaactttgttttacgtaaagtccgtaaacaaattccagcttggaatattcctgggcatgttaaatttaacagtgcattaaataaagaaaatccaagcaattataaacgcccgactttaactttaagtgatactgccgtgcttcaatataccggtggtacaacgggtgtttcaaaaggtgctgagctgactcaccgcaatttggttgccaatcttttacagtgtgatggtattttccaaagcaaattcggtgcaaacgatggtgctaaaggcgatcgtattgtttgtgcattaccgctttaccatatttttgcgttcatggtttgtgcgatgtacggtatgtacaaaggacaggcaaatatcttaattccgaacccgcgtgacttaccggctgtgattaaggaattacggaaatatcaaccttctttcttccctgcagtaaatacattatttaatgccttggtgaataatgaagagttcaagcaacttgaccatagcaacttaaaaatggcgatgggcggtggtatggcagttctgccatctacagcagaagcttggaagaaaattactggtaccaccattattgaaggttatggcttatcagaaacttcaccagttgcaactgcaaatccacccgcatctactgaatttagtggcaccattggtattccattaccgttaactgaggttgcaattttagatgatgacggaaaagaagtacctttgggtgaacaaggagagatctcaattcgtggtcctcaagtcatgaaaggctattggaaccgtccagatgagactgctaaagtcatgacagcagatggtttcttccgtaccggtgacattggcgtaatggatagccgtggatacgtcaaaattgtagaccgtaaaaaagatatgattttggtttctggctttaacgtttacccaagtgaaattgaagaagtgattgctaaacatccaaaagtattggaagttgctgcaattggtgttccagatgaaaaatcaggtgaagtgccaaaactctttattgtgaaaaaagatccaagcttaaccactgaagaagttttgaactttgctaaagaaaacttaacaggttataaacgccctcgttatgttgagtttatggatgaattaccaaaatcaaatgtaggcaaaattttacgtaaagatttacgtaagcctgcgtaa

SEQ ID NO: 1335 - DNA, 1212 bp, Acinetobacter baumannii
aatcgctcgatagttaatcaggttgagggaaagattccctctcccgcttcacctcataattggaacaccatcatgtctaatgccaatcgttatactggtcttgtagatcgttatcgtgaccgtttgccagtttcggcaactactcgtgctatctctttgggtgaaggcaacacccctctcattaaacttgagaatattccacgtattattggcaaagacgttgaaatttatgtgaaatacgagggcttaaacccgactggttcatttaaagaccgtggtatgaccatggctgtaaccaaagcggttgaagatggctctaaagcaattatctgtgcatctacaggtaacacttttgctgctgctgctgcctatgctgcacgcgcaggtatcaaagcgtttgttttgattccggaaggcaaaattgcgatgggtaaaatggcgcaagccatgatgtatggtgcgatcactatgcaaattcgtggtaacttcgatgatggtatgcgtattgtaaaagaagtggctgatcaagcacctgtaacgattgtaaactcaatcaacccttaccgtttgcaaggtcaaaaaactattgcttatgaaatcgttgaagctttaggccgtgcacctgattaccactgcttaccagttggtaacgcaggtaacattacagctcactggatgggttataccgaagcagtagctaaccaacctgctgaccaatttgaacaagttatttatgacgctgcgactgatcaattcactggtccaaaaccagaaggcttaccaacaatggtaggttatcaagcttctggcgcagttcttttcttacgtggtgctccagtagaaaaaccggaaacagttgcaactgcgattcgtattggtaacccacaaagctggaaccatgcaaaagctgtagtacgcgactctaaaggttggttcgatgaacttcaagacagcgaaattttagaagctcaacgcttactttctatgtatgaaggtgtatttgttgagccagcatctgctgcttctattggcggtgcaatccgtgacattaaagccggtaagattgctgaaggttctgtcattgtatgtacagtaacgggtaatggcttgaaagaccctgatacagcaattaaacaatgtgctgatgcagtgatgttgtcaattgatgcaacaatggaccaagtaaaagattcgattttatctaatatgtaa

SEQ ID NO: 1336 - DNA, 1101 bp, Acinetobacter baumannii
tcatttgagatttttatgtctgagttaaaacaagatcaatactggatgcagcaagccattgaacttgccaaacgaggactctattcgacaaaaccaaatccgaatgtgggttgtgtcatcgtcaaagataatcagttgattggtgaaggttttcaccctaaagctggtcagccacacgctgaagtttttgccttacgtgaggcgggtgaacatgcacaaggtgcaacggcttatgtgacgcttgaaccatgtgcacattatggcagaacccctccttgtgccgaagcattggtgaaagcccaagttaaaaaagtagtggtcgcttgtcctgatcctaatccattggttgcaggtaaaggtgttcagatattaaaaaatgccggtattgaagtagaaatcggtatttgtgaagatttggcagctcaacttaatcaaggctttttaaaagcgatgtctaccggcatgccatatgtacgattaaaagttgcttctagtcttgatgggcgtactgcaatggcatcaggtgagtcgaagtggattacaggttctgcggcccgtcaagatgtccaacattggcgtgccatttcaggcgccgtgattacaggcattgatactgtaattgccgatgactgccaacttaatgtacgttcacttcataatattgatatcgagacggttgctcagccaaaacgagtaattctagatcggagaggacgtttaccgctcaccgctaaaattttagaaaatcctgaaactgtcatggtgatggggccatatcgtcaggaactcgctgacttaggcgtgatacaattagaaattcaacctttaaaaacactattacagaccttatctaagcaataccaaatttatgatgtgttggttgaagctggcgcaactttgtctaccgcctttttgcaagaaggcttgattgatgaaatgatcagttatgtggctccaactttattggggcaaagtgcaagagccatgttcaatgcagattttgaatatatggcacagcaacttcgttttaaacttcttgatgtaacacaacttgatcaagatatacgcttaaggttaatccctacgcaagagaaagtatga

SEQ ID NO: 1337 - DNA, 942 bp, Acinetobacter baumannii
cggttaattgtgacggttaagaattctccagccgagcttagttcggctcttgcgaatcagcgaaacgatgttccactgattcgctactcaggtcggtttgcgccctcgccaaccggccctttacatttcggatcactcattactgctgttgccagttactgcgatgccagagcccatcaaggtcgatggttagtgcgtgttgaagataccgatatcccccgtatctaccccggtagtgaagaccatatactcgcatcaattgaagcttttcagttcgatccggatgccgagatcatttttcaaaaagaccgcctagatatttatgaaagtgtattagaccaacttaaaaaagagggtctggtttacgcctgtcaatgtacccgtaaaatgctcggttcaaacactatctatgcaggcacatgccgagatttgcagctcgacttccaacatcaagccattcgggtaaaagttcaagatcagccaatctgtttcgatgaccgcttacaagggcttcattgttctaatctagaacatgaccttggtgattttgtcctcaaacgccgtgatggaattattaactaccagcttgctgtcgtcgtagatgattacctacaaggcattactcatgttgtgcgaggtgcagacctgttagataacactgagcgtcaaatctggcttggtcagctcctcggctaccctaagctgagttacatgcatcttccgctcgccatgaacgaccaagggcaaaaactttcaaagcaaaaccttgcccatgcacttgatttaactaaagctcctgagttactacaacaagccatacaagccttaggtcaaccaaatgttgatttagatcgccccgaagtgatgctcaagcaagcggtagcccagtggaatgtagatttgattcctcatgggcaacagctttgcggaacatatctataa

SEQ ID NO: 1338 - DNA, 243 bp, Acinetobacter baumannii
aatagagactttacgccctaccattcaatactaccgatctcggcttgtttatttccgataaggtgttttctcatgttttctttatattttacgcaaacaaaatgttcatactttattgttatatataaaaataattatttagaagatttttatttttcgcgttgtataagttttttagtctctaaattaatgaagtgtagcgataccaaatatgaacttggcacagcaattgctaaagcttaa

SEQ ID NO: 1339 - DNA, 1404 bp, Acinetobacter baumannii
ttttcaaatgttatgaatgccacgccaacccatcaagccttgcaacccgaatatcgcctattggttcttttggtttccattggcttttttatgcaggcattagatacaacaattgtaaatactgccattcctgcaatggcacatcatttaaatgaagatccattacgtatgcatagcgtagtggtggcttatgttttatctgtagcagcctgtattcctttaagtggatggttggccgaccgttttggtgttagaaatacgtttttatcagcaatcattattttcacgcttgcttccttaggttgtggcctttctcaaagccttaatgaacttttatttttccgtgtcattcagggtgttgggggtgcgttattactccctgttggtcgtttatcacttttaaaaattattccccgaactcaatttttggcagccatgagcctcatgagtctagcaggtttactaggccctttagctggtccaacactcggtggttggctcgttgaagttgcaacctggcattggatctttcttattaatattccaatgggagtattgggcatattaatgacattaaaggtcatgccaaatgtaaaagagcctaccgttaaaacttttgatcttattggatttgtgctcttagtcgtcgcaatgattggctggtctttgggtattgaacatcttgcctcacctgagtattccaaatggtttagtatttctttattagtggtcgggatagtcgcaaccctttggtatgcctaccattcacatacccatcaaaatgcattgttccgtagccgactctttagaaacaagatttacgcgattggtattttaggtaatttctttgcccgctttggtggtaatgccttaccttttgttttaccactcatgctacaagtcgcttttggttttgagccattcattgcgggattaatgatgattccgctagtgttagggtcgcttttctccaaaccgattgttagaccgattatccagaaaatgggttatcgccgctttctattaattaacacaaccttagtgggtctatgtattgcttcttttgccattatgactgtcgacaccccaacttggtttagagctttacactttttcttattcggtacattaaactcattacaatttgtgggaatgaatacacttaccttaaaagatttgcctcaacaagatgcaagtagcggtaatagtttcttatcaatgattatgatgctttcaatgagtattggtgttgcactggcaggtacactcattaatgtatttaccgattactatggtacagcacatgtgacaactgccttccatgttaccctcatttgtttaggctgtattaatatcattaccgcactgatcttttggcaaatacccaaaaatacgcctgtgtaa

SEQ ID NO: 1340 - DNA, 1908 bp, Acinetobacter baumannii
ttcgttgatgttattcataaggatcatgtgatgaaccaattaacgaatctctcttctgctgaaatttcagcacaacatgaacaagatgcaaaagacttaacccgcatcttacccgcttctaaaaaagtttatattgaaggctctcgccctgatattcaggttccaatgcgagaaatttctttaaccgataccccaactggccttggtggtgagcacaacccacctattatggtatatgacacttcaggtgtttatactgacccgaatgttcaaattgatttaaataaaggtttaccttcagttcgtcaaaaatggattgaagagcgtaacgatactgacgttctttctggcctaacttcaaagtttggacaggagcgtttaaaagatattcgtactgctgatattcgctttgcacatattcaaaacccacgccgtgctaaagcaggcaaaaatgtcactcaaatgcactatgccaagcaaggtattattacgcctgaaatggaatatattgcaattcgtgaaaatcagcgtcaacgtgaagctgtagatatgcgccagcacccaggtcaaaactttggtgcgaaaaacttaaaagaaattacacctgagtttgttcgccaagaagttgccgaaggccgcgctattattcctgccaacattaaccacccagaacttgaaccaatgattattggccgtaacttcttggttaagattaatgccaatattggtaactcggcgcttggttcttcaattgatgaagaagttgcgaaaatgacatgggcaacccgttggggcgctgacaccattatggacttgtctacaggtaagaatattcatgaaacacgtgaatggattattcgtaactcaccagttccaatcggtaccgtaccaatttatcaagcacttgaaaaagttgatggtgttgctgagaatctgacttgggaaatctttaaagacacgcttattgaacaagctgaacaaggtgttgactacttcaccattcacgcaggtgtattgcttcgctatgtgccacttacagcaaatcgtttaacaggtattgtatctcgtggtggttcaatcatggcgcagtggtgtctcgctcatcatgaagagaacttcttatacacacactttgatgaaatctgtgaaatcatgaaagcctatgatgtgtcatttagcttaggcgatggcttacgtccgggttgtattcaagatgcaaatgacgaagcgcagttcagcgaacttaaaacactgggtgagctgactcaccgtgcatgggaacatgatgttcaggtcatgattgaaggtccgggtcatgtaccaatgcacatgattaaagagaacatggacttacagttagaagtgtgtaaagaagctccattctatacgcttggacctttaactacagatatcgctccgggttatgaccacattacttctgctattggtgcagccatgattggctggtatggcacagcaatgctttgctatgtgacacctaaagaacatttaggtttaccaaacaagaaagatgtgaaagacggaattattacctacaagattgcagcacacgcagccgatcttgccaaaggtcatccgggcgcacaggttcgtgataatgccttgtctaaagcacgtttcgaattccgttgggacgaccagttcaacctaagtctagacccagatacagcacgcagcatgcatgacgagactttaccaaaagaagcgcataaatctgctcatttttgctcaatgtgtggtccaaaattctgttcgatgaaaatcacccagaatgtacgtgactatgccaacaatctcaccaatagcgattcagaggttgaagaaggcctcaaagcaatgaaagaggtttatcaagagcaaggacaaaaactgtatcataaagtgtaa

SEQ ID NO: 1341 - DNA, 501 bp, Acinetobacter baumannii
aagcaaggtgtaaaaatgaatacctccactctgttcttccaagctttatgtcttggtattggtgcaaccatcgttatggatatatggctgttaatactaaaaatatttaaggtcccgactctaaactttgcctttcttggacgttgggtgggctggatatttcaaggaaaactcgtccatcaatctattgctaaaagtaccccaatgaaaggggaatatttattaggctggattgctcactatagtgtcgggattatcttcgcattgagctttcttttaattgtaggttcgacttggctcgaccaccctcagttttactcagcactactgtttggtttggtcaccgttctcattcctttttttattatgcaaccagctatgggtagtggttttgcctcatcaaaaacacctcatccttttttgaactgtctgaaaagtttgctgaaccatagtgtttttggctgtggtttatatctcactgcaaaactatttcaaatttaa

SEQ ID NO: 1342 - DNA, 216 bp, Acinetobacter baumannii
actgtattagtgggtttatcttcacttgagcagccacagccacctgcacaaccaaaagtcattttcggtttcagccattttgctaaagttgcccaaccctgcttttcacaaaaaacggatagtgctgaaaaggccgagtttgctgtttttggaaatactttcttaaaaacaacaacagcactccaaatcactaaaaccgcaataatcagatattga

SEQ ID NO: 1343 - DNA, 327 bp, Acinetobacter baumannii
ccttatttggtaattattctcatttatatgtatactagtaaaaaaggtttaggatcggatgcggtgcgtttatcagcgttgaaagtgaagcaagcggcgaccatcaccaaagtgaatcggatagaagtagagtccgaggagcaagatttggtcgcaattcgtttggaaagtctgggttttgtaccaggcacgcgagtggaagtgattaccaagggtgtttttggtggtgatccgatcttaatccaaattggctttactcgtttcgctttacgtaaagcagaagcggaaaaaatcgaaattcaagtagaagaaggagtacccgcatga

SEQ ID NO: 1344 - DNA, 429 bp, Acinetobacter baumannii
tcaacagtattttcagtgatggatggcactatgcacggcatcagcagcattatctatattattttagtggcatgtttgctgccatacgcatttaccgtaattgcaaaatttaccggtggttttcagcccgtcgataatcagaacccaagagactttcttgctaatacaaagggtatcgctgctcgggcaaatgcagtacaacaaaacagttttgaaagtttacctttatttttaacagctattttgatggctgaatatatggtggtccctgaatactttattttaagattgggctgggcctatattattttacgcgtgatttatggcatttgttacttaagcaattgggcaactttacgctctattgtctggtttttatcattgttatgcccaatattcttgttgatcgtgacaattaagttgacttga

SEQ ID NO: 1345 - DNA, 624 bp, Acinetobacter baumannii
ataccatcatttcatttgaaatttgattattggttttgtattttgcttacctcatctttagctcaagatcattttgcaccatcacaattacagcgccttagtctcagattctttattattgcgttgatgacaataatgacgggatgtacaagtttaggccctaatagcggttcattttcttggcgctcaagtaagctttcgtctggcttacaaaaagcttattccgttccgccaagtacagcaaatcgcctatctccaatgattattcaaagcgctgatagatataatgttccaccgcttttattggcagctgtgatcaggcaagagtctagctataatagtaatgctcgctctcccaccggggctattgggttaacacaaattattcccagttattggcaacaaacttgtgctggtaacttgtatgatgaatctaccaacatccaatgtggtgcttatattttaaatcattactatcagacagcagatagctggttcaaagcgacagcatattataatgttggtccaacaggatatgaacgaagtttctggacacgacacaaagcaaaaaaatatgctcgatctgtgaaacgtcatcagaaaactttaaaaagtgctttataa

SEQ ID NO: 1346 - DNA, 579 bp, Acinetobacter baumannii
agggaaacttccatgaaaactgttgccattatttaccatagccgccaaggccacactcaatttattgctcagcaaattcaaattggcgtcttgagccatcacaatattaaagcagatttactcaatgccgaggatcttatcgagagctcaggaattcttatccaatatgacggattaatttggggatctcccacttatttaggtggtgtatcttccaagttaaaacagctcatggatgcaactggtccattatggaaaaaacaaagttttaaaggaaaattagcggctgggtttaccgtttcatctcttcctgctggtgataaacaatccacactaatttcaatttttactttttgcatgcaacacggcatgttatgggtaggtaacccaattctaccagaacagcatcaaggtgttgcctatacacaagcagctaaccgactcggttcatggtcaggtttaatggctcaggctgaacatgctagtaatgcagatggttttgatgaaggagatattaaaactgctcaacaatttggtgaaaattttgcattgaccttaaatgcttatcaagggacttaa

SEQ ID NO: 1347 - DNA, 543 bp, Acinetobacter baumannii
aatgctacatcttgtaacccttatgttgttaatcagtggtttttaatcatgaaatctaacttaatcactcggtcaggccatgacaaattagttgctgaattaaaacaactttggcatgaagaaagaccagaaattacgaaaaaagtaaattgggctgcaagcctcggtgaccgtagtgagaatgcagattatcaatataacaagcagctccttagaaaaattgatcgacgagtacgctacttaggaaagcgtttagaagagttaaaaattgttgattactcacctgagcaagaaggcaaagtttactttggtgcttgggtcgacattgaaaatgaagaaggggagcaaaaaactttacgaattgtcggggtagatgaaatttatgatcaccatcctcagcatatttcaattgagtcacctatggcacgtgcactcttgagtaaagaagtcgatgatgaagtagaagtacacacacctttgggcaaaaagctgtggtatatcaatgcaattcgctatgaaaaacctaaaaatgatgaaatttag

SEQ ID NO: 1348 - DNA, 3120 bp, Acinetobacter baumannii
ttaacgacatcataccgagcagccatgctatctaaattttttattcaacgccccatttttgccaatgtattggcgatcattgttatggctttcggtattttttcggtcatgaatttgcctgtagaacggtatccagacattgctccacctaaaattactgtgtcggccaactatagtggtgcagatgcacaaacggttgagcaaagtgttactcaaattttagaacagcaaatacaagggattgatcacttactctattttagttcatcaagtgactcatctggacgtagtcgaatcactataagttttgataacggaacaaatccggatactgctcaggtccaagtacaaaatagtattagtggcgtaatacgtcgcttacctgatgaagttcaacgccaaggtgttacggtaagtaagtcactgggtgatacttttatggtaattggcttatatgactcgactggtaaaacaggaaacattgagctatccgactatttaactacgcatgtggtagataatctgaaccgtattgaaggggtgggcgaaactgatgtatttggttcacaatatgccatgcgtatctggttaaatcccgataaattaaagcaatataatttaatgccaagtgatgtagcgaatgcaatcaccgcacaaaatactcaagttgcagcaggtgcgatcggtgacttacccgtaattgacggtcaatatttaaatacaaaagtcacagcaggttctcgcttaaaaacagttgaggattttaaaaatattgtcgtaaagtcgaataaaacggcgagttatgtgtatttaaaagatattgccagagttgagctaggtgcagaaaactatcagtcttttaacactattaatggctatcctgccgcaggtttgggtatttctttatcttcaggtgcaaatgcaattcagacctctaagctcatccaccaaactctagatcagcttacaacgaaactaccagcgggttataaaatcgtttatccacgagataatacgccctttgttcaagagtcaattaaggaagtagtaaagactctggtagaggcgattattctggttattttggtcatgttcctgtttttacaaagctggcgtgctacgctcattccgagtattaccgttccagttgtaattttaggaaccttcgctgtcttatatgtgcttggttttagtattaacaccttaacgttatttgcgctggtactagcgattggtttgctggtcgatgacgcgattgtggttgtagaaaacgttgagcggctcatgcatgaacagcacttatctcctaaagaagctgctattgagtcgatgggggaaattagtggtgccttagtcgggattacgttggttttaactgctgtttttattccaatgtcctttttaggcggttcaattggggtgatttaccgtcagttttctattactttagttgccgctatggcgttgtcgcttattgttgcgctcattttaacaccggctttatgtgcattaattttaaaaccaaaccctcaacctcagcgctgggccgtatggtttaaccaaaagattgagcaacttaaaaatcaatatatcaagcttgttcagacgagtattcattacagtaaatcagttattgtgatttttgtggctttaattgccgtttttacgctgttctataacggtttaaaaagcggttttattcctaaagaagaccaaggaattttaagtgttcaaattaagctcgtagacagcgcaccaatttctcaaagtcagaaaattggtgagcaagtccgccaatatttcttaactcaagaagataaaaacgtagatttggttttaatccgctatggacgaaattattcgggtacaggacaaaacttggcacaagggtttattgctttaaaaccatgggatgtccgaacaggaaaagaaaactcggctgaggctatacaaaagcgtgcaatgaaatactttagtcattttaataatgcacagattaatgtgactttacctgcctcagttaatggcttaggtcaaacagatggtctggatttatggattcaggatttgaatggacaggggcaagattttctagatagtgccttccgccaattgcaggctcaaagtaaaaattattcaactttcgaaaactttgataagcagtcaaccaatagtaaggcaaatcttaatattaagattgaccagaaacaggcactagcaaatggactacagctatcggcaattaataacactttgtcgagcgcatggggcggaacttatgtaaatgactttattgatcggggccgtattaaacgtgtcatgattcaaggtgatgccgagtttagatctaaaccggaagatttatataactggtctgtacgtaatgaccaaaatgaaatggttccctttagttcatttgccaactttagctggggcggggcgccggaaattgtaaaacgctatatgggatatagtgctttacaactacaagcagatgttgcgagtggcagcagttctggccaagcgatgaaagatgtagaacaacttgttaaccagcaaaaagatattggtttagcgtggacaggtttatcttttgaagaacaaaagtcgactaatcaggccgtgtggttatatttaatttcggctggatttattttcttatgtttagctgctttatatgaaagcttaagtattcctgccgccgtaatgacatctattccgcttggtgtaggaggaagtgtgattttctcttatatttttggtttgccaaatgacgtgtatttccaaattgcgctattaacgactattggtttgtcatgtaaaaacgccattttaattgttgagttcgcggccttagcgcaagaaaaaggtaagaatgccattcaggcggccttagaaggtgcgagcttacgattaagaccgattctaatgacctctttagcctttggggcaggcgtaattccgcttgtgtttgctcaaggtgctggtgcggttagtcgtcaagagattggtattagtattttaggtggcgtcatgtttggtactgtgctggttctgttttttattccggtcatgtacgtattattacgttcactatttaaatcgaaagcttcaacctaa

SEQ ID NO: 1349 - DNA, 636 bp, Acinetobacter baumannii
attatggatactcctctaattaacacaccagtccgccattggtgtgaatttgagttcatttccaaaactgtgaaaaatccaaatatccatattaaagggaattactcttactactcggcatattgggatcaaggttttgaacgctgtgtagtgcgatatctacatgacaagccttctactcctgacaagccaattgatcagctctatattggtaattttgtttgttttggcgctgaatgcgtgattatgatgggtggtaaccaacttcatcggccagactggatatcgacattcccctttgatacccgaagttttttagccgctggtgacactataattgcagatggctgctggattggaagccgtgcaatgattatgcaaggtgtaaaaatcggtgaaggtgctgttgttgcaactggagctgtggtcactaaagatgtccctccttatacaattgttggtggcgtacctgcaaaaattattaaataccgttttcctcaggagcaaatagaaaaactacttgctttaaaaatttatgatttagatgaaaaacaagttttaaaaatgcgggaatatttacaaacggatgatatagatgcattaacagcatatcttaaaaaattacagagcgaataa

SEQ ID NO: 1350 - DNA, 1845 bp, Acinetobacter baumannii
ataggcctcaccatgaccacagtgaacgcaccagaattcgttcgtcatcctaagcttatagcatgggttgaagaaattgcaaacttaaccaaaccagcaaaaatcgaatggtgtgacggaagcgaagaagagtatcaacgtctaatcgacttgatgatcgctaacggcaccatgcagaaattaaaccaagaaaaacatcctggttcttatcttgcaaattctgacccatctgacgttgcgcgtgttgaagatcgtacttacatctgctctcaaaataaagaagatgctggtgcgacaaacaactgggaagatccagctgttatgcgtgaaaaattaaatggtttatttgaaggttcaatgaaaggccgtaccatgtacgttgttcctttctctatgggtcctttaggtagccatattgctcacattggtatcgagttaactgactctccttatgtagctgttagcatgcgcaaaatggcacgtatgggtaaagcagtttatgacgtattaggtacggatggcgagtttgttccttgcgtacatacagtaggtgctccacttgctgaaggtcaaaaagatgttgcttggccttgtaacccagagaaatatatcgttcattacccagaaactcgcgaaatctggtctttcggttctggttacggcggtaacgcgttacttggtaaaaaatgtttagctcttcgtatcgcttctgtcatgggacgcgaacaaggttggttagctgaacacatgcttattcttggtgtaactaaccctcaaggtgaaaaacactacatcgctgctgcattcccatctgcttgtggtaaaacaaactttgcaatgttaataccaccagcaggttatgaaggttggaaaatcgaaactgtaggtgacgatattgcttggattaaaccaggtgaagatggtcgcttatatgcgattaatcctgaagctggtttcttcggtgtagcacctggtacaaataccaaaactaacccgaactgtatggcaactcttcacaaagacgttatctatacaaacgtagcagtaactgacgatggtcaagtatggtgggaaggtctttctaaagaagttccagcaaacttaaccaactggaaaggtcaacctcacgtaaacggcgaaaaagcagcacatccaaatgctcgtttcactgttgcagcaggtcaatgtccatctatcgatgctgattgggaaaacccagcaggtgttccaatttctgcattcatcttcggtggtcgtcgtgcagatacagtacctttagtttctgaagctttcgactgggttgacggtgtatataaagcggcaactatgggttctgaaactactgctgctgctgttggtcaacaaggtattgttcgccgtgacccattcgcgatgcttccatttgctggctataacatggctgactactttgaccactggttaaaccttggtgcgaaagtaagtgaaaaagctgaagcttctggcaacaaattaccaaaaatcttcaatgtaaactggttccgtcgtgatgctgaaggcaacttcgtatggcctggttttggtcaaaacatgcgtgttcttgagtggatcattgaccgttgtgaaggtcgtgcgaacgctgttgaaacacctatcggttttgttccaacatatgaagacttgaattgggaagggactgagttcactaaagaacaatttgacctcatcacaaatcaagataaagaccagtgggttactgaaattgaaagccatactgagttattcaataaacttggcgaacgcttacctaaagcattaaaagaacgtcaagcagctttacttgaagctgtaaaaactggcttctaa

SEQ ID NO: 1351 - DNA, 186 bp, Acinetobacter baumannii
cactcgttaactggttttttattggtttgttggaaatattcaatcacgctttgtttttgtcttaattacatttattgtttaattctacttgtcttttttataccgctcgttgatcatcacaaggtctcgaagcggcatttacttctgttaattaacgacatcataccgagcagccatgctatctaa

SEQ ID NO: 1352 - DNA, 345 bp, Acinetobacter baumannii
ataatgtcaacgtttatggattccattttgacaactcagtatgaactacatcgacaaattttagaagtcatcgctttgattccatatggaaaagttgcaacttatggccaagttgctcgtatggcaggtttacctaaacatgccagattagttgggtatgtgcttaaacatcttgaggcagatcatcaggtcccttggcaccgtgttattaattcgcaaggtaaaattagcctaagtaagtttaatgaaaagggcgaaaatattcagcagttaaagcttgaagcagagggaatctatttattaaatggcaaagtaaacttaaaggaatttgcttggcagccttaa

SEQ ID NO: 1353 - DNA, 654 bp, Acinetobacter baumannii
gttatggcaacacgcatcaccaaccaaaaattgtctaaaagtagtcgtgcgtggatgagggaacatctagacgatccttttgtaaaaaaagcacaaaaggaaggatatcgtgcacgagcagcgtataaacttcttgaaattcaagaaaaatataagttgatcaagccaggcatgacagtggtggacttgggagcagctcctgggagttggtcacaaatcgctgggaaactcgttggtagtaaaggattggttattgcttccgatattttacctatggatgctttgccagatgtcactttcttacaaggcgacttcagagaagaagctgtatttgaaaaattgttaaatattttaaacggaagacaagtagacattgtaatttctgatatggcccccaatacatcaggtaatagggctgttgatcaacctcgacagatttacttgtgtgaacttgctttagactttgctcagaaagtcttgggtccaaatggacagtttgttgttaaagtgttccaaggcgcaggatttgatgagtttcgtaaacaagtcgttgatagttttgatgtgttaaaaacagcaaaaccagcagcttctcgggcacgatctaaagaagtttttttggttggacaagggcgtaagaaagcattgcaataa

SEQ ID NO: 1354 - DNA, 1038 bp, Acinetobacter baumannii
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaaatagcaaagcgtttaaagacatttcctgatttggatcaaacaatgaatgtaagccatacaacgatttattcaacgatacgagcattacccaagggtgagttgaaaaaagacttattatcctgtctacgtcatgaaaataaaaagcgaaaagctaacggtgaacctaaaaaagattctatattacaggatattaaaactattcatgagcgcccagccgaagttcaagaaagaaaaataccgggtcattgggaagctgatttaattaaaggtaaagacaataaaagttcgatagcaacacttattgaacgaaatacacggctctgtatcttggcaacattacctgatgcaaaggcagaatcagtgcgcaaggctttaactgaagctctgaaatatttacctgcagaactgcgtaaaacgttgacctatgaccgtggacgtgagatgtcagaacataaaatactcgaagaagatttaggcatagatgtatatttctgtgacccacattcaccctggcaaaaaggcacatgcgaaaatatgaatggtttaattaggcaatatttacctaaagggattgatttaaatcaggcagatcagcattatttaaatcaagttgccatgtcactgaatactcgtcctagaaaggcgttagattggcttacaccattagagaaatttgctcagcttgttgattatcatatggcttttgaaactgtcgcacctcatgtttga

SEQ ID NO: 1355 - DNA, 387 bp, Acinetobacter baumannii
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaaatagcaaagcgtttaaagacatttcccgatttggatcaaacaatgtattcaccacgccgtggaagatcagagtcgcgt

SEQ ID NO: 1356 - DNA, 897 bp, Acinetobacter baumannii
agcttacttgctaaaatagccgctgattttgaaccggagctttttatgcagttaatatctttaccaaagcagattttacagtgtggacagcttcaattagatttatctcagccccatgttatgggtatcttaaatgtcactcctgattctttcagtgatggtggtaaacataaccaattagaccaagcggttgatcatgcacttagtatgattgagcaaggcgcgactattattgatattgggggggaatctacccgacctggtgcttcagaagttgtagtagaagaagaagtgcgtcgtgtggtacctgtggtcgaggctttatctcaccataacgttattttgtcgatcgacacaagtcagccagaagttattcgcgcagcaaaagcagcaggggcacatatctggaatgatgtccgtgccttaacacgtcccaatgctttaaaaactgccgtagaattagatatacctgtagtaattatgcatatgcgcggtgaaccaacgacaatgaatcagttggatcagtacactgatgtaacactcgatgtgatgcaagagttgcaacagcgtattgatgaggctttggctgctggggtaaaaaagcacaatattattgttgatcctggatttggctttgcgaaaaatgcccagcaaaatttaaaactattaaaagaattttggaaacttaatgaacttggttatccaattttatccgggctttctcgtaaacgtttcataggtgaagctttacaaggcgctcctgcagatcaacgtgttgtgggaagtgtaactgggcatttgcttagtattcagcagggagcatccattgtaagagcgcatgatgtaaaggaaatgcatgaagcaattttagtttggaaagcgatgcagcaagtctga

SEQ ID NO: 1357 - DNA, 543 bp, Acinetobacter baumannii
ctacttatggcaagttacgaactttcagcttttgatcgttttcatgctgtttctgttgttggcgcaattgaacagcaagccccatatacattaaatgtgggtttttggattcgtgatccaaaccaactaattatctggccccaagaagtcgcagctcatcctcgccaggactttttgtgggaagagacttgttttgaaattttcattggcgtgcattatgaagatttctaccgggaaattaatctttccccttctcaagcatggcagacttaccagtttgaagaatatcgctatccggaaagcatgcctcccctcgttgcttacgatatcgaattgaatcatctcaaacgtacccactatgggttaaatgtaagtcttgacttaagccagtttatgcaacaacaccgcttaaaatgggcaaacctttatctaggtttgactgctgttttaaaaacaaaagatggtatgcagtactatgcaatgcagcatagtggaaaacatgctgattttcacaataaacgtgattggctgcatgagttttaa

SEQ ID NO: 1358 - DNA, 507 bp, Acinetobacter baumannii
ctgtgttttctcaacttaagagggaccgaaatgcaacgttatccaatgacccctgaaggtaaaatcgccttagagaaagaattacaacatctgaaaactgttgaacgtccacgtattactcaagcgattgctgaagcacgtgaacatggggacttaaaagaaaatgcagaatatcatgctgctcgtgaacagcaaggtttctgtgaaggccgtatccaagatatcgaaggaaaattgggtgctgcacaagtcatcgatgttaaagacttagaacaaaacggtcgtgttgtattcggtgttacggtaacgattgaaaaccttgatactgaagaacgcaagacttataagattgttggtgatgatgaagctgattttaaaatcaataaaatttcagtaaattcgccaattgcacgtggccttttgggtaagaatgaaggtgatgaagtaaaaattaccactcctcaaggcgaagtggaatacgaagttgtaagtgtagaatacctctaa

SEQ ID NO: 1359 - DNA, 933 bp, Acinetobacter baumannii
tattttatttataagaggattttctcaatgatgcggattggtttgtttttgcttaccaacctcgcggtactggttgtagctggcattattttgtcactcttcggtgtcggtagttaccatggcgcgggtggcttaaatctaggcaaccttttagtcatctgttttgtgttcggtatggtgggctctttagtctctctattcatgtccaaatggatggctaagaaaactactggtacagaactgattgacccaaatgctcctcgtaaccaagctgaaagctggttattgcaaacagtcgctgaactttctcaacgtgctggtattaatatgccagaagttggtatcttcccttcatatcagtctaatgcctttgcaacaggctggaataaaaatgatgccttagttgccgtttcatctggtctacttgagcgtatgaacaaagatgagctacgtgctgtgctcgcgcacgagatcggccacgttgcaaatggtgacatggtcacattggcactcatccaaggtgttgtaaacgccttcgttatgttctttgctcgtgtagtaggtgactttattgaccgtaatgtctttggtcgtcaagacaatgaagccccaggtatgggttatttcatcattacaatggttctagatatcgtgttcggtattcttgcctctgccatagtgatgtggttctctcgttaccgtgaataccgtgcagatgaagccggtgcgcgtttagctggtaaacaagcgatgatttctgctttattacgtttgcaagctgaaacagagttacctgaccaaatgccaaaagaaatgaaagcgttcgcaattgcggaaggtaaagaacaaggctttagtttagctgcattgttccaaactcaccctacaattgaacaacgtgtggcagctctacaccaattagattgcccataa

SEQ ID NO: 1360 - DNA, 9873 bp, Acinetobacter baumannii
gtctctatttatcttaatattttagaaaaacttaataattatttgaaatttcatggtggaaaaatggtacaagtatcattaatggcaaataatgcttcaaaaaataatacagttgatattaatgtaggccaaacaaaaaatattgtaatagatccgaaggtaatcgcaaaaattgatattaatccagaaagaattgcttcaataacaagagatggtaatagtgcggttattcatctaaaagatgggactgaaattgttttagagaacttttttattagtgaaaatccacaaattcttttaaatgaagggcagacttattggactgctaatttagctgaagatgctacgggacagaccactgttaattatttagaattaaaagagataccaaaatatatagatgcttcatcttctgtacctatctggtcttgggttgttagtgctttagctggtgcagggacagttgcattattatctcagcaagacgccaaagataaaacacctccggaaccaggtaaattgtctttccaaaatcttttagattcaggggagttaacacaagatcagatcacgaatgataacaagtttaatttaaaactcagcggacaggaaaagggaagtagcgtaacgtatttaatctctaccgatgaaggtaaaacctggcaagagacgacattaaatcaaaaagatttagctgatggtatttatctttataaagctgtagtgacagacgctgccggcaatacctcggaaacggctgtacaaaaagtggttgtggatactaccacaccacaagcaggtgaactgactctatctgacttgaatgatacaggcgtttcagtaacagatcagatcacgcaagataaaaacttcaatttaaaactggaaggacaggaaagcggcagccgagtaacatatttggtctctaccgataatggaaaaacttggcaggaaaccacggtagcccaaaaagatttaactgatggtgtttaccaatataaagctgtagtgacagacgctgctggcaatacctcggaaacggctgtacaaaaagtggttgtggatactaccaccccacaagcaggtgaactgactctatctgacttgaatgatacaggcgtttcagtaacagatcagatcacacaagataaaaacttcaatttaaaactggaaggacaggaaactggtagccgagtaacatatttggtctctaccgataatggaaaaacttggcaggaaactacgacagcccaaaaagatttaactgatggtatttatcaatataaagctgtagtgacagacgctgccggtaatacctcggaaacggctgtacaaaaagtggttgtggatactaccacaccacaagcaggtgaactgactctatctgacttgaatgatacaggcgtttcagccacagatcagattacgcaagataaaaacttcaatttaaagcttgaaggacaggaaactggtagccaagtaacatatttagtttccaccgatgaaggaaaaacgtggcaggaaaccacggtagcccaaaaagatttggctgatggtatttatcaatataaagctgtagtgacagacgttgcaggcaatatatctgaaactgctatacaaaaagtagttgtggatactaccgcaccgcaagcaggtaaactcactttatctgatttgaatgatacaggtgtttcagccacagatcagattacgcaagataatagttttactttaaagctagttcaaccgattgtgattggggaacaagccgctttactagaccactatgaagtttcaaaagatgaaggtaaaacttggcaagagacaacagctgatcaaaaagatttagctgatggtatttaccaatataaagctgtagtgacagacctcgcaggcaatatctcagaatctgctatacaaaaagttgttgtagataattccttaaatgttgaatcaaccacagtgattgtaaagccgattactgaagacaatacaataagtctagttgaaaaagatcaagttatttctataagacttgaaatagctaatttacccacagatttaaatagctcactgacatcagtaaatacgacattagaaaatgttacttataactttcattttgatgaagtcacgcaagaatgggttaccgaaattccagcagagtttctttggtcagtagagccgcaaaccaatatatcaattgatattagtcttactgatcaagctggcaatacagccattatcacacatacccaaaattataatgtggatcctactccgaattcaccaaccctagattcattgactttcaacaatatagatggagctattatttcaggtagtgcatataaaggaagtaaggtcgatatctacaataaaaatggtgattggcttgcaagtacaataactaatgaagaaggtaaatttactttacaagatctttcaattaacacaaatcaagaagtttacgcagtcgctacttataatggttatagcagtgaaaattcatcaattgggttagttactgaagttccagctattagtattacacgaattagtccagaaggcgtgattagtggttatgcgactgaaggtagtcattttattgtaaaagatcagaatggaaatattctacaagaatttaattctaatgtatttgatagctctggtattacaccatttagtgtaatggcattaggcgaagtaagaccatttattttgtccctcgatcagcctttagaggaaggggctcaaattattatctctacagataaagataatatttcaggccatccacaatatattactgcagactatactccagcagtatttttagaaactccacaatttgatattagtggtgaaactttatcagtacatgttaatgaacctaacagctttattcgtgcattttctggagaaggcaatttaattgctacaggttttaccgatgagcaaggctttgcaagtttacaggtgttccaatttttaaaagaaggcgaaacggttactgtacaagtagtagataaaaatcaaaatacgagtgaaaccctaatcgaggttccaaactttgcttatattccacatgttgaacgtattacacaagaaggcttaatttctggagttgctgaagataatagtacggtaattgtacgtgatgctgatggcaatgaattaggaaaggttacattaggtgatgataatagttggagtgactttagtcattttagcttgagtgtaaaccgccctttaattgatggagagaaaatttccgttcaaattattgataataaagggttaatgagtcctgagcaaaatatcatcgtagatctgactcctccacctgctccaacggagttaaatttcaatgatgctggtgatttagtttatggtcatgcagaacctttctctgaaattttagttaaagatgggcaaggaaatattcttaataaatggttttggaataactggaccgatgagagtggaagtttctcaatagaactaggtacatttttaaccaatgctgagacggtttatgtcacggctaccgatgtaaatggaaacgtaagtttagcagctcagatacaagcacctaattatgcctttgctccatatgttgatagctttacttcggatggcgtgataagtgggcaagctgaaaataatagtactctcgttgttaaagacgccaaaggtgacgttgtagctgaaattaaagttggtgaagataacggttggaatggatcgagttattttaaactccagcttgaccgtcctcttgttgatggtgagcagtttttcttatcaattaaggatgctcgtgggcaagtaagtgctgatactgtaattaccgctgatacggttgctcctacaccagccagtaatttagttttctcagaagatggttcatatcttacgggtgtagcagagctgaatactacgattcaggtttttgatcataatggtcagctagtgaatatatggaataacaccattaactctgatggtacatttactatttacttaggtagcaacaatttacatggagaagcattcacagtcactgttaaagaccaagccggaaatgtgagtgaggctatttcaataaatgcgccacttgacgatattgcaccgaatccaattaaaaatattttacttgatgcaaatggtcagaactttacagcacaagcagaagcaaatagtcagatcgaagtttttgattcattgggtaatcagacaggttggggttctacagatagtgcaggtaatgcttctggttctttcaatcaaacttatttacacggtgaggaactcacttttgttgttatagatcgagcaggtaatcgcagtatcgaatttaagcaaaatgctttaattgataccattgcaccaaatccgattgaaaatatcatcttcaacgaaaatggccaaagttttacagctcaggcagaagccgggagttctattgatgtattagatcagactggaaataagattggttttggttacaccgatagttcaggtaatgtatcgggttattttcagcaagtttacttacacggtgaggaacttacttttgtcgtgatcgatcgagcaggtaaccgcagtgcagaggtcaagcagagtgctttgaatgatgacgtcgcaccaaatccgattgaaaatattttattagatctcaatggtcagaactttacagctcaggcagaagcaaatagccaaattgaaatcaaaaataataatggtgacgtcgtaggttatggatcagcagatagtgcaggtaatgtttcaggatatttgtatcaagtgcatttacatggcgaagagctcacttttattgtagttgaccgagcgggtaaccgcagtacagaggtcaagcagaatgccttgattgatgatattgcgccaaatccgattgaaaatattgtattagatatcaatggtcaaaactttacagcgcaagcagaagcaaatactcaaattgaagttaaaaatgctgttggtgagattgtaggttcaggttatgtggatggcgctggtaacgtgtcaggttatttatatcaggtctatttacatggagaagagctcacttttgttgtcgttgaccgagctggtaaccgcagtacagaggtcaaacagaatgctttgattgatgatatcgcaccaaatccgattgagaatattttacttgatgcaaacggacagaactttacagctcaggcagaagcaaacactcaaattgaagtcaaaaatgctgctggtgaagtcataggatctggttcaaccgatagcatgggtaatgtttctggttacttctatcaggtctatttacatggtgaagaactcacttttgttgtagttgatcgagcgggtaaccgcagtacagaggtcaagcagaatgccttgattgatgacattgctccgaatgcgattgaaaacattatctttaatgaaaatggtcaaaactttacagcgcaagcagaagcaaatagcaaagttgaagttaaaaatgctgcgggtgaggttgtaggttctggttatgtggatagtgctggtaatgtgtcaggttacttgaatcaagtttatttaaaaggtgaggagctcacttttgttgtgattgatcaagctggtaatcgtagcattgaagtaaaacaaacagcctttcttgataatacagcaccggaaaatgcgactaatttagtatttagtgaagatggctcatatctaagtggtatggctgagccaaatgcgacgattcaaatatttgatcagtatggtcaattattaaatcagtggaataataatgttaattgggatggaacatttaacatctatttaaacagtaactacatgcatggagaagtatttaaagtagttgtagttgatcaggctggtaatttgagtggtgaggttactgtaaaagcaccgcttgatgatattgctcctgtagctgcaagtgatctggtctttaatgaagatggttcatccctttctggtgtagctgagccaaataccttcatccagatttttgatcaaaatggtcagcagatgaatacatggagtcagagtgtaaatgctgatggtacatttactatttttttcggtacttacaatttacatggtgaagagtttacagtcattgttaaagaccttgctggaaatgtgagtgaagctgtttcagttaaggcgccgcttgatgatattgccccaaatccgattaaaaatattgtatttgatgcaaatggccaaagctttacggcacaagcagaagcaaatagtcagattgaaatttttgactcatttggtagtcagataggttggggctctaccgatagcactggtaatgtgacgggttacttctatcaagtgtatttacatggagaagaattaacgttcgttgttatagaccgagtaggtaaccgtagcgatgaaatgaagttaaatgctttgatggataccattgcaccaaagccgattgaaaacatcatctttaatgaaaatgggcaaaattttacagcacaagcagaagcaaatagttttattagtgtcaaaaatgctgtgggtgagtttgttggctatggttatgtcgatagtactggtaatgtgtccggtcacttcaatcaggtttacttaaaaggtgaggaactcacttttattgttatagataaagcaggtaatcaaagtattgaatataagcaaaatgctttaactgatgatattgcaccaaatccgattgaaaacatcgtcttaaataaaaatggacaaaactttacagcgcaagcggaagccgatagccaaatcgaagttaaaaatactgcgggtgaggtcgtaggttctggttatgtagatagtattggtaatgtgtcaggttcttttaatcaagtctatttacatggagaagagcttacttttgttgtagttgaccgagcaggtaaccgcagtacagaggtcaagcagaatgctttgattgatgatatcgcacctaatcaaattgagaatattgtttttgatttaaatggtcagtactttacggggcatgctgaagcagatactcgaattgaagtactagatcaatttggcaatcgcgctggttggggatatgttgatagccaaggtaacgtgataggttatttcaatcaggtttatttacatggagaggaattaactttcatcgttgtagatatagctggtaaccgaagtgttgaagttaagcaaaatgctttaattgatgatgtcgcaccgccagcagcagcaaatattacattaacctcagacggattgctttttggtgaggcggagccaaactcaactgttgaaattattgatcaatatggtgcagttatcacaacaacttatgtttggtacgatggcacatttaatcaatggattaatctgagtcaataccagacacaaaatttaagtattgttgtcaaagatcaagcaggtaaccgcagtgaagttgtacatgaattagtaccagtatttaccaactcaccaattgctgcaacagagctaaaactggatatagatggtcatattctgacaggtaaggcgacagtaggaatgtcggttgttgttacatctactgatggtcagaccattaacggagggtggaataatgctgtgaatgaagatggtagttttgctattcagttaaatgattactatctacagggacagacattacaagttcgagtttatgatcagaatacgaatcaatatagcctaatctctgaaattattgcgcctttagacaatattgctccaataattaatgatgtggtaattaacaatgatggttatagcattactggacacactgatccgaaagtaattattaaagtaatggatgaggatggagattttagagcagaatttcaatcggatgaagcgggatatttcaatgctagtatttatccaccactattacgtggagagcagttatttatcacggcaacagatttagccaaaaatataagtacaccatttaatattacttttaatgcagatattaatgcaccgccatcagcaaatcatgttgtggtatctgaaaatggtttctttattgagggaactgctttaccaaatagtgtggtgcgtatttatgatgtgtatagtaattatattggtggtggttttgtagacgaaacagagcattttaatatccagttatattcacctcaggcgaatgggcaaactttacgcgttgttgtggagcaaaatggctatcaaagcgcttacaccgaaattaaggcacctatagacactgtcgcaccaaatgcagcaactcagcttgtcttagaagatggaaatgtactttcaggacaagcggaagcatattcaacagttaatatttttgatgctaataataatttagttggtcaaactactgtcggaagtgaaggtagtttcttaacacaattatggtcacaatattggcatggtgaaacattgacggtaaaagtagttgatgccaatcaaaatgtgagtgtaggtacgacgattactgctacaaatgatacaacagcaccgaaagtggtcacccagcttgccataaatggatggggagagctcacgggacacgcagaaggtaaggctactcttgaaattacatattattttgctgatcaagaaccttccgtaacgagtactacggtcatggcagatggaactttctctacttatgtgtatgggactgcaacgtcatttgaccttactgttattgatcgtgcaggaaatcgtagtgaaactatcagcaaagcgattaatgatttacctacaatcactgttgatcagtttaaaggtgatgctacggataatacgtatatagttgatcatataagtgattttgttgaagaatatactgttgagccgtatgcaatatataaagatgtttggattgataatagctatatgtatccagaatgggttagtgaaggtcattatgaacaaatatggtttgttgatggatattatgattcccaatggatcacaagtggttactcaactgtacaaaatgtttatcaagatcagaatggtataacttatattgataatggtacggcagatagcgattatagtcgatatgaacaacaatattatgatttcgtgaatgggcaatggcaagaaggctacgaactgacttatatacgttctgaagaaggttgggttgatacaagtcataatgaagatgtttatattgatacaagtcattatgaagatgtttgggtagatactagccactatgaagatgtttgggtagaaagtggctattgggagaaccagcttgtcgaatcaggctaccgagatttcgattttggtggacacgataaaatagtaagctctgtgagttatagtctggttggatattctgattggtcgacaggtctagaaagcgggcgttatgtagaagacttggaactggttggttctgctcatctcaatgcaacaggtaatgctttagataatcttttaacaggtaactctggtaataacattttgaatgggcgtgaaggtaacgatacctatatcactaatgaaggtactgataccattctgttccaattgctaaatagccaagatgcgactggcgggaatggacatgacacggtgttagattttactttaggtgatataagaactaaccttcaagctgacaaaatcgatttaagtgaactattaattgactattctaaagatgtaagcgcattagctaaatttattactgtagagcaagatgctgggaacacgactattagtcttgaccgagatggcgaaggtacaatgtttaatagtgtgtcactgttaactctaaatcaagtaaatacaacattagacgaattactaaacaaccagcaaattattgtttag

SEQ ID NO: 1361 - DNA, 375 bp, Acinetobacter baumannii
atggatagttattctccctataaaggtaaaagtggcctaaagcgcatcttgaacgctaccagttattcaatttcaggatttaaagctgcttatcaaaatgaagctgcatttcggcaaattgttttaattaatcttgtactcatccctgtcagctttttcctggatgtaactcgcggcgaacatgccctaatgatcattgtctgtttatttgccatcattgttgagctcttcaactctgccattgaagcagtggttgaccgagtttcactcgagaaacaccaactttccaaaaatgcaaaagatatgggtagtgccgctcagtttgttgcactttctattattgtcaccacttggcttattattttatttggataa

SEQ ID NO: 1362 - DNA, 456 bp, Acinetobacter baumannii
gatacttcatataagaaaataaggacgatactgatgaataaaagtattctatgtttggcattaagtagtatgttcattttaactgcctgtcagactacgcctcgacaatataatggttcaactggctaccagattgaaaaccaaacaaaaacttcagcgactttagcttacactttagctggtcgtagtaaccagcaacttgatgagcgtaaattgcaacgtgcttgtcaaaatgtgttaggtgctcagaaagtttataaattatcaattttaagcatcaatgaaattcctaatccagctaaagatgagcattacggaattcaactaggtgaaacccgcgcttcttttggcttatcaaatacacctagcttaaataatggtgaagattatgcgacacgccaagcacttgaagcacgtccaagtacattaaaagtcgttcgttatacttgttcataa

SEQ ID NO: 1363 - DNA, 969 bp, Acinetobacter baumannii
tgcgattctcatccgaatcatataaaattgcgcggtatttttatttatgggtatatctcgtctatgtacgcgccagttgagtccaacgaaggatttaattttaagcctgaacttccaacaagctcggcctattatcgtttgcttaagaagcttcgccgtcaagttggacatgccatccgtgacttcaatatgattgaagatggtgacaaggtcatggtgtgtgtgtctggtggtaaagacagttataccttgctcgacattttgttgcagttcaaacgtattgcaccaatcaattttgatattgttgcggttaaccttgaccaaaagcagccgggtttccctgaagatgtcttaccacgttatatggaagaaaataacattccgtattacattttggaaaaagacacttacagcattaccaaacgtttaactcctgaaggtaaaacgtactgtgctgtgtgttcacgtttacgtcgtggttcgctttatggctttgctcaagaaattggtgcaaccaaagttgcgctagggcatcaccgtgatgacatcattgctactttcttcttgaacttattccatggcggtagcttaaaggcaatgccacctaagcttttatcgtcggataagaaaaatattttgattcgtcctttggcttatgttgaagaaaaagacattatcaaatatgcagagttacgtaagttcccgattattccgtgtaacctttgtggttcacaagagaacttacaacgtgccatgatcaatgaaatgcttcgtgaatgggacagacagtatccaaaacgtttacacagcatttttggtgcgttacagaacgtttcaccttcacaacttgctgaccgtgatttgttcgatttcgaagttcttgactcgcagcgcgaattagactttaaagatccagaagaactgaaaaaacgtttagatgtagtgaacttaagctttgctgctgaataa

SEQ ID NO: 1364 - DNA, 1785 bp, Acinetobacter baumannii
tcaggaacacaacctttctggttatattgcctacgtaaaagatttcgaagggggggagatatgacttaccctctatttgaacttaagctgctagctgctcttgatcatgctcaatttgaagaggcaatttgggcatttgaaattgatggagacatttctacattattactgattgattatgcattagaacaattccatcaaaaaaaagttcaagctgatgaaatctatcgggttcctgaacaaaaaattaagaaaattggtgaacaaaatttaggtctagaaaaaaatgaatcatatacatttgccgagctcttacaattcttaatttttactcaggcaaatgatgttaaagatgccttaagcaatatgctgttgggttctgttgagcaaacacaattgatcttgtctaaaagagcagaatattaccagttagctttaagagcacctaatcaattaaaaaatctatttttgttggtaaaacacatttatagctatccagccgagctgaaaaaacttttctttattagaacactttcttttaaaaataaagtatatcaaccgattacgcctttgcttgctcatccggtactcacttcggttttatatatctcacatacctttagacagatttatatcacttattccaaacataaccggagcattggttttttctcttttctggatgatattcaccgtctggagcatttggttccttactatcattattttcaagaagggcatgtggaggcaaaaaaatattcttctcaaacaggcattatcaatattcttggagatacctattttggtgaaatgtataccgaaaagcgtaagtctagagggcaaacagatgccttacagcaatatgggtatcattattcatttgaaaaaatacagccctttttaggtaaaaatgacatcaacatagctaactttgaagcagtattttctttagaaaatcaatcgccgttaaaagataaaaagccatttattttaaaagcagatgctaaaaaaacattagaagaatttaagagtattcatctaaattatttggttttggcaaataaccatttgaaagattacggtgagcaaggattagcttatacattacaacagttggatcaggcgagtatttcttatattggcgctggattgaaccaaaaagatgctcacaattactttgaaatcacttttgagactaagcactatgcgatttttaatggttattggcatagagacactgcctatctggattatgacttttatgcgttaggatcaagaagtggagtagcttgcttaaatggcgttttacttgaacaaataatgcgttataagcaggctcacccagaacgcaaaattattgttatttgtcattggggtgtcgactttaagcctattacaaaagaccaaactaaactcgcgactattcttactcaagcaggagcggatctgatcgttggtcatggtgctcatactattcagccaattcagatcatcaatcaaaagcctgttgtttttaatataggcaatgcagtgtttaatagtgacggtgaatatgaacagcaaaatgctttgccatttggctgtatagctagacttgatttggcaaaagatttactccgtctttaccccatttacaccaataatttacaaacattttggcagccttatcctgtagatactgaagacttctcaaaggccagtatttatatgacatctttactgacccctgagaattacatggcatcccaagataaattagggagatatcttgaagttaaattttaa

SEQ ID NO: 1365 - DNA, 378 bp, Acinetobacter baumannii
gctggtttttttatgcctgatgaaaataatgccatgatcagaatattaatatttatatccgctctactcttttttataccctttgcaaatgccaaagatatatttaacggtacaatcttgttcaaaaataatgattggcactttgtacgctgctctattactcaagatgactatctaattgaagcccctcaagagatatttactcaatttaaagagctacagcagcaacaaaaaaactattgggtcagcgtgttggcagaagtaaatgaacagcagaatggaaatttaattttaaaaattgagaaaatagacgaagttcacttagacgagacatgtcatttaatagatgctctcaaaaattttgaaaatcgagagtaa

SEQ ID NO: 1366 - DNA, 945 bp, Acinetobacter baumannii
gcgaagatgcacataaaaacaacatctagaataaaattgtcgaaattatcatgtattattggcacattaaattcatgtctaccttggagatgtgctgtggcattggttttagacggtcgtgcattagcaaagcaaattgaagaaaatttgttggtacgtgttgaagctttaaaagcgaaaacaggtcgtaccccaattttagcgactattttggttggggatgatggtgcttctgcaacttatgtacgtatgaaagggaatgcctgccgccgagtaggtatggattcattaaaaatcgaattaccacaagaaaccacaacagaacaattattagctgaaattgaaaagcttaatgccaatccagatgttcacggtattcttttacagcatccagttcctgcacaaattgatgagcgcgcatgttttgatgcgatctctttagcaaaagatgtagatggcgtaacttgccttggttttggccgtatggcaatgggtgaagctgcatatggttcagcgactcctgctggcattatgacgattcttaaagaaaacaatatcgaaattgctggcaaacacgcggttgtagttggtcgttcagcaattttaggtaaaccaatggcaatgatgttgttacaagcaaatgcgacagtaacgatttgtcattcacgtacacaaaacttacctgagcttgtgaaacaagctgacattattgttggtgctgtaggtaaagctgaacttattcaaaaagattggattaaacaaggtgcagttgttgtagacgctggtttccatccgcgtgatggcggtggtgtaggcgatattcaattacaaggtattgaagaaattgcttctgcttatacaccagtaccgggtggtgttggtccaatgaccattacaactttgattcgtcaaactgtagaagctgctgaaaaagctttaggttaa

SEQ ID NO: 1367 - DNA, 3252 bp, Acinetobacter baumannii
acagtaattaaggagcgaataatgcctaaacgtacggatattaaaagcatcttaattattggtgctggtccaattgtcattggtcaagcttgtgagtttgactattctggtgctcaagcatgtaaagcacttcgtgaagaaggctatcgtgttattttggttaactctaacccagcaaccattatgactgacccttcaatggctgatgcaacttatattgagccaattacttggcaaactgttgctcaaatcattgaaaaagagcgcccagatgcagtactccctactatgggtggacaaactgcacttaactgcgcacttgcacttgatgaaaatggtgtattagaaaaatacggcgtagaacttattggtgcaacgaaagaagcaattgaaaaagctgaagaccgtaaattgtttgatgaagcaatgcgcaaaatcggcttggaatgtccaaaagctgccattgctgaaacaatggaagaagcattggaaattcaatctcgctttggtttcccagtaattatccgtccgtcattcactatgggtggttcaggcggtggtattgcatataaccgcgaagaattccttgagatttgtgaacgtggtttcgacctctctcctactcaccaattattgatcgacgaatctttaattggctggaaagaatacgaaatggaagttgttcgtgacaaaaacgacaactgtattatcgtatgtgcgatcgaaaacttcgacccaatgggcgttcacacaggtgactcaatcactgtagcaccggctcaaaccttaactgacaaagaatatcaattgatgcgtaatgcttcagttgcagttcttcgtgaaattggtgttgagacaggtggttctaacgttcagttcggtattaacccgaaagacggccgtatggttgtgatcgagatgaacccacgtgtatctcgttcttctgcgcttgcgtctaaagcaactggtttcccaattgcaaaaatcgcagccaaacttgctgttggttacacccttgatgaattgaaaaatgacatcactggtggcgtaactcctgcaagctttgaaccatcaattgactacgttgtaacaaagattcctcgttttaacttcgagaaattcccacaagcagaacctgtattaaccactcagatgaaatctgttggtgaagtcatggctattggtcgtaacttccaggaatctgtacaaaaagcattacgtggtcttgaagttggcgtaagcggtttcgatgaaaaaatcgaagctggtgcaacaaatgtaaaagaaactattctaaaagagcttaaagttccgggacctgaacgtatttggtacgtagcagatgcattccgtcacggcttctctttagatgatgtatttgaagcgactaaaattgatcgttggttcttgatccaaattcaagatatcgtcaacacagaagctcaagtaaaaactttaggttttggtgatctcactgctgaaaatatccgttcgttcaaacgtaaaggtttatctgaccttcgtattgcgaaccttatgggtatttctcaaaagcaattccgtaagcaacgttggaacttgggtgtttaccctgtttacaaacgtgttgatacatgtgctgccgagtttgaatctggtacagcatatatgtactcgacttacgatgaagagtgtgaagctaacccatcaaatcgtgacaagatcatggttattggtggtggtccaaaccgtattggtcaaggtatcgaatttgactactgctgtgtacatgctgctttagcaatgcgtgaagacggttatgaaacaatcatggtgaactgtaaccctgaaactgtttctaccgactatgacacatctgatcgtctatacttcgaacctgtaacacttgaagacgttcttgaaatcgtacgtacagagaagcctaaaggcgtaatcgtacagtatggtggtcaaactccacttaaattggcgcgtgctttagaagaagctggtactccaattatcggcacatctccagatgcaattgaccgtgcagaagaccgtgaacgcttccaacaaatgattcaacgtttacagcttcgtcaaccaaacaacagcattgtaaaatctgctgaagaaggtatctctgaagctgcgaaagttggctatccattagttgttcgcccatcttatgtattaggtggccgtgcaatggaaatcgtctataacgaagatgagcttaaacgttatcttcgtgaagcagtacaggcttctaatgaagcacctgttcttcttgaccacttccttgatgatgcaactgaagttgatgttgactgcgtatctgacggtaaagatgtcgtgattggcggtattatgcaacacatcgaacaagcaggtattcactcaggtgactctgcatgttctatccctccttactctctttctaaagagattcaggatgagatgcgtcgtcaaacaattgcgatggcaaaagaacttggtgtagttggtttaatgaacgttcagttcgcagtgaaaggcaacgatatttacgttcttgaagtaaacccacgtgcatcacgtactgttccattcgtatcgaaatgtattggtgaatctttagcaaaagtagctgctcgttgtatggcgggtcaatcacttgagtctcaaggttttactaaagaaattattccaaatcgtttcgcagtaaaagaagcagtattcccatttgcaaaattccctggcgtagacccaatgcttggtcctgagatgaaatctacaggtgaagtaatgggtgttggtcaaacctttggtgaagcattctataaggctgttttaggctcaaatgaccgcttaccaggcttgccaactgaaggtgaagtaaagcatgcgttcttatctgttcgtgagtcagacaagaaatacatcgctgatattgctaagaaattagttgaatatggcttcaaacttgtagcaacaggtggaacatatcaggtacttaaagaagcaggtttagaatgtgaatctgtaaataaagtaactgaaggccgtccacatattgttgaccgcttgaaaaatggtgaaatacaccttattgtcaatactactgaaggcaaacaagctcaatatgactctgcaatgattcgtcgtgctgccctacaaggcaaagtgtattacacaacgactatcaatggtgcagaagcggtttgccaagcctttgctgtgaaattgccaatggatgtataccgcttgcaagatttaactgtaggttaa

SEQ ID NO: 1368 - DNA, 750 bp, Acinetobacter baumannii
acctactctaagatgagctcaagggaaaatcgcatgaaaaaaatattgctgttgatcagtggaactttactgtgtgtttcttgtactactcgtccccctctgctttcagaaagaggtccaagcatatctgcagatggtcggcctattgttcccgtcacttttgtttttactaccaatactcctcaggctacaaaatttgataattatcaacaaatgcgtaaggaaattaagattttaaataaatattatgtagatgataaaaataataagattttcaaatttaaattacaccgttatatcccttatgaagagttctcaaagttacattgtgatttgaaacagcaaattaaccagccttatcccatttctactgaaactattcctgccagtgtaaatacatgttttcctaagcgcactgcaagtaaagaagtcattgtttttatttatgatgcctactcaacaaaatggaaatttgaagatgtaacaagcagagcatttcgtaataatggcaaaccttttattttattagattggaaccgtctaaattataatattcaggctggtagtgtgcatgagatggggcatgtatttggtctaaaacatgtttgtgcaccgaaggctacaaaacgtactccaaccaatattatgacaagtgccgaatgtaaattaggcagtggtggcttaagaaatttagggtttactccagtacaattgcaaaccattttatcgacttacaaccaatatccttaa

SEQ ID NO: 1369 - DNA, 1911 bp, Acinetobacter baumannii
tatgggaataaagctttgagcgattacttcaagaatgccgtattgtggctaataatacttggtgttctgattttaattttcagtaatatcagtgaccgcaataagccaactgcaatgaaatattcagattttgttgcagcggtgaatgctggccaaattaagcaagtcacgattgacggtttaaatattagtggtgaaaaaactaacggatctcagtttgaaactgttcgtccgcaggttgaagacactgaacttatgccaagcttaaacaagcaaaatgttgttgtagagggcacagcaccacaacgtcaaggcattttgatgcaacttctcattgctagtttccctgtactgttaatcattttgttattcatgttctttatgcgtaacatgggtggtggtgcaggcggcaaaaatggtccgatgagttttggtaagtcgaaggcaaaaatgctttctgaagaccaaatcaaagtgacttttgctgacgttgccggttgtgatgaagcgaaacaagaagttgtggaaattgtagatttcttaaaagatcctgcaaaattcaaacgcttgggcgctactattccacgtggcgtgcttatggttggtcctccaggtactggtaaaacgttattagccaaagcaattgctggtgaagcaaaagttccattctttagcatttctggttctgactttgttgagatgtttgtgggtgtgggtgcgtcccgtgtccgtgatatgtttgaacaagcaaaacgtcatgcgccatgtattatctttattgatgagattgacgcagtaggtcgtcaccgtggttcaggtacaggtggtggtcatgatgaacgtgagcaaaccttaaaccaaatgctcgtagagatggacggttttgaaggtaatgaaggcgtaatcgttattgctgcgactaaccgtgttgacgtattagataaagcattgttacgtccaggccgcttcgaccgtcaagttatggttggtttacctgacatccgtggtcgtgaacaaattctgaatgtacatttgaaaaaattgccttcagttactggtgtagatgttaaagttttatctcgtggtacacctggtttctctggtgctcagttggcaaaccttgtaaatgaagctgctttgtttgctgctcgccgtaataagaacactgtcgatatgcatgactttgaagatgcaaaagacaagatctatatgggtcctgaacgtaaatcaatggttctacgtgaagaagagcgtcgcgcaactgcttaccatgaagctggacatgcaattgttgctgagattttaccgggtactgaccctgtgcataaggtaacaattatgccgcgtggttgggctttaggtgtaacttggcagttacctgaacaagatcagattagccactataaagacaaaatgctaaatgaaattgcaattttgtttggtggacgtattgctgaagaagtcttcattcagcaacaatcgactggtgcttcaaatgacttcgaacgtgctacaaaaatggctcgtgcgatggtaacgaagtacggtatgtctgacaaaatgggtgtgatggtttacgaagatgaaaaccaaaatggattcttcggtaacgtaggtagccgtacaatttctgaagcgactcaacaacaagttgatcaggaagtacgccgtattttagatgaacaatataaagttgctcgtgatatcttgggaaataataaagatatcgcccatgcaatggttaaagcgttgatggaatgggaaactattgatcgtgaccaaatccgtgacatcatggaaggccgcgaacctcaaccaccgaaagtttatattgctgaaaatccggtatctgcgtttgagccgccaaaagatggtccatctactccgccgccattaccagcgatgaattaa

SEQ ID NO: 1370 - DNA, 954 bp, Acinetobacter baumannii
ctttacgataataaaatgcggcctttgaaacctctttcaatcatctataacgaaaaatcaggatttcatgcttcaaaacatgaagacgtctatgagcagctcatgactgtatttacagaatatggttttgaaatacaagtatttgaattaaatgaaaatatattatttgatgatttgataaataatgttattcatcgacattcacaaaatgaaaatacaggagtggttgttgcggcaggaggagatggtactttaaatgcggttgcaactaaacttaaaaatacttctattcccatgggaattctgcctttagggacttttaattatgttgctaaagttttagagattccgttagaccttttagaggcagcagaggttattgcaacaggtaaacctaggtcagtacatgtagcagttattaatgatcatatttatctaaataatgccagtttaggtttatatcctctttttatcaaaaaacgcgaactctacaataaatatttaggaagactgcctttacatgcctatacctcagctttagatgttttattgagagaaaataaatcaatgaagctttctataactgtagatggcaagaaatatccagttaaagcgccgcttattttctttggaaataaccaattgcaactatgtgatatgaagctcagaattgcagaatgtgcagcacagggaagagtcgctggagttgtaattacaaaaagtgataagctgagtttactaaatatgctttggcaatgggttcaaggtaaagttgaagatgcacaagatgtatatagtttttgtgctgatcatgtcattgttgaatgtgcaaagaaaaccaaactcacagtggccttagatggagaaatcatagagatgaaacctcctttaaatttcactgtagaaaaaaatgctttaaatattatggtgccgaatgttactacatctgtctga

SEQ ID NO: 1371 - DNA, 1389 bp, Acinetobacter baumannii
ataatatgtaaaaacggaataaatcttctcttttttagcattcaacccaagcgaaacatggagcgaatcatggttgatcaaccttctaccgcaacaactccacattctaatttagatacaaaaacccgtctaaaatcaattttgggcggttctgccggtaaccttgtcgaatggtacgactggtatgtatatgccgcatttacgctctattttgctcatgcattttttccaaaaggaagtcaaaccgctcaacttcttcaagctgccgctatttttgcagtgggtttccttatgcgtcccattggcgcatggattatggggatctattctgaccgtaaaggacgtaaagcgggccttacgctttccgttactttaatgtgtatcggttcgctactgattgcggttacaccttcctacgaaagtattggcgtatttgctccattgcttttggttattgcacgtttaattcaaggcttaagtgtaggcggtgaatatggcgcaagtgcaacgtatttaagtgaaatggcagaaaaagatcgtcgtggttttttctcaagctttcaatatgtcactttaattgcaggacagcttacagctttatgcgtactacttatcttgcaaatgatacttaccgaagaacaactgcatgactggggatggcgtgttccgtttttcatcggagcccttttagctattgtagtgttccgtattcgtcgtggcttattggaaactcaatcctttaaaaacgctcaagcagaaacagatcagccgaaatcaggaatgtttgctttatttaaacattatcctaaagaggccttcactgtattattcctaactgctggtggtactttagctttttatacttacactacctatttacagaaatatttagtgaatacttctggttttaccaagcctgaggctactcaaattaccactttagccttattcatctttatgtgcttacagccattggcaggtgccttatcagatcggattggccgtaaaccgcttatgatcgccttcggggtcacaggtgttttattcacttatattttgtttgatacgcttgcaaacacacataactactggactgcattctggttatgtttaggtggactgattatggtaaccggctacacatcaattaatgctgtagtgaaagctgaacttttccctgcacatattcgagctttaggtgtcgcattaccttatgcaattgcgaatactttatttggtggtacagccgagttttttgcattaagttttaaagaagccgggcacgaatcatggttctttatttacgtcagtatcatgatttttatttcattgctgatttatattttcatgaaagacaccaagcatcattcaaaaattaaagaacattaa

SEQ ID NO: 1372 - DNA, 702 bp, Acinetobacter baumannii
tcaaatagtaattataaattgttgagcttatttatgagctgcacctttcaactgtccaaagcccctgaacatttacttcaagccttacatgaagtcattcctcattgtgaattaatggcacaacagttgccagaaactccaatttctttatggttgattccacctgtttttcaaactgatcgattggatgacgaagttattcgccgtatctggaatgacacgccgtattggattttctgttgggcatcaggcttggcgatggctcagtggatacttgcagagccgcaccatgttaaagataaagtggtgttagatttcggagcaggttctggtgtagtggcaattgctgcaaaaatggcaggagcaaaacgcgtaatctgctgtgatattgatcaggtcagtttaaatgcttgtcgtgaaaatgctttacttaatgatgtagaactcgaatatttagatgatttatataaggctgaacaagtcgatgttttacttgctgctgatgtgttatatgaccaatgtaatcgctttttcttagatgaatttttaaaatttgcaccagaagtatgggtagcagatagccgtgttaaaaattttagtcatccaaaatatgaaaaaattgaagaaagaagtgcaacaacttggccagatctggatgaagcgaaagaatttagaaatgtaagtttttataagacgctgtaa

SEQ ID NO: 1373 - DNA, 1779 bp, Acinetobacter baumannii
aacttaggtaattttatgtcagagaaaatttcacgccgagaattaattcaaaaaagtctactcggttttggggctttatctatacctgttgcttttacaggttgtaatgatggctcagatgatgaaagcccagaaatacaagcagattttcttcatggtgtcgcaagcggggatccactacaagataaagttattttgtggacacgagtaacaccgacagactctggggtgcgcttaaaagttgtatgggaaatttcaaccgataatcagtttaaacaaaatttaaagacgggaatggttgaaacaagcaagactgatgactttacagtgaaagttgatgcagctgggttacaagcagatacggtgtactactaccgttttaaatttggtaataaagtttcaccagttgggcagacgaaaacattaccaacatccaccaataaagtgagctttgcagtatgttcttgttctaactatcctgcgggttacttttatgtttatcgtgaaatggcaaaacagaatgttgatgtcattattcacttgggtgactatatttatgaatatggggcagatggctatgcgacagaagatgcaatcaagctaggccgtaatttacctgccgataataataaagaaattattaaattagatgattaccgcaaacgttatgcgctttatcgtcaagataaagatttacaagcagctcatcagcgccatccttttattgtgatttgggatgaccatgagttggcaaatgatgcttggcgtgagggggcggaaaaccatcaaagtaatgaaggggccttttcggaccgtaaattagctgccctacaagcctattttgaatggatgccaattcgtccagtttctagtacagatcatttaaatatttatcgccagtttaattttggctctcttgttcagttaaccatgctagatacgcgtattattgcgcgtgataagcagcttgcatatgcagactacatgacgactacaggtttggatattgcaaagtttcagggagatttaactaatccggtgcgtactttgatggggtatacacaaagagattggttggttgataaattaaagcaatctacagcaacatggaatgtagtagggcagcaagttttaatgagtaaaatgtggattccagctgagttgttggcgtctttagggcaaattacttcaggaggaacttcgcctgatgcgcttgctaagatgaatgcacaaattaccgagttggtcgctttaaaacttcgtttacaacaaaatgatccgacattaacagcccaagaaaaagcaagaattatgacggttgcgccatataatctcgatgcttgggatggttactatgctgagcgagagtttgtgtacgataaattggcagagtttaataaaaagatcattgtgttagccggggatacacataatgcatgggcatcttatttatatagccagaaagggaaatatgttggagttgaattagcgactagctctgtatcgtctccaggtttggaaaaatatttaagtattccactggctcagcttcaacagtttgaatttgcatttactacattaattgatgaattggtttattgtaatttaaatcaacgaggatatttgttggttactctagatcaggtgcaagttcattctgagtggagatttgtagattcaattaaaaataccgaatatcagatagattcaagccgacaaaacgatattgtattggatctaaatttgatgccgttaaaacaaggtcaaaagactgcttga

SEQ ID NO: 1374 - DNA, 4011 bp, Acinetobacter baumannii
gagagtataaaaatgaaccagtttgtaacgaacacgaaaaatgtaattcgtggaaattatcatccggaatttttgcagaatgaagtcttatccgatatttttactcatactgcacaaactcttcctgataaaacggctttaattgaagcagataaaacgctgagttatggtgagctgtatcagcaagccttaattatggctcaacatctggctttaaaaggggtaaagccgggtcatattgtagggctatggttgccgcgtggtattgagcttttaaaagctcaactggccatttgtttaagtggtgcagcttggcttccttttgatatggatacgcccgcagaccgtattgcggtatgtcttgaagatgccgaagcggtaggaatgattactatagatgaatggtatgaacatttagctgaagtaccacaaacaaaatggaccaacactgagctgcaaaaaccactaagcgaaagtgtaagtttagcgaaaaccactccagatcaacctgcctatattatttatacctcgggttcgacaggtaaacccaaagggattgtgattactcaaaaaaatatttgtcactttttacgtagtgaaaatagtattttgggtattcaagagcaagacaaggtctatcaaggcttttcagtcgcttttgatatgtcgtttgaagagatttggctttcttatttggtaggtgcaacgttgtggattgcaccgaagtcacttgtcagtgatcctgagcggttatgccaaaccttaaagcaggaacaaattacagtactgcacgctgttccaacgttacttgccttatttcctgaagacgtacctaatttaagaattattaatttaggtggggaaatgtgtccggactcactggttgaccgctgggcattacctcatcatcaaatgtttaacacctatggaccaactgaaaccacggtttctgcaagtcttgagttattagaacgcggcaaacctgtcacgattggcaaacccttaccaaactacggtatgttggtcattaactctgaaagagagttgctggagcaaggtgaaacaggggagttatgtatttttggtccaagtgtggcacaaggctatttaggacgacctgatttaaccgcagataagtttattgagaacccttgggcaatgagtatagaggaagaattactctaccgtactggggatttggctaaaattgatgagtttggtcaagtacactgcttaggtcgtgccgatgaccaagttaaaatccgtggtttccgtgtagagcttggcgagatcgaagctgcgctttgtgatattgacggaattggtacggcagccgttattcttcgtcctgaagacggcattgatcaacttgttgcgtttattgcaccagaaattgatgcaaagcaagctatagaaattaaagaactacgccataacttgagtcagcgattaccgccttatatggtgccaaatcgttttgagattattgaagaagttccacgtctattatctgggaaaattgaccgtaaagctttaaaagcaagaccgctcacgagtgtggtagatcgcagtgaatctgaccagccacagaacccagccgaagaaatcttgtttgaaattttgaatcgcttgttcccgaacatgccgattaaactcgattccgatttctttgatgatttaggcgggcattcactactcgccgctgttttaatttcaaatctgcgtgagcatgcggaatatagccatctgaccattcaaaacttatatcaagcgagaagagtaggcgcgattgctgcactcatgttagagcagcctgaacctactttatttgatagccaaattggacaagataaccctcgtaatcagacctataaatggttatgtggtattgcccagctcgttactattccagttttaatctcgattaatattttgcagtggttagcgccattctttacctatcactactttaccggtggaacccgcgacagtattccgtatgcgattgcgttgtctttattggtgtatgtcagtgtcattatgagcagttttgtactgtcgattacggtaaaacgactactaatgttaggaattggcgcagggcgttatccattatggggattaacctatttccgttggtggctagcagaccgtattagtaatatttcacctgtttatcttttatctggttcgactttacttaacttatatttgaaagcacttggcgcaaaaatcggtcacgacgttaccattagttctgtacatattcgtatgccatctttactgactattgaagatggcgtgagtattggttctcaggtgaatttagaaaatgccaaagttgaacatggccacttggtattaggttcaattcaccttaaacaagacagttatgtaggttcgtatgctgtattagaagaaaatacagtgttagaaaaacaggcccatgtaaatgccttaacttcaattgaatatgacacggttgtacctgagggcgaaatttgggatggaacacctgctcagaaaatagggcatatagatgagcaagctaaattgccagagcgtcctaaactatcgtttatacgtagaattgctgaatatggatactatggcgttagcgcattagtcattgcctgtcttttctttattccgttttttccaagcttccttttggtcgactggttagatgtaaatgtatttaatattaacccgaacaaccatttgcaaatcgcgctttattatttcattttagcgattccggctagtgcaatgatgatgatgattactgcggtgatttcttcaggtctgcgtaaaattgcattgccgcgtcttgaaaccggaacctatgcggttcatggcagcacgtattatcgtaaatggtttgcggcccaaattttagaaaccagcttgcaaaccttacatggcttgtttgccactatttatgcgcctacatggtttcgtatgctgggagcaaaagtaggtaaaaataccgaaatttctacagcaaccggggtcattccagaaatgctgactttgggtgaagagagctttattgccgatgctgtaatgctgggtgatgaagagattaaaagcggttggatgtctttaaaagcaaccaaaatcggtaaccgtagttttgtgggaaatagtgcttatattgctgatgggacagtgttaccagacaatgttttaattggcgtgcaatcaaaaacaccagataaccgtgaaatgtatgacggacaaacttggtttggttctccggcattgctgttacctgcacgtgaagttgctgaaaaatatcctgaccatttaacctttaaaccaagtattaagcgccgtttaatgcgtggttttattgaaggtcttcgtattgtattgccggccgcacttgcgattggggtgggttatatgatcgtactagacgttattgatgtgattaataactacaatattgagacaggactggttgcattaacgctcgcagggctgctttatggcgttggctgtttccttattgttgcgctattaaagtggattttgattggtcgctatcaaccgcgttcggcacctatgtggaccatgtttgtatggttaagtgaagggattaccagcttatatgaatcagttgcgattcctaacttcttaaactacttaagaggaacgccaatgttgccattcttcttgcgtattttaggggttcgtattggtaaagacgtttatatggatacggctgatattaccgagtttgactgtgtcagcattggtgaccgtgccgagtttaatagcttttcaggcccgcaaactcacttgtttgaagaccgtattatgaaaatcgggcaagtgaacgtggggcatgatgtagtggtcaatgcgcgcagtattattttgtataacgcaaacgtgagcaatcatgcagtgttaggtccattaacattggtcatgaaaggtgaaaatattccggctaaatctgcgtggattggttcaccagccgtgccttgggttcataaataa

SEQ ID NO: 1375 - DNA, 870 bp, Acinetobacter baumannii
cataaaatgaaaaattcggttcaatatcttttttcttgtttactggggatgaccactttttcggtaggtataacgccgacttcagcaggtcagatgtacatttaccaagacaaaaacggcagtactttactgactaaccgtaaaagttatgaccattcactcaaaaaagtaaaagtcacctactacccggatagtaatattcatagttatagcaactgggggacttcagaggcttcggttctaccaagctatagcaaaaacaaaaatgcttttgaccatattattaagcaggcagcacaacagcacggcgtttcggaaggattaattaaagccgttatgcataccgagtctggctttaacgtaaatgcccgctctccggttggcgcccaaggtttaatgcagcttatgccggctactgctcgtcgttttaacgtatctaacgcttatgatcctcagcaaaacatcttcgctggtgctaaatatttaagttggttgctcaaacgttttaacggtaatacgcaaatggcgcttgccgcttataatgcaggagaaggaaacgtcgataaatatggcggtattcccccattccgtgaaacccaagattatgttcgccgagtcacaagccgctaccaaaacttatattcttctggtgtaggcctttcttcttttagcaattcaagtatttctgcccaagcgataaaccagccagccataccgcacagtacctctacgcaagtctctgctcagcctgttaagtattcttcctcgcgccaaatcgtgacattgccagatggtacatatacagatgcacctacgggaacttatgtcaccaataatgcaactgctgttgcacatatccggattgagtaa

SEQ ID NO: 1376 - DNA, 1707 bp, Acinetobacter baumannii
tgcattgagaattttatagaacaacaaataacggatagggacttaattcgagtggcggtatttttagacttcaaaagacagctcaagctttggttagaacatattgttcaccatgtttcagaccttcaagaagaaactattttatttatatcatttggccctaaagatcatagatgtagcgtatggcatagtgaaaaaacagtgcttacacaagcaaatctacaattatttgattttattgatgatcagttttcgccagatcaacttccagactatataaaaattgatgttgcgtacaatttagaaaagcaaagttggaaccaaatagagcagcaggttcatcaccaatttcacaataatcattatcgcagaggtattggatttgatgattcttgttcggtagcttttctggagcaagaaatatatggaaaagctattattcggggcttaagttatgacaagccgaacttttttgatgaaacaaatctgaactatgcaattaaacaaaaatatcgtgcaacaaagccggaaattaaacttcagtcactacaagaagtgtggactttcgatacctatgcaactttttatgaaaatggacaatttattaatttagcgagtcgctacgatgcaaatggtattagagccattgctagcaataaaaaacagcactttagagacctcattgaaaaaaatgcagcgtttttacatagccagattcaagaaaatggcaaattcatttatggatattttcctgcttatgatcgtgatatacggaactataatacggtacgtcattgtacttcgctttacgcgcttttagagacttttgaagtacaagataaacctgaatactggcctaaaattgttgcagcaattcaatacgcacttactactttctataaagaaaaagacccaataactgcttttatgattgatggtaaagaaggggagctagaaattaaattaggtgcaaatgccgcagctattttaatgttaacgaaatatcaagaaatcacaggaaaagatgattatttaaaatatgcagagaaacttgctcatggtattttagaattagtggatccggatggattaactactcatgtattaaattatccaaattatgatttaaaagaaaagttcagaatcatttattatgatggagaagcagcattagctttattaaggttatatcaaattaatcaggataaaagattattagacacagttaagttaatgtttgaaaattttattcataaaagatatgaaaaatatcatgatcattggttaagttattgtaccaatgagcttacaaaaatgtgtcctgaagaaaaatattttatttttggtttaaataattatttaaaacattttatttttattcgaaatagaaaaacaacatatgccactttattagaaatgctaatggcagcctataaaatggtaaatcgtttaaaagagcaaggccataatgcactttttgaacaagcatatatgtctgagttaaaaaaactcattacatttcgagccgaatttcaaaccacaggttttttctatccagaaatagccatgtatatggctcgaccagataaaatattgcatgctttttatgtacggcatgatcgctttagagtaagaattgatgatcaggaacacaacctttctggttatattgcctacgtaaaagatttcgaagggggggagatatga

SEQ ID NO: 1377 - DNA, 11679 bp, Acinetobacter baumannii
tataaaaggaatatagatatgcctgagatacaaattattgccaaggataatcataaaaccttggtaaccacagagggaacttctgcaaaactttcagaagcgtcagttgtgttggtgaaagtggctgccagtgatgtattggtagtgaatagggagggtaccaatgcagtcatacgtctgaaaaatggcgagaccattgttattgaaggcttctttagtggaacagctgagcctaaagataacagtctggttttccaagatgaaaatggacagttgatttgggcaaaattcaaagatgctgaaaatgatgcagatgcggatagtgacgctgacgcagatgctgacagtgacgtagaaccacaagcacttttaggtgaagatttaccagcagctctaccagcagaagctccacaagagttggtatctgatgttatttaccaacctatttcttcaattgaacctctactttatcatgatgcaggcgtgaacccatggttatgggctgctattccactagttgcaggcggtattatcgctgcagcatcaaatcatgatagtaatgatgattcttcagcacctgctgacaccactccaccaagtaccgatggcgtaactttctcggttgacccagttacttctgataatgtgattaatgcatcagaagcatcaggtaatgtcaccattacaggtgttttgaaaaacattccagcagatgcggccaacacggccgttacagttgttattaatggggtaacttataatgcgactgtagataaagcagcaggtacatggacagtaagtgtaccgggcagtggcttagttgcggatgcagataagacgattgatgccaaagtaacgtttacagatgcagcaggtaacagcagcagtgttaatgatacacaaacttatacacttgataccactgcaccaaatgcaccagtgattgacccagttaacgggacagacccgattacaggtacagcagaacctggttcaacagtgactgtgacttatccggacggtagtacgaaaactgttgtagcaggaccggatggtacttggactgtgccaaacccaggtttgaatgatggcgatgaagttacagctgtagcaacagaccctgctggcaatacatcaggcccagcaacggcagtggttgatgcagttgcgccgacagtagcacttgatgatgtactcactaacgacagcacaccagcacttactggtacagtgaacgatccgactgcaactgtagttgtcaatgtggatggtgttgactatccggcagtgaacaatggtgacggcacctggacgcttgcagacaatacacttccaacactcgcagacggtccacacaccattaccgtgactgcaacagatgcagcaggtaacgtaggtacagatacaggtgttgtgacagttgatacagctgctccaaatacagctggcgttacctttacgattgactcagtaacagctgacaatgtgattaatgcatcagaagcagcaggtaatgtcacgattactggtgttctgaaaaacattccagcagatgcgactaacacggccgttacagttgttattaatggggtaacttataatgcaacggtagataaaacagcaggcacgtggacagtaagtgtgccgggtagtggtttggttgctgatgcagataaaacgattgatgctaaagtaacgtttacagatgcagcaggtaatagcagcactgttaacgatacgcaaatttatacattagacacagctgctcctgcagcgccagtaatcgacccagttaacgggacagacccaattacaggtacagcagaacctggttcaacagtaacagtaacctatcctaatggtgacacagcaacagttgtagcaggaccggacggcagttggtcagtaccaaaccctggccttaatgatggtgacgaagttgaggcaattgctacagatccagcaggcaacccatctttgccaggtacagctactgttgatgcagttggtccaaataccgatggtgttaactttacggttgattcagtaacagctgacaatgtgattaatgcatcagaagcgtcaggcaacgttactgttactggtgtattgaaaaacgttccggcagatgcagcaaatacagtggtcactgttgtaatcaatggccagacgtatactgcaactgtagatagcacagcaggcacatggacagtaagcgtaccaggtagtgacttaactgcggatgcagataagacgattgatgctaaagtaacgtttacagatgcggcaggtaatagcagcagtgttaacgatacacaaacatatacaatcgataccactgcacctgatgcaccagtaattaacccggttaacgggacagacccgattacaggtacggcagagcctggttcaacagtaactgtgacttatccagatggcagtacaacaacagttgttgcaggaccggatggcacttggacagtaccaaacccaggtttaaatgatggcgataaagttacagcaattgctacagatccagcaggcaacccatcattaccaggtacagctactgttgatgcagttggtccaaataccgatggtgttaatttcacggttgattcagtaacagctgacaatgtgattaatgcatcagaagcatcaggcaacgttactgttacaggtgtattgaaaaacgttccggcagatgcagcaaatacagtggtcactgttgtgatcaatggccagacgtatactgcaactgtagatagcacagcaggcacatggacagtaagcgtaccaggtagtgacttgactgcggatgcagataagacgattgatgccaaagtaacgtttacagatgcagcaggtaacagcagcagtgttaacgatacacacacatatacagttgatacggttgcaccaaatgcaccggtgcttgatccgatcaatgcaacagacccagtgagcggtcaggcagagcctggttcaacagtgactgtgacttatcctgatggcaccactgcaacagtggtagcaggaccggatggtagctggtcagtaccaaacccaggtaacctggtggatggcgatacagtgactgcaacagcaactgaccctgcaggcaacacttcattgccaggtacaggcacagtttcagcagacatcacagcacctgtggttgcgctggatgacgtgttgacgaatgacagcacaccagcacttacgggtacagtgaacgatccgacagccactgtagttgtcaatgtggatggcgttgactatccggcagtgaacaatggtgacggcacctggacgcttgcagacaatacacttcctgcgttaactgatggtccacacaccattaccgtgactgcaacagatgcagcaggcaatgcaggtacagatacagcagtggtgacgattgataccacagcaccaaatgcaccggtacttgatccgatcaatgcgactgacccagtgagcggtacagcagaagctggttcaaccgtgactgtgacttatcctgatggcaccactgcaacagtggtagcaggcacagatggtagctggtcagtaccaaacccaggtaacctggtagatggtgatacagtaactgcaacagcaactgaccctgcaggcaatacatcattgccaggtacaggcacagtctctgcagacatcacagcacctgtggttgcgctggatgacgtgttgaccaatgacagcacaccagcacttacgggtacagtgaacgatccgacagccactgtagtggtgaatgtagatggcactgactatccggcagtgaacaatggcgacggcacctggacgcttgcagacaatacacttccagtgttggcagacggtccacacaccattaccgtgactgcaacagatgcagcaggcaatgcaggtacagatacagcagtggtgacgattgataccacagcaccaaatgcaccggtacttgatccaatcaatgcgactgacccagtgagcggtacagcagaagctggttcaaccgtgactgtgacttatcctgatggcaccactgcaacagtggtagcaggcacagatggtagctggtcagtaccaaacccaggtaacctggtagatggtgatacagtaactgcaacagcaactgaccctgcaggcaatacatcattgccaggtacaggcacagtctctgcagacatcacagcacctgtggttgcgctggatgacgtgttgaccaatgacagcacaccagcacttacgggtacagtgaacgatccgacagccactgtagtggtgaatgtagatggcactgactatccggcagtgaacaatggcgacggcacctggacgcttgcagacaatacacttccagtgttggcagacggtccacacaccattaccgtgactgcaacagatgcagcaggcaatgcaggtacagatacagcagtggtgacgattgataccacagcaccaaatgcaccggtacttgatccgatcaatgcgactgacccagtgagcggtacagcagaagctggttcaaccgtgactgtgacttatcctgatggcaccactgcaacagtggtagcaggcacagatggtagctggtcagtaccaaacccaggtaacctggtagatggtgatacagtaactgcaacagcaactgaccctgcaggcaatacatcattgccaggtacaggcacagtctctgcagacatcacagcacctgtggttgcgctggatgacgtgttgaccaatgacagcacaccagcacttacgggtacagtgaacgatccgacagccactgtagtggtgaatgtagatggcactgactatccggcagtgaacaatggcgacggcacctggacgcttgcagacaatacacttccagtgttggcagacggtccacacaccattaccgtgactgcaacagatgcagcaggcaatgcaggtacagatacagcagtggtgacgattgataccacagcaccaaatgcaccggtacttgatccaatcaatgcgactgacccagtgagcggtacagcagaagctggttcaaccgtgactgtgacttatcctgatggcaccactgcaacagtggtagcaggcacagatggtagctggtcagtaccaaacccaggtaacctggtagatggtgatacagtaactgcaacagcaactgaccctgcaggcaatacatcattgccaggtacaggcacagtctctgcagacatcacagcacctgtggttgcgctggatgacgtgttgaccaatgacagcacaccagcacttacgggtacagtgaacgatccgacagccactgtagtggtgaatgtagatggcactgactatccggcagtgaacaatggcgacggcacctggacgcttgcagacaatacacttccagcactcgcagacggtccacacaccattaccgtgactgcaacagatgcagcaggtaacgtaggtaacgatactgcagtggtgaccattgatactagtgtgccagttgtatctttagatgatttaactactaatgacacgactcctgctttaacaggagctattgatgatccaacagcaaccgttgttgtaaatgttgatggtattgattatccagcgactaataatggtgatggtacttggacgctcgcagataatactttgcctgcattaatagatggtccacatacagtgactgtaactgcaactgatccagctggtaatacggctacagatacagctacgcttactattgatacagtccctgcagacctgatcggtgcgatcacgattcctgaagacttaaatggcgacggtatcttgaatgcagacgagcttggcacaggcggcagcttcaatgcacaagtggcgttgggaccagatgcgcttgacggcacagtggtgaatgttaacggtactaactacaccgtgactgcggctgaccttgcaaacggctatatcacagcagcgattcctgtgacaggcgaaggccctgtagcgatccatgcagaagcagtggatgcacaaggtaacgtagatgttgcagatgcagacgtgacagtaacggttgatacagtccctgcagacctgatcggtgcgatcacgattcctgaagacttaaatggcgacggtatcttgaatgctgcagaacttggtacagacggtacattcaatgcacaagtggcattaggaccggatgcaatcgatggcacagtggtgaatgttaacggtactaactacaccgtgacagcagctgaccttgcaaacggctatatcacagcaactctggatgcaacagcagccgatcctgtgactggtcagattgtgattcatgctgaggctgtagatgcgcaaggtaacgtagatgttgcagatgcagacgtgacagtaacggttgatacagtccctgcagacctgatcggtgcgatcacgattcctgaagacttaaatggcgacggtatcttgaatgctgcagaacttggtacagacggtacattcaatgcacaagtggcattaggaccggatgcgcttgatggcacagtagtgaatgttaacggtactaactacaccgtgacagcagctgaccttgcaaacggctatatcacagcaactctggatgcaacagcagccgatcctgtgactggtcagattgtgattcatgcagaggctgtagatgcgcaaggtaacgtagatgttgctgatgcagatgtaaccttaaccattgatacaactccacaagacctgattacagcaattacggttcctgaagacctaaatggcgacggtatcttgaatgctgcagaacttggtacagacggtacattcaatgcacaagtggcattaggaccggatgcaatcgatggcacagtggtgaatgttaacggtactaactacaccgtgacagcagctgaccttgcaaacggctatatcacagcaactctggatgcaacagcagccgatcctgtgactggtcagattgtgattcatgcagaggctgtagatgcgcaaggtaacgtagatgttgctgatgcagatgtaaccttaaccattgatacaactccacaagacctgattacagcaattacgattcctgaagacctaaatggcgacggtatcttgaatgctgcagaacttggtacagacggtacattcaatgcacaagtggcattaggaccggatgcaatcgatggcacagtggtgaatgttaacggtactaactacaccgtgacagcagctgaccttgcaaacggctatatcacagcaactctggatgcaacagcagccgatcctgtgactggtcagattgtgattcatgcagaggctgtagatgcgcaaggtaacgtagatgttgctgatgcagatgtaaccttaaccattgatacaactccacaagacctgattacagcaattacggttcctgaagacctaaatggcgacggtatcttaaatgcagacgagttaggcacagacggcagcttcaatgcacaagtggcgttgggaccggatgcaatcgatggcacagtggtgaatgttaacggtactaactacaccgtgacagcagctgaccttgcaaacggctacatcacagcaactctggatgcaacagcagccgatcctgtgactggtcagattgtgattcatgcagaagcagtggatgcacaaggtaacgtagatgttgctgatgcagatgtaacggtaactttagatgttactccacctgatatcactacaactgtgttagcaattgacccagttactgctgataacattctagatgcgacagaagcgggtggatcagtgaccttaacaggtacattgaccaacatccctacagatgcagtaacaacaggtgttgtggttactgtaaatggtattgactatacagccacagttgatgccgtagcaggtacttggacagttgatgtagctggtagtggtcttgcagcagattcagacttaactgttgatgctactgcgacattcacagacctcgcaggaaacgctagtacacttcaagatacacaaacttatactcttgcaagctctatcattgctttcgataacactgatacagctgtacttgctcctcaaccattgcttgtacaagatgatgcagcactaggtagtaatacttatctagcacttgtatcgcttgctggacttgatttgcagttaggatcagagtcaattggctttacagtgggtgctggtcaagaaggcaatgcgacctttacttatagtgctttaattggagtggatgcattatctgactactcattagttgttcagaaatttgatacagcaacaggtcaatggactgcaatttatggtggtggccaggctgatattcttgatcttactttactaggttcaacacctggtgtagtgattgatgggttagaagaaggtcaataccgtgcattcatgacttacaacggtcttgcaggtattggcttacttggtaccttaacaggcacaatggatgtttatgacacaacacaagtaggtggttactacactgaagttgctgaaggtaacgtcattacagaaataaatgatgcaggtgaggtagatgttgtaactccaacaacagttataagtgaggttaatggtcagcctgttgtagcagatggcacgagcatcactggtacttacggtacattagtgatcaacctggatggttcatacacttatacgcctactgctagtgcggcaggtgtaggacaaacagatcagtttacctataccttaactgatcctgtaactggtgatacggctcaagcaaacctcaatattcaattgagctctgtgaaagctgtggataatgttgtaactgcagaaatcaacccagaaccgttgctagttgcagatgatgttgctctaggcagttcaacttaccttgcagcagtatcgttagctggtctggacttacaattgcttggtaacgacgcaattgagtttactgttgatccaaaccgcgaaggtacagcaacgttcacattcgatgcggtaatcacagcagatttactcagtgattatgcgattgttgttcagaaatttgatgaagcaacaggccaatgggtatcgatcggtggtactaacccagaagcatcactcatcgatctatcactaatcggtggtacgccaacagctgtgcttgaaggattggatgctggtcagtaccgcgcgttcatcggatatgaaggcttgctaggtgtaggtttaggcggaacattaactggtacgatggatgtctacaatccatacatcgtggctggttactctgttgaaccgatctctggtaatgtcatcaaagatgcgagcctcactggtgaagttgatgcagcaagcagcagtgctgtgatctctcaagtgaatggtgttgcggttgacccagttgctggtgcaacaattactggtacatacggtacattggtgattgaccaagatggcaactacacttatacaccgactgtaaatggagcaaacctaggtcaggtagatcaatttacctacaccttgcttgatcctgtaacgggtaacacttctgaggcaacactttacgttcgtctcgatagtgacagtgtagatatgacttggaacgatgcagatccatctcaaccagctgtaattactagtccgcttccagtagacgcaatggataacgttgcttcggctgaaatagacatggtttatcctgtaacgactgaggtacttgataatgcgattagctataactggttactcggtgtcggtggtatcgttatcggttctaaagaaggtacagcgacatttacagttgatccaggtaatctgactgatgcgattattgcagtgaactttggttcggttgctacggttgtcgacggtttacatgtggtattaacacgagtaaatccagatggcactcgtactgtagttgcagatagttctgatactggtgtgattgacttgttaggtatctttggttctgaagttcaattcaagattgataacttaagtgctggtacttacgagttgttcatggaaagcaatacacttcttacagctctaggtagtgttactgcggatatcacgctaaatcatggtgatatcactcaaccgcctgtactggttgttgaccctgtaactggtaatgtactcgctgatgataactcggctgtttacggtacaaactatgtgccggattacattacaacaacttcagtagtaactgctgttacagctgaaaatggtaatacaactacagttgtagtgggtactccagcaacggttgtaggggtatatggaactctgactattaatgcagatggtacttatagctatcaggcaactgcggatatggcgaatgtaggtaaagttgatagcttcacttacacagtgtcagatcctgtaacaggtagaactgatactgctacattacatgttcaagtcggttcgccagatgttgatgtaacttggaatacagcagatccttcggcagatgctacacttccaacaccatcagtaacagctgatacagatgatgcaacaatcagcatggcaccagtggtagatccagttgtagatgttgcgagtggtaacgtgactattggtaacttggctggcttcccaccactacctgtattaagcagtaccgtaacttcaagtcagtttacagtagcggcaaatacagtaagtgatgtgcatgtacagttgaactatacagcctcattaagcttgtccgcccttccaacgactggatatacaattcaacagttagttggtacaacttgggtagatactgcatattctggttctgcaactgcattggcaggtgtactcggtgctccagcattctcggcagatgtgcctcatttgtcggaagggacttatcgagttgtgttcagtttatcaagtctgatttctcttggtaccgtaactctagattctgtagtgaccacgacagcgactcatctagaccaatacacaccagatggacaaacagactggataactggcaacgtacttactaatgatgttgtagaaggtactcagctctatgtaatgaactcaacaactggtacttacgaactagctgctggtcaaggagtgaatacaggcgaaggtacgttgtatctatacaatgatggctcttacttctacaaaccattagacagcgctgcaaatgcgacagttgatgtgattgactacaagttagtttcggtgattgatggtagtgaatacacttcttcattgacaattaacttgagtcaagagttgaatagccttgcagtgagtactgcggcaaatgatacatttgctcttggtaatggctcggataccttgatctacaacacattaacagctgcaagcgtaactaacgcaactggtggcaacactacagctggtggtgtagatgtatggactgacttccatgtaggtaatactgcaacggatgatcaagctgataagattgacttaagtaacttgttaattggttcacaaactaacttaacaatcggtcaatatgtgacagtaagttacgatgctgcgactcaaactgcgacaatcagcgtagaccgtgatggtggattactcgtagaaggtacttacactgaaacaccattgcttcaattgactaacctcactggtccagtcacattgaatgacttgatcaacaatggtcaaatcattttctaa

SEQ ID NO: 1378 - DNA, 1245 bp, Acinetobacter baumannii
gttacaagcgagcagaccagtgaggaggggcatgtttttttagaacatcgcctatcttttttaggtctactcgcttttttacagccgaaattcaggagctttggtttgagcacccccgccattttagccctcgcagatggaacgatctttaaaggaacgtcaatcggcgcaacgggaagtacgactggagaagtcgtttttaacacagccatgacaggctatcaagaaattttgactgacccaagttatgcacaacaaattgtgacattaacttaccctcatattggtaacactggttgcaacgaagaagacgttgaatctggtcgtatccataaagtatgggcgaatggtttaattattcgtgaccttccactattacacagcaacttccgttctgagcaatcattaagtgaatatttgcaagcgcacaatgttgtcgcaattgctgatattgacacacgtaaacttactcgtattttacgtgataaaggtgcacaaaatggttgtatccttgccggcgaaaatattactgaagaagaagctattgctaaagctcgcgcttttggtggtttaaatggtttagaccttgcaaaagagtgctgtgacccgacaggctttgaatggtctgaaggttcgtgggtattaggtaaaggctttactcaacctgagttaaaataccatgtggttgcatacgattatggtgtcaaaaccaacatcttgcgtatgcttgcagaccgcggttgtaaactcactgttgttcctgctgaaactccggctgaaaaagtattagcacttaatccggatggcgtattcctttcaaacggccctggcgacccagctgcttgtgattacgctatcgaagctgtaaaaactattgttgaaaccacaacattacctgtatttggtatctgtttaggacaccaaatcttggcactcgcttctggtgcaaaaactgtaaaaatgaatcatggtcaccacggtgcgaaccaccctgtacaaaatcttgaagatggtacagtgatgattacatctcaaaaccatggttttgctgtagatgcagaaacattaccggctaacttaaaagcaacgcataaatcattgttcgatggcactctacaagggattcatcgtacagacaaaccagctttcagcttccaaggtcaccctgaagcaagcccaggtccacatgattgtgcacctttgttcgatcattttatcgaacttattgaagcatctaaacagtaa

SEQ ID NO: 1379 - DNA, 384 bp, Acinetobacter baumannii
ataacatcagataccaactcttgtggagcttctgctggtagagctgctggtaaatcttcacctaaaagtgcttgtggttctacgtcactgtcagcatctgcgtcagcgtcactatccgcatctgcatcattttcagcatctttgaattttgcccaaatcaactgtccattttcatcttggaaaaccagactgttatctttaggctcagctgttccactaaagaagccttcaataacaatggtctcgccatttttcagacgtatgactgcattggtaccctccctattcactaccaatacatcactggcagccactttcaccaacacaactgacgcttctgaaagttttgcagaagttccctctgtggttaccaaggttttatga

SEQ ID NO: 1380 - DNA, 981 bp, Acinetobacter baumannii
ctccatagagaagaagagatgaaaaaactatttgtagccttaggacttatcatgggtagcttgcatataagctatgcagaaccagcttcagctcaacaagtacccggatattaccatcatcaatttggtaattatcggataacttccttgctcgatggcactatttatctagatcctaaattgtttaaaaatttaagtccggctgaaaaaactaaaattttaacgaaatatgctgctgtaaatgagaaggggattcagacttcagtaaatgcctttttagttgatgatggtaaaagtttgacgcttgttgacagtggagctgcgagttgttttggtccacagttaggttcaattgctaaaaatcttgaattagcgggctatcaacttgccaatgtgaaaactgttttattgacccacttacatccagaccatgtgtgcggtattgctcaaaatggaaaagccgtatttcctaatgcaacgatctatgctcatgaacgtgaagcagattattggttaaatccagcaaatgaaaaaactgtaccagcggataaaaaagaaaattatttaggtactgttaaaaacgtaaaagctgcacttgcaccttatcaagcaaaaaaagcattcaaaacctttaaagatggtgatgttattcaaggttttgaagtgatcaatacacaagggcacacacccggacaccatagcttccgtttgaagagtaaagggcaacaaattgtctttgttggtgatattgtccactcacattctttacagtttgatgctccaaaaactggggtagattttgatgtaaattcagagcaggcaattaatactcgtttaaaaatgtttgctgaaatttcaaataagcaacaatgggtagctgctccacatttaccgttcccaggaattggtcatgtgtataaagtgaatgctgagcagtatcagtggattcttttatattttaataacagtcttgataaataa

SEQ ID NO: 1381 - DNA, 1539 bp, Acinetobacter baumannii
atgtgtgtggaaaatgaaagggacattcagatgtcaaattgcccgaaaaaatatattgtcgcttttgatcagggaacaacaagctcaagagcaattgttttagatcatgatgcgaacgttgtcagtattgctcaaagagaatttacccagatttaccctcagccaggttgggttgagcatgatcctatggaaatttgggcaactcaaagtgctgtatgggtcgaagcattggctcaagctggcatcaagagtgagcaagttgcggcaattggaattacaaaccagcgggaaaccaccattgtctgggacaaaaaaacaggaagacctatttacaatgcgattgtttggcaaagccgacaaacaaccgaaatatgcaatcaattgtataaagcaggttggcaagaatatatccgtaagaccaccggtttagtcattgatccatatttctcggccacaaaaattaaatggattttggatcatgttgaaggcagccgtgagcgtgctgagcggggagagttattattcggtacggtggacacctggctcatttggaaactaactaatggtgctgttcatgtcactgattttaccaatgcatctcgaaccatgctgtttgatatcgaaaagcttgagtgggatgaaaaacttttacaagctttagatattcctagagcaatgttgccggaggttcgtagttcatctgaggtttatggatatacacataccattagtggacaagaagtagggatcccaattgccggaatcgcgggtgatcagcaggctgcgctttttggtcaaatgtgtgttgagtcgggacaggctaaaaatacctacggtactggctgttttctactcatgaatacgggtaaaaagattgtccgttcagagcatggattactcacaactattgcctgtggtgcgagtggtgaggtgaactatgccttagagggtgccgtatttaacggtggttcttgcgtacagtggttgcgtgatgaattaaaggttattaagaatgctaaggattccgagctttatgcaacacgtgtaaaggataataatggtgtatatgtagtacctgcttttaccggattaggagcaccatattgggacccgacagcacgcggcgcaatttttggtctgacacgtggggctagtattgaacatattatccgcgcaactctagagtctatagcctttcaaactcgagatgttttagatgccatgcaacaagatgcagaagaagagcttcgtacactccgtgtcgatggaggagtaacggaaaacaatttcttgatgcaatttcaggccgatattttaacgacaccggtagagcgtccaataatgaaagaaactacagcattgggtgcagctttcctggcagggttggccactggtttttggcaagatcttcatgagttaagaaataaatctgccatagaaaaggtatttgaaccgaaaatgccttctgaacaagctgaactcatttataaaggttggctaaaagcagttaagcgtagccaaaattgggcagaggattga

SEQ ID NO: 1382 - DNA, 1653 bp, Acinetobacter baumannii
aaagattcggagtttaatatgtcagctaaagacgtaaaatttggtgattcagctcgctcaaaaatgattgcaggggtaaacgtacttgcagatgcggttaaagtgactttaggtcctaaaggccgtaatgttgtgatcgaccgctctttcggcgcgccgcacatcactaaagacggtgtaactgttgcaaaagaaatttcattaaaagacaagtttgaaaacatgggtgctcaacttgttcgtgaagtttcaagcaaaactaacgacatcgcaggtgacggtacaacaactgcaactgtacttgctcaagcaattttaaatgaaggtatcaaatcagtaactgctggtatgaacccaatggatttaaaacgcggtatcgacattgcagtaaaaactgtagttgaaaatatccgttctattgctaaaccagctgatgatttcaaagcaattgaacaagtaggttcaatctctgctaactctgatactactgttggtaaacttattgctcaagcaatggaaaaagtaggtaaagaaggcgtaatcactgtagaagaaggctctggcttcgaagacgcattagacgttgtagaaggtatgcagtttgaccgtggttatatctctccgtactttgcaaacaaacaagatactttaactgctgaacttgaaaatccgttcatccttcttgttgataaaaaaatcagcaacattcgtgaattgatttctgttttagaagcagttgctaaaactggtaaaccacttcttatcatcgctgaagatgttgaaggtgaagcgcttgcaactcttgttgtaaacaacatgcgcggtatcatcaaagtatgtgctgttaaagctcctggtttcggtgaccgtcgtaaagcaatgcttcaagacattgcgattttgactggcgcaacagttatttctgaagaagttggtatgtctttagaacaagcaactcttcaagatttaggtacagcgcacaaaattactgtttctaaagaaaacacagttattgttgacggtgctggtgatgctgctgctatcgctgagcgtgttcaacaaatccgtgctcaaatcgaagaatctacttcagaatatgaccgtgaaaaattacaagaacgtgttgctaagttagcaggcggtgttgctgtaattaaaatcggtgcagcaactgaagttgaaatgaaagagaagaaagaccgcgtagacgacgcacttcacgcaactcgtgcagcagttgaagaaggtgttgttgctggtggtggtgttgctcttgttcgcgctgtaaatgctcttgaaggtttaaaaggcgctaacgaagatcaaacagctggtatcaacattttacgccgtgcgatcgaagctccacttcgtcaaatcgttgcgaatgctggtgatgagccatctgtagttatcaatgctgttaagaatggtgagggtaacttcggctacaatgctgcaactggcgaatatggtgatatgttagaaatgggtatccttgacccagctaaagtaactcgttctgcacttgagcacgctgcttctgttgctggcttaatgttaactacagaatgtatgattactgacattcctgaagacaaaccagctgctccagatatgggcggtatgggtggtatgggcggaatgatgtaa

SEQ ID NO: 1383 - DNA, 348 bp, Acinetobacter baumannii
gcggcaagtttttgctgttgtgtaaacttttgtatgtttgaagacttacttctcccaatgtttgatgatgaatattatccagatattttggtcgctgaactcaagcagcttattgagcaatttgctaaaaaagttcaaaaacctgcgttagctgagcaagatatctatcgatacgctcatcaaactgtaaatgaaattaatgaaatgaagccacagttcgaagatctagactcatcgcttgatgatagtgctgctgattatattgctgaggcaatgatgatggtggtacaagatgcaggatatttggatctggaaatggaagagttggtgatgaatcgagagtggtga

SEQ ID NO: 1384 - DNA, 321 bp, Acinetobacter baumannii
tcaaaaagactaagtctgatggagttaattatgagcaacattcgtccattacatgatcgcgttgtgattcgtcgcgtagaagaagaaaccaaaactgctggcggtattttattgccaggttctgctgctgaaaaaccatctcaaggtgaagtaattgcagtaggcaatggtcaaatcactgataacggcgtacgtgctttggatgttaaagttggtgacaaggtgttatttggtacttatgcaggtacaacagttaaagtaaatggtgaagaactcttaatcatgaaagagtcagacatcttagctgtattagaaggctaa

SEQ ID NO: 1385 - DNA, 774 bp, Acinetobacter baumannii
atattatggtgccgaatgttactacatctgtctgatttacactttgggacagaaaaaaaagagtgtttagaggcaataagagatttttgtattcagcaacagcctgaagtgattgttgtgagcggcgatattactcaacgcgccaaatatgaacaattttttaaatgtcgacagtatttagatagcctcaatattccttatcttgttgtgcctggtaaccacgatatacctttgtatcatgtctggaatcgttttttttctccatttacccgttatcgatatttttttggtgaattagagccgactttagaaactgaacatttttatattgttggggtgaatagtatacgtcgtcgttatcatacgcgtgggcatatttcgattgaacaaattcaagctacttttgagcgtttagacaggggacctaaaaataaaataaagctagttgtttttcatcaacctttttatacgccacctgataataagcatggaataaaagattgtccggttctgggcaaaatcgctttagaaaagtggagtacaactggtctatttggaatgttacatgggcatctccataaaacagctatatatgatttaactcagatttattctttaaaaatagatcatcctatttttgatatacatgcaggtacagcaacttctactcgcttatatcatcataatccaaatagctttaatacaatttcaaatgaaggaaaaattcagcattattggtttaattacgatttaaagatttttcaattaatttaa

SEQ ID NO: 1386 - DNA, 354 bp, Acinetobacter baumannii
agaaatttgctcagcttgttgattatcatatggcttttgaaactgtcgcacctcatgtttgaattcgccatatatactgttgttgcttcaagtcagtgcaaatatttaaaacctgtgttttatccagatgtattgaaagtaggggttcgtgtagaagagctacgtaagagcgcgttccgtatggcttatatattatggagtgaatctcagcagcaaatcgttgctacaggtgaagcagttatggtttgtgtgaataaaatgacaggattaaaatgtgaaataccaagtgaagtaaaaagtaaaattattgaattagaaaaatcagttgggcatgatttaatacatttagcttaa

SEQ ID NO: 1387 - DNA, 1047 bp, Acinetobacter baumannii
aagttcttgcgctcagcactatgttttttcccctttcatagtatcaatgcaggaaaaaccctacagtacaatactgtagttaacacaaacacattaacagtggttgctgtagaaagcccaacgactgtttttaaagaagaccagtttttacacggcttcggttatgacttagcgcgtaactatgcacaaagcttaaatgtaaagttggacttcaaaatcgtgacagacaatgccacggcgcttaagtgggttcagcaaggtaaagcaaatcttgccatgacaaccgcaagcttaagttcaatcgagaacaaaggtttaatgtctttttctgcaagttgtggtgatatcgtaaatttgcaaaaaaatggattaaatccgaatttaagctgggtgtttaaacaagcagatgacccgcttacacaaacagcaagcggttttgtttgtcaaagcaaacaaaatggtctaactcagcaacttgcttctttttataaccgtaatgttgtaaaaccagaagcttggtctacgattcaacgtgacttaagtgcacgtataccgatttacaaagcaagctttaaacaaagtgctgctcagtacgatttagactggcatttgcttgcagcgattggttatcaagaatcgtacctaaagccagagtcagtttcaccaacaggtgtacgtgggttaatgatgttaaccaatagtacagctcgggcaatgggtgtaagtaaccgcaacgatccagcacagagtattcagggcggtgcgaaatattatgatctcatgttaagtgagtatgatgatattcctttcccagatcgcaactggtatgcacttgtagcttacaatatgggtccaggtgcggtgaaccagattcaaaagcgcttgcaagcccaagggaaagacccgaaccaatgggttaatctctataattatttgcagagtaacaaaactcgcaatggtcgatacaaacaagcggttcagtatgtgactcgtatacgtgcttatcttgagcacattaaaacggcacaaacgcgaattaatatctag

SEQ ID NO: 1388 - DNA, 1161 bp, Acinetobacter baumannii
aacaatatgagtagaattatgtttagaaaagcacttttatgcttaagtttaattagcttggttggttgtaatgatgacgataaaactgaaacgacgccaaccacgccagaatatcaacttcctaaaattctagtagtaggacaccgcggcgctagcgctttacgtcctgaacatactttagcttcatatcaaaaagcgattgatgacggcgcagatttcattgaaccggatctagtctctacaaaagatggcgtactggttgcccgccatgaaaatgaaattggtggaacaaccaatgtaagcactttaagtcagtttgcagaccgtaaaaaaacaaaaaatattgatggcgtcgacttaactggttggttcacggaagacttcactttaagtgaattacagcagcttaaagcccgtgaacgtattcctgagtttcgaccagccaacacagcttataatgacctttaccctgtcccaactctagaacaaatcattgagcttgccgaagctaactataaaaagacggggaaaattataggtttatatattgagacgaaacatccgacttattttaaaaatcaaaatctggcaatggaagatactcttctaaaaaccttagccaaatataaatatacacgtgatattgcacctgtctatttacagtcttttgaagttcagaatctaaaagatttaaaaagggagcttgaccttcataagacgcttaaacacgcacaaattattcagctatacgactcaaaaacatctcgaccagcagacttcgtagagtctggtgacactaaaacttatgctgatttagccacagcacaagggttaaaagatgttgccaaatatgcaaatggtgtaggaccaagtaaaggttacatactgacctttaataatgatggctcttataaaactagtacgtttatttctgatgcacatacggctggtttaaaagtacatccttatactttccgaccagaaaacaacttcctaccagcgccgttaaagtgcagcccagataaacctgctgaacgttgtccaactggtgcgttaaaagagtttgaagcctatttcaaggcaggtgttgatggcgtctttaccgatgacccagcactcggtcgcgaagctgtcactaattttgaaaaagctgcaaaataa

SEQ ID NO: 1389 - DNA, 627 bp, Acinetobacter baumannii
acaatacgaggaaatagcatgagcgataaccaagtttcaaaagacatagctgagaatacttcagcagtagctgagaatacttcagcagtagcagagactgtaaagacagaagtagcggaagctaaagaggccgtagccaaaacgacgattcgagctaaaaaggcggttggcactaaagctacacaggtaaaagaagttgtagctgaaaaaacagaacaggtaaaagaagtcgctcacgaagctacttcgcaagttaaagaagctattgcagaaacacaagagcaagtaaaagctgtaattaatgagaccgaagaaaagattgaagctgaaacacaagaattgaaccagaacattcacaatcaatttgctcagattaaacaagatattttacagcgtcttgatgtgattaaagctcagttcaatacttcacaagaaggattgaatgaattaaaaaatactttaaaagctgaaatcaatgcattaattgaagatctaaccaaagtgactaaagaacttaaaggtgacattagccaaatttctttaaaacataaagactctttaactgaaagtttaaaacgtactaaaaataatgcggttgaagcttggaacaaagtaagagatcactaa

SEQ ID NO: 1390 - DNA, 600 bp, Acinetobacter baumannii
cttttcttcttatatttgattttgatgcctcaagaaaaaaaattaacacagcagcaggttatcgccctagaacgggatcttgccaagttcgcaaccatgatggatagtgcggtccgtattccttttacaaagcagggtattggtgctgatgctgccttaagtactattccaattgccggtgatgtcgctgggttcgcactgacgtgttatgccatttataaggctaaacaaataggtgtgcctcagcataagctcactccagtgatcaaacttgctgtagtcgatgccgtagtcggttttgttccagttgcagggactattttcgatatttttatacgtcccagtcgaaaagcattagatgtggtgcatacgcatatacgtgaagaatacgcgatccaaagtgatattcatgtcgttcatccgtatttacatgaaaagctcgaaaagaagcaacaacagtcggcattctggcgtaatcctgttgtgagttggttatggttgcacatacccgatttattaggtgcgtttgtactgcttttaattggcttagctgtgtggtggggtgcaagttacctttggggactttatcaaaccgtgtaa

SEQ ID NO: 1391 - DNA, 468 bp, Acinetobacter baumannii
ataaccatcattacaataaggaataaacccatgttatatcaacatattcttgtaccaattgacggttctgaaacttctatggttgctatgaaagaagcaatcaaaattgggaaagcattaaacagtaaaattacggttgtacaagttatggcacttgacccgattattgctgacctttacgttaagacggggcaaaccaatgaattgattgagcgtactagaacatatttgctagatattttagagcaagccaagcaacaatttttgcaagaaggacttagtgtagaaaccaaattacttgaaggttttgttgttcacgaagaaattattcaagctgcacaagagcttaatgctgatctgattgtgatgggttctcatggccgcacaggtgtacgaaaacttgtattaggaagtgttgcgcaaaaggttttaggtgaaagtcatatcccggttttaatagttcgttaa

SEQ ID NO: 1392 - DNA, 393 bp, Acinetobacter baumannii
ggaagaatcatgcctgcatttttaactgatgattggtttgcgactgtcgaaaaattaactgctgaagcaggtgatcttaatttgccaccagctcttgcgaatttggcaattaatttagtagttacagatgcttctggaaataccgaattagcgttagatgggggtaaaatccaaaaaggtttgtcttcaaatgccaaaactaccttaaacatggatgctgaaactttacgtaaagtattccttgagtttgatatggcagctgctatgcaggcattcatgactggtaaaataaaagttcaaggcgatatgtctcagttaatggctttacaaacagctaaaccaagtcaagaacaaaaagatttgttcaaaaaagtattagagcaaaccgcttaa

SEQ ID NO: 1393 - DNA, 237 bp, Acinetobacter baumannii
gggcgggggattttaaatcccctgtgtctacctatttcaccacccgggcatgtgcgcaataatagaggacaagtgcgcgattggcaagagaaaaacagagagtttgctttattttcaatcagttcttatcagtatttctataaattaaccaatttatgtcatgatttgttcatcaaactgagatcagttgttcatcttctctacttaagtttaagacactcattgcttaaaacttag

SEQ ID NO: 1394 - DNA, 909 bp, Acinetobacter baumannii
aaagaggttttaaagatgagtttagaatttgaaaaaaaagaatatgaagaaagattaagatatcgacttaaaattctttcagagaaattaagtgaaggtaaagttaaatttgctagtcacttagttgaagattttaaagagagtatgagaaagattaggtatgataaaaatggtgagattattttagattctgttgatggacgtattcgttcaatggctcttggtatagaacaaattgatactcgagataaattaaaaaaacaaatttcattatttgaaattcaaaatctatattttgaacttatagagcaaaattttggtcaattttatgaaaaaatgaatgagctaagagaaaatcctcataatattgctgattttttatctaggaaagaagactttgttgatggaatggttgagcaaatcccaagtttcatggaagcaattttagaattttggagaaatgttggtgacgtaggatattggcatttagaagacagcttcgacaatattactggagtatttgggggagatctattcccaacacatgacgaaaatattgcatctaaatgtggtatatacactgatactatagttttacctgatccttatgtcagatcaattcatgttttcaaacactatcctaaagaaagcaaagtttattttttgattaagcatgcactcaatttattaaagtataagaaactagcttgtacggatgcaggaaatcctgcggttgttattcttccagatttatcaaatttagaagaaaatgggagagattttatttatgagttttcccaacaagatgctttaattcatggtagtaagatatttggaagaaaatttgaaaatatagatgaatttgatgaattttgtctaagtttaaatactgggcagagtaaaacttga

SEQ ID NO: 1395 - DNA, 375 bp, Acinetobacter baumannii
attttgtctgtattatttgaattgtcagtaagactggagtatttattaatgaaaccggatattagtgaattatctgttgaagagttaaaacgcttacaagaagaagcagaagctttaattgcaagcaaaaaagatcaagcaatcgaagatgcttataatcaaattatcgaaattgctgaaaatgtaggttttagagttgaacagcttatagaatcttgcgctcacaaacgtaagaaaacaacacctaaatctgtagaaccacgttaccgtaacaaaaacaatgctgaagagacttggacgggtcgcactaaacaaccacgttggttagttgctgaaattgaaaaaggtgcaaaacttgcagatttcttaatctaa

SEQ ID NO: 1396 - DNA, 810 bp, Acinetobacter baumannii
acttttatagtaacatgcaataaaatgaatattacatacatcctacctaatactccttacaaatcaaggaatatctctaagaatctaaccaatatttattgtttacattgcaaaagtgaaataaaacatgaattcctagttggtctacaaacttatgaaagtactgaagatgatagctattatgctgaatatgacctattaaaatgtataaattgtgattctataacatatagaacagatttttattcaaattatgatatggaagaagtacctaatgaatttggaaaaaccgaatgggtaagaactacacgcccaaattattatcctacaagagataaagagctaggcaatataaatcatgttattgatcttctcccagattctattcaagacacatttaatgaagtcgttgttgctcttaataataagcttgaaattttatcaggtttaggattaagaacattgttagaacaaatatgtaaacactttattaaagatgatgatttaggggaaattttaaaaaattttgaaaatgaaggttatatctcaactaaacaaagagagttattagatgatattcgttatatcgggaacgatgctgctcatagggcagaaccaaatagtataaaaaaacataaacttagcttaaatattcttattaatcttattcagctcttatttgcatactataaatatgatgagccacaaaaaaaaattgagactggcgtccctcttagaagaagccctaaaggtgaaacgccaaaagtaagagaaactacgagtaaaagaaaacctcaaaaaaaactctag

SEQ ID NO: 1397 - DNA, 1521 bp, Acinetobacter baumannii
gaaatgaaagtacaacctaatgattattcaaaaatatatgatcttgccgtaattggtggcggtattaatggtgttggtattgccaatgatgcagcagggcgcggattatcggtatttttatgtgaaaaagatgatttagccagccatacctcatctgctagcagcaaattaattcatggcggcctacgttatttagaacataaagaattcaggctggtcagagaagcattagcagagcgtgaagtattgctagctaaagcgccacatattattaagccaatgcgttttatcatgcctcatcgaccccatttacgccctgcatggctaattcgagcaggtctatttttttatgatcatttgggaaaacgagaaaaattattaggatcaaatctcatttatttcaaagaagacagccctttaaaaccagcgataacacgtggttttgaatattctgactgtactgtagatgatgcgcgtcttgtggtgttaaatgcactacaagctaaagagaaaggggcaaaagtcgttacacgtacacgttgtgttaaggcttatagacaacaggaattgtggcatctggagttacaaagcggagctgagttctatcagatacgtgcgaaagctattgtaaatgcggcggggccttgggttgaagaaattattagtaaaaacctgggtttaagttcgccttatcaaattaggcttatacaaggaagtcatattgttgtgccaaaattatatgattgccataaggcctttattatgcaaaacgaagatcgacggatcgtttttgcaattccttatttagaaaaatataccctcattggtacaacagatcaggaatacataggcgacccacaaaaagtagagattactgatgtggaaattgattaccttttgacagtgacaaattcacattttaaaaagcagttgacgcgagctgatattataagtcagtactcgggtgtgcgtgctttatgtgatgatgagtcggataatccatctgcaattacacgcgattatactttggctctacaggcagaagataaaaccacaccattgctctcagtgtttgggggcaagattacaacttaccgaaaattagccgaagctgctttagagcatctggctccgttttttaatgacatggcagaggagtggactgcacatgaagcattacctggcgccgaaaactggacaaccctagaggatttaatcaatcagattaaaacacgtgtaagtggaatttctgactcgcttgccaaccgttgggctcatgcatatggcacaagagtgtggaatatgcttaaagagcgaaatgctatagaacaattgggtcaacattttggccatgatttgtttgagtgtgaagtcagatatttgtgtgaatatgaatgggctcacacagcagaagatatactttggcgcagatctaaattaggtttggcatttgatgaaaaacaggtaaaagttttagaagcttatttatctgaacgtcgattaaaagacgatgccgcataa

SEQ ID NO: 1398 - DNA, 558 bp, Acinetobacter baumannii
gttgtatgggttaaaacgaagatactcttgaaaggcgagctaagattacctgtttcatttaagcatgacgaagtatctttatttataatatttgaaaatggacttaaagaattaaacagtggtgctggtatgagtcaacacataataaacccaaaagaaatacctttagcatttcaaaccgcttggaataagcatgatatgcaggcctttgctgctctttttgataaagatgcgactttcgttaaccgtttcggtcactacgttaaaggagttgatgaaattattgcaatccatcaacctattcatgaaaccatttatcgtgattcaacactagagaatgagctgatagacctcatacctatgagtgaggatatatgtatttcacatttttggagccgcctcactgcgggcgtagctcatcctcaagggcctcatcagattgatactctcattcttactgtgctcacccagaagaatcattcttggtacattcaggcgctggaaaatgtcactttaacgaaccctcgaacgggagagactatacttagaaatatgtag

SEQ ID NO: 1399 - DNA, 273 bp, Acinetobacter baumannii
gcgacttcttttacctgttctgttttttcagctacaacttcttttacctgtgtagctttagtgccaaccgcctttttagctcgaatcgtcgttttggctacggcctctttagcttccgctacttctgtctttacagtctctgctactgctgaagtattctcagctactgctgaagtattctcagctatgtcttttgaaacttggttatcgctcatgctatttcctcgtattgtttattttttagctaacattacaataagaggaattagataa

SEQ ID NO: 1400 - DNA, 339 bp, Acinetobacter baumannii
aatcaggtatttttaatggccgctttatctattcatgaacgtaaacgtttacgtcaaattggtcatgtgcttaatccagttgtcatgattggtggacaaggcttaacagacgctgttattgaagaaacgctccgtgctttaaacgatcatgaactcatcaaggtaaaaattgctggtgaagaccgtgaagctcgtgccgcagtaattgatgcgattgtagaagcaactggtgctgaagctgtacagaaaattggtaaaattgttttactctataaaaaagcagctaagcaaaatcaacatttatctaaccttgttcgtcacgcacacttagcaaactaa

SEQ ID NO: 1401 - DNA, 2589 bp, Acinetobacter baumannii
ataagcagttctagggacataatcatgagaatactaataggttttgtatttagcttcttttgtttgattattcatgctggacaaatagattgggctgttgcaaaaacttcatttccgagtgatcaaagtattggtgatactgggcatgaaaagacacctaatggttatgtagatttaatgagtggtaatctaatttatgatactcctgaagtaatattaaaaggtgatagggggttagattttacactttctaagtcttacggaaaagtgaatagtggctttcgtgccatgggtaactgggaattggaagttcctagactagtaatgaatacgggaccatctactattctaaaaggagatatagatggaaatggaatttgtgaggccaacggagatgcaacaaacaattcctctgggcgacctagttttacagcatccttattaaatacttcatttaaaaataaaattgaagaatcatatgtaaaccaagtaaatttaaacttagcgaatcaaactttaaattcaattgtctacttacttggacagtttggaactgcaacaggggattcgaatgcccagtataataatcaacaggctcaatctgctctatcgaagttgcaagctcagctttacgatgcatttaaaacaaatgtaaatgcaatttctattagtagtgccgaggcaagtaccgaaaaaagtaaatataaacaaagtttaattaatactttgcaaacagggcaagtgaaaattcaggttaatggtatatccttgacaactggtaatattagttctgtgttagatgatttagctattaattctaattttactgtgaagacaaataacgtaatacttgacacagtgataagacaagttattgttggatacctctattatcataatataatagtagcaaagtctaatgaagtattgaatggaatttactcaacagtatcacttaatacatcttcatatgttgactcaagacaaagagtgattagtttatatcttccaggccaaaagaatattattttttatcccgttaatgagcgtgtaactggattccctaagtctgctaaatatgtatcccaagataactggtttattagctgtgcggaaagtggtaaagactttgttgtacgatctaataatggtgttacttactatttccctaattctaatcgagaaaatcaaacaggatttacttctttttttgcaaatgagtatattcctggaaaagtaactgtctatgcttcaaaaatagagaatcaatataaagaggcttatattttaaactattttagtaagcaggctaatactttaatttatagtgggtttaatacttctaataagttttttctaaaatctgttcaacatacattagatgataagcttataaattcaacctcaccagaaattagaattgattatgtaaaaagattagatacaacagaaaatacagatgaaagtcaatttgatagtgtaaaaggagatatcctcttaaagaaaatttcccgattcatcaatggtggctataaagattgggtttcttatacctattcatctggtgctaaagcaggtacgacttataagttaaatgattcaattctattaaatggtaatattggtagttttcaggatgaaaacgctgcgctcttttatttagatacagtaagttatatatctggagataaagtatcttatgcatatggagggccatatcgtattgtgggtaatataagtccatccgaaataggtggtataaccgcacaagattttctttggttttatagtgatttgacagcaattaagtattataagaactctaagagtggcttagttaatgctctctctgtggattggacttatgagttggtaaatagctcaagaccaggttttacagaagaaaagtcttttaaagttacaagttctaaatactctatagcgaatgctaattcatatgatgtgacttatagctatagccgagatgactctacacatgagcaaacaacagttgttactagcaaagattctgtaactggactttcaaaggtttatacttatgtaatgcatgcatttttaggtggtggtgctgagaacttcttacatgggcttttgaaaaaaattacgataggtgatcgagaagaaagttatacatggacaaccctatctctaattgggcaaaaacctaagactatagatgataactatactgattatgaggatgttcgtttagtccgtcttgctagtaaagcaattagtcattttggtgagtataaaactacctatagtaactttgaccaatatgggaatgcacaatcagtccagatgactggattgaatggttcaagtactgttcaatttccagcaacaacggctacatattttaatgctaatgctgcaagtgatgatgtaaatacaggaaatttaccttggattatcggattaccaaaaaaaaaatatcaggtagttttacgttacaaactactgaatatgatgcacaaggagcaatacgtagtaatactcaagctggtcgtgttaccaaatataaatatgaaacggtatcattctcaacatgtcttggaaatttag

SEQ ID NO: 1402 - DNA, 1359 bp, Acinetobacter baumannii
atgttaggattagcaatgactgataatgcaactatcttgcagcatgtaccagtaggcaaaaaagttgggattgccttctccggtggtctagacacttcagctgctttattgtggatgaaacaaaaaggcactgagccttatgcatatactgcaaacttaggccagccagatgaagatgactacgatgcaattccaaagaaagcagaacaatacggcgctgtaaaagctcgcttgattgactgccgcttacaattggcgcttgaaggtattgctgcaattcagtgtggtgcattccatatcagtacaggtggtgttccttatttcaatacgactccactcggtcgtgcagtaacaggtactatgctcgttactgccatgaaagaagatgacgtaaacatctggggtgacggttcaacttataaaggtaacgatattgaacgtttctatcgttatggtttgttgactaacccaaatcttaaaatttataagccgtggttagatcaaaattttattgatgagcttggtggccgtgcagaaatgtcacaattcctcatcgacaacggttttgactacaaaatgtcaaaagaaaaagcgtactcaactgactcaaacatgttgggcgcgactcacgaagcgaaagatcttgaatacctaaatgctggtatcaaaatcgttgatccaattatgggcgttgctttctggaaagaagaagttgaaatcaaaccagaagaagtgactgtacgttttgaagaaggtgtacctgttgcattaaatggtcagcgttttgacaatccggttgagcttattcttgaagcaaaccgtattggtggccgtcatggtttaggtatgtctgaccaaatcgaaaaccgtattatcgaagcgaaatctcgtggtatctatgaagcaccgggtatggcccttcttcatattgcttacgagcgtttggttactggtattcacaacgaagatacgatcgaacaataccgcattaacggtttacgtttaggccgtttactttaccaaggccgttggttcgactcacaagcacttatgttgcgtgaaactgcacagcgttgggtagctaaagcgattactggtgaagtaacacttgaacttcgtcgtggtaatgactacaccatcatgaacactgaatctccaaacttaacgtacgaagctgaacgtttaacaatggaaaaaggtgattcaatgtttacgccaatggaccgcattggtcagttgactatgcgtaacctcgacattaccgatacacgtgcaaaactaggcatctatacagatgctggcttgctttcaatcggtcaaggttctgctgtacctcaattagacaataagaaaaaataa

SEQ ID NO: 1403 - DNA, 321 bp, Acinetobacter baumannii
atttatatgttggaaaatttaattttaatagtttttctcggagtaactattggttgggtagttggtttatgttatgagaaagtatttgttctaacttatgggggaatggagaaagttttttttaaaattttctccattaacattttttttaaattaatttcattgcttttttcatgcttaataactcttttgttttttttaataggaatgttgtttttgccagttattcctgatgctctttggaataatttctatatctccttctttatgggaattgtagtgggtgtggcgatgaaaggcgtagtctttaaaaataaataa

SEQ ID NO: 1404 - DNA, 246 bp, Acinetobacter baumannii
ggctcagtgcctttttgtttcatccacaataaagcagctgaagtgtctagaccaccggagaaggcaatcccaacttttttgcctactggtacatgctgcaagatagttgcattatcagtcattgctaatcctaacatttatgaaaaagaccccgttgaggcggtctcgagaattctgaatggcggctattgtagcactattcatggtgctttttttggcaaaaaagcattaattcacttgttctga

SEQ ID NO: 1405 - DNA, 252 bp, Acinetobacter baumannii
ttcgctaagtttaaatttacttggtttacatatgattcttcaattttatttttaaatgaagtatttaataaggatgctgtaaaactaggtcgcccagaggaattgtttgttgcatctccgttggcctcacaaattccatttccatctatatctccttttagaatagtagatggtcccgtattcattactagtctaggaacttccaattcccagttacccatggcacgaaagccactattcacttttccgtaa

SEQ ID NO: 1406 - DNA, 420 bp, Acinetobacter baumannii
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaaatagcaaagcgtttaaagacatttcctgatttggatcaaacaatgaatgtaagccatacaacgatttattcaacgaaacgagcattacccagggcagaccagaaaaaataa

SEQ ID NO: 1407 - DNA, 495 bp, Acinetobacter baumannii
gtaatgcaaacatggaataaagccttttttaaatttatgactattattttaatgggtacttgctgtattgcatgcgatcttagaaaaaaaaatgaagtaacagttgttgaaaataagaatataataattaaaaaatttgaaagtgatgctgaatatatttttggtaatcaaattttaggtaaaaaaatattttcttcctataatgcagaacgattaatatttcaagtgaaagatctagagcaaaatagtgataattttatagataaaatagatggtaggctgaataagaggggttggaactataaagaaaaatacaaagaagcttacatttattgtgatagagatatgaatcaacttgagttagttcctcctataaagataggtacagttatgcaatcaggagaaggacagtcattgaatcagttagtagattattggaatataggttttatccattctagacataaacgttatgtatgtaatatgaatagttga

SEQ ID NO: 1408 - DNA, 189 bp, Acinetobacter baumannii
ttaccaaccgcacaatcaggtttattagctctaccttctacatttacatacaccagtccatcagagtctcttacaataatacttgttatcttccctctagcatttcctgcccatacgcttccaccaacaactattagtaatataaagcacaaaaattttctatacatactctatctcgtctacttttaa

SEQ ID NO: 1409 - DNA, 702 bp, Acinetobacter baumannii
tcaaaaaatcatcccgctgcatgccgggaaaacgctgcaatggagaaaagtgtgacacaagaaaactctgtcccggtcattggccaacgttttcgtggcttcttacctgttgttgtcgatgttgaaacggcaggttttaatgcccagacagatgcattgctagaaatcgcatgcattccgattgtgtatgatgctcagggacaatttgtccctggtcctgcatttcatgcacatattaacccttttgaaggggctaacctagaccgccgttcgctagacttcattggtattgacccattcaacccaatgcgtattgcaatggctgaagatgaaagaactgctttacgtcgcatttttaaatcggttaatgaagttcgtaaacagcaacattgtactcatgcagtactcgtaggccacaacgcacattttgaccttggttttttgcaagcggccattgctcgctcaggtacaaaaaaccagaacccattccatagtttttcagtgatggatacggtcactttaagtgcagtaatgtttggacaaactgtacttgcaaaagcatgtattcaagctggaattgagtttgatggtaaagaagcacactctgctttatacgatactcaaaagactgctgaactgttttgctatattttgaacaaactgtctccttacctccttgacagtttggtggcggcttcttaa

SEQ ID NO: 1410 - DNA, 3198 bp, Acinetobacter baumannii
gtgatgtttaataatatttttcagatcttagagagttttggttttctctcacagcatcgttcggtgtatctccagttttcagatgcatccctgaatagtcaggtttttttacaacgtatagatgggcaacattatcttaatcagggcatgacagccgagctgatttgtttatcaaccaatgctcatattccactcaaaacatttattgggctgcaggttgctgttgaccaagtaacagaccgaggaagctttttccgtacgactggtattattactggagcatcacaggggcagagtgatggtgctctaaccttatataagctcactgtaagtgatccaacttatctctggcataaacgcagaaatagtcgtgtgtttatgaacaagagtgtgaaagaaattagtgaaattctatttcaggaatggcagggaaaaagtccattatttgcttctagtctgactctagatttgagcggattgaaacagacctatgatgtccgtccttttgttatgcagctcaatgaaagcgactatgactttttaactcgcttatggcgtagtgaaggtattagctggctcattgatgaagcagagcttactgtggcgagcaatatggacaatattcagccacaaaaattacgtcttattgatgataataaccaatatcaagctctgacaagaagagtgattcgttaccaccgcagtagtgcaactgaacaatttgatagcatgaccagcctaatggctgatcgcagtttacagccgacttctatatttgtgcagcgttggcagccagacgtattacaacaaacagatggggcaggtagtgtccaaagtaaacatcagcatagtactaactacgacaatcaaagcttaagccttgaagaagcatggcactttagtccggcatggatgcaggatttaaatggcgaagatggggcaacctcagcaagtaatcaacaaatagaaaagtttaaccagaacctaagtgcttattatgatgctcagtctaagcagtttattgcaaaaaccacagtacgagatacacaagttggctattggtttgaactcaatgaacaccctgaaattgatcagcatgaaagcacagataaagagtttttaatcataggtaagaattattataaccaaaataatttacccaaagatttaaaccagcaaatccaaactttacttcaacaaagcgattggcaagcgagtaataccgacgagcgtcaagcgaatcagttaattttacaacgtcgttatattccaacaacaccagcttataacccacagactcatagccccgttgctcatccacaacgcgcaaaagtggtggggcctgaaggtgaagaaatctatgtagatgaatgggggcgtattaaagtccgcttcctgtttacgcgtagtgatgaccatagtcatgatgggggcgcagggaccaataataatgacaccgattcagcttggattgacgttctaacgccgtgggctggagaaggttatggtgcgcggtttttaccgcgtatcggtgagatcgtcgttattgacttctttaatggcgatatcgaccgaccatttgtaatgggccgaattcatgaggcccagcgccatccaaccaaatttgataataaaggaaagcttcctgatactaaaaagctgagcggcattcgttctaaagaagtgtcaggtagcggttttgggcaactcagatttgatgatacaccgggacaaattagtacccaactccaaagcagtcatggtgcaagccagttaaatctggggaaactcagtcaccctaaagataaagcagaaagtgaagaccgcggagaaggttttgaactacgtactgaccaatggggagctttacgtgcggggcaaggtttattggtatccactcataaacaggataatgccaaaggagaccaccttgacgccgaagttgcgaaaaagcaacttgaaggtagtcaaactaacagtaaagcactgagtgacattgctaaaaaccagaaaaccgatgaaatcgaatcgattgaacagttaaaagattttgcctcacaaattcagcagcaaatcgctaaatttgaaaaagctttacttcttttgagttcaccggatggtatagctctaagtagttcagaagatattcacatctcggctgatgcacaaatcaatcagattgctggagacagcattaatataagtactcaaaagaatgtgattgcccatgcccaaaataggctcagcctctttgcagcacaaagtggactaaaagctgttgctgcacaaggcaaggtagaaatacaagctcaagcagatgcactggatgtactgagtaaacttggaattactatttcatcaaccgatgacaaggtcatcattagtagcccgaaagaagtcaaaatcacgggcggctcatcgcaaattactctaaatggttcaggaatctttccgaaaactggtgggaaattccaagtcaatgctggacagcatttgtttatgggaggagcgagtgcaaacgccagtgctcctgagttgcctaaagctaaacctatgcagggagcattggagctactgcggagttatggtggagataacttcttcaagcaaaatagttataaagtcattgattcattaggtaagcaaattacgggcaaactcgatggaaatggttttgcacaagtaacaggtattgcacccggaccagctaaagtagtttttgagaaggataatacaagtgcatggctacaaagcagtgattttaaacgtaattatacgtgggctgaaccagtcaaaagtgttcaaggattaatgaaaaatgccctagaagcagtggggcaaaatacgatgtctcagttgcaaaataatcttctttcaacggataaaaatagtttcaaaaatttaggtaagaatactttagataatttagctggccaaacagtagcccagattaaaaatcaggtaactaatactgcccttaatactgtttcaaaacaacttaatctcaatttatctgccgatcaaatgaaaagtcttggtcaaatggcgacgaatccaagtcaatctcttgaaatgcttaaagagcagggcggagattttttgagtgatcaaatgaccgcaaaattatttaagaccacaaatcaagagtcacctattcagcagggcgatttagatacttttgtacggtcaaaaaagtag

SEQ ID NO: 1411 - DNA, 2115 bp, Acinetobacter baumannii
atggatcttaagcttcgccttctctccctgagtattgcacaactatgctgtattccagctacttttgcagacacgaacaactcttcaactactcttgcaactatcaaaattaaagcccaacagacatctgaccagacttataaagtggatagttccagtagtgctacgcgtagtgaaattgcattacaagataccccgcaatctgtgagcgtagtaacccaaaaagtaattgaagatattggtgcaactcgcttagttgaagcacttgatttagctggtggcgtgactcgtgctaataactttggtggtcaaggtttaactggttttaacgtgcgcgggtttaccagtggtgagttttatcgaaacgggtttccaattaaccgtggctatccaaatgcgccagatagcaacaccattgaacgtgtagacgttttacgtggcccctcttctagcttatatgggcgtggtgacccaggtggtacgtttaacttaatttctaaaacaccaaagtctgagcaacaaaccactttaggtgcacagctcaacagtgaaggtttatatcgcactaccgtagacacgacaggtactatcccaaatgcagaaaatattggttatcgtctaaatgtgattgcagaaggtggggatagttaccgtgaccatgtcgaatctaaacgttatggcattgctccagtcattcaatggcaagctactgatgccaccagggttacttttgaagccgatattttaagaaatcaacatccgcttgaccgtggtcatacacgttatccaacacagaaatcttttaatagctcaccagaaacctatttatgggaaacgggtaaatactacaatcgactctacaatgataacaatatggctcaattacgagttgagcatgatcttgcgaatgactggaagctaaatgctggcgtgcaatatttaaatggcaaattgcatggctatgcagtagaggcaaatggtatccaaaatgacggagaaacattagggcgaaattacaattatcgcgaattaaaatggcaagataccgatgcccaaattaatctcacaggcaatttccagcttttaggtttagcccatactttagtgactgggcttgaatatgaaaattatgattataagtcatacattattcgctcaagcggagatatcggtagctaccctattaatatttataatccggttttagggcaacctttacctgagctcaatcgtgtaaccacacatgaccgtgaaaacttaaaaacaacggccctttttgtacaagaccaaatcgacttaaatgagcgtttaagcgcactcttaggcttacgatttgagcattacgagcacgattacaaaaacctattaccaaatactaccaactggaataccagtcatgatgcatttattccacgtttgggcttagtttataaagcaagtgatgacctttcactctatggcaatgctgcaaaatcttttaaaccaaatactggcgccagccgtaacggagaaggttttgatcctgaagaaggtacgacttacgagttaggttttaaatggcaagcacttgataatatgttatcaattgattccgctattttttacgccaataaagaaaatgtcttaacactagaccctgttgattcagcttataaagtcgctgctggcgaagttcgtagccgtggcattgagttaaatattgctggtcaaattacacctgcctggaaaattattggcgggtatgcttatacagatgcggaagtaactacagacaatactttgcaaaaaggaacagctctagccaatattccaaagaatagttttaatcttttaaatatctatgaatttcaggttggtcctttacaaggcttaggtctaggcatcaatcaaaaatatattgataaacgtgcaggtcagacagctaatagtacctataccatgaaaggttatgcagttacagatttggtttcttattatcaggcgacaccaaaacttcgtcttaacttagatgtgaagaacatttttgataaagtttatgatgaaagtgctttcaatttatatgcttatccgggtgaatcacgtaccgttcaattaggtatgagctatacgttctaa

SEQ ID NO: 1412 - DNA, 207 bp, Acinetobacter baumannii
gaagcatataaaaattcagatgttttttgtaatggtaagaaatatcagttagaggttattcagcctaaagattactctaaagaaactattaatgaagaaaataggttaacttttacttcaattgaaaaagaatggaatatcggtatgtattatcaagaacaagggacattgtactgtggaaatgaattaccaataataaatatttag

SEQ ID NO: 1413 - DNA, 810 bp, Acinetobacter baumannii
tctcaaataaaaaataattcttggtcatccaaaattatcaaaaaagtattaaagtactatgcaacaagttgcaaaaaaatattgggacgcagcatgacaagttacgccaatttattaaaaccattacatttgggcttcacaaccattaaaaaccgtgtggtcatgggatctatgcatacgggattagaagaccgcttttttaattacccaaaactggcagcttattttgaagagcgtgccaaaggtggagttggtttgattgtgactggcggtatttctccgaaccgtcaaggatggttggctccggctggcggaaccatgaatagtttatttgatattccgcagcaccgtttggtgactcatgccgtccataaacatggttcaaaaattttgatgcaaattttgcatgcaggacgctatggttaccagccatttgtagtgtcttcgagtgcaataaaatcaccaatttcaccatttaaaccacgtcaactttctgaaaaaaatattctcagtacaattgaagattatgcacagtgtgccgacattgccaaaaaggcaggctacgacggcgttgaaattatggggtcggaaggatatctgattaaccagtttttaagtcgccatgtaaaccagcgtacagaccgttggggcggtgaaattgaaaaccgtatgcgttttcctgttgaaattgtcaaagcgatccgcgcaaaagttggcgaaaatttattatctgtttccgtttatcgctgcttgaccttgtgcatgacggtaacactatgcaagaagtggttacggttgcgaaagctttag

SEQ ID NO: 1414 - DNA, 1065 bp, Acinetobacter baumannii
ctaaggagaaagcagatgaaaaaaaatataaatactgcattaccaaacacttggctaagtactgtttatttgatcgtattgagtcttgtattacttgttagtcagttaggttttgcgaaagatcgaattcaatatcatgttcaaaactttgatggttcaactttaaaagtaatcaacgaacaaggtgtagttagtcagtcgtaccaatatgcaccttttggtcaacagctacagttaaagaaaccaagtaacttaaagaacccaagagcatttgttggtggaatacaagatgcgaatgacttggtttacttaaagcaaaggcactataaccctgtagtgggacgattctaccaacctgatcctataacattcataagtggagggtatggacagactaatcgttatcagtatggttggaatgattcatatacttttaaggactctagtggcgagattcctttaccgattgtaactggggctatcggtggggtaatgggaggaggtgtgtcaatatttacccagatatataaaaataaggggctaaccgtaaattggagagaagttggtgtggctacaactgttggagcaattgcaggagctgtatctccatggacagcaactacaactattggggcaatcgcgacaggttcgacagcaaatgtaatgcaatatgggattaatcaaaaactttctaatcagatgattacacaaaaagatgttataattaatgcagtaagtggtgctattggtggcggtataggtgggtcagtagtatcaaagttaaaaatacctacagctagttcaccatttatctcaaaatcattagcaaataaaattaataataatcaattattttatgctaatgtcggggatcagactctttatagaaatattttagctaatatggcgagtaatgatatgtttaattggggaagccatataaattataattttcttaataatagtcaatatggtagttactataaaggtaatatgggatatgaccccgaattgtggacttctgggggattgtatcttgaaatatctaagcctgctcctaaataa

SEQ ID NO: 1415 - DNA, 1041 bp, Acinetobacter baumannii
actgccttgaactctattaccctgctccagccagatgattggcatgcacatttacgtgatggtttagcattaaaacgtactgttccagatttggctaaacaattcgcccgcgcgatttgtatgcctaaccttgtaccgcctgtaaaaacagtagaagaagctttagcttatcgcgaacgcattcttgctcatgttccggaaggcaataattttgaccctcgtatggtgctttattttactgaccacacttcacctgatgaagttcgtaaaattaaagaatcagaacatgtaaatgcgattaagctttatcctgctggtgcgaccacaaactccgataatggtgtgagtgatattcgtaaagtttatgcagtcattgagcaattagaagagcatcaagttccgttattgcttcatggtgaagtaactcataatcatgtagatatttttgatcgtgaaaaacgcttcctagatgaggtattatcacctctattgaaacagttcccgaaacttaaagttgtgcttgagcacatcactaccagtgatgcagcacactttgttttagaacaagaccgtaatgtggcggcaacaatcactccacaacatttattatttaaccgtaatgatatgttggtcggtggtattaaaccgcacttctactgtttaccaattttaaaacgccaaacgcatcaaacgactttacttgaagtagcgacaagcggtaatcctaaatttttcttaggtacagacagcgcccctcatgcacaaaatgcaaaagagaatgcttgtggatgtgcaggctgctatagtgcaccaaatgcaattgagctttatgcacaagcatttgaccaagtcggtaaattagagcgtctagaaggttttgctagccattttggtgcagacttctacggtctaccacgtaatacttctaccattactttggttaaagaagataacctcgttccagaatcttttgattatttagataatcaaaaaatcatcccgctgcatgccgggaaaacgctgcaatggagaaaagtgtga

SEQ ID NO: 1416 - DNA, 4791 bp, Acinetobacter baumannii
attaaaggttttatattgatggctaaagagaatacacaacagaaagaaattaaaagacaacctgctgttgaacttgctgtttttaacttaaatagcgtgacggatgtagcggacttgcaaatgatcgcaagtcaggttcagctgtatttacaagtgtgtggaaacacgacattagaacaaataaaaagtaaggccaatataaccacggttgctaatatttttgcattgacgggtagtgtactagatctaatgctctatgctacagataaaaaaactggtgatgctgctgtacaacgtggggcattacttgcggcaaatttaattggtttattttcagaaccgaataatgaagcacatgcacgcatggctttacgtccgatgtttggcttaatggcagagtgcttatatcgagaaaatggaaaaattaaagaaacggatattaagcgtttaggtttacatctcaatgcgatgatcgctggagatctagagaacttcttaaaagagactcaagcgaagttaagcagtttacttattagcgctacaacattgggtgtaaccattctacaaagcatggcgaccccagcaacaggtataaatgcaggaataaccactgcggcaggtgcaagtgcagaaaaacgagatccgaaactcaaatttaccaactgggctgttccactcattgatttattagggaagccgagccaagcaaatttaacccctaaaatacaaccaaatataacaagtcgtttgcaacaagaagcaactcaagctattgcggctttaagtcaaactttacagcaacaagcaaatgctggccaaaaatatactttggcatggctattacaagaaacactgaaagccatacaggcattagaaaataaaggtaatgcaagtgtgccaatcaaccagacaggtgaatatgaacggcatacgaaaggagacactttagagtttgtaagtttgcaggccgatgctttaaatgctcctccatgtgaaggtgctgattcccaatctggaaaaagtattagctattcaattggtgctgaacgggttcaacatgcagacttctatttaccgaaaataggtttttcttttatacggcaatataactcacaaatggatgagtttgatcaaagtatggtcggtgcacgttggatgatgccattttccaatatgattcaacaaaatgcccaaggctatctatttattgatagtaaagggcgaaagcatcaactgccggtttccattatatttgaaacatatgaagtaccttatgagggatggattattaaaccccttaaaaatggggaattaattttagattttggaggtgaatggagatctcattttcaaagctttgatgggggaaaaaactattatttagttaaaaaaatgaatgagacttctcaagaggaaattcttctagagtatcttttgttagatcacatagcatatttaaaggttatcaattttaaattgaaacaagcagagtatgagctgaaatttgcttttaatgagcaagttaaaatcattgcggtgtttttagatgacaaagctgagccattagcacgttatgaatacgatacccaagggaacttaattaaagctattgatcagaatggccatacaagaacctatgaatataaccaatttcatcaactaacccgttatacagaccgtacagggcgtggacaaaatattcggtacgaatcaactgaagccaaagctaaagcgatagaagaatgggctgatgatggcagtttccataccaaactaaaatggcatccgcgcttacgccaagtggcagtttatgatgcttatgatgttccaacttattattacttcgatcttgatgggtttacttatcgaactcgtttagcggatgggcgtgagtcatggtatagccgtgatgggaaaaagcgcattactcgacaaatcgattttgatgggcgagagactcaacaagaatacaatgatcaagatcaacttgttaaaattgttcagccaaacggtgggataattcgttttgcatataataagcagggtaacttagttgaaattaaagacccagaaggtagtatttggaaacgagaatacgatgaaaatagaaatgttagtaaagaaatcaatccattagggcatatcacacagtacaaatataacaatgataatcaactggttgaagtcattgatgcaaaaggtggtgttaagaaaattcagtataatgaattggggcagatgatttcatataccgattgctcaggtaagagtagtacatgggaatatgatgaagatggtgcactgacagctgaacaaactgcaaataataaagttgtacagtatttttacagtaccaaaggccgagataaaggacagctgcaaagtattatttatcctgatgggttaaaagaatactttgaacatgatgaagaaggacgcttacttaaacataccgataccaaaggtttagtaacggaatataagtacaatcaagttggcttattagagcagcgtattgatgccaatcgacatagtgtagcttatcaatgggacaaacaaggtcgcattcaaaagctaatcaaccagaatcaagccgaatatttgtttggatacaatccgtatggatatttgatacgtgaacaggcctttgatggagaggaaaagcactatagttacaatgaaaatggtcgattatttcaaatccgtcgaccaaatatactgacccaatttgactattatgcagatggacaaattgcttcgaaaagttttacccacttacatacagggcagaaacaaacagagcaatttgactataacctcaatagccaactgagccgagccagtaatgaggttagccaaattgatttatatcgcaatgcacttgggcagttggttagagagcatcagcattataaaattccagaactgaaaccgctcacagcagtattacattatgaatatgatgagcttggaaatttaattaaaacaattcgacctgatggacatacactgaatcatcttgtttatggttcagggcatatttatgcaattggtttaaataaccaagaggttgtttcatttcagcgtgatgatttgcatagagaaacaacacgattactagcaaatgggctcatgcaaaccaaacaatataatgatgtggggttattgagttcacagttcaatcaacctgagcaagaaactcaagactatttacaatatcaagcacatagaaaatatcactacgataaaaactatttgcttagtcaagttgaagatagccgtttgggtaaactcaattatcaatatgacccaattgggcgtttaattgcagctcaaagtttacataaaacagaaagctttaattttgacccagcaggtaacttaattgattctgagtcggtattaagtcctgcacaaattaaaaataaccttattaaaagttataaaggtaaacactaccaatatgacgttcaaggtaatgtgacagagattattcaagcgggcaaaaaccttaaactgacttgggataatcaaaatagacttattcgaagtgataataatggtctagttacagaatatggttacgatgtctttggtcgtcgactctacaaaaaaacagccaaagaattaaccttatttggttgggatggagatttaatgatatgggagtcttttaaatctgcacagaccaattatacaaagcactatatttatgaacctgatagctttgttccactattacaagcaggttataaggattttattcaactgatagaaactcctgattatcaggaatatcaaacaaaaccttattctatttataaagacccagtatggaatcgtaatcttggtaaagagcgtactgctttagagcagtttacattctaccactgtgatcaggtcggaacaccacaaaccatgaccaatatccgaggagagtgtgtatgggaaattctccaagatacatggggcgcggtgtcgcaaattaaagcactaaatcaagataatccatttgaacaaaataatttacgctttcaaggccagtattacgaccgtgaaacagaactgcactataaccgttatcgttattatgaacctcatagcgcaagatatgtaagtaaagacccgattgggttagagggtggtatgaatacctctagttatgtaagtgatccaaatcaatggattgatccaaaaggattaaatagttttaattatggtgaaatgtttggtattccagctagtgcccagtcaggtctagcatatcaaggtcaacgaaattatgagtgttatgctgaaacaggagaattatgtaaaataaaagtgccaccattatttgattatgttgcatgtagcggcggaggtttaggaataggagtgggctttgttaaaaatccatggactggcgaatattatattagtggttcgaaggattcgctattaattcctgtagcaaaatcagttgctcaaaataaacaatttagcgctaaagatctggcaggggctagttgtgtaggtggtaatattcacaacataccaagttataccaaaacaacaatgactatgggcgagattacaaatgaatttgtaagtggagcttcagttactgttggtggtggagcttatggagcagtagcaaacgtagtggttccattagtaagtaaaagcagtcctgtaaaaggtacgtgggcctctgagttaggagtaggaacaccaggtttcaatgtaggtgtgagcggtactgttagtgttgatacaattttagatgctgtgaaacctagtaagaaataa

SEQ ID NO: 1417 - DNA, 1287 bp, Acinetobacter baumannii
tgcagaatatgtaggaatcgactagtggcgaataggggaaatgtacatcaattactcaaatctaaagaagaaatcgagtatttggtcactctacatacccatcgttatgccaatatgcctttgcccaaacaactagaaaaaaaattctggtgtttaaatcttgatcgaactagacagaacatctcaaagtttctagcaagtggtgtactcacttatttaatttttattttactggccctgccaaccgactatttagtgattggggtaccttatattactttggactttattcattgcttacttagtgcaatgaatattgcacttgccctgttattgttctgggtttttgccaaatttacaaaactctccgagcacttttatttagctgcatgtggcattgtatttttaaccattattattaatgcgatgttattgcttagtgtcggaaatatggcactgaagaaccagtctatgttgcttctttcatttttatatatgctcgggttcatattaagcggtattaaacctttgcacatgctttgtgttggtttattggcagcatttttagtttttgcttttcttattttgttagacgtaaattgtgactatattgcactgggtcgtgctttgttcggtagttgtattttaggtttctcgattagcagtatgctcatctcaagagaaagaagcctttttttaaataaccagcttgctgaaattaatgaacagatcttacggattgaagcgtcggagttattgcatttaagccagcaggatgccctgactcaaatttcgaatcgacgtacatttgatgagatgtttgattttttctactaccgagcaaatcaagagaagcgtcctttagctgttttatttattgatattgatttttttaaaaactataacgatttttacgggcaccagatgggagataaagtcatctctagcattgccgcagcaattaaaaactcaattcgtcatgttgactttgttgcgcgttatgggggcgaggagttcgttgtacttttacctgaaacacctgcacagggcgcttattcagtggctgcaaatatctataaagccattgagcggcaagcgattcctcatgcagcttctttagtgtcgaagtatgtcactatcagtttagggtttaccgtatatacgggtgggctaaagatgggacaagataggcttattcatgcggcagatcaggctttatatcgggcaaaacagcttggtcgtaatcaaatttattatcaaccattacaagtcgccgaaattgcctaa

SEQ ID NO: 1418 - DNA, 333 bp, Acinetobacter baumannii
agtatgtatagaaaatttttgtgctttatattactaatagttgttggtggaagcgtatgggcaggaaatgctagagggaagataacaagtattattgtaagagactctgatggactggtgtatgtaaatgtagaaggtagagctaataaacctgattgtgcggttggtaactatatgatcattaaaaatgaaaattctgctacaggaaaaaggcagcttgcactattattaatggctcaagcagcaaataaagttatatctgtaacaggttatggtacttgtacacgatggcctgatggtgaagatataaattatattctagtcgaaaaatga

SEQ ID NO: 1419 - DNA, 2415 bp, Acinetobacter baumannii
tgtaaatacaggaaatttaccttggattatcggattaccaaaaaaaaaatatcaggtagttttacgttacaaactactgaatatgatgcacaaggagcaatacgtagtaatactcaagctggtcgtgttaccaaatataaatatgaaacggtatcattctcaacatgtcttggaaatttagcgagctttcaatggtcaaagtttgttagttgcttatcaaattatgtattaggtgatcaacatgtgggtttaccaattgaagttgatgttggaaatggtaaagaaattactcaatttgctggttacaaaaggggtattccaactcaagttaaacttgcaaatggggcgacagaaacaaatattgtagatgactttggaaatataactcaacatactgatgcagatggggttatttcaagaaaacaatatgatgatgctggccgattatatatagatacaccaattgttgggttaaattactctacattcacttatgatggtttaactgtttctagggttgtaactggtggcgggcaactgagccgaatagaaaaatataatggtgatggtttactgatttcgagtgaggataagatatcaaataaatctattattaactctaataagtatgatgcatttggaaacctgatatttaaatccaatcctggttttagtgctataacaagtggaactacaagcagttatgatgtctttgaccgcccaattactgtcaatgataatggaagtgttgtgacatattgctatcagtcctgtggaggaaaaactggtgcaattgtacaaacaacagatagctttggtacaacagaatctaatctattagcagcaggagattttagtgctgatttaaaaacactggttgcacgtaaaggtacagatggatcagtctttcagacaacaactgaatttgaaaacgcacttttaaaaccaaaagttgctgtatcgggtagttctacacaaagttatacatataactctaatacaactttagcaacagaaaaagataatagtattagtgggcaaaagacatttaaatatgatgatactggccgaattacttcaattacccatccagatagttcagtagaaacgatcaaatattttcaattaaaggacctcatcgcgtcccggacatggcgagaagttgagacaacttatagttattctcttgctgggcgtttaaaaacaacgactaatgcaaatattagtgaagcatttgatcttgatacatatggccgtgttataagtcatacacaaaaaatcaatgccaatgataccaataattcatatgtcgtaagatatggctataatcaattaaaccaagttacttcaattcaatatcctaatggtaaatctgtaaatttatctaatcagaatgctttaggggaagtaacatcaataccaaatgtaatacaaagtttgaattataatgcacggcaacaacttacaactgtgcaagccaataccgatactttatggtcatatacttataatgatagcgggttgctgaataatatctctgctacaagtctggaaaagtgtgtcctcaatgttgattatggttacgataaattgaaccgagttaataagctttcggacaaatgtggatcagtttataacgctacaattgaccgttatggtacaggtttgatgagtactgttgagttagatcaagcacgttatcaatatagttataataatgatgacattactaaagttaatatcacttcaaaaagctcgacagtagcaccagctatctatacatataactatgtaaataacacttctcgattagcaagcgtaagtggctcaacttatagctttacttatgatgcgatgggtaatgtaacaaatgatggtgtgcgtactctaacttatgataattatagtcgcctcaataagaatggtaatgagacctatctttataatgctgatggactaagagtccgtgctgtaagggatgatggtttaacagattatatttatgatcttgatggtaatttattatatgacataaattataaatctggttatagccgagcttatgtctatgtagcaggtaagctggtagcgactttagaacgctatcctgatgccaataaaggttttgactttgttaatgattttgaagctgccgaattaggattaacagatctattaggtagctatacagacactgataatgatggattacctgattatttagaacgttttattggatctgatcctaacaatcctgatacagatggagatggacacaaagatggttatgagtatcgcttattaggtgcgaaaggggtattgagctcttcagttaagccagatgttgctgatcctaatgaaaatcttgcagcatggatgactccaatattagccttgattctggaagatgactaa

SEQ ID NO: 1420 - DNA, 453 bp, Acinetobacter baumannii
gggcaaataagtatgaagttaaataagttgagtttggttgtttttatactttttatatttactgggtgtggtgaaatttattctcaaccttctgataaatatccatttgaagtgaaaatgaaagctttattaggggataaccttaaaattgtgaactcaatacgtaaagcagaagttcaaatttcttcttttagatttgaaaaagatcctaataaattgaaaaaagtaatcaaccaattagaagaagatgggtgggtgttaaaaggcaaaggacaaggagttgatacttattgtttagggagaaataatagaattaatgttgtgagccctactatgataggtgtttttgattaccaaggtgggaaactcaatataacagattataattctgacgctatatcttatagctataacaaatggggagatgatatgtgtgagcaatctgaggagtaa

SEQ ID NO: 1421 - DNA, 1437 bp, Acinetobacter baumannii
aattgtcaaagcgatccgcgcaaaagttggcgaaaatttattatctgtttccgtttatcgctgcttgaccttgtgcatgacggtaacactatgcaagaagtggttacggttgcgaaagctttagaaaaagcaggtgtcactttattaaatacgggtattggttggcatgaagcacgtgtgccgactattgtcacctcggtccctcgtgccgcgtttgttgattatacggctcatgtaaaacaacatatttcaattccggtaattgcgtctaaccgtattaatatgcctgaaactgctgaagagattttggcaactggcaaagcagatatgattcaaatggctcgccctttattggcggatgctttttgggtaaataaaactgcgaccaatcgtgtagatgaaattaatacgtgtattgcctgtaaccaagcatgtttagatcatgcatttaaaaataagcgtgtatcttgtttagtaaacccacgtgcaggccatgaaactgaattggtttatttaaaaaccaaacaaccaaagcgtatcgccgttgtaggtggtggtgtagccggtatgtctgctgcaactgttgctgcaagtcgtggtcatgcagtgaccctgtttgaagccaatgcagatgtaggtggtcaatttaactttgcaaaggttgtgccgggtaaagaagaatttcacgaaacgattcgctactttaaagtacaacttcaaaaaactggggtagatgttcgtttaaatactcgtgttaatcgtgaacaacttgaacgtgaaggttttgatgaggtgattgtggcgactggagtcgtgccgcgtgcattaaagattgaaggaagtaattcacctcaagttctttcttatgctcaagttttacagggcgctgaagttggacgaaaagttgcagtgattggggcaggtggtattggtttcgatgtctcagaatttttacttaaaccaccacatcaaccacagcctcaacctttagccgagtggcaacgtgagtggggtgtagacccagatccaaattatgtttctgaaggtggtatgcaaccaccagtagttgagccagcgatacgagaaatttatttgctgcaacgtaaaacaaccccactcggtattggtcttggcaagacttcggggtgggtacatcgtgcccagcttaaaaagcacggtgtacgcatgcttcgtggcgtgcaatataaagcagttaccgatgaagggctttggattgagcataatggtcaggaccagcttttacgtgtagataccgttgtggtgtgtgcggggcaagagtcggtaaaagacttgatgccaaaagaaggtgagtcgactatagcgaactaccatattattggtggtgcaaagctcgcagcagagctagatgcgaagcgcgcgattaaagaaggagcagaattggctgcccaactgtaa

SEQ ID NO: 1422 - DNA, 720 bp, Acinetobacter baumannii
tcacctgtagggttttcatgctttaagtcattacggctcaaaaaacttgtattaactataaaacttgagatgtgccaagcacagtctttatggctttgctgtgcctttttttctcccaaaaaagtatctcatttagaaacaacaagaatttataacggtaaaactatgccaaatttagaaacctcttctaaaaaattacacattattcgtaccgctattcgtttgtttaccacatatggattccatacaacaggcgtagacctgattgtcaaagaatcagaaataccgaaagccaccttgtataactattttcactcaaaagaacgacttattgaaatgtgtatagctttccaaaaaagtctacttaaagaagaagtgcttgcgattatctattcaagccgttattgcacgccaactgataagctcaaagaaattgtggttctacatgttaactctaacagtctgtatcatttgctacttaaagctttttttgaaattaaagggtcatatcctcaggcttaccgtatggcaatcgagtatagaaagtggctaattcgagaactttttgacctaatttttagtttggaaactcgtgctttaaaacctgatgccgatatggttttaaacctaatagatggtttgatttttgggtttttaagcaccaatagtttgagtgagagggatgaggtgttggagcggttttttatgccagtacgctag

SEQ ID NO: 1423 - DNA, 885 bp, Acinetobacter baumannii
gatatatttatgaaaaaattatttagcgtactgttcagtgcctctgtactgacactgactgcatgtaataagcaacctgcacaaactgaaaatacagcagccaaagataaaactgagtcagttcgtacaattaaactggtttcaacaggttctgatacggacgtatggaaatacgtagcaacacttcctgaaactgctcaagcgggcattaaactcgaagtaactaatttaactgactatgttgtgctcaatacgtctgtagcaagtggcgaacaagatgtaaatgcgtttcagtcattcaactatttggcagcttataatgcttcaaataaagctaaagttgctgctgttgcaacaacttacctagagccaatgggtatttatgcaaataaagttaaaaccgttgatgagttcccgcaaggcgctaccattgcaattccaaacgatactgctaacgaagctcgtgcattaacattattgcagtctgctaaattaattaaacttaaaccaggttttgaccctgtaaaagggacagtgaatgatatcgctgaaaaccctaaaaacttacaattaaaacctattcaaatgacaaccgcagttcgtgttaaaaacgatgtagatgcgattgtactcggtaatacattggcacttgagggcggcctcaatgtaatgaaagacgcaatcttccgtgagccaatcgatcagtctactaagctttatgtcaatttattaggtgttgctgaagcgaacaaaaatgacccgatctatacgaagcttggtgaactttaccacttacctaaagttcaaaagtttgtaaatgaaaaatttggcggcacaaaagttgaagtgaacaaacctgtttctgaatttgcagacatcaaataa

SEQ ID NO: 1424 - DNA, 333 bp, Acinetobacter baumannii
ggaattattatgaaaaagcaaatgaaatttacactttcttttttttcctctcttttcatcttggctatctctacttcaacctttgcagccacgaattctgaccaaaatgtaattggtacaattgaaagaatttatctaagcggcgacacctacttttttcgactaaatggcaatgatacctgtgcaaaaaaaactaatggatataatgaatactatacttttaaagtaagtcagcctcattcaaagaactggtatgctctaattttaacagctgctcaaaccagaaaacctggcagagtaaaacttgaagtgcgacataaaccacctaattaa

SEQ ID NO: 1425 - DNA, 222 bp, Acinetobacter baumannii
gaaggagttatgattaaaattaattgtttaatgttgattacaggtcttagtcttttattatcaggatgcaaaaaagatgttgaaataaaacctcaatttaaaagttcgaatgaagctactccacatgattatagcagtgtccctgcagaacaatttaaagggaaattaagttttttaaagaataattggataaaatctttactaatcaaaagattattttga

SEQ ID NO: 1426 - DNA, 192 bp, Acinetobacter baumannii
tattccaccatttcccaaggtagtttctcaccaaatcttaaagttattatttttatgaatttattattatcttttgaagttggagcagaaggtatagtaaatatttctaaatcacgccaaaatgcaagaatacgactatcctcaataaagttacttttcttattatccataaagactctcgaagctatatag

SEQ ID NO: 1427 - DNA, 351 bp, Acinetobacter baumannii
ccaaattcaatatatgaaagtatagtcatgaaaaaaatagttctttctctttctatatgttttttttctacttctgctctagcagtaactaattgtggaccctataaagtaaaatctatccaaacacaagctaatgatgttttagttgaattccttagtagtgatggaaaatcttattttaaacagattggtctttggagtagtccttcaacgcgtccatttttagctactgttatgcaagcttttggtatgaataaacctgtttcaattagatatgcacaagataactacttatgtgcttctaccgaatatacagtaccaattattatgattagaattgctaattcataa

SEQ ID NO: 1428 - DNA, 219 bp, Acinetobacter baumannii
ttggataaaatctttactaatcaaaagattattttgagggatgagggtattgcttttgctcctactcaaagctttcttgttgttcaaattcctgtagagagattaaatgaggaaacctatcaaagaaatattgttcctagaattagagagaatggttggattcttgagaagcatataaaaattcagatgttttttgtaatggtaagaaatatcagttag

SEQ ID NO: 1429 - DNA, 267 bp, Acinetobacter baumannii
ataaagaaaatttttcgattaatgattataatgagattaaaaaacaaactattaagtggaaaatgggattttgttgattcatacgataattattataatttttgtaaaactaataattattctatagatatattaaatcctattcatgatagaaattatacaagagagagtgatgaagttgattttaaaagcaaagattattggtattttgcattatacaatgataaattaggtgttaataattgtatggaatattatggtaagtaa

SEQ ID NO: 1430 - DNA, 264 bp, Acinetobacter baumannii
attattatgattgtgagaaaattcatattttctttattcatttttagtctctattgctccctaatagcatgtagtactaacccaactagcttacaagagctttctaaggagttgttcagtgaatatctatatgaagttgatactgatagaaataaaagctctactcaattaattgtgataaaaataaataaagaaaatttttcgattaatgattataatgagattaaaaaacaaactattaagtggaaaatgggattttgttga

SEQ ID NO: 1431 - DNA, 309 bp, Acinetobacter baumannii
agcgcttgcttgattctcggcccgtctgtgaagacaatactcgaagaagatttaggcatagatgtatatttctgtgacccacattcaccctggcaaaaaggcacatgcgaaaatatgaatggtttaattaggcaatatttacctaaagggattgatttaaatcaggcagatcagcattatttaaatcaagttgccatgtcactgaatactcgtcctagaaaggcgttagattggcttacaccattagagaaatttgctcagcttgttgattatcatatggcttttgaaactgtcgcacctcatgtttga

SEQ ID NO: 1432 - DNA, 228 bp, Acinetobacter baumannii
tcaagctgctttaaatttttaagttgtgtcgttatagcttatggcaatgagtgccaagaaataatggatgtgcaaagccaactcctttttattgggagttctgccaaaacatttaaattatggtggcagaacgaaagggggttagcagactggccgaaaaaacccagcacacccgaaggtgtccccctcccgttccgccgtagagggggcacgagggttcgtcactaa

SEQ ID NO: 1433 - DNA, 816 bp, Acinetobacter baumannii
ctcaccttatcgtatgtattgattatggcacaatcctttcattccaaacagcttcaaactcatcaactggctaaaggctttttgattaaagcttctatagtcgtatgttcaagtttcgctgtggctttgacaggttgtagcacattacccaaacatagccctgaaccaatccagtacgcacgagatatcgatacatctcaaacttctctttcaaaaattattacgcctttacgtgaaaaaaatccgaatttaacgggttatcatcttttaaatgatcccttagaagcactcgcggctcgcttaaggctgattgataaagccgaaaagactttagatttacagtactatatttgggataacgataaagtcggtgctttagctttacatgcaattattcgtgctgctgatcgtggtgttaaagtacgtttattaattgacgataataatgctaaaaagatggaaggcgtgttacttgcgctttctcaacataaaaatattgaagttaaattatttaatccctaccgtttccgcaaatatcgcgcgatggatatgattttagacttaaaacgtatcaatcgtcgtatgcataacaagagctttattgctgataatcaggttgcgcttattggtgggcgcaatatgacaaatcagtattacaacgttagcgacagttatcagttttctgatgtcgatgtcatgttggttggagctgccgttgatgatatcgtgaattcttttgttgactactggaatcatgaatatgcttattcagtccaaagtattgtcaggtgctcaacaacacggtttgcgctatga

SEQ ID NO: 1434 - DNA, 435 bp, Acinetobacter baumannii
tgtgatatgtctgagcaaactattgaattaacccctacacgtccttatcttgctcgtgcaatctatgaatggatttgtgacaatcaactcacaccttatttactcgttgatgcaacacaaccgcacactgatgtaccacaacagtttgtgaaagatggacaaattgttttaaacattgtgcctcatgcggtacatcaactactcattagcaatgatgcgattacattttcagcacgttttggcggcgtttccaaagatatttacgtacctattcaagcagttttaggtatttatgcacgtgaaaatggacaaggtttattctttgaccccgaagaatatgccaatgtagcgcctgtagaagataagttagactcagaaacacaagaaacatctgaaccaaccaagaaaaagccaacattaagaattttagattaa

SEQ ID NO: 1435 - DNA, 1200 bp, Acinetobacter baumannii
tcaatctttaccgtaattaaaaaaattaataggaacaacaccatgaaatttactgccgaacatgaagcattacgtcgcacagcgcgtcaatttgttgaaaatgaactgaatccgaatattccagaatgggaagaagctggacgtttcccgatccacgatgtatttaaaaagatgggggatcttggcctattggggatttgtaagcctgaggaaaatggtggtctggctttagattactcttataacttggttgttgctgaagaaattggacgcgcagcttgtggcggtgtgcctttagccattggtgtacaaaccgatatggcaacacctgctttggcgcgttttggtagcaaagaattacgtgatgagtttttaacaccagccattgctggggaatatgtggcatcgattgcagtatcagaagtacatgctggttcggatgttgctgctattaaaacgactgctaaaaaagatggcgatgactatgtcattaatggcagcaaaatgtggattaccaactcattgcaggctgatttcttctgcctattggccaacacatctgacgataaaccacatgttaataagtcgatgattattgtgccagccaaaactaaagggattagtttttcagagccgttaaataaattagggatgcgttcaacgaccacagcgcaggtttatttagacaatgtacgtgtaccacagcgtaacttggttggcgttgaaggtatgggcttcatgatgcagatgatgcaatttcaggaagagcgtttatgggcttgtgctaatgcgattggtggtttggaaaatttaattcaaaagactatcgcctataccaaagagcgtacgacgtttggtcaaccactcattaataaccaatatatccattttcgttttgccgaactcatgactgaagtagaagcgcttaaagccttaacctaccaagcgtgtgaacagcatattgctggtgaagatgtgaccaaactggcatctatggcaaagctcaaagcaggccgtttaagccgtgaagttgctgatagctgtctacaatattggggtggcaatggctttatgtgggataaccctgcatcccagctatatcgtgatggtcgtttaggctctattggcggtggcgcagatgagattatgttggggattatctgtaagttgatggatatcttgccaaaaaaacaaaaataa

SEQ ID NO: 1436 - DNA, 324 bp, Acinetobacter baumannii
tttatgaatacaagatctttgaaactctcctttattgcattgctgtgcattgcgcttgcaggttgcttgagttttggtcctttgaaatatcgtcaagtaaaaatgctaaaaaaagaggggtttgtacttactaatgaaggctggactctaggtttaccagaacgcttattatttgattttaatgacgcaacattaaaacaaagtcatgaagcagagcttacacgtttagcaaatcaattaaataaatatgatttgaataaattaaaaatcgttggtcacactgacgatgtaggtaatcctgaataccaccaaaagttattgtga

SEQ ID NO: 1437 - DNA, 681 bp, Acinetobacter baumannii
ccgattcacacaaccataccttgtgatatgtcggtcgaaaacacctcaattcagggaattaccctttacagccatgctgatgatttccgttcacactggatccgttttttattggcagaaaaacaaattaaatatcaattaatcgtgactgatcacgaagatgaagatctcgcaagcctaaatccttataatcaattgccaatgctggttgagcaaaatcttaaattattttcagcgcctatcattgctgagtatctcgatgaccgatatcgtcagaataaactatatgccgatgcccctatggcacgtgcagagcaacgccaatatatttggcgtcttgaaaatgattggtttaagttggccgatcatatgctcagacatgcagatacgttaaatatagaacaaaaacaaaaagcacaaaaagaattgcgtgacaccttaatatcacttacccctttatttcagcatttcccttattttatgtccgaaaatttttcaatcctggactgtatgcttgctccaatttttgtgagacttaatagcatgggaattgatttaccaaagcagcagtgtcgacctatatttttgtattgtaaacgtatctttagccgcccttcttttgttaaatcaatgacgccccaagagaaaacccgttacaatgaactattaaatatggaatag

SEQ ID NO: 1438 - DNA, 315 bp, Acinetobacter baumannii
ttcgatgcaacgcgaagaaccttacctggccttgacatactagaaactttccagagatggattggtgccttcgggaatctagatacaggtgctgcatggctgtcgtcagctcgtgtcgtgagatgttgggttaagtcccgcaacgagcgcaacccttttccttacttgccagcatttcggatgggaactttaaggatactgccagtgacaaactggaggaaggcggggacgacgtcaagtcatcatggcccttacggccagggctacacacgtgctacaatggtcggtacaaagggttgctacacagcgatgtga

SEQ ID NO: 1439 - DNA, 927 bp, Acinetobacter baumannii
atggatgaaacaaagatgagttatcaatcaatatttagaccagatgctttcgccaataaagtcattattgtgacaggtggtggctcaggaattggccgttgtactgcacatgagcttgcagcccttggcgctcaagtcgtgattacaggacgcaaaattgaaaaattagagaaagtaagccaagaaataatagaagatggtggtttagttcatttcattgtttgtgataaccgtgaagaagaacaagtgaaaaatatgattgccgaagtgattgagaaattcggcaaactcgatggtttggtgaataatgcgggcggccagtttccgtcagctttagagaatatttcggcgaatggtttcgatgcagtcgtgcgtaataatttacacgcaactttctatctaatgcgtgaagcttataaccaatggatggctaaacatggtggcagtattgtcaatatgactgctgatatgtggggtggtatgccgggaatgggacattctggtgctgcgcgttcaggggttgataacttaactaaaacagcatcggttgagtggggcaaatctggtgttcgtgtaaatgcggttgcaccagggtggattgtgtcatccggtatggataattatagcggtgattttgccaaagtaattattccaagtcttgctggcaatgtaccgttaaaacgtatgggaactgagtcggaagtctcatcggcaatttgttatttactatccgatgctgcggcttttgtgtcaggtgtaactttgcgtattgatggcgctgcatcgcaagggacacgcatgtacccactagccgaagcgacaaatagtcagtcttataatggtttccatcgcgcgtttattcctgaaatttttaaaaaagataagactgagaaagtcgagcaaagcaataattcaggctcggagtga

SEQ ID NO: 1440 - DNA, 816 bp, Acinetobacter baumannii
aattttatgactcaaacgcaaagtatagtgaattcaacgttaaagaaattttcaaaaataggtttatacggaaaaaaagttacttcagcgactgcggcaatcagtgaaggtttttacttagtttatcgtcatggactttataaagatccaaataaccctgttaacactcgatatgttcaatatttctgtcgtcgtttatgtcaagtatttaatcttgaagttcaagtacatggcacaatccccagagagcccgctttatgggtgagtaaccatatttcttggcttgatatcgccgttttaggttcaggtgcacgtgtcttcttcttagctaaagccgagatagaaaagtggcctattcttggcaatttggcgaaaggtggaggcaccttatttattaaacgtggatcaggtgactccattaaaattcgagagcaaattaccgaatttttaaagcaaaatattccggttttatttttccctgaagcgactactacagatggccattctgttaagcgggttcatggtcgtttactcggagctgctatcgaagctcagcgtccggtacaggtatgtttaatctgttacgtaaaccgtcatggtgagttagataccgttgcaccatttattggtgagatgtcattcgttgagcatattcaacgtgtgctagaaatgccgaaagtaacagcccatttacttacacttcctcctatttcggtagaaggccatgatgtaaaaagtttgactcaagaagtgcaagaaaaaatggttgaaggattggctcaattacataaaaaagtacttaagccaaaaagttaa

SEQ ID NO: 1441 - DNA, 459 bp, Acinetobacter baumannii
aaggattttttgattatggggaaattttttgttggagctttgctcctagtgggaataaatacagctacttttgcagctgatattacaggtctttggcaaacgattgatgataaaacaggtacacctaaagcacatgtagaaatacggaaagaggcaaatggtacttatgcaggcaaaatcgtaaaaataacaccacgcccaggttatacgccaaaagaaatttgtgataactgtcctgcaccttataccaataagcctattttaggcttagatatcgcaaccgggctcaagcaaactgataattcaacatatacaggtggaaaaattctagacccaaatacgggtaaagtttacggattaaaagcaaaactcagtgcaaatggtaaacgtctacacatgcgcggttaccttggggtatctgctttaggtcgtaatcagatctggattcgcctagaataa

SEQ ID NO: 1442 - DNA, 192 bp, Acinetobacter baumannii
gtgaacaatttatttcagactcaattttgccaatctgttaatgagttaatgtgtcttcgtcagatcacactaattaccgtgataatgaaatcacagaagttaataaaccaagatctcaatctttatttactaatttctgtaatccgaacttatcttaagttctggtggagactaggagagtcgaactcctga

SEQ ID NO: 1443 - DNA, 738 bp, Acinetobacter baumannii
gcacccttatacccttgtgggtctatgcaaaaatggcaaaacattggttataaggagaataaaatgtttatgattctttatggatttttgatcactttagttggctacctttgtgcaaaaccattaaaccgccgctttcctcaagttcctcttttagttttcggcatgttcattgtcattgggctattgtcaatcttgaaagttccctatgaagaatatcgactttacgtaaatgatttatttagccatttattaggatatgtcacggttgctttagctatacctttggctgcaatgcgttatgacgatttacctcttaaatcggtgattggtattttatgctttgccagcattagtgccgttgctttaccaatgggccttgcttacctattgcatatgtctgagccgactattttggcttttgctacacgtgcagtaaccaccccaattgctttaaacatcgcgaccttattacatgctccagagacattagtcactctcattgtgattttatccggagttattggtgcagcattttcaccatttttacttaagcatatacacgatgaaagagcttcaggtttagctctaggcttagctgcacatgcaattggaactgctcaggcttggcaacgtggacctgtagcaggtcgttatgcggcatttggtatggcattaaacggtgtatttaccgctatttggctaccaaccttcatgttatcttttggaatacactga

SEQ ID NO: 1444 - DNA, 981 bp, Acinetobacter baumannii
agcaatcaatatcacattgggcttaccatttattcggacttcggtcgatcatggtactgctctgtctttagctgggacaggattggcaaaaagctcaagtttaaatgtcgctgtcgatttagctttatctttggcagcgagttaaatttttcatgttggaaatgttctatgtatcaaattaatgccctaaacccgaaagatgaagggcataaagctcgtaaacgttttggtcaaaacttcttacatgatcaacgagtcattgccaaaattgtacgctcagtcaatccgcgtacgggtgataatatcgtcgaaattggtccaggtttagctgctttaacttctcctctaattggagaatgtgatgcattaactgtagttgaattagaccgtgatttagctgccggcttacctgaacgcgtgccacatccagaacgtttaactatcgtagaagctgatgcattaaaatatgattttagtcagcttgtaaaagatgggcgtccattacgcgttgtcggcaatttgccttataacatttctacaccattactttttcatctcttggaatttggtagccaagttaaagacatgcacttcatgttgcaaaaagaagtggtagaacgtattactgctgaaccgaatacaaaagaatatggccgtttatcagtcatgatccaatattattgtcagcctacctttttatttgaagttccagcaggcgcatttaacccgccaccaaaagtgacaagtgcagtatttcgcttggttccttacgaacaaaaaccaattacggcgaaagatgaaaaagctttagctcgcttggttgcccacgtctttactcagcgccgtaaaacgctaagaaacagtcttaaaggcatgttggcagaggatggtttcgagaaagcaggagtcgacccaatggctcgtccagaaactttaactcttgcagagtttgtggctttggcagatcaaatggtggcataa

SEQ ID NO: 1445 - DNA, 429 bp, Acinetobacter baumannii
atgaaaactctcagcgcaaagcctgctgaagtacaacacgattggttcgttgttgatgctacaggtaaaactcttggtcgtttagcgactgaaattgcacgtcgtttacgcggtaagcacaaaacttcttatactcctcacgttgacactggtgactacatcatcgttatcaatgctgaacaagttcaagtgactggtaacaaagcgcttgacaagaaatactatcgccacactgaattcccaggcggtttaaaagaaactaatttcgaaaaattagttgctcacaaacctgaagaaatctttgaacgtgctgttaaaggcatgttgccaaaaggtcctcttggttatgcaatgatcaagaagatgaaagtgtacgctggtagcgagcatccacacgctgctcaacagccacaagttttggacatctaa

SEQ ID NO: 1446 - DNA, 621 bp, Acinetobacter baumannii
ataaaggaacaaactgagcacatgattgccacctcaattgaacagattccaaatatcccctgctttgatgacagtccacgtggccgtttattgcacggtgcagcctatctttttcataagcaaggctatgataaaaccactgttcgtgaacttgctcagtttattggaatccaatcgggaagcttatttcatcatttcaaaagtaaagatgatatcctcgctcatgtgatggaacagaccattatctataatcttgcccgtttaaatgatgcagtaactcaatctacagacccagaacaacaattacgtgctcttattaaatccgaactgatctcaattactggagatactggtgcagccatggctgtgttggtgtacgaatggttcgctctatcaaaagaaaagcaagattatcttttaaaaatgcgtaatgaatatgaacaaatctggctcgacgttatagaaaagttacgcacacaaggtaaagtcaaacacgatgcttttatttggcgacgcttaattggcggtgcaatttcatggactgtaacttggtataaatctgagggtaaagtcaaaattgatgagttaacggaaatggtttgggaaatggctttgaaataa

SEQ ID NO: 1447 - DNA, 399 bp, Acinetobacter baumannii
gggatacagcacatggctactaattatggtacaggtcgccgtaagaccgcaactgcacgtgttttcttgtcagctggtacaggtaaactcgttattaacaaccgtactttagagcaatatttcggtcgtgaaactgctcgtatggttgttcgtcaacctttagagcttttagaagctactgaaaaatatgacctttacatcactgttaaaggtggtggtatcggtggtcaagctggtgcgatccgtcacggtattactcgtgcacttatcgctgctgacgaaactttaaaacctgttcttcgtcaagctggtttcgttactcgtgatgctcgtgaagttgaacgtaagaaacttggtttacgtaaagctcgtaaacgtcctcaattctctaaacgttaa

SEQ ID NO: 1448 - DNA, 291 bp, Acinetobacter baumannii
tttttagacaaaataatgagaaatagaatggcaaataatcagcaggatgatcatcgagtcgtaaaaatagggtgtgcctctgggttttggggagataccaatactgccgcttttcagttagtgcatttgaccgatattaattatttggtttttgattatttgtccgagattaccatgtcgattatggcaaaagcgaagatggtagaaccgaaacatggttacgctttagattttgtcagccgagtcatggcacccttactaaaaaaattgctgaaaaaaagattaaagtga

SEQ ID NO: 1449 - DNA, 1227 bp, Acinetobacter baumannii
ctgatggtaaacatgacaagatatgttctggaattaaataaaaacatcaggacatttctaaaaatgcagctcaatccaatttactataatgaacaacatatagcttttgccgataatgttcgtagatttgtacaaaaagaaatggcacctttcgttaatgaatgggatgaggctgagacattcccaagagaactttataaaaaggctgccgaaattgggttactgggtctaggtttttcagaagaatatggtggtattccagatgcagatccattctattcattactggctggtatcgaaatggcaaaggcgggttcaggtggggtgcatatctcgctcatggtccataccattggcgcccctcccattcagcactttgggagtgaggagttaaaggctagagttctgccaggtattatttccggtgagaaaatttcggctttagcgattacagaacctggtggtggttcagatgttgctgcattacagactaaagctgtcagagatggggattattatattgtttcgggcgagaaaacatttattacatcgggaattcgtgcagactattatacagttgcagtgcgtactgatccgacaaaaacgggtgcagaaggcatttcaatgttactcattgatgcacatagtgaaggtattactaaaacgtctttgaagaaaatggggtggtgggcatcagatacggcacatttgcattttgatcaagtacgagtacttgcatcaaatctacttggcaaagaaaatgccggttttaaagttattatgaataactttaatatggagaggtttttcttgggagtagtcgcttatgggtatgcattagtctgttatgaagaagctttagaatgggcacagcaacgtaaaacttttggtaagcgattaatagatcatcaagtagtacgccataaattggtagatatggcaacccaactgacctcaacgagggcattacttgaagaaacagcatggaaaatgactcagccgaagttacaaggacctgagttggtggcgcaaatttcaatgcttaaaaatgttgcgactcgcactatgcaattttgtgctgatgcggctgtacaaacattaggtggtatgggctttatgcgaggtaccaagtcagaacgtatttaccgtgaagtgaaggtcaatatgattggcggtggtgctgaagaaattatgaaagatttgattagtaaacagcttggttattaa

SEQ ID NO: 1450 - DNA, 1005 bp, Acinetobacter baumannii
aataattcaaattttagagatgtgtcgggggtgattgtgctgcctttatatgtcacttccggtgaacctgccggtattggtccagatatttgtttaagtctggcaaaacgggttgatgaacgtcctgttgtggttttggctgatcgaaatctattacaacaacgcgctcaaaagcttggtctagacattaaatttttagagtatagcggacaagctgaatcgtctttgcaaggcgagctttatatagagcacgtagcattaaaagcagaagtcatcgatggtcaattaaacccagctaatgcagcttatgtattagaacaactacgtcgttcagctgattatgcaatgtctggtaagagcgtcggtgtagccactgctcctgttcaaaagtcggtgattaatgatgcagggattttatttagtggacatactgaatattatcaagaatttgcaggcgtagagtgtgttgttatgatgctggcaacgaaaacgttgcgggtggctctggcgaccactcatttaccattaagagatgtcgcggatgcaattaccaaagaacgcttgcatcaagtgattgatattttacttcacgacctaaaaaccaaatttaaaattaatgatcctcgagtcttagtatgtgggttaaatcctcatgcaggcgaagatggttatttgggacgtgaagagattgatacgatcaatccggtacttgaaagctaccgatcacagggagttaaattaagtttaagtttgccagctgatactttatttactcctgaacatcttaaaaatgctgacgctgttcttgcgatgtaccatgatcaaggcttacctgtgttaaaatcacagggttttggtgaagcaatcaatatcacattgggcttaccatttattcggacttcggtcgatcatggtactgctctgtctttagctgggacaggattggcaaaaagctcaagtttaaatgtcgctgtcgatttagctttatctttggcagcgagttaa

SEQ ID NO: 1451 - DNA, 375 bp, Acinetobacter baumannii
aaaattagaaataggaaaaataaaatggaatataaaggaagttgtcattgtggtcaggtaaagtttgccgcggaaggtgagctaacagaagccttatcttgtaattgttctatctgccaaaagaaagggtctttactttggttcctgccgactaatcaggttaccgttactttagattctcctgatattttagcgaattacacttttaacaagcatgtgattaatcatcatttctgtaaaaattgcggtattcatccctatgctcaaggtatagatgcccaaggtaattcgatctttgcgattaatgttcgatgtatagatgatattgatttagaaaagataaaaataaattattttgatgggcgttctgtttaa

SEQ ID NO: 1452 - DNA, 876 bp, Acinetobacter baumannii
tggatatcttgccaaaaaaacaaaaataaggaatcagccatgacactttcagcatcgcttcaagctttagatattgatgacagtattcaattagaacaagacggcagtattttatatctttggttaaaccgaccggagagccgtaatgccatgaacttgaatatggtcaatgcaattcaacaagtctttaatgccatacgcgatgacctttcaattcgtgcagtcatcattcgtggtgaaggtgggactttctgcgcaggtggtgatattaaagacatggctgctttacgcgttgaagcaactaacgttggtagtctacaaccttatactaattttaaccgccgttttggtgccatgcttgagcaagttgaagctgcaccacagactgttgtggtcattttagaaggtgcggtgttaggtggaggttttgggctgacatgtgtttctgatgttgccattagccgtgataatgcgcagtttggtttacctgaaactgggcttggtgtgattcctgcacaaattgctccttttgtggtgaaacgtattggcctgactcaggcacgcagactggctttactcggcatgcgttttgaagggcataccgcactgagtgtcggtgtggttcatcaaattgcacataatgaaattgaacttgagcaagctttagaggaaaccattcaacacattaaacgagcagctcctctagcttcacgtgtgactaaagcactgttacatcgaacactcaatgaacctttaaatcagttgctagatgatgctgcacagcagtttgctcaagcggttggtagtgctgaaggacaagaaggaacgatggcttttatccagaaacggttaccaaattgggccgatgaatcataa

SEQ ID NO: 1453 - DNA, 510 bp, Acinetobacter baumannii
ctcaccatgtggcactccgctaagaaagtattattttgcatacttgtagtgtttgctacgagtgggcctgcttatgccaattcaaaacataacttttatgtgctcactttatctattttaagttatagcaaatgggagaatgtaagcacgcctactctttgcgtaattgataatgcatcaattacttctaccttccagtcttatattcaacaattatcttataattatcgtgtacaaaccgttaatgctaaagatttttctaaatcgcattgccaggctgtttatttctctactacaccacctcagcagcaacaaaacttaattcagaattatccatatcgttctttgctttctttaagtattaataatccagaatgtgaagttggtagtatcttttgtttatataatcaaaataattacaccacttttaaagttaacttagatgcattaagccattccaaggtccatattgatccaagggttttactcttggctaagaacgcggagtaa

SEQ ID NO: 1454 - DNA, 1677 bp, Acinetobacter baumannii
ttatttgtccgagattaccatgtcgattatggcaaaagcgaagatggtagaaccgaaacatggttacgctttagattttgtcagccgagtcatggcacccttactaaaaaaattgctgaaaaaaagattaaagtgattagtaatgcgggtggtgttaatccattggcttgtcgggacgcattgcaaaaaattattaaagagtatggtctagatctgaaagtggctgtggtgttaggtgatgatcttttgccaaaacatgagcagctaaaatcacagaatattcaagaaatgtttagcggagaagcgttgccagaacaggtggcaagcagtaatgcttatttaggcgcggttgctattcgtgacgccttagacttaggtgcagatattgtgattacgggtcgtgtagttgactctgctgtggtacttgcacccttacttcatgaatatcagtggcctttagatgactatgacaaattggcgcaaggttcgttggcaggtcatgtgattgaatgtggagcccaatgtacgggtggtaattttaccgattggcaattggtacagggcttcgacaacatgggctttccagtggttgaagtgagtgaagatggctcatttgttgtaactaagcctcaaggtacgggtggtctggtttctactgctactgttgcagagcaaattgtttatgaaataggcaatcctcaagcatatttactacccgatgtcattgctgatttcagccacgtgcatttagagcaagtcggggagcaccgagttcgtgtgacgggtgtaaaaggacaagcaccaactacacaatataaagtcagcgcgacctatcctgatggttatcgggttttagtgagtttcctcattgcaggacgtgaggcaccacaaaaagcacaagtcattgctgatgcgattttgactaagtgcgaacgtgttttagcaatgcgctcagtgccgccatttagtgaaaagtctgttgaaattttaggtattgaaagtacctatggcgaccatgcccaaacattaaatagtcgtgaagtggtagttaaaatagctgtaaaacacatgtttaaagaagcatgtatgttctttgcatctgaaattgcacaagcttcaacaggtatggctccagccttggcaggaattgttggaggtcgaccaaaagcatctccagtgattaagttattttcatttttaattgataaaaatcaattgaatattgaaattgattttgaaggcaaacgttacccagttgagattccacaaggggattctacagagcaattgcttacattaacggcaggtgaaaatgcagtttatcaaggagatgaaattgaagttcctttgattgaaattgcgcatgcccgtagtggtgataaaggcaatcatagcaatattggcgtgattgcacgtaaagcagactatttaccatggattcgtgcagcactaactgaacagtctgttgcaagctatatgcaacatgtcttggatgctgagaaagggcgagtaattcgttatgagttaccgggtttaaatgcactgaattttatgttggagaatgccttaggcggtggtggtgttgccagcttacgtattgatccgcaaggtaaagcctttgcccaacagttattggatatgcctgttaaagttccggcacatcttttagaaaaataa

SEQ ID NO: 1455 - DNA, 840 bp, Acinetobacter baumannii
atgactaagcgctataactatgtaattggagatgtgcaaggttgttttgaggcactcaaagcgctattaaaagaaatacgttttgaccctgatcaagattttatctggtttgctggtgacttggttgcacgtggtgaaaactctgtaggtgctctacgttttattaaaaaactagctgatcgaggggctgctgctaccgtattaggtaatcatgatttaaccctgattgccggtgctcgtggtcttaaggaaattaaagaaaaagatcgcacgcaggatgttattgacgccgtggatggtgatgatcttatcgattggttacgtaaacagccgttatgtttatttccaaatgagcaaacaatactcacacacgcaggtgtaccttgtatttgggatgcacaaaaaactgctgtattggcaaaagaagttgaggctgtattggcgcatgatgatttatctgtgctagatgcatttttagctgaaatgtatggttcaaaacccgatctttggacagatgatttgacaggcaatgaacgtttacgctgtattaccaattacttaactcgtatgcgtttaactaatgcagaaggggctttggagtttagttttaaagatactttagatgcaccaatgccagaaggttatttaccgtggtttgaatttccaagtaaggctgcacaaacccatcaaatattttttggacattgggctgctctagagggtagaactattagtgaacacatccaaaatgttgatggtggttgtgtatggggtaaaaacttaattgcttatcgtcttgaagatcaacaagctttttctgtgagcaatcctgttatgtag

SEQ ID NO: 1456 - DNA, 405 bp, Acinetobacter baumannii
aacttgatgagtaaacttttagagataaaaaatatggataagatcaaaagtatagactgggcagcatgggtaggaaccttactacttattatcggttttcgcgaaggctcagtcgtcgttatgcgtgcttttggtcatccagagttaggcaatctggtaggtttaattagtttacttatcgttttactcatttggcgtaaatttaagaaaatcccgttaagacttgtcgatactaataataaagtcatgaaagaaagtggttttgcttttttacctatttgtgcaggctccttaattatgctggtacatatgggtaaagaaattccgttatttctttttgttttggtagtgagcacccttatacccttgtgggtctatgcaaaaatggcaaaacattggttataa

SEQ ID NO: 1457 - DNA, 1029 bp, Acinetobacter baumannii
gataagtcgagaatcgtaatgtggaacccaaattcaatcatcttttgtttttatcttattttttcaatacttgctctctggggaattattgaagcctgggttcatcaatcacgtactgaaacgattcatccatttaaagcttttgttcacttacttgctttttatctatcttatcttcttgttccactttggttctttaatttatacgctggttggataggttattactcaattcatgaaaccatttttatctttttattaagcggtattctcatttacgcacgttttatagagccacatatggtacgtgtcgatgttcaccaatatcgtttaaatccagatcgccattttgctaaacctgtaaaagtcgctttaattgcagacttacatataggcctattctctgggcatgaacgtcaactcaaaatcattgtgaaaaagctcaatgaacaacagccagacttagtagttgtggcaggagattggacttatgagccagaagataagctagtacaggaactgagtgtacttaaagatattaaagctccagtttattcagttccagggaaccatgacgagcaatatccgggtccgcctattcaacagttattaaaagatgcacttcactacaatgatgtaatggatatcgaaggaaaaattgttgagtttgatgagtttcgtttaatcgggattggtgacttatgggcagggaaaaccgatatgcgttcaatgccagacttacctcaagataaaccatggttaattctttcccataaccctgatacggtagatatggtccctaaattacctaaccgccctttaatgttgtcaggtcatacacatggagggcaggtcgaacttccgtgggtaaccaactatattatgaaaaaagtatcaattttaggccataaacgtggtttctattcgcatgaacacgctgatgtatttgttaccgtaggaacaggtatggttggaataccattaagatttcgtgtaccgcctactattgatattattgaacttgtataa

SEQ ID NO: 1458 - DNA, 1641 bp, Acinetobacter baumannii
ttcaggctcggagtgaggaataaaaaaatgaccattcttcaatccgaaattactgttggtagtgaacagtatcaaaagaataaagaggcactgcttgctcaactgagtgaagtccgtgcaattcagcaaaaaagtattgataaatcgtatgctgctaaaccgaaattcgataaaaagggcaagattctgccgcatgagcgtgtacggttattgctcgatgccgattcgccttttgtcgagctttgtggcttggttggctacaacatgcatgatgacaaggatggctccgaagctggtggtggtgtaattgctggcattggttttgtcagtggtgtgcgttgtctggtctctgcaagtaatagcgcgattaaaggcgggaccatgtcacctatgggtgtacagaaaactttgcgtttgcaaaaaattgccttagaacaaaaactcccgctgattacgctgaccgaaagtggcggtgctaacttaaattatgcagctgaagtatttacctatggtggtatgacttttgccaatcaggcacgtttgtctgcagcaggtattccacaacttgcagtggtacatgggaatgcaacggcaggaggagcttatcaaccaggtctttcggattatgtcattgtagtacgcaaacaaacagagatgcttcttgcaggtccacctttacttctggctgccacgggtgaagtcgccacagcggaggaattgggtggggcggaaatgcatgcgcaggttgctggaacagcagaatacttagcagaaaatgatgccgatggaattcggcttgcacgtgaaatttttgaacacctcaactggaaagagcaaatcaaaccagttgatgtgacttataaagagcctcgttacgataccgaggaactgttgggtgttattccaagtgatcctaaacaaccatttgatatgaaagaagtggttgcccgcattattgacgattcagattttctagaatttaagcaggaatatgatgatttaacggtatgtggctgggcaaaaattggtggtttgcatatcggtattattaccaataatggcccgattacgcctcaaggagcagtgaaagcagcgcagtttattcacttatgtgaacagactaaccgcccgttattattcttacataacactactggctttatggtgggaaccgatgccgagcaaaatggcattattaagcatggctcaaaactgattcaagcggttgccaattgtactgtacctaaaatttcaatcgttgtggcagggtcatatggtgctggtaactacgcaatgtgtggtcggagtttatcgccagattttatttttgcttggccgaactcgcatgttgctgtaatgggggctgcacaggccggaaaggtactgcgtattgttgctgaagggaaacaaaaagcttccgggcaggaaccgaatccgcaaatgctcgattttcttgagcaaagtacggccatgaaattagagcagcaatctaccgcgcttttcaatacggccatgctacatgatgacggcattattgacccgcgtgatacccgaaaattacttattttccttttagaaactatttatgaagcacagcaacgcggactaaatccgacccgttttggtgtgtctcgtttttaa

SEQ ID NO: 1459 - DNA, 1365 bp, Acinetobacter baumannii
agttttaccttattcaggatttatagccacgtggaatatgttgatcggcatcaaggcggtgaacgcacaatattagtgagtgtgtctgtacaattattagatgatctggatgccgaagaatttgctctacttgcacagtcagctggtgcagatattcttgagcacattaaagttcaacgtaataaaccggaccctaagttttttattggttcaggtaaagttgatgagattgcagaacaagttcaggacttagaagcaagtcttgttatttttgatcatgcattaacccctgcccaagagcgtaatttagaaaagattttaaaatgccgcgttattgaccgcaccggtctcatcttagatatttttgcccagcgcgcgcggacccatgaaggtaaattacaagttgaacttgctcagttaaaacatttatcaacccgtttaatccgtggttggtctgctgattttgaacaacaaaaaggtggtattggtttacgaggtcccggtgaatcacaactcgaaacagaccgtcgtctcattcgtgtccgtattacccagttaaaagataagttagagaaagtccatcaaacccgtatgcaaggacgagctgcaagacaaaaagcgtcgatcccaactgtttcattagtcggttataccaacgcgggtaaatcaaccttatttaatattttagcaaaaagtgatgtatatgcagccgaccaactatttgcaacacttgatccaaccttacgtcgcctagaatgggatggaattggtacggtggttctagcagatactgtagggttcgtacgaaacttacaacatgatttggtcgaatcatttaaagcaactttagaagaaacgcttgaagctaccctgcttttacatgtcatcgatagtagtagtcatgacatgcttgaccagattgaagccgttgaaggtgtattgaaggaaattggagcggatgcacccgtacttcgtgtttataacaaaattgatttgagtggtgaagaggcgaaaattatttattcagagcctcatgttccagatcgtgtttatgtatctgcacactcagggttaggtctagatttacttcgccaagccgtacaagaatgtctaatgggacaacttcaacacttctcattggtacttaaacctgcttatggcaaattgcgtactcaactttatgctttaaatgtcattcaatctgagcattatgacgatgaagggctattacatattgatatacgaattgcacctcataagcttgagcagttaattcgccaagccaaactccctatagatgagatattaggtgaacgcgcgagtcattttaaaagaccactggaagagtttgaaatcaagcactag

SEQ ID NO: 1460 - DNA, 609 bp, Acinetobacter baumannii
attattttgatgggcgttctgtttaataactataaggtttattcaatgatgactaaaaaacaattaacttcaaaacaaatagatatgttgcttgaattattaaaaaatagatttgaaaagaatatacaccgacataaagaaattgattggacgaatgtgcgagctaaactcattgagtctccagacaaactatggacattgcaagaaatggagaatacagggggagagccagacgttattacttatgaccagcagaaagatgaatatttgtttatagattgctctgttgagtcaccgaaaggtcgtagaagcctttgctatgaccgagaagccttagagtctagaaaagatcatcctcctaaaaatagcgcaatagacttagtccaagaaataggggctgaactcctaacagaagagcaatatcaccaattacaacagctcggggagtttgatctaaaaacatcaagctggcttgctactccagaggaaattcgaaaattaggaggagctctttttgcggaccgtcgctatggtcgagtcttcatctatcacaatggagcccagtcatattatgtagctcgtggttttcgctgctgtttaagggtatag

SEQ ID NO: 1461 - DNA, 1959 bp, Acinetobacter baumannii
gagataaggataaaaataatgaaattttcaaaaatactggttgccaatcgtggtgaaattgcagttcgggtgatgcaaacagccaaggcaatgggttaccaaaccgttgcagtttattccgatgcagaccgtaatgctcgacatgtgcaagaggctgatgaagctgtttatattggtgcttcaaaagtatcggagtcttatctctccatcgctaaaattattgaagcttgcaaaaaaacgggggcggatgcagttcaccccggctatggttttttgtcagaaaatactgattttgctcaggcatgtatcgataatcagattacctttattgggcctaccgcttctgcaattgagttaatgggcagtaaacgcctttcaaaaatcgccatgattgaggcgggcgtcccttgtgtgccggggtatgaaggtgaccgacaagatctcgaatatttagcaactcaagctgagcagattggctttccaattatggtcaaagcttctgcgggtggtggcggtcgtggcatgcgtttggtacagcaagcatccgagttgtttgaggcattacaaaccgcacgttcagaagctgaaaatgcttttggttctggcgagctcattttagaaaaagcagtcattgctccacgccatgtcgaaattcaggtttttggtgatactcacggcaattatgtgtatttgtttgaacgtgattgttcaattcagcgccgtcatcaaaaagtagttgaagaagctccatgtccggtgatgacgcctgaactgcgtcagaaaatgggtgaggcagccgtagcagcggcaaaaacatgtgcttatgtcggggcaggtacagttgagtttttgctagatgcatcgggtgcattttactttttggagatgaatacccgtttgcaggtagaacatccggtcactgagcttattacagggttggatttagttgaatggcagttacgtgtggcgaatggtgagcagttacctttaaagcaacaggaattgaccttaaatggacatgcgatcgaagtacgtttgtatgcagaagacccacgtcaggactttttgccacaaacaggaaaaattttacgttggaagcctgcaaccttgccaaatgtgcgaattgatcatggcatgttagcaactgatgaagtcagtccattttacgatccgatggtagcaaaggtaattgcatacggtaaaacccgtgaggatgcgattcgcttactggctcgtgcagtcgatgatagtgttttacttggagtgaatagtaataaacagttcttggtcaatttactgcgccatccagttgttgttacaggggataccaatacagcatttatccaacagcatttccaaaatgatcccagcttacaccatcaggttttatctttagaaaccttagcgattgctgcggcactatttagccaaagtaaaggtactacagtgtggcaaactgggcttggtgtgccattaccgttaaaattacaaactgccgatcagcaaattcaattacagctttcatctgtaaataacacgtttacggtagagctctgtgagcaaactgtaagtattgaggttgttgaaaaaacagcggaacaattaatctatctgttggatggcgtgcgtcatcgtgtgcaatatgtattggatggcgatcagctttatctagatagagataatggtaatgttgcaattcgcaacgtaacttatgccgccccagagatagctgatgtggctggtgatggcaaaattcgtgctccgatggatggtgcggtagtaaatatcttggtcaataaaggtgatcaagtcataaaaggccaaactttattagtgcttgaagccatgaaaatccaacagcagattaaatcggatgtggatggtgtagtcgatgaaattttaggtcaacaaggtcaacaagtgaaaaaacggcagatgttatttagtatccaaatttaa

SEQ ID NO: 1462 - DNA, 354 bp, Acinetobacter baumannii
cttcaaccagtcaaagtcatggtgggtctgacaagacttgaacttgtgaccccacgcttatcaagcgtgtgctctaaccaactgagctacagaccctcagatacatctatgaagaacaacttgttgtggattcttaccaatcttcaatctttcgttaaggaggtgatccagccgcaggttcccctacggctaccttgttacgacttcaccccagtcatcggccacaccgtggtaaccgccctctttgcagttaggctagctacttctggtgcaacaaactcccatggtgtgacgggcggtgtgtacaaggcccgggaacgtattcaccgcggcattctgatccgcgattactag

SEQ ID NO: 1463 - DNA, 1242 bp, Acinetobacter baumannii
gaacgcggagtaaggattatgatatctaagttgtatcaatccacttcgctacatgcactttttagaaagtctcaatttacgatctttgctataactttctttatttgctcttttacatttgtatcaatttccgtttttacgatggaaacttatgcaaaacaaaatttgcaattacttagccatactcttcttgagcgtattcagcctgccgttgtgtttaacgataagatcacgatcgaacaaatcttaaatgaatacacaaatgatcactctattcgagcgattcatatttatgactctgaacatcacctgattgctcaaagttttaagttgtcgagtcaaacttcggtgttagagaaatggtttgatcactggtttttaaatgagccggtacatttaacgatttatcatcatcaacagaatgtaggtgaactcaccctttttggtagttctgaaaaaatattgcaatttttaaagatgattatggtcggtcttgctattgcgatgctatttattgtttgtgcattgtggtggtcagtgaatttgacttatcgtcaaattatgcaagcgatttatccactcacaaatattgctcaaatcgtgagtgaacaaaaagcttataaccttcgttttccttataaccgaattaaagagtttcaagatctaaatacagtttttaatgagttacttgaagaaattcagatttgggataatcagctgcaaaaggaaaatcgtaaattatcgtttcaagctcatcatgaccagctgaccctattaccaaatagacattatttttatcaaatactattagatatgtttgaagataaggattttgataataagtcagccttattgtttatagataacaataacttcaaatcaattaatgatcagttcgggcatttagctggtgatgaagttttaaaagagatggcgaaaaggttacaaacgcgtttacgtcatcaagattttattgcccgtttaggcggtgatgaatttgcggttattttgcattccattacgcatgccgatcatttaatatctattgctgaaaatttactcgaaagctgtaaagaacctttgcatctaaatgatcaaacgatttatttcagttttagtgtagggattgctttatcccaatttgcgtctagtccagaagattttattatgcaagcagatcaagcgatgtataaggctaagacttctgagcaacattggtttatttataaaccagagaattaa

SEQ ID NO: 1464 - DNA, 660 bp, Acinetobacter baumannii
agtatggcatttgatttagtccaatactttgctgagcaaataaaaattcaaaagcctcagcttttaaatcaatatccagccaatgagaaaaataagctgattgacgaagtgaatatattgacgcttggtaaattaatcagcttatggcgtcaggacgataataaaatttatcatgaaatcaaaactgccgatccattgtatattcaagaagttgcacgtcatctaactacgtcaaaacacaataagtcagttttaaaaaatgctgaacttgagcaaagtatttctgagattctggcattacagttaacagaacttaatcaacttgatgagactggtggtttcggccaaagtggtttaaaagagctcattttagggcaagttgaacatttatctggccaagctgaagattgggtttggtcaacaaaccatctaacagagctcattggttctaaacctgttgaacaagaagagctatcattggatgcaacaatgaaggagttcaaccaaatggttcaccaagcccaaccacatcatgaagatttacatgttgaagagcaacctatcgaaactttcattcctggatggtcaaaaattatcgctcctcttgttgctttagctattttaggctatctctattgtatgtatacacagcttgtataa

SEQ ID NO: 1465 - DNA, 828 bp, Acinetobacter baumannii
  unsure (36),(38),(48),(49): Identity of nucleotide sequences at the above locations are unknown.
aaacaacaatttgatgttcatattcaacaagccacngntcagaattcnntgaacctaacttttagatcacatgcttttgataaatggttagaccgtaatattaaatttgattgggttaaagcagaggttgtgaaagactcacctgataaaattagatcaaaagcgaaaaaagaagaacatttaaatttccaattgattaaccatttagaaaaaccagaaagcaatgttgacctgatttcagcttattttattccagaaaagcaaggtgctaaaattttaagtacgcttgctaaagaaggtgtagaagttcgagttttaacaaactcattcaaagcaaatgacgtagctgttgttcatgcgttttatggaaaatatcgtaaagaacttttgaaaaacggcgttcaactttatgagtttttaccaactccagataaacgcgatttaaataaaaatacggatgagttggcaaccaaagcgaaagtaaacatgaaaggtttaagccgctcaagtttacacaccaaacttatggcattagatgaacaggtttttatcggttcatttaactttgacccacgttcggcgtatttaaatactgaaattggcgtaattttagatagtccatcactggccaaaacaattcatcatacgatggatgaaaacttaaacaaatatgcttataaattaaagctcgacccaaacaatcatatttactggcaacaggaaactccaaaaggccctgtaatttataaaaaagaaccagaaatgaaatggtggcaaaaggcaggcatgaaactactatcatggctgccactcgaaggttttatgtaa

SEQ ID NO: 1466 - DNA, 732 bp, Acinetobacter baumannii
ctatatggttcatacagtaaagacaggtgcatgatgaaggctgttttatttgatttagacggcacgctcatcgatacggctgccgactttattcgtattattcaacaaatgtgccgtgatgcaagacgccctgttgtagaagccgatcttattcgtacacaagtgtctgaaggtgcccgtgcgatggtcaaattggtctacccagagctggatgtgaccaatccaattttcttggcacatcgacaaaattttttagatttgtatggcaataatattgttgtcgatactgacctatttgaagggatgtatccacttttagaagagttagaagctcagcgaattccgtggggtattgtcaccaataaaccacgtggtttaagtgaatctcttctagaaaagttaaacctgacagatcgctgtgcggttttggtatgtcctgaagatgtttctaaaaccaagccagacccagaaccaatgtatttggctgcaaagcagttaaatatcccggcaaatgaaatcatctatgtgggggatcacccacgtgatatcgatgctggtcgcaatgctgatatgtataccatcttggcagcttatggctatttgcctatcgaacatcgggatgatttaaacgcttggcaagccgattcgattgtaaatacggtgacagaattacacgagttgttacgtcaaaagcttcctgctctacaggaaaatcagcgtatgataagttaa

SEQ ID NO: 1467 - DNA, 537 bp, Acinetobacter baumannii
gaaaatatgcctaattcacaagctaaaaaaggcttattccagttttatcctcacaacctcatttggcttggactttctgtccttgccattgtgttggatcaatggacaaaatggattgcaagtacacatctgaactacgcagatcctgtacctgtgcttccatttttaaactggacactattacataactatggtgcagcttttagctttttatctgatgctggaggatggcaacgctatttcttcacatctttggcaggcttagtttcaatactttttgtattttggttgctacgtatgcctaaaaaaatggtggtgctacctgtagctatcgctttaattttaggtggagcacttggtaatctaattgaccgtattactttagggtatgtagtcgattttattcatgtttattaccaaaatcatcactttccagcttttaatattgcggacagtgccattactctaggtaccattttgctactcatcgatacattcttccttgagaagcaaagacctaaaaattcggatgcataa

SEQ ID NO: 1468 - DNA, 489 bp, Acinetobacter baumannii
atgatcttcacagtttctctgcattttgcgcgtacagtattcaacatgagagacatcagatgtaaacgaggatgcatcatgaaaaagttgttcaccatcttagccctttgcatcactgtactgaccaccagtatggcaagctttgctgatcctccttttgaccgaggacatggcccgaaaggtcctaaaggcggacctcgtggtgaatggaatgatcgtgggcataaatttgaccgtgacgataatggtgatcgtgttcgcgatgaacgccgtatgcgtgaggaacgtggctttgagcgtctgaaacaacatcgttggcagccaggttatgtgatgccacagcactatcgtggtaatggttataaagtcgactataaagacaataacttacctaaacccgatcgtaaccagcagtggtacaaaattaacaatgactatattttagtcgacacggactctaacagtattgtgagtattcgcggtttctaa

SEQ ID NO: 1469 - DNA, 435 bp, Acinetobacter baumannii
tttaaagggtttatggagtatataaaattgtcataccatcatcttaactttgaagatcgtactgcattaatgcttgagtcaagaaaagaaggcttttcagccagaaaatttgctgaacttattaaaagacatcctagtacgatctatcgtgagcttaaaagaaatagcatcaatgacgtttatcaagctcaatatgcttctgataacacttttgctagacgtagacgtggtcacagaaaactcaaaatcgattcaatcctctggaaatttattgttgaagcgatccgttgtttatggtctcctcagcaaatagcaaagcgtttaaagacatttcctgatttggatcaaacaatgaatgtaagccatacaacgatttattcaacgatacgagcattacccaagggtgagttgaaaaaagacttattatcctgtcta

SEQ ID NO: 1470 - DNA, 228 bp, Acinetobacter baumannii
tattggtcagcttcacatatcactatgcttccacatccaacctatcaacgtcctagtctcgaacggctctttagaggacataaagtcctagggaaatcttatcttgaggtaggcttcccgcttagatgctttcagcggttatcccttccgaacatagctacccggcgatgcgactggcgtcacaaccggtacaccagaggttcgtccactctggtcctctcgtactag

SEQ ID NO: 1471 - DNA, 735 bp, Acinetobacter baumannii
aagaaaaaggcgaaaatttcgagaaaagtctttttctttttacaggaagtaaactattcgttaggccaaactggtgtgggaatacctatgaatcttgatcgtcatacacagtttttgatgcgcaaagaaaaaattctaagcgttgcagaaaaattgttactagaaaacaatcaggaaattactctagatgaattagtggccgagctagatattgcaaaaggtacgctttataagcactttagaagtaaaaatgaacttctgcttgaattgattattcaaaatgaaaaacaaattttagaaatttctcaaaaatataatactgattttaaagagtatgcaccacggtacatgctccaccatttgctcacaccgggaaaaacgattttattgcatcaacttgaagaaaatctgacgatgacagagtctaagttgaagcatctttttgaagagctttatgaagttcgtcaacaacgtattctagcgattaaagacattacagaaagttatttaaaatcattaaattatgatatgtcgattcgtgactatttatcttatatctggtcactcacttacggtgcatcgttgcttttaaactcgacctattatcagcgctcgattggttctcgccaaaaattaattaatttatatattaaccaagcattatcactacctacccaaaccaccaattttgatgcgctaaattttcagatagaagacgagaattctcaaaattaa

SEQ ID NO: 1472 - DNA, 438 bp, Acinetobacter baumannii
atttcttcttatttcatagaaaattttcacatttattattcttcgccttcacgatttatctgtaatttttcactaatctttaattatcgaaatttaatagatcattcgaggtttacgatgaaaaagataacaacagcaattgttctttcaatgagtggtttaatcgcaacaacagcaatggctgcgcctcacgaccattatcaccaccaaggatatgagacaaaaaccgttaaagtcattcataaagatgaccatgcgaatatctggcgtgcaggccaagtcgtaccgcatcaataccagcatccacgttatgtcattgactaccgctcacaccagaaattgactaagccaggtcgttatcaaaaatggtataaagtgaacggaaattatgtactcgtaaatgagcaaagccataaaattattaaagtaattcgttaa

SEQ ID NO: 1473 - DNA, 2202 bp, Acinetobacter baumannii
cgccaagattttaagcttatgaaccaaaatactaataccgaagataccattgatttaaaggaattatttttttcactgattgcacagtggaaactaatcgcactctgcattattttaagtcttgtatgcgcactactttatttacgtgtaacaccagatacctactcggttgatgctttggttcaagttgaagacagcaaaggtgcttctgctgcacttttgggcgatttgtccgatatgatcgaacaaaagtcaccagcgcaagctgaaattgaaattttaaagtctcggttggttttaggctcggttattaaagaactacatctagatattcacgtttctagcaccgaaaacacacttactcaccgtttattaagtgatactgaatataaaactgaatacactaaaaattcagttttatttaaagatggcaccaaaaattttgatatacgaagatttgaagtacctgcatattatttagacaaacaacttgtattaagctttgatcaaaaatcttttaaattagtagatcctgagacggatgaagttgtactcacagctccaatcaatcaaaataaccaaattacaggagcttatggcgtatggaaggttgcgatctttactaaagatcaattagattcaaaatataatattaagaaactctctattccagcagctgtagataatataagttcaaattattcagtagccgaacgcggtaaattaacaggtattcttggtttaaattatcaaggatatgataaagaacatattactcaagtcttaaatgcgatcttggtaacatatggtgcccaaaatgttgaacgtcgttcagctgaatctgctcagactttaaaattcttggatgaacagcttccagatttgaaaaaacaattagacgatgctgaacgtcaattcaacaaattccgccagcaatacaacactgttgatgttactaaagagtcagaactatatttaacacaaagtatcactttagaaacgaagaaagctgagcttgaacaaaagcaggcagaaatggcggcaaaatatacggctgagcatcctgcaatgcgtgaaattaatggccaaattactgctattaataaacaaattggtgaactcaacagtactttgaagcaactaccagatgtacaacgccaatacttacagctttatcgtgaagttgaagtcaaaacccagctctacacagccctgctcaactcttaccaacagctccgtattgccaaagccggtgaaattgggaatgttcgtattgtagatactgctgttgagccagttgagccaattaaacctaaaaagttacaagtccttattttatctttatttttaggtggtttcataggaacattaattgccttattacgtaatatgttacgtacgggtattaaagattctggccaaattgaaaatgagttggatttaccagtctatgcaactgttcctcgctctccaattcaagaaagtcgtattaagattttaaagaagaagaagagtattcctattcttgcggttaaaaatagtgatgatattgcaattgaaagtttacgtagtatccgtacagctatccactttgcattagcaaatgcaaaaaataatatcattatgattgcaggcccttctccagaagtgggtaaatcgtttatttcaactaacttggcgactatttttgcacaaggcgataaacgagtactattgatcgatgccgatatgcgccgtggttatatgcataaatattttgatgtggatgtgaagccaggtttatcagaacttttaagtggacaagctgatttacaaaaagtattgcacaaaactcaggtaactaacctagatgtgattactcgtggtaagagtccaactaatccttcagagattttaagctcaaaccagtttaaagaattacttgagcagctacaaagccaatatgaccacatcattattgatactccaccagtacttgcagtaaccgatggtattattatttcgcaatataccggtgtgaacttaattgttgcgcgttatgctaagtctcagataaaagaacttgaattaacacttaaccgttttgaacaggcgggagttaaagtcaacggctttattctcaatgatattcaacgtgctagcgctggctatggttatggttataactatgcttatgcctataaggcacaaaaagaagactaa

SEQ ID NO: 1474 - DNA, 1173 bp, Acinetobacter baumannii
aaagaattacagaggattaaccctatgaatatggcattaaaagtttctatggcttctaaatctgctcatttaacccctgagcaaattgaagaatttggccaccgtgttgaacagattcgtcaagatgttatgcaaagtcttggtgagcaagatgcaaaatatatctacaaagtccgtaactttgttcgctataccgaaatcgcatcacgtggcatgttgatgtttggtggctggattcctcctgtctggttattgggtacaggtttactgggtatttctaaaattgtagaaaacatggaacttggtcataacgttatgcacggtcagtttgactggttaaatgaaccaagtctgaatggtaatacctatgattgggataccattgcctctggtgatgactggcgtgaaacacacaactatgtacatcacacctataccaatattgtcggtaaagatcatgatgtcggttatggcattttgcgagtaagcgatcaacagaagtgggaacctcgtcacctatttaatattcctctggctctacagttaatgtttttctttgaatggtatgtaggtgtacaaaatctacatcttgaagatgcattagtttataaaaccaaaagctggaaacaggtgtgggaagatgcggctaaggtccgtaaaaaagcaacacgccaagttttaaaggattatgtgtttttccctgtgatctctggtcctatgtttttaccggtttttgcaggcaatgtagttgctaatattattcgtaacttgtggtcatctgctgtgatttttaatggtcactttactgaagatgcagaaacgtttgagccggataataccgacactgaaactaaggcagagtggtatttacgtcagattcgtggttcaagtaattttagtggtacagaatggcttcattttatgagtggtaatttaagccatcaaatcgaacaccatttattcccagatatgcctgccaaccgctataaagaagtagcaccgaaaattaaggcactctgtgcagaatacggcattaactacaatgaagctaatttcatgcgtcagttctggagtgtatgggtgcgtttagcaaaatgctcattaccaaaccacaccactgcaaaagtgatgcagacattagaaaaattaaaagcaaaattcaaatttgcctaa

SEQ ID NO: 1475 - DNA, 870 bp, Acinetobacter baumannii
ggtcatcgacaaaatggaaaccgtatgagcatacctcagtctttgcttgaacagtcaattcaaatcaatattcaacaagcattacaagaagatattggggacggtgacattaccgccatgctcacacctgaagatgaacaggctactgcaactatcattagccgtgaagatatggttttagctggacagccttgggtgaatgcgctcatctcagcttatgacaacactgtacaggtgacttggttaaaacaagaaggtgaccgtgttgctgcaaatgaagcctttttaaagcttactggttctgcacgtagcttactgactgtagagcgccctgctttaaactttattcaaacattatcggctgttgcaacaaaaactgctgaatatgttcagcatcttgaaggtttaaatacaaaacttctcgatacacgtaaaactttaccgggcttacgtattgcacaaaaatacgccgtaaccgtcggcggcggacaaaatcaccgcctcggtttatttgatgcattcttaattaaagaaaatcatattatggcagcgggcggtattgcccaagcgattgcaaaagcacatcaaattgcgccgggtaaacctgttgaagtcgaagttgaaacttgggatgagctaaaccaagcgcttgaagcaggtgcggacattgtcatgctcgacaactttagccaacaacaaatgattgatgctgtaaaacacgtggcgggtcgctgtaaactcgaagcttcgggcaatatcactattgaaaacttacgcgaagtagcgactactggtgtcgactatatttctatgggcgtgttgactaaagatatcaaagccgttgatttatcaatgcgttttaatgcctaa

SEQ ID NO: 1476 - DNA, 222 bp, Acinetobacter baumannii
tacctccagcatgcttctcaacacaccttcatcggcttacagaacgctcccctaccacgtatacaaagtatacatccgcagcttcggcacatagttttagccccgttacatcttccgcgcaggccgactcgactagtgagctattacgctttctttaaagggtggctgcttctaagccaacctcctagctgtctatgccttcccacatcgtttcccacttaa

SEQ ID NO: 1477 - DNA, 624 bp, Acinetobacter baumannii
tttatgcagcaaatggaacaaaagaagagtacccaaaagcgcaatcagcttcttgctgccgcccttgatgtgttttcactatatgggttcagtggcgcaagtctggatgaaattgcccaactcgctgacatgcataagtcgaatattttctattactatgaaaataaagagtctttatatgtggaaatgctgaccacagttttacaaaaatggctagctcccttacaaaccttagaagctgagttagaaccagccgaagccttgtctcattatttaattcaaaaaatcgaactttctcgtagccaaccaaaagcttcgcgactatttgctttagaaattattcaaggggcaccgcatattttgcctatactgaaagggcccttgaaaaagctatttaagcgcaaagctaaggtcattcaaacttggcaagagcaaggaaaaatttcaccggatatcgacccggaacttttaattctcaatatttggggtcttacgcaaaactatgccgattttgcaactcaaatggaaatggtaaccgggaaaacgcttcgtaaccgcagtatgttccagcgttcgattgagcatacggtacatatgatgctctacggtgtattacctcgctaa

SEQ ID NO: 1478 - DNA, 1017 bp, Acinetobacter baumannii
ccatattttaagttcatgaaactgcttcgtcttaatgcgttatcgcccaatttccagttaccacaaacagcggtaactattggtaattttgatggtgtccatttaggtcaccaagcgatgattgctcaactcaaaaaaattgctgcagcacaaggcttaaaaacattggtcatgatttttgagccccaaccgcttgagttctttaaaggctacgatgccccacctcgtattaattcattacgggaaaaagttgaatatctagctgaacttggggtggattacattgcggttgccaagtttgaccagcatttccgtagcatgagtgcttctgagtttgcagatttattaaaagacaaattaaatgctcaagctttggttttaggagatgactttcatttcggcaaagaccgacaaggcaatagcgaatttttaaagaattacggctttcaagtcacaaatttacatacgattgaactcgaaggtgaacgcgtcagttcaactcgtattcgccaagtgcttcaagtgggtaatctcgctttagcagctaaattattaggccgtccgtacagtattaccggtcgtgttcaatatggcgaccaaattggacgaactttagatttcccaacgattaatgttcgtctcaaccgccataagccttgtttaaatggtatttatggcgttgaagtcatttgcgaaacaacttcgctaactcaaaaagtgcttcaggataatcctgaaaagccaggaattgccggataccatgaaaacagcctctatggtgcaggtcatgtcggtacacgtccagccattcagcaagaacatccagagtggagattagaagtacatttccctgatgtttctgctaatctgtatggcttatttatgcgggtgacttttcttcactatcttcatggtgaattgaactacccttcgcttgaagcacttaaggcaggaattgataatgacgtgcagcaattacgacaatatcgtaacgacacgacacaatttcctttttaa

SEQ ID NO: 1479 - DNA, 1224 bp, Acinetobacter baumannii
gcatttcttaaattaaatcatatgctatcactattaaataaagcaaaatggctcattggtggaaatttcgttttcgcattttctcaatgggtcatcttaatttttcttgctcgtatgacaactcaagagaacttaggccaatactccttagcgttagcaatagttactccagtttttgctatttttaatttacaattaagaccgctctatatcttagacttaaatggagaacaaaaatatagatattcaaatttctattacttgagattaataacttcaattgttgctttatttgtttgtttatttgtttgtttattctcaaatgtttcattttttgttgttgttttagtagcatttttaaaattttttgaagcatattcagatattatatatgcttattacaatgcacatgatcaaaccaaattaattagtaagtctttatttataaagggggtgttttctgtagggggaatgctaataggtctttatttttttaatttttatatagctttaattttatttttattaatttatttattcgtgtggcttggattagataattcttatattgtaagaactaatgaattaaaaaaaattagaatagattactcaattatgaatttagctatacctatgggcatttcattaggtattgttactttacaaagtaatattccccgcttatttttaggtcattatattggagttaaggctgtaggagtttttacagttcttagttactttattattgtcggtagtatatttatcaattctatttgtcagtatcttagtcctcgattaacaagagcttggaatagtaataaaaatgaatttagaaaaatattatttttagctataacgattgctggatctttaggagtaatagcaattattgtaagttacttctttggtgaatttttcttaaatttaatttatggagaaatttataaagaatatacatatgaatttaacctaataatggttgcaggttttattctttatgtttgtacagttttaggctatacattaacagctattggttttattaaaaaacaagcttttttgttttcaatagttttaatttttagtttattaatctcatatctatgtattcctgaatatggagtgctaggaggaatatacactttaataggtagttatagcatacaatgtatcctgtctatatttgttatattatttttatctaaagagaaattaaaatga

SEQ ID NO: 1480 - DNA, 1077 bp, Acinetobacter baumannii
agagaaattaaaatgaaagttatgttgtttattactggtttaggcatgggaggagccgagaaagttgtttgcgaattagctgataaattatatgagttgggacatgaagtctgtattgtatattttacgggtgaaattataagacgaccgaagaataatatcaatataatttatataccactaaaaattagttcacttatttttagtgtatattcagttatgaaactagttgatcaatggaaacctgatgtaatccattcacatatgtttcatgcaaatataattgcaagattggcaaaaataagaagaaaaaatattcgtataatttgtagttcgcattctaattatgaaggtggagcattacgtatgatgatgtatgctatgactgaaaaattatgtgatgtacatacaaatgtaagttctaatgctgctactgcattaatgcatgctggagcagtaagaaaaagaaaaattaaagctgtttataatggtattaatataaaagactatcattttgatgaagtagaaaacaagtacttacataaagcgtttaacttgaaaaatgaagctaaaactatacttgcaataggaaggatagatactcctaaagattatccaaatttattaaaagctttcaaaataatttatgagatagacaatagtgttcatctatttatagctggaaatgggccaaaaaaagaagaaatcatgctattggctaataatttaggtattaatagcaatgttaaatttttaggcatacggaatgatattcctaagctattaaattcatgtgatttatttatttcatcgtctgcatgggaaggatttggactagctatattagaggcgatgatttgtaaaaaacctattgtagcaactgaaactgatggtgccaaagaattattaaataatgaaaatttggttgaaattggaaatccagagcttttggctaaaaaagctctgcaaaaacttaatagtaatttaggtttaattgaatatagtgggattgagagctttgattggaatgaaatatctaaaacttggctatctttatatgaaggaaaagatttttaa

SEQ ID NO: 1481 - DNA, 384 bp, Acinetobacter baumannii
attccacctaaggagttaggattagaaaatgcaccattaaatggaatggaaaaaccaaatgaaaaatttattaaagtaataattaaaaaagtcaatttaacaggtttatcaaaaaaatcaaaacaagctttattcaaattaaaaatagaaaaattgattactaacaaaagaaataaaagaacacctataaataaatcaacagcattatttaatgctgccgatatcaacatcaacacaaaagaaaatataaataaaatacaaataataccacttttatctaagattaaattatttttatttccagttaatgcaaatacaaaaaaaatgaatatacatacaccaaacacccctaaagaaattacttttaaaaagtctatagagtaa

SEQ ID NO: 1482 - DNA, 750 bp, Acinetobacter baumannii
aataataacaatccaggagagtcgttatactctcctgtttttttggaaaatgacatgaaaaaaatcagtttggttattgcagcgtcaacaatgagtttatctgtttttgctgctgcaccgataacaaataaaagtccggcgaaagatcagtttagttatagttatggttatttaatgggccgtaataatactgatgcattaacagatttaaatcttgatattttttaccaaggtttacaagaaggtgctcaaaataagacagcacgcctaactgatgaagaaatggcgaaagcaattaatgattataaaaaaacattagaagctaaacagctagtcgaatttcaaaaacaaggtcaacaaaacgctcaggctggtgcagcttttctggcagaaaatgctaaaaaatctggtgtggttacgactaaatcaggtctgcaatatcaggtattaaaagaaggctctggtaaaacacctaaagccacctctcgtgtaaaagtaaactatgaaggacgtttactcgacggaactgtatttgatagctcaattgcacgtaatcaccctgttgatttccagttaaatcaagtgatcgccggatggaccgaaggcctacaaactatgaaagaaggcggtaaaacccggttcttcattccagcaaaacttgcttatggtgaagttggcgctggggatagtatcggtccaaatagtactttaatttttgatattgagttgctacaagttttgccaaaataa

SEQ ID NO: 1483 - DNA, 1047 bp, Acinetobacter baumannii
ccagaaacaaaagaggaacgtatgaacgcaacacttaactatcaaccacattgggtacgagaagatttcgttgattttgttttgcagaaaattaacgcgacttgggcttggaaaagggtacttgcagaagttaccgctgttcagccacttcataccgatatggtactgataaaacttaaaccaaatcgaaattttaatttcgaacaggtttgtgcgggacaaagcattctactgacgttgcttatcgatggcgtttaccaacaacgtagctattcgattattgaagtaaccactcaaggtgaaatcgctttaggtattaaaatacaaggcttagtgtctcgtgcagctcaactattacatgtgggcgagtgtgttgaaatttcacagccacaaggtgatttcactttgcatcaaggccagcagcctgcgattttgattgcttcaggaagtggtattactgcaatttattcactcttgcagcaagctttgaaacagcagcttgaacaaattcatgtcatttattttaatcgtgcagaaatttttcatgccgaattaaaagctttggcagaacagcacccacagcttcaatatcatttttttaataccactgagcaaaagcagcatttaactgaaagcttactgcaaaagctggttccagattttgcgcagactgcgacctatatatgtggacaccacggcatgatgcagcaggcgaatgaaatttatgcgcaaaaaggtgctcagtctcagcttcaccaagaatatttccaaccactccaagtgactggtacacatgcagcacagcctgttattttccgccgtgctcaacacgaatttttagctgaaacaaatttactgagcagtgcagagcaggcgggactacgcccgcaacatggctgccgtatgggtgtttgtaataaatgcagttgtaccaaagtgagcggagttactcaaaacctgttaacaggtgaaattgaagaccaaccgaaccgtccaattaaactatgcgtgagccaggcattaagcccagtcacaattgatctataa

SEQ ID NO: 1484 - DNA, 804 bp, Acinetobacter baumannii
aatatgacaaatctgaatttaaatattaatcagaatgacgtagagctcattccagaaaaccatccagagtcacaagaacctgtggtaggcgcagagattctgattgaacagctttataagttttatggtgaagttaaagttcttgaagatcttaaccttcatattcaaccgggcgaatttttagctattgttggacgtagtggttgcggtaaaagtactttattgcgtttaattgcccaacttgaaaaagccagttttggagaaataaaatttaaatctgcccgacatttgcgtgaaggtattactaacgatgacatacgggttatgtttcaagacccacggttactgccttggagaaatattcttcagaacgttcaacttgggctaccaaaatcgcaacatgctttggcagaagaattattagagaaagtaggtttaaaagaaaaagcgggacaatggccttcacagctctcaggtggtcaacgacaacgtactgccctagcccgtgcgttatctcatactccccgtattttattgttagatgaacctttgggtgcattagacgcgttaactcgtcttgagatgcaaagcttgattgaacgtttatggaaagagcaaggttttactgccattttagtcacacacgatgtaagtgaagcagtgcaactggctgaccgcattatattgttagataaaggtcagattgctcaaagttttcaagttaatttgccgcgtccacggaaaaagagcattacttttgctcagcttgaacaacaagtactcgatgccgttttagccacttaa

SEQ ID NO: 1485 - DNA, 2859 bp, Acinetobacter baumannii
ttaaactggaagacaacttgcatgagcgataagcaaactactgaaaatgcagtggactacaaagccacgctaaacctgccggatactcaatttgcaatgaaagcaaatttggcagtacgtgaagtgaaatggttagaagagtggtataccgacaacatttatcagcagattcgtgcaacgcgtattggtaagaaaaaatatattttgcatgatggccctccatatgcgaacggtacaattcacttgggccatgcggttaacaaagtacttaaggacatcatcgtaaaaagccgtactttggcaggtttcgatgcgccatatgtaccaggttgggactgtcacggtttgccaatcgaactaaaagttgaagaaaaagtaggcaaagtgggcgaaaaagttgacgcagccactttccgtaaacactgccgtgaatatgcgctaaagcaaattgatttacagcgtactgactttaaacgtcttggtattttaggtgactgggataatccttacctcaccatgaactacaaacaagaagccgatatcgttcgtgctttaggtttaatccaaaaaaatggccatatccagccgggcttaaagccagtgaactggtgtatggactgtggctcagcacttgctgaagctgaagttgaatacgaagataaaaaatcagacgcaattgacgttggttttggcgttgtagatttaaaagatttaagcgctcgtgtaaatgtagacgttcaagatccaacggatatcgtgatctggaccactacaccttggacattacccgcgaaccaagcagttgcattgcatgccgaaattgaatatcaattggtacaagtgactactgaacgtggtaagcaaaactttattcttgctaaagacttagttgcttctgcaattgagcgttacaagcttgaaaacccaattgttttagctgactttactggttcagctcttgagaaccttaccctacaacatcctctacttactgatcgtcaagttccggttattttaggtgagcacgttatcgcaacaagcggtacaggtgcggtacacactgctcctggccacggtgcagatgactataaagtaggtcttcaatacaaccttaaagttgaaaacccagtgggtggtaacggtgtttacttaccaaccgcaccaatatttgctggcgagcacatttataaagccaatccaaagattattgaagctttaggtgctgtaggtcgcttatgggctcatcaaccgattaaacacagctacccacactgctggcgtcataagactccgattattttccgtgctacaccacaatggtttatcagcatggatcaaaaaggtttacgtgacggtgcgcttaatgccattgaaaacgatatcgagtttgtaccgaactggggtaaaaaccgtattgaatcaatgatcgaaggccgtccggactggtgtatctcacgtcaacgtacttggggtgtaccaattcctttcttcgttcataaagatacgaacgaattgcaccctcgtacgcctgagctcatcgaagaagttgccaaacttatcgagaaagaaggtattgatgcatggtttaaccgtgatgcgaaagacttcattggtgaagacgctgaacagtacaatgctgttcgcgatacgcttgatgtatggtttgactctggtacaacgcattacgctgtacttgagcaacgcgacgaattagaaagtcctgctgacttatatttagaaggttcagaccaacaccgtggttggttccaatcttctttattaacgtctatggcaattcacaatcgtgcgccatataaagccttgttaactcatggttttacagttgatgaaaatggccgtaaattatcaaaatctttaggcaactatattccgcttgaagaaatcatcaaacaacttggtgccgatggtttacgtttatatgtagcatctagcgactatcgctatgaaattgcagcatcgaaagaaatctttagccgtgtaagtgatagctaccgtcgtattcgtaatacgctacgcttcttacttgcaaacttaaatggtttcaaaccaagtactgatgctctggcagtagatgatcttattgctcttgatcaatacatcttgcaacgtgctaatgaagtacaacagaccattatcgcggcctatgaagaaatgaacttccacgtcgtgtgtagtgcgttaacaagcttctgtattaatgacttaggtggtttctatctagacatcatcaaagaccgtcaatacaccactaaggctgactcacaagcacgtcgttccgcacaaacagcgctttaccatatcgtacaagcatttgttcgctggatgagcccgattctaagcttcacagctcaagaagcgtggccacttattcctgaacaaactgagaagtatgtatttacagctgaatggtatgacttacctgtttcatcaaaagcaaacttgctttctgaagcagattggcaaacattgattagcgtaaaatctgcagtaaataaacagattgaagcagctcgtaacgctaaacttgtcggtagtaatctttcagccaaagttgaactttgggcaaatgaatcattacaaacagttttaaaccaactggctgatgaactccgttttgttcttattacttcgcaagtagtagtacatccatttgctgaacaaggtgaagcaactgaaatggaaggcttacgtgtacaagtatctgcagctgaaggtgaaaaatgtgcacgttgctggcatgtccttcctgatgtaaatacacatgccgatcatcctggtttatgtggtcgttgtattgtgaacgtcactggtcgtggcgaagtgagaaaatatgcctaa

SEQ ID NO: 1486 - DNA, 567 bp, Acinetobacter baumannii
atgaacacagataccgctttaattatggcacttcccaacgagtctaaaggtttattcgagcaagcaggtatcgaagtccattacagtggtattggtaagatcaacgctgcttttaaagcgtttgaagttattcaaaaaacaggctgtaaaactttaattaacttaggtacagcaggaagttcatcttttaatcggcacgatttagtagaaataaaaacttttgtacaacgtgatatggacgtttcacctttaggatttgaagttggggtaacgccgttagatgaccacttggcggctgaaattcatctccaaacgcattttgcggatttaccaaaaggaatttgtgggacaggggactcatttgaaacgggtcagccgaaggtcgcttgtgatgtggtcgatatggaaggctatgcgttagcaaaagtttgccacaagttaggtgtacgtttaatttcggtgaaatatattactgatggagcagatgatacggctcatttggattgggaagaaaacttattattgggtgcacaaaagcttttagcactttatcaaaatcatttctaa

SEQ ID NO: 1487 - DNA, 741 bp, Acinetobacter baumannii
ttatttttggaaccctttatgagtaaagccttacccattgctgtcgctgtagttttaggcggtgctgcacttgtacctgtatattatgcaactcaacatccgaccacagaagtcggacgtaaagcagacaaaaatgcttctccaattcaaaaaatcagttatgttcttgggtatgaagttgctcaacaaacccctcctgagctggataccaaagcatttgttcaagggatccatgatgcgcgtaataagcagcctagtgcttatactcaagaagatttaaaagctgccgttgctgcttatgaaaaagagttacaacaaaaaatgcagcatcaagacaaacctgagcaagcgggtacagctactgactctgcagatgcacagttccttgcagaaaacaaaacgaaagctggcgtaaaaactactgcatcaggtttgcaatatatcattactaaagaaggtactggtaaacagccaactgctcagtctgttgtcaaagtacattatgaaggtcgcttaattaatggacagattttcgatagttcttataagcgtggtcaaccagtagaattcccgcttaaccaggtcattccgggttggactgaaggtcttcaactcatgaaagaaggtggaaaagcgactttcttcataccatcaaatcttgcatatggcccacaagagcttcctggaattccagcaaacagtacactgatttttgatgtagaactcatttcagtgaaataa

SEQ ID NO: 1488 - DNA, 1002 bp, Acinetobacter baumannii
gggaacaaggatatcaatatgcaacatcagtcattatttaataagagtcagtggactcagttagttaagcgctttagcgcggtcgctgtattaggtttaacaatcgcagcacctgcttgggcaattgacccaacagtgaaagaacttcgtattggttttcaaaaaagttcgattaacttcgcgattgccaaacagcaaaaactatttgaacaagaatttccaaatgccaaaatcacttggaatgagttccccgctggccctcaaattttagaagccttagctgttggctcactcgatgttggcgttactggagacacgcccccggtctacgctcaagccgctggcaagcctttatattacattgcttatgaagcagccaaaccattggcctcagcaattttagttcccaaaaactcacaactaaaacagcttaaggacctaaaaggtaaacgtattgcgctacagaaaggttctagctcacattacctacttgtacaggccgtacgtaaagcaggcttaaaatggagcgacattaccccaatttggctcacacctgccgatgctcgcgctgcattccaaaagggtgctgttgatgcatgggcaatatgggatccgtactacgcttcagcacaactagaagaccaagctcgtgttcttgcatctggtaaaggcctaagcccgaactataccttttacttagccgctccaaattttgttaagcaatatccaaaagctgttccaggactcatcaagcagatcaatcaagctgacaaatgggtccaaagccatcaagcagaaactgcaagtgcgattggccaaagtacaggcctaaaaactgcgaccagtgacttatttattaaacgccgtccacgtccgtcatcggcagctccacttaacagtaaagtcattgccgagcaacagcagcttgcagacatctttactcaacaaggcatcatccctaaaccaatcagcattaaacaagctgtttggggtgccaagtaa

SEQ ID NO: 1489 - DNA, 450 bp, Acinetobacter baumannii
atcgattgggacaataattttatgcagttcaaaaatattttagtcgtctgtattggaaatatctgccgtagccctatggcagagtattttttaaaacagcaataccctcagttaaatattgagtctgccggtatttcagggcttattggtcatcaagcagatgaaaaagctcgactttgtatgcaacgattaggcattgatatgcaaccacatgtagctcgtaagctaaatgctgaacatattaaaaaagctgaccttattttagtcatgagtcaaaaccagcaaaaacatattgaacagacttggccctttgcaaaaggtaaaacctaccgcttgggccattggcagaatcgaaatgtgcccgatccatatcgacatgatcaagctgtttttgatgaaacctgtcaacttattcaacagtgcattgctgactggaaaccttatatttaa

SEQ ID NO: 1490 - DNA, 189 bp, Acinetobacter baumannii
tattgtccactgcatagtaacaagtgtctattaaacgcaggatgtcccgattctagccgaaaaaaaattaaaaaacacagaaaaatcgtagagctttgtatgtttaatttatatcaatgctttttatcctacataagtagtaattttttgcacaactcgagaaataaaaaaacaggttatataaggtga

SEQ ID NO: 1491 - DNA, 552 bp, Acinetobacter baumannii
gtaccattttgctactcatcgatacattcttccttgagaagcaaagacctaaaaattcggatgcataatatgaccgaaattattcaacctaatgaagaaattcgtattactgacggttctaaagttgacctacacttttctgttgctattgaaaatggcgtagaaattgacaacacacgtagccgtgaagaacctgttagcttaactattggcgacggtaacttgttaccaggctttgagaaagcattacttggcttacgtgcaggcgatcgacgtacagtacatctaccaccagaagatgcttttggtccgtggaatcctgaaaatatacaaacttttgatacggttaaattcgaacaacgacctattcctggtcatatgatcgagtttgaagataaagcaaaagcaactttatttggtgttgtgaagtcagtaaatgatgatattactgaaattgatttcaaccatcctctagccggcaaaaatattacttttgaagtagagatatttaaagtgactccagctggtcagcaaggcattaagatcatgtaa

SEQ ID NO: 1492 - DNA, 414 bp, Acinetobacter baumannii
tgcaactattgctgcagcacagaaaaaattgcacaaatggactcagtgggtcagcaacgcatggcggctctacacggcggtaatcgagacaaacttgaagtatccccaaatctttgggcaggtatcggtctagtccgcggtggtgcaggtacagcacttgtcggcgatcctgaaaccgttgctgcacgtattcaggaatatgcggatttaggtatcgatacctttattttctcaggctatccacaccttgaagagtcaatccgttttgcggagttagtattcccattattaccaatcgagacccgagctaaacttgctcagccaaatttaaccggtccattcggtgaaatcattgccaacaactatgttccagacgagaagaaacaaaatagttccgtcaaggagcctgcatga

SEQ ID NO: 1493 - DNA, 246 bp, Acinetobacter baumannii
agacttagttggcataccgatctcgaatcaacagcaaaaagatataaagaggattctaaacaaaaaagctcaaagtcgcatgttttagataaaaaaacacccaaattagctttgggtgttagatgttttatgaacttaacgaattactttaataattttatggctttgctcatttacgagtacataatttccgttcactttataccatttttgataacgacctggcttagtcaatttctggtgtga

SEQ ID NO: 1494 - DNA, 192 bp, Acinetobacter baumannii
gcgcaccttcgtactcctccgttactctttaggaggagaccgccccagtcaaactacccaccagacacggtcctcgtcccggatcacgggacagagttagaacctcaacattaccagggtggtatttcaaggacggctccactggaactagcgttccagcttcaaagcctcccacctatcctacacaagtaa

SEQ ID NO: 1495 - DNA, 192 bp, Acinetobacter baumannii
gcctttatttttattattcatctatacgacagcatcttcccccatagtattttatataaacatcctattccctttatttactatcgtgatgtggatatctcgtttctctattcggcctacgcggcagagtcttaccgcttagaatttttttgccaacagctcattctgttactttggttttgcccaaagtaa

SEQ ID NO: 1496 - DNA, 735 bp, Acinetobacter baumannii
cccaagtttagaggtgacaccatgtcgcaattgaatgttgatttacaagaaatcgcaaaatttgaagcacttgctgccaaatggtgggatcaacattctgaatttcgcccacttcatcaaatcaatcctttacgcttgaactggattgatgaacgtgcaggtggccttgccggtaaaaaagtacttgatgtcggctgtggcggcgggattttggctgaaagcatggcacgtcgtggagcagatgtactgggcattgatatgggtgaagcgcctttagctgtaggccgtttgcatgctcaacaagaaaatgttcaaaatattgaatatcgtcaaattccagttgaagaattggcgcaagaacaagcaggccaatatgatgtggtcacttgcatggaaatgatggaacacgttccagacccggcatccattgtaaaagcatgtcagactttggttaaacccggtggccatgtgttcttctcgaccatcaaccgtaacccgaaatcttatttattcgccattattggtgctgaatatgtgctgcgcatgctgccaaaaggtacgcatgattatcacaagtttattcgcccatctgaaatggcacatgatattcgtaatgcaggcttaacgttaaaagaaatgacgggcttacactacaacccaattacgaagcgttattggttagcgccaaatgttgatgttaactatatggttcatacagtaaagacaggtgcatga

SEQ ID NO: 1497 - DNA, 201 bp, Acinetobacter baumannii
ctgaagcttagagacttttcctggaagcatggcatcaaccacttcgctgtacaagtacagcttgctatcagatctcagcatagagtaccccggatttgcctaagatacatgcctacatcctttcacctggacaaccaacgccaggctgatttagccttctccgtcctctcatcgcattacacagaagtaatggaatattaa

SEQ ID NO: 1498 - DNA, 1293 bp, Acinetobacter baumannii
ggaataaggctaacttttatgcaacttgccgatttaagaatagcgattataggtttaggttatgtaggcttgccattggccgttgagtttgggaaaaaagtacctgtagtcggttttgatatctatcaaaaacgtataagtgaattaaaaagtggtcaagatcacactttagaagtttcaccagaagaattaaaacaagcagctcaattaagctatactacaaatttagaagatctaaaagattgtaatttttttattgtcactgttccaactccaattgataactataagcagccagatttaacacctttggttaaagcttctactagtattggtaaaattctaaaaaaaggtgatattgtcgtatatgagtcgactgtttatccaggtgctacagaagaagtttgtattccggtgctcgaagaaatttcaggcttgacgtttaataaggatttctttgcaggttatagcccagaacgtattaatcctggtgataaacttcatcgtgttactaatattttgaaaattacctcaggttcgactcctgaagtggctgattatgttgatgaagtatacaatctgattattgaagcaggaacacataaagcagctagcataaaggttgctgaagcggcaaaggtcattgaaaatacccagcgtgatgtcaatatcgctttaattaatgaattagcacttatttttaataaattgggtattgatacagaagaggtgcttaaagcagccggtacaaaatggaatttcttaccatttcgtccaggtttagttggcgggcactgtattggtgtagacccgtattatttaactcataaagcccaagctattggatatcatccagaaattattctagcagggcgtcgattaaatgattcaatgggagcatatgttgttactcaacttgtaaaaggaatgataaaaaagaaaattcaagttgaaggagctaaggttttagtattgggtttgagctttaaagaaaattgccctgatattcgtaatacaaaagttatcgatattgtaaaagaactacaagaatatcatatggatgtagatgtatatgatccttggattgatagtgaagaaactcaacacgaatatggtattacaccagttaagcaacctacagcaggtcaatatgatgctgtaatattagcagttgctcataacgaatttaaagaaatgggtatagaggcaattcgctctttaggtaaaacatcgcatgtactttatgatctgaaatatgttttagctcaatctgagtcagatatccgtctataa

SEQ ID NO: 1499 - DNA, 1041 bp, Acinetobacter baumannii
tatttgttgagaataaatatgaatcgctatgaagaagtattggagcagcttaagagcaatcctaaaacatggttaataacgggtgttgcgggttttatcggatcaaatctgttagaaactctattaaaattaaatcaaaaagtaattggcttagacaactttgctacaggtcatcaatataatctggatgaagtagagactttagtgagcagtgaccaatggaagaattttactttctataatagtgacattcgtaacttagaggattgtcagaaggcatgcgctaacgttgactatgttttacatcaagccgctctaggttctgttccgcgttcaattgctgatccaatattgacaaatagtgccaatattacgggttttttaaatatgctcgttgcagcaagagacgctcaagtcaaaagttttacttatgctgcgagtagctctacatatggtgatcatccggcattaccaaaagtagaagaaaatattggtaatccattatctccttatgcggtaaccaaatatgtaaatgaactttacgctgaagtttttgctcgtgcatatggttttaaatcaataggtttgcgctattttaatgtgtttggtaaacgtcaagatcctaatggagcttatgcggcagttattccaaaatggacagcagctatgattcaaggagacgatgtatttattaatggcgatggcgagaccagtcgtgatttttgttatatcgaaaatacagtacaagccaatattttagcagctgtagcaaatgatgaagctaaaaatcaagtctataatgtggcggtaggagatagaactaccctaaatgatttatttaaggctattaaatctgctttgaaagaaaatggaatttcttatgacaaagaacctggttatcgtgaatttagagctggtgatgtaaggcattctcaagcagatgtaactaaaatcaaaacattactaggatatgatccaaaatttagaatttttgaaggtatctcacaatcaatggtctggtataagcatttcttaaattaa

SEQ ID NO: 1500 - DNA, 1368 bp, Acinetobacter baumannii
ttcgagatcggtatgccaactaagtctttagagaaatcacataataatacccagcattatgtacattggttccgacattcagcaccctacatcaatgcgcatcgtgacaaaacttttgttttaatgtttggcggtgaagcagtccgcgatcctaatttcgaacatattattcacgatattgccttattacattctcttggcatccgcttaatcttagtgcatggcgcacgtccacaaattaatcacaaccttaaagaaaaagggattgaaacccctttttatgataactgccgtattactacacgcgaatctttaagctgtgtcatgagtgctgtagggtctattcgattagaaatcgaagcattgttatctatgggtttagctaactctccaatgtatggtgctcgaatagatgtcgtatcaggtaattttgtaaccgctaaaccttatggtattcgtgaaggaatggattttcagcttacaggcgaagttcgttcaatagatacagacgcgattgaacgtcatcttgataacaataatattgttttacttggcccaacgggctattcaaccacaggtgaagtatttaatttaagagctgaagaagttgcaaccaaaactgcgacttatttaaaggcagataaattaatctttttaggtgagcaacaaggtttacctaacgaagatgggcaattactgcgtgaattaagcccacaccagcttgattattatattcaacaataccaaaccacacacccaaccctaaccctacatttgcaagaagcaaaaaaagcatctttatcgggtgtacatcgtgtccatctaatttcttattcttatgatggtgcacttattgaagaactctttacgcgtgatggtgtggggaccatgattaccgatgcgcattatgaagaagttcgtatggcacatattcaagatgtcggcgggttaatgaaccttttacgcccattagaagaagaaggcattttggtgtatcgctcacgtgagcgtttagaacaagaaattaaccagttcgctgtcattgaacgagacggtatgattttggcctgcgctgccctttatccaattccgactgagtttaatgaaacacgttcagcagaaattgcttgtgtggcagtacacccaagttatcgtaaatcgaaccgtggcagccaaattctgcaatttctagaagaaaaggccaaacaacaaggcattcgtcaattgttcgttttaaccacccgtaccgcgcactggttcttagagcacggtttccatcaggtgagtgtggatgacttaccaaatgcccgtcaggcactttataactatcaaagaaattctttagtctttaaaaaattgcttccctag

SEQ ID NO: 1501 - DNA, 258 bp, Acinetobacter baumannii
atactcagcgggaaactcgccagagcagcggtcccaaacattgtttttgtagaatttaaaagaaattcgcgacgattcattagttctatcctgagttcttattatggtgcacagtgcattttgcaattactggtaggcggtgttgttggcgatgaattatctgagtcattatcatcgttacaagcactgagcatgagtgctaaagatgtaattaataaaattgaaagttttcgcattggtttttcccaaacggtttaa

SEQ ID NO: 1502 - DNA, 735 bp, Acinetobacter baumannii
gagaatttaggaaggattatgcgtattgaccaacgtgcattagaccaattacgtgaagtgaaaattacacgaaactacacccgttatgctgaaggttctgtgctggtcgaatttggtcacaccaaagtcctttgtactgcaagcattgataactcagtgccacgctttttaaaaggccaaggtcaaggctgggtaacagcagaatatggcatgttaccgcgctcaacacactcacgttgtgatcgtgaagctgctcgtggcaaacaaactggtcgtactcaagagatccaacgtctcattggccgtagcctacgtgcgatggttgatttgaaaaagcttggtgaaaacacgattacgatcgactgcgatgtaattcaggctgatggtggtacacgtactgcttcaatcactggtgctgctgtagcattggttgatgcgatgaatgttttacttgcacagaaaaaaattaagcaagatccgcttaaaggcttagttgctgcaatttctgtaggcatgtatcaagatgaagtattacttgatctttgttatgaagaagactcgaactgtcaaactgacttaaatgtcgtgatgacacaagcaggcgagtttattgaaattcaaggtacagctgaagataaaccatttacccgtgctcaaagcaatgccatgttagaaatggccgaaaaaggaattgccgagctcattaaaaagcaacaagaagctttaggctggtaa

SEQ ID NO: 1503 - DNA, 816 bp, Acinetobacter baumannii
ttccgtcaaggagcctgcatgagcaaagatataaatattgtttcacgtggaacgaagcaagtcgggcagcgtctgctgccttggattttcccgattgttctattggttgtctggcaaattgcatcgagttcaggccttttagaaaatcgtattctgccggctcctacggctgtcgtttctgctttttggcatctactcattagcggcgagctttggcagcacgttaaagtcagtgcaggacgggccttactcggactatttattggtggtggtttaggtttgctattaggtctgctcaatgggtcttcgcgtttcgcctctaccctgctcgatacaaccttgcaaatgattcgtaacatcccagcattagcacttattccactggttatcttgtggttcggtattgatgaaacagccaaattatttttggtggcggtcggagtcttcttccctatttatatcaacacctatcacggtatccgttcagtcgatccacaattaattgagatgggtaaaagctatggtctttcacgttggcagctttacaaagaaattattctaccgggtgcgatgccctctattttagttggtttacgttttgctttaggtctggtttgggtgttgctcattgtagctgagactatttcagcacaagcaggtattggctatatgactatgaatgcacgagagtttttgcaaactgatgtggttctggtcggtattcttctttatgccctattaggcaaattagccgatgttctagcgcaacttttggaacgttatttactacgctggcatgccggttatcaaaaataa

SEQ ID NO: 1504 - DNA, 1119 bp, Acinetobacter baumannii
atacacaaagggttgcgtgtgaagtattgccagtttttttctgttcttgccttaagtttaagtgctgcgagttgtgcagttacctccggtttacaaacttatgacatcccaagtgaaggcgtttataaaaccgaccttggaactacggttaatgtcgttaaaatttcacaagacactctacctgcaatacaacctgcacaggttgattatcaacgtgactatgcaactctatttaaaaaccaacagccaatatatcgtttaagccctggagatgttctttcgattcaactttgggcctaccctgaaattacaccacctgtaaataacgttaataatgaacaatctgtacaagcaagtggttatccaatcgatcaaactggttatatccagtttcctctagtgggacgctataaagcagctggcaaaactcttgctcaagtgaaccgagaattacacagtcaacttgctagattcttaaaaaatccagatgtaatcgtacgtgtactatcttatgagggacagcgcttttccgttcaaggcagcgtcataaaaggtggacaattctacttaagtgatcaaccagtgagtgtatatgcagctttaggtcttgcgggaggagtaacggataaaggtgacaatacctacattcaactcattcgtaatggcattacttataacttaaatacaattgagttagaaaaagcaggttattcattacataaacttttagtacaaccaaatgacacaatttatgtcagcacacgagaaaaccagaaaatttatgtaatgggtgagtctggtaaaaaccaagcattaccaatgcgtgatcagggtatgacgttaagcgatgctctaggtgaaagtttaggtctaaatcctttatctgctagtgctagccgtatttatgttttacgtactaacccaaatgaccatacaactgagctttaccatttaaatttaatgagtattggtgatttcggattagccaatcagtttaaattacgtagtaatgatattgtctatgtcgatgcaactggcttgactcgctggcaacgtgttgttaatcaaattattccattctcaagcgctttatataacatagatcgattgggacaataa

SEQ ID NO: 1505 - DNA, 642 bp, Acinetobacter baumannii
caacttagaggaaaagctgtaacaatgaaaaaattggttttgggtggtttgagtgcagcaattatggccgtatcgggtagtgcaatggcagcagattttgttgctggtaaagactacaccgtaatcgccaatccaggcaaagtggaagtaccggggaaaatcgaagttcgtgagttcttttggtatggctgtccgcactgttttaaacttgaaccacatatgcaaacgtggttaaaacaaattccgagtgatgtacgttttgtgcgtacgccagcagccatgaacaaagtatgggaacaaggggcacgtacttactatacatctgaggcattaggtgtacgtaagcgcacgcatttaccattattccatgcaattcaggtaaatggtcagcagatttttgaccaagcttctgcggctaaattctttactcgttacggtgtgcctgaacaaaaatttaatagcacttacaactcatttgctgtaactgcaaaagttgccgagtcaaataaacttgctcaacaataccaattaacaggcgtaccagcagtagtcgttaatggtaaatatgttgtacagggtgaagatggtaaagttacccaagtccttaattacttaattgaaaaagaacgtaaggcaaaataa

SEQ ID NO: 1506 - DNA, 765 bp, Acinetobacter baumannii
aaagaaggaggtttaccaatgaaatattcagaatatcaacctcgtccggatctactcaaagatcgaattattttaatcactggtgctggtgatggaattgggcgagctgcggccctcagttatgctttacatggtgcaactgtagtcttgcatggtagaaccttaaataaacttgaagtaatttatgatgaaattgaaggtttaggcgcacctcagcctgctattttacccctccagctttcgagtgcttccgatcgcgattatgatttcttagttagtacgctagaaaaacaatttggtcgtttggatggcattttgcataatgcgggtattttgggtgagcgggtagaacttgcacattatccagcagaagtatgggatgatgtgatggcagtcaatttacgtgcaccttttgctttaacccaagctttattaccgttattacaaaagtcagaaaacgcttctgtcgtatttaccagctcaggtgtaggccgtgaggcacgcgcgctctggggtgcgtattctgtctcgaaagtcgcgattgaagcggtgagcaagatttttgcggctgagcatacttatccaaatattcgctttaattgtattaacccaggggctacacgtactgccatgcgtgctaaagcttatcctgaagaagatccgaaaacattaccaacacctgagtccatcatgccggcttatctttatttaatgggtgaagatagcttaacgctcaatggacaaagtattgatgcacaggattaa

SEQ ID NO: 1507 - DNA, 216 bp, Acinetobacter baumannii
caattttatatactccataaaccctttaaattaattaggtggtttatgtcgcacttcaagttttactctgccctcatttataaaacactattctttttaaaagaatttaaatttacaatcattaaaaaacaaaagaaaatagttttattaatcatactttcagaaattgataagaaaagaaaagaaaagcatataaaacttggagtaattccataa

SEQ ID NO: 1508 - DNA, 552 bp, Acinetobacter baumannii
gaaaaacatatgctggtctatattatcgtcggaagtgttcgcgaagggcgcacagctattaaaattgccaattggttagaaacaacaatacccacatttaatctaaaagattttcaaacagaagtaattgatttaaaagaatggaatctacccttattttcaggttctcacccacctgctacaggtatttatgatcaacctaaacaacaagaatgggctgataaaattgcccaagctgatgcatttatctttattagcccagaatataaccacggttatagcccagctttaaaaaatgcactggactatgttggtaaggaatggagcggcaaaccagccgcatttataggttatggctcaacaaatggttctcgttctattagccaaatacgccaagtcacttcaagtttaagtattgttgacccaaatgctgtgatcgaaatacgagatatcttcaaacgcaataaagatgaaaagtttgaagccaatgaatttgaagtaaaaggacttcaatcaattgttgagaaactacagaaatatcatttgtcttaa

SEQ ID NO: 1509 - DNA, 1065 bp, Acinetobacter baumannii
agactgaatatttattttttacgaaataaaaatccctttagggtatctgctcatccaattatttttctttttctctttcggggagcacgaaaccacatggcactttttaattccacttcatgggcaaaatattcagtcattgctgccagccttgcgggagtgatgatgctaggtggttgtgccaaaaaagaggagcacaccacaacaactttaaatatcggctatcagaaatatggcatccttcctattctaaaagcacgtggtgacttggaaaaagcgctcaaagatcaaggcgtacaagtgaaatgggtcgagtttcctgcaggacctcaattacttgaaggcctaaatgtaggaagtgtttcgttaggcgaagcaggtgaagcaccacctatttttgctcaagcagccaatccaaatttagtttatgttgcaaatcaacctgctgcaccaaaagcagaagcgttattggtacaaaaagattctccaatccagtctattaaagacttaaaaggaaaacgtgtcgcactgaataaaggttcgaatgttcactaccttttattaaaagtcttagaagcaaatcacttgagcttaagtgatattcaacctgtttatttaccaccatcagatgcgcgtgcagcctttgaaaaaggagctgtcgacgcatgggtgatttgggatccgttctttgcagcagctgaacatcagattcaggcccgcgttctagcaacaggtgaaaacttggtaagcaatcatcagttctacttagctgatcgtaaatttgcagaaaataatccaaaagttctgaacacggttgtacaaacgctaaaccagacaactgaatgggtcagcacacaccaagatgaggctgctaagctactcgaaaaacctacggcacttgaatttgatgtacttaaaacatccatttcacgtatgggttttggagttcagccaatatctgacaaggtagcccaagaacaacaatatgtagctgatgccttctacgcgcaaaagctcattcccaacaagctcaccattcaagaagccattttaaaactgaaataa

SEQ ID NO: 1510 - DNA, 903 bp, Acinetobacter baumannii
gtaatgcacatgaaaattttctggtttattcctacccacggtgatagtcgctatttaggtacaagtaaaggcgctcgtcaggttgaccatgcctatatgaagcaaattgctgtggcagtagataacttgggttacgaaggagtacttattccaacaggtcgttcatgtgaagatccttggattacggcggctagcctaatcgatgcaactcaacaccttaagtttttagttgcattacgtccaggggtaacaacaccagcgttggcagctcgtatggctgcaacatttgaccgcttgtcgaatggtcgtgttctactcaacttagtgactggtggtgatgaagcagaactacgtggggatggtttatatgaagatcactcaacgcgttatcaaacagccaatgaatacgtaaaaatctggcgtgaaattttgacgcgttcacatacgggtgaagcttttacattccacggtgaacgcttagaagtagatgatgcaaaactactttacccacctgttcaaaaaccttatccacctctttggttcggtggttcttcagatgttgctgttgaactcgcggctgagcaagtcgacacctacctgacttggggtgaaccacctgcagccgtgaaagaaaagatcgaacatgttcgtgccaaagctgaggctaagggccgtaaattaacttatggcattcgtttgcatgtcattgttcgtgaaaccaatgaacaagcatgggcagcagctaacgagcttatccaatatctggatgatgcaactattgctgcagcacagaaaaaattgcacaaatggactcagtgggtcagcaacgcatggcggctctacacggcggtaatcgagacaaacttgaagtatccccaaatctttgggcaggtatcggtctag

SEQ ID NO: 1511 - DNA, 648 bp, Acinetobacter baumannii
gtttttttaatgtcgatacgggatgaacgaaaacagcaaagtcgtcaggcacttctcgatgcagccttgcatctgagcacgtctgggcgttcgttcagtagtatcagtttgcgtgaagttgcacgtgaagtgggtttagtgccaacagcgttctatcgtcattttcaagacatggatgaactcgggaaagagttggttgaccaagttgccctacatttaaaaagcgttttacatcaactcggccagagttatttacagcacaagtctgcaaaaacccaaaccagtattgagctatttgtacaggcagtgaaccatagccctaaacagtggcaatttatgattgctgaacgttggggtggttcagaaacggtccgtgcagccattgctagagaaattgaatttttgattgaagatctcacaacagatctgactaaactcgaaaattttaaacatattcaaaaccctcaagacttaaatgtcttatctaccattttgaccaatatgtcatttacatgggcaatgacgtggctcaacctcgccaaacaatatcaaggtgagcaacttaaacaacaacagactgcatttattgaaaatgcgtctacacaagttcgcttactgtttagaggtattgctaactgggaacggtaa

SEQ ID NO: 1512 - DNA, 606 bp, Acinetobacter baumannii
actaaaacaattggcaagcaatttattggcatctcaatgaagcaaatcacaccgtatgaagttatagatggacaattaaaaggggcgagacaagtaccttctccaaattttaaccagcgtcccgctggtaccgaaatacaaatgattgtggttcataatattagcttgccgccttctcagtttgggggaggctatattgaacagtttttccagaataaattagattggtccgttcatccctattttcagactattgaaggtatgcaagtctctacacacctgttaattttacgaacaggtgaagtcctacagtttgttaactttaatgatcgtgcatggcatgcagggcgttcaagctacttagccaaagttgaatgtaatgattattcaattggtattgagcttgaaggaagtgatgatttaccttttgaagacgtacaatatgaagtgttaactgacgttgttactgctattcgtcaggcctatcctgaaattaaaagccatattgcagggcattcagacattgcaccgggccgaaaaaccgatccgggaccttattttaaatggcagcactttaggcagttgttagcacagaaaaaaacttga

SEQ ID NO: 1513 - DNA, 1551 bp, Acinetobacter baumannii
gtgagtacgatggcattatggcgatcgacttttattgtcagtgcgatgacgatgttgtcacgggtattgggcttagtacgagatgtcgtattgctcaacgtgtttggtgcgggtaaagatttcgataccttcgttgtggcttttcgtattcccaacttctttcgacggttgtttgccgaaggggctttttcacaggcttttattccggtattgaccgaatataaaacaggtcgtgcgcatgcagaagtacagatcttaattagtcgagtatttggctgtttgctgacagtcatgactttactgactttcgtggctatggtcttagctccagcaattatctatatgtatgcgccgggtttccataatgaccctgaaaagtttgatttagcggtcagtatgttccgtctgaccattccctatttaatgtttatgtcgcttacggcttttgccagcagcatcttaaacagttatggctcgtttgcctcgccagctttttcacctgttttactgaacgtagcaatgattgcaggggcttggtggcttacaccgtatatggctgagccaatcaaagctttaggttggtcggttgttgcggctggtattttacagttagctatacaaattcctgagttatggcgtaaaaacttactgatcccaccgaaagttgattttaaacatgaaggtgtagaacgtattttaaaattaatgcttccagcattatttggtgtctctgtgactcagattaacctattgctaaatacgatttgggcatctttcatgcaagatggttcagtgtcttggctctacagtgccgaacgtatgactgagctacctttaggattaattggtgttgcgattggtacagtgattttgccttcactatcagcacgtcatgctgaacaagaccaagcgaaatttcgtagcatgattgattgggcagcgaaagtgattgtattggtggggttaccagcaagtattgctttatttatgctttctacaccgattattcaggcattgttccaacgcggtgagtttgatttacgcgatacacaaatgacagcacttgcattgcaatgtatgagtgccggtgtaatttcctttatgttaattaaagtatttgcaccaggtttctatgcgcagcaagataccaaaacaccagtgcgtgtgggtttaatgtcggttgcagctaatgcgattttaaacgttgtattcattggattctttaaactaatcaattggcatgcagagcatatggcgcttgcattagcctcctctggttcagctttagtaaatgcaggtttgctctatttttatctgcataagcgtaatattttccgatttggtgcacattggaaaaaactggcacttcaatatggcttggccaaccttgcgatgattgcagcgctttggttcgggctaaaatggtataacggtgaactctctcaatggattcgtgttgcagaggtagtaggtttatgcgttgtaggtgtaatcgcttacttaattggcttattactgacaggctttagaccgagagatttaaaacactaa

SEQ ID NO: 1514 - DNA, 1143 bp, Acinetobacter baumannii
agacttaagatgaaaagacccttttaccaattaaatcaaagtaaagatgttatacggcattttaccccaaattggtttacagcaactatgggtactggcgtggtcagtatgattttaattcagcttccatttgccaaatcatttttatttatgctggctacgctgttatggcaatttaatattgttctatttagtgttttttcagttctctatttattgcggtggtttcttttccctcatgaagcgaagcaaatatttaatcatccaaatatgagcttgtttttaggtgctataccgatggggcttgcaaccatactaaatggctttttaagcttcggaatcgggctttacggcgaagtggcagttcatatcgcccaagctttatggtatatcgacgtctttttagcactggctattgcgtggatcgtaccattttgtatgtttagccgtcagaatcatcaactacataccatgactgcaatttggcttttaccggtggttgcatgtgaagtcgcagcaagttctgcgggcatgttggttgcacatttaccagcagatgtgcatagctttcatttattgttaacgggttacgtactttggggaatctctgttttacctgcatttgccattttaacgattttaatgttgcgtatggctttgcatcagttaccagaaaaagaagtcgcgatttctagctggctttctttaggcccgattgggacaggtgctttaggtctattgttgctaggtgagcaggcacaaagagtatttgtaaatgttggctttcctgagttggcccatgtctttcaagccttgggtgttgtgggtagtctggtacttttaggctttgggttatggtggcttggccttgcgattttaacaacacttcgtcatgcaaagacaggtattccgtttaacttgggttggtggggtttaaccttcccatttggtgtgtttattttggctttatttaatttaggtcatcagattgaagttgtatttttacaatatgtcgctgtggcattcagtattttattattagtgatgtggagcgtggtaatgaagaaaaccttagccggagcatacagtggcaaactattcttctctccatgtttggtggctttacaacaaagaatgcagtaa

SEQ ID NO: 1515 - DNA, 1158 bp, Acinetobacter baumannii
atgattaagatatctagtacactttatattttagctagtcttttagtactttctggtgctttttactctatagactttttaaaagtaatttctttaggggtgtttggtgtatgtatattcattttttttgtatttgcattaactggaaataaaaataatttaatcttagataaaagtggtattatttgtattttatttatattttcttttgtgttgatgttgatatcggcagcattaaataatgctgttgatttatttataggtgttcttttatttcttttgttagtaatcaatttttctatttttaatttgaataaagcttgttttgatttttttgataaacctgttaaattgacttttttaattattactttaataaatttttcatttggtttttccattccatttaatggtgcattttctaatcctaactccttaggtggaatttatgcaatgttatcatttttatcaacaggtatattattagataaggcttataattctaaaggtaaaaaaattgattattatttattacttataattttgttaagtactttccttacgttagtatcaaacagtaggatatcctttattagttcttgtttgtgtttaatagtattgtttctatattttatgataaatagctttaacttaaaaaaaggaattagtattaagattagtttttttaagaagatgttggcaactttggttgttggtattagcgctattcttattctttgggaggagattgaggacatctttgtaaaaaaagtaatgtataaaatggatgatgggggaggtgttacaggtggaagaaatgaagtttgggatgcaattattgataacagtttaatgtttggtcatggtagattttctccacacttagaatattttgatttagcagcccataatacttttttaagtatatatgatcagtttggatggttaagttgttctttcttcgccataactgttgttttcgttgcttttaatgtttttaatcccaaaaatataagaagttatggaattactccaagttttatatgcttttcttttcttttcttatcaatttctgaaagtatgattaataaaactattttcttttgttttttaatgattgtaaatttaaattcttttaaaaagaatagtgttttataa

SEQ ID NO: 1516 - DNA, 2187 bp, Acinetobacter baumannii
gaactcaggatagaactaatgaatcgtcgcgaatttcttttaaattctacaaaaacaatgtttgggaccgctgctctggcgagtttcccgctgagtattcaaaaagcgttagcaattgacgccaaagttgaaagtggaactattcaagatgttaaacacattgtgattttgactcaggaaaaccgttcatttgataattattttggaacactcaaaggtgtacgtggtttcggtgaccgttttaccattcctatgacagaaggccgaaaggtttgggaacaatatgatgcgaataaaaagaaagtattgccataccatttagatagccgcttaggaaatgcccagcgtgtttcaggtacacctcactcatggtctgatggacaagcagcctgggacaacggtcgtatgagtgattgggtggcatataaaaaaccgcagtcgatgggctattacaaaaagcaagaagttgaatatcaatttgccttagcgaatgcttttacgatttgtgatgcctaccactgtgccatgcatgcaggaactaacccgaaccgtaaatttatctggacgggaaccaatggccctacaggtgcaggtgttgcgagtgtggtcaatgaatttgatgggattggaccatcaacagaaggttatgaatggacgacatatcctgagcgtttacagcaggctggcgtgacatggaaagtttatcaaaatatgccggataactttaccgataaccctttagctggtttcaagcaatatcgccgtgcaaatgagcaatctggtcaacctgtcagtaacgacacactaacgtgtccagcatatgatgaaaagattgatgcgactcaaccactttacaaaggtattgccaataccatgccggacggtggttttttaggaacttttaaagctgatattgcgcagggtaaattaccgcaagtgagttggttagttgctccggcaacttacagtgaacatccagggccatctagtcctgtacaaggcgcttggtatattcaggaagtattaaatgcattaactgaaaaccctcaagtgtggagccaaaccgttttattggtgaacttcgatgaaaatgacggtttctttgaccatgttccttcaccaagtgcaccttctaaagatataaacggtgttgtatatggaaaaaccactttaacggaccaacaagtgtcttatgagtactttaaccatccagcagtagcgacttcaaaatctcaacctaagccagatggtcgagtgtatggtccgggtgtacgcgttccaatgtatgtgatttcgccgtggagccgtggaggatgggtaaattctcaagtctttgatcatacttctattttacaattcttagaaaaacgttttggtgtgcaagaacctaacattagcccataccgccgtgctgtatgtggtgatttaacaacggcatttaattttaaaacaccgaatcttttgcctgttgctgaactagacggaaagaaaacaaaagccgaagccgatgcgattcgtgtcgctcaagctttattgccccaagttcctgttccgagccagcaacaatttcctcagcaggaaatgggaattcgaccatcgcgtgctttaccttatattttgcacactagtgccaaagttgatgccactcaaaaaacagttaaattgatgttctccaatacgggtaaacaggcagccgttttccatgtctataaccgtttggatcttaccgcaattccacgccgttatatggttgaggcgggtaaacagcttgatgacgtgtggaatactacaaatggacagtatgatttatgggtacttggaccaaatggttttcaccgtgcgtttaaaggtaatttaagtcaagctaatcagactcaagcattaccggaaattagagtatgtgtagaagaatgtgatgcgaatttatatttaaaagtgcgtcatgatggtaataagtcagtcaagctcactgtcaaggcaaatgcttatctgccaaacaagacatgggcgatagaaaccaatagttctgaaaaagaactggtttgggatatgtctgaattcggtggttggtatgactttacggtgacattagcggatgatgcgacatttagtcgccgttttgcaggacgtatagaaactcaagaagattcaatttctgatccatatatggggtatttagagtcttag

SEQ ID NO: 1517 - DNA, 282 bp, Acinetobacter baumannii
gactcgatttctctacggctcccctatacggttaacctcgctactgaatataagtcgctgacccattatacaaaaggtacgcagtcacaccacgaaggtgctcccactgcttgtatgcatgcggtttcaggatctatttcactcccctcacaggggttcttttcgcctttccctcacggtactggttcactatcggtcagtcaggagtatttagccttggaggatggtccccccatattcagacaaggtttcacgtgcctcgccctactcgtcatcattatg

SEQ ID NO: 1518 - DNA, 420 bp, Acinetobacter baumannii
agaattcattcaataaagaattatttaaatatagaactacaaatcatttttggatgcttactcggttctatggatataatgaggaagttttttatttttggtgtccccgtgaaaattaattctttctctcccatacctgaagacgatgaagaactccctcttccagagctgatttattgggcatctttaggtgatctagagcaagtaaaacaattattaatagatggagaagaccctaatcagaatgatgatgaaggatatagtgctttgcaagcagcggctgagaatgatcatttagagatagtgaagctattagttgaaaaaggggcgcatgtcacttataaaagcgaatatacagcactacagcttgcagaaatggcgggtaatactgacatagtgaattatttaaaaagtttataa

SEQ ID NO: 1519 - DNA, 549 bp, Acinetobacter baumannii
aagaaaatgtctgttgcacaactaagtaagcgtgatttaattttatttgacctagatggaacgttggttgattccgctgccgatttatatcggtctatgaacttaagtctgcaatcactcagttggccattggtaacagaagcacaaatacgggaatgggtaggtaaaggggcttcaaaactttgcgaaagtgttctgcttcatatatttggaaaattagatgttgaacaacataaagttttattacagaaatttgtagaggtatatggtgcggagctgtgtgtgaatactcaaatttacccaggcgtacctgagtttttaaaacattgccaaactttgaatatcaaaatggcatgtgtgactaataagcctgtcaaacttgctcaagggttactggatgcgctagagctttcttcttattttcaagttgtacttggaggagatagcttacctgaaagaaagccgcacccactaccattattgcattgcatggaaagcctaaaaatatctgcttcacaatcattaatgattggcgactcaagtaattga

SEQ ID NO: 1520 - DNA, 195 bp, Acinetobacter baumannii
cttaacactttaaaatggtgccggcacacggattcgaactgtggacctactgattacaagtcagttgctctaccaactgagctatgccggcgtttcttagtgtttcgtacgtttcgtatcggaacggtgtgcagtttagcaaaacttccaaacgatgcaagcggtttttttaaaaaaaccgctaaaaactcataa

SEQ ID NO: 1521 - DNA, 288 bp, Acinetobacter baumannii
ttactactgttcgaattaccatttaggttaattgcaggagttgaaattgaggtaccacttgaacccgatgtatttgaaccagaattctggttattaccaattaaactattaatcggattcgatgagttagatgaattattactattattcgatgaagatactgcctgtcctgtgactaagccttgcaaaatttcagacaagtttttagcactggcatacttcaaacggaaaacttttaagccacctaaacgatctgccgaaggtacatccagcatctcaatcatatga

SEQ ID NO: 1522 - DNA, 744 bp, Acinetobacter baumannii
atgaagaaaaagtctaagcaatggaagtggtggttttttgccctcattgtatttttaatttttattattttacagattccggcgacttggcttatctctaaattttcaaagaataatcaaactgtccataatgtaagtggcaacatctggcaggggcaggcagactggcaccgtggggcgttacgaggcactatccactggaaaacgagaccgctagacttacttttattacgctttgctgcagatgttgatattcatagtggtaatacgcaattaacggggattatggcgtatggttttggaaaaaaagttattgtaagggatatgaatggccagattgctccagaaacactgaagcaaattgtaaattggcaatggcctgtaaacagtattcaacttaaagatatccaatttaattataaaaaagagcaaggctttgcggcagttgatgggcaattgcattggggtggtggggcgctcatttataatattggtgatcgtcaagatcgtatgaatatgccttctttaagtgggcaattaactgaccagaacggacagctacaagtggacatccgtgatcagcgtaatcaaaaaatggccaatcttttactagatgccaatatgatgctggatgttcagctcacacagcgtttattactaaatgttccatcatatgacggtaaagctggtttggatacttttgtcattagttctcgccaaccattattacaaggtggtaactaa

SEQ ID NO: 1523 - DNA, 315 bp, Acinetobacter baumannii
tatcccaccctgctcgttataaaattaaaacgcttagaagaagaatcagaagctttaattgcaagcaaaaaagatcaagcaatcgaagatgcttataatcaaattatcgaaattgctgaaaatgtaggttttagtgttgaacagcttctagaatttggcgctcaaaaacgtaagaaaacaacacgtaaatctgtagaaccacgttaccgtaacaaaaacaatgctgaagagacttggacgggtcgcggtaaacaaccacgttggttagttgctgaaattgaaaaaggtgcaaaacttgaagatttcttaatctaa

SEQ ID NO: 1524 - DNA, 2286 bp, Acinetobacter baumannii
gaaatatcgcgagttatggctttattgaatcatcaacgtccactttgggcattacttgcagcagccccattgattgcgacagtaagtagcagtgcctatgcccaaacatggaagatcaatttacgtgatgctgagttaactgcctttattaatgaagttgcagacattacaggaaagaacttcgctgtagatccgagagtacgtggtaatgtcacggttatttctaataagccattaaataaagatgaagtttatgacctatttcttggggtcttaaatgtaaacggggtcgttgcaattccgtctggtaataccattaagcttgtaccggatagcaatgttaaaaactcgggaattccttatgattctagaaatagggttcgtggtgatcaaatcgttacacgtgtgatttggctggaaaatactaatccaaatgacttaattccagcactccgtcccttaatgccgcaatttgcccatatggcagcaattgcaggaaccaatgcacttattgtttctgatagagcggcgaatatttatcaacttgaaaatattattcgtaacttggatggaactgggcaaaatgatattgaagccatcacgcttcagtcgagccaagcagaagaaattattacccagcttgaagcgatgagcgcaacaggcgcatctaaagattttagtggtgcccgtattcgtattattgctgataatcggacaaaccgtattttaataaaaggtgatccgcaaacacgtaaacgtattcgtcatatgattgagatgctggatgtaccttcggcagatcgtttaggtggcttaaaagttttccgtttgaagtatgccagtgctaaaaacttgtctgaaattttgcaaggcttagtcacaggacaggcagtatcttcatcgaataatagtaataattcatctaactcatcgaatccgattaatagtttaattggtaataaccagaattctggttcaaatacatcgggttcaagtggtacctcaatttcaactcctgcaattaacctaaatggtaattcgaacagtagtaatcagaacaatatcaccagctttaatcaaaacggtgtgagtattattgcagataatgctcagaactcattggtagttaaagctgatccccaattaatgcgtgaaattgagtctgcgattcagcaacttgacgttcgccgtcaacaagtactcatcgaagctgcaattattgaagtctctggtaaagatgcggatcagttaggggtgcaatgggctcttggtgatattaatagtggtataggcttgattaactttacaaatgcgggttcaagtttagcttcgctggcagctggctatttaacaggaggagctgctggtttgggaagcgcaattggtgctggtagctcaatcgcattaggaaaatataaagaaggtgcagatggttctcgtcaactttatggagccctaatccaagctttaaaagagaatacagcttctaatttattgtctactccctctattgtgactatggataatgaggaggcttatattgttgtaggtcaaaatgttccatttgtaacaggttcggtcactaccaatagtacaggtattaatccctatacaactgtggagcgtaaagatgtcggtgtaacattaaaagtcattcctcatattggtgagaatggtacagttcgccttgaaattgaacaggaagtttcaaatgttcaagcaagtaaaggacaagctgcggacttaattactaataaacgtgctattaaaacggctgtattagccgaacatggccaaacagtagttttaggtggtttggtttcagatgacgttgagtttaaccgtcagggcattcctggtttaagtagtattccttatttaggacgtttattccgctcagatactcgaagcaatactaaacgtaaccttctcgtttttattcacccaacaattgtaggcgatgcaaatgatgtacgccgtttatctcagcagcgctataatcaactttatagcttgcaattggctatggataaaaatggcaactttgcaaaattacctgagcaagttgatgatatttataatcaaaaaatgaccccaccgagtattgcctctaagccaaaaaattaccaacaggttccatcaggtggtaaaagttcgaccataactacgccggtagctgtagaacctaccgtccaaaagcaaacactacagttgcctgatcccgaaattaatcgtactaaaaatacagtaacaacaacgacactgcgtccaagcacagcgccgtag

SEQ ID NO: 1525 - DNA, 1503 bp, Acinetobacter baumannii
agaagattcatgacaacattagcgcaattcgagcaacttaaggctgctggttacaatactattcctgtttatcgtcaacgtttagcggatacagaaaccccattatctgtttttgctcgttttaaggatcaaacacaggcttacttatttgagtctgttgaagggggtgaaaactgggcgcgctactctatgattggtttaggcgaatccacagttttttcctgtaacgctggtgttttatctatacaacatggtgacggatcagtaacacagcaaaattgtctagacccattccaatatatccgtgaattccaaaaacaatttaaagttcctacggctaaactcttaccagacttaccaagctttacgggcggcttggtgggttatttgggctacgatgctgtccgctatatcgagccacgtttaaagaatgtacctacggctgatccgattacgctaccagatttatggttgatgctctcaaagacagtcattgtttttgacaatcttaaagatacgctatttttaattgtgcatgcggatacagagcagagtaatgcttatgaagacgctcagcaaaaattagatcaattagaacagttgttggcgactccagttagtttgcaagcgcaaccacatacgcctccgcattttgaatcaattactggtaaagcaaaattcttagagacggtagagaaggttaaagagtatatccgtgcaggcgatgtgatgcaggttgtacctgggcagcgtatggtttctgattttgatggagaagctttacaggtttaccgtgcattacgtcatttaaatccatcaccttatctattcttggttcaagggcaaacgattactgataaaaaaccatttcatattgttggctcatcaccggaaattttatctcgtttagaaaacggtattgctacagttcgacctttggcaggaactagaccgcgcggtaaaactaaagaagaagatatagcattagaaaaagatttgctgtctgatgaaaaggagattgctgaacatttaatgctgattgatcttgggcgaaacgatgtagggcgcgtatcgaaaataggtaaagtccaagtcacggatcaaatggtgattgagcgctattcacatgtcatgcatattgtttcaaatgtacaaggtgaagtgcgtgatgatatcgatgcacttgatgtatttaaagccacctttccggcaggaacgttatcaggtgccccaaaaattcgtgcaatggaaattattgatgaagtagaacctgtgaaaaggggagtttttggcggggctgttggttatttgggatggcatggtgaaatggatatgtcgattgcaatccgtacttgtgttatccgtgacaaaaaggtgtatgtacaggctggtgcagggctagttgctgactcaaatccagaatctgagtggaatgaaactcaaataaaagctcgcgcagtgatcaaagcggttgaattatcatcaaacggattgattttatga

SEQ ID NO: 1526 - DNA, 639 bp, Acinetobacter baumannii
gacataggcatgacttggaaattacaagcaattactggtgaatttactggccaagaaattaatgttgatcgtgatatgttggtgggacgtcatcaagatgctgatttattactacaggctgctgaaatttcacgtcgccatgcagcattgctgttaaaagatcaagcgctatgggtgcaagaccttaattcatcgaatggtacgtttgtaaacgatatgcgtattgagcaagaaaaacagttgcatgatggtgatattgttcaattcgcaagtttaaaattttcagttttcgcccctgcacaagaaaatactgatttacctgaaattgaggtggagccagtacaagctgcaccgacacaagatttaagcgatcaaggtatgccaagtattgcggagcgtgcagcggaaactgaagtgagtcgtgatggaatgcctcagcgagtttctgtgccaaaaccagcaccgattcctgaaggggtggatattcatgctcagccagaacaaactcctgttgctattgaggagccagtttctcgggttactgaagagaaagagcagcaaaagaatgcatctattggtctagtgaccattattattttagtgattttagctgtattggcgtggttattctttaaataa

SEQ ID NO: 1527 - DNA, 840 bp, Acinetobacter baumannii
ctaatgaaagtatggattgataaattacagcaattgcaatggcaaaaattagatcgactgagtgtagtggtccttgccattttaattttatggttatgctggaaactcgcttcatttttttggttggtgattgcgcctcctcaactgatgcaatttgatcgggtagaactcggttctcaacaaccacaaataccaaatattagtactttttcactttttaacgaaccttctgccaatgcggctcaagaaagcgtgaatttagaattgcagggtgtaatggtcggctatccaaaccggttttcctctgctgttattaaaattgataatactgctgagcgttatcgagttggtgaaaccattggttcaacttcttaccaattggcagaggtgtattgggatcatgttgtgttgagtcaaggaaatggcagtacccgtgaacttcagttcaaaggtttgccaaatggtttatatcaaccgatgactccggatgcttcacaacaaagtgctacaccgtctcaacctacagagcctatgaatacggcccaacaggcattgggacaagcgatccagcagatgcaaggtaaccgagagcagtatctccgagatatgggggtaagtggtaactcaggtgaaggctatgaagttacagaacgtacaccgactgcacttagaaataagttaggtttaagacctggcgatcgaattgtctctttgaatggtcaaacggttgggcaagggcaaacggatgtgcaattacttgagcaggctcgtcgagcagggcaagtaaaaatagaaataaaacgtggtgatcaagtgatgaccatacaacaaaatttttag

SEQ ID NO: 1528 - DNA, 243 bp, Acinetobacter baumannii
aacttctgttcaaatccaatcgacaaatcctcaagctcttccttaagtgttgcctcagcctcgagatatttttgtgtaggctttggcagtggccggcttttaggtttaggtttaggttcttttttccgagtaagccaaaagtattctgtaaaatccattattcttacccataaaaaaaccgccctaaggcggtggctaaaaatagagacaactaactattatttcttaaaagttgccttataa

SEQ ID NO: 1529 - DNA, 492 bp, Acinetobacter baumannii
ttagttgtctctatttttagccaccgccttagggcggtttttttatgggtaagaataatggattttacagaatacttttggcttactcggaaaaaagaacctaaacctaaacctaaaagccggccactgccaaagcctacacaaaaatatctcgaggctgaggcaacacttaaggaagagcttgaggatttgtcgattggatttgaacagaagtttcagccgatccataccaaaaattggcgttttgactttcatattgtgaaattacgcttgctcattgaaataacgggtggtccttggtctggtggccgtagcggaaagctatcaaataaggcttggagtcttgatcgatatgatcatgctgaagagatgggttacaaaatagagcgctttcatccagactctgttttgtcgggatatgtcattaactggattaaagacgaattagcgagaattgaagatggagcagatcagaccatttccaccgactga

SEQ ID NO: 1530 - DNA, 210 bp, Acinetobacter baumannii
tctttaacctcttcaggaggattcgggatctcaatattcaaaaacatttcatcaggaatactgcgtcgtctctctacactgccttgcattttacttttgtatatttttcttagagaattagatctcaaaatcaaatccaaatattctacattaacttctcgttttaatctaaagattttgtatgctgggcttacggcagcagcatcgtaa

SEQ ID NO: 1531 - DNA, 186 bp, Acinetobacter baumannii
gataatggctcagccaccgagaagaacattaaatcgataccaatacctgccgaaaacagcatggcagaccaactcagtaaactaaactcaggctttgagtgtttagggccaagtttaatctcaccataccgtgagcaggcaatgaaaattacaaacaccatatacagcgttgcagccagtaaatag

SEQ ID NO: 1532 - DNA, 867 bp, Acinetobacter baumannii
aattgtttatctgtacggagtaaaaaccaaatgagtgctcagttatttgttgtagccaccccaatcgggcacttagatgatatgactttccgtgcaattgatatcttaaaatcagtttctgttgttgctgccgaagatacacgccaatcagctcaattattcaaacactataatatagctaccccacttaccgcatgccacgaccataatgaaagcaacaaaattgagcagttagttcaaaagctacttgctggtgaaaatattgctttgattagtgatgcaggcacaccacttattagtgaccctgggtttaaactggttcgtgctgctcaagaaaatggtattagggttgtacctgtaccgggtgcatgtgctgcaattgctgctttaagtgctgtaggcctaccaagtgaccgttttagttttgaaggctttttaccatcaaaggcttctcaacgtatttcgcaactcgaaaagcttaaaaatgaaactcaaaccttaattttctatgaagcgccacatcgtattttagaatgcgtaaaaaatatggctgaagtatttggtgaaaaccgccctgtgggtttcgcacgtgaaattaccaaaacatttgaaacgatcaaaaaaatgaccttaaaagatttggttagttttattgaaaatgaccataaccaagaaaaaggtgaaattgttcttgtagttggcggtgcaccagaaaaaaccgatctggaacaagaaaaactagatgagcttttaaagcgcttacttcaagatttatcagttaaagcagcatctcaactggctgctgatttaacgggtattaagaaaaaagtcgcttatcaacgtgcacttgagctgacacaatcttaa

SEQ ID NO: 1533 - DNA, 522 bp, Acinetobacter baumannii
gcgtatatatcagatggtggcgtgatggaagtaaattttaaaaacgcaaaaattttagatccatgttgtggctcacgcatgttctggtttgatcgtcaaaatccaaatgttgtgtttggtgatattcgtaaagaagaacataaattgtgtgatggtcgtaccttagtgattgaaccagatgtattaatggactttcgcaaaatgccttttaacgatgagcaattttctttagtcgtttttgaccctccccatcttttgcaagctggaaagaaaagttggttagctgccaaatatggaaaattgtcacaggattggcgtgaggatatacaaaaaggtttttcggaatgcttccgtgttttagtgaaaggtggagttttaattttcaaatggaatgaaacacatatcaaagttaaagaaatattagcactcactgatcaaaggcctttatttggacacatcagtggaaagcgaagtaacacacattggattacttttatgaaagcggaaagtaaggagaaatag

SEQ ID NO: 1534 - DNA, 279 bp, Acinetobacter baumannii
attgcagtatccttagtttacctaactgccaaaatcaataacacaatggaacaccaaacacttttagacgaattaaattcgcagattgaatattactcaaaaagaactgactgcccaccaactagaattcgtattgggtataaaacctattacaaattaatgcagaatcctaaatttgccgatgaagtatcaaactccgctttagatccaaacaaacgcaaatacaaaaaattaaaaataaaagttactaaggatgacaatcaacttgaacttgaatga

SEQ ID NO: 1535 - DNA, 255 bp, Acinetobacter baumannii
acaagaacatccttattcgcattaatcacaggaagacttatggacaattcaaaacgaccaatcaaccagattattgctcgcatcaatgatgctgcgaaacatggtgaagctttggtgctaacagccgaagaagtaaagattctttctaaagatattggcgacaaggtctttattcctgtgcttactaatgagcaggtcgtgcagttggtaaaagaaggaaagctaggccagaaaattaataacaccaaagattaa

SEQ ID NO: 1536 - DNA, 1836 bp, Acinetobacter baumannii
atattgggattatgcaatatgtctaatattgagcaagatacacgttttattgttaacaataatttgattaacaagggctggatcttggacattcaagatccaaacaaaaatgtcttttttgaatcagatatcttaagaattgttaataatgagtttctcaagaaaagtaaaaaaagacccgattatgttcttttcgattcacaaaataagcggccaatcggtgtaattgaaacgaaatcaggtggaaaaagcttaacaaaagcactggatcaggcaaccgaatatgctgaaatgcttgatgcacctttgatatttgcaatgaataatggtttctgcgaaacacggcatttgtatacccaaaaaccattatttattgatgaaaatgaggttaatgaattaataagagtaaatgaagctaaagagttcatattgcaggaaacaaatggtatttatattacacctaaagaaattttagtctctcgcaaagagttaattaatgttttcaagaagttaaataactcactaagaggtgaaggtttaagagctggtatagaaaggctttcagaatttgcaaacattctttttttaaaattgtatacagagaatgctaatacaggtatttggaattctctcaaaagtctcgataatgatttgctaattaatacaactaataacatactacaagatattgatagacaatatggtgcttctgtttttacaaatttacagctaaccaaccctgttgctgttaaagagatgatcaaagagttggataagttaaaactctcatcaatagataccgatattaaaggagatgcttttgagtatttcttacagcaagctacagcaactaataatgacttaggagaatattttactccacgtcacataactaaaaccattgttaacttagtcaaccctaaatatggtgaaaagatctatgaccctttttgtgggacaggtggttttttaacagaggcatttgatcatataaaagataacactttaattgcaaacaatagtagtgaagaaatcaagcttaaacataatactatttttggaagagaaattacctcaaatgcaaaactcgcaaaaatgaatatgattctgcatggggatgggcatagtggaatttgccagatagacacacttcaaaaccctattgaatctgaatatgatgtggttataaccaacatgccattttctcaaaaaacttcttattctcacttatatgagaataagttagctaaaaacgatggtgatggagtatgtgttctacattgctttaaagcaacaaaaaaaggagggcgaatggcattagtagtacctgaaggctttctttttaaagccgctttagctccagtaaggaagtatttatttgaaaacgcccaactaaaagcagtagtttcacttccaaaagaagtttttctgccatatgcaaaagttaaaaccaatatactctactttaccaactgtcataatggtagaacaaattctgacgttttttactacaatgtgacaaatgatggcctaagtttagattctttccgtagaaaaattgacgaaaatgatttaaaaaatttagattttgctgatttaaataagagcgactttgataaatattataatgaattaggtttcttaaaagttaatccagaattaatcagaagcaatgattatatttataattatgctcactatagtaattcacatataaaatcaaaattcccaactataaaactaaaagaactcctatccttgtctggcaaagtcaaagtgggagaagatacaaatatacctattatgagtatcactatggaaacatggcttaattga

SEQ ID NO: 1537 - DNA, 189 bp, Acinetobacter baumannii
aaaaagagatcgctttatgtcaaaaacaaaagaattttcatgaaatattcatcaaatgatcatgatattgaaatatttcatgctcaatatgccgaaatattacagttgctttgtatgaaaaatagacacatgggtcattttatttatttttttgctgtaaaaataagcacaaaaggagctcataattaa

SEQ ID NO: 1538 - DNA, 1014 bp, Acinetobacter baumannii
gaccttatgtctacccaacccatgattgaaaaacttattgaagctcatctagattttttagatgagcaatttgctcagactcaggtgatccaacaagagtttgagcagttttatcattggttggggagtcgacaattacaacacctttggacatttgaacaagttcaacagctcattcaaaagcagattttagacacacccgcttcggattttttgattgaacagattgcggagcatatccgctttgcactgattcatcctgcaaatgacaccgcaactgttgaagacattattcctgttttaaccattgatcgaattgcacaatacgtagcaagtaaagaagagcaccgtaaaaaactcattaaaacaattgtgaataaccctgccttttcagcactgttgactcaattgattcagcaaacaatacatgattatttagatgaatccatgtcaaaacgcgtacccggtgtaggtcgttttatgaagatgggcaaatctgtattagaaacagtaaccgactctaatcttgacgataccattaaccattacttgcaaaaaaatattttaaaactcagccagatgagtgagcgtgttttaaaccaacattttgacaatgataagctctatcattttcaggcaaatgtttggcataaagttaaaacctcgccactttctgttttaaaaaactatatagaagttcaagatttaacaaaaaccgttggcctaggacatgaaatctgggaccacattcgtcaaactgattatctaaaacagcaagtacatgatggtatctatacttggtatgtacgaaatcaggaacgtaattttgatttattgctccgtgatcttaatattgacgaaaatttagtgaagcatgaactcaccgaattgcttgtacccgtactacaacaattagtcacaacaggacatttaagacgtcgtgcccgtgtatacttagagaagttttattattctgaaaaagcattagagattttaaataataaaggcgcttaa

SEQ ID NO: 1539 - DNA, 225 bp, Acinetobacter baumannii
attaatatgtcatgtatgctgactttagaagaaatcgaaattaaacggcaagaactggaaagacatcttgaagatgttatgtctgttgaactgaagaagtggcaaagcgaaaacaagctatgtgtttctgatgtgaatatacgtttggctaatgttgttagtctcggagggcctaaacataacgttgttactggagtaaatgttgatttagattacaagccttaa

SEQ ID NO: 1540 - DNA, 2046 bp, Acinetobacter baumannii
tacacgatgtcatctgccagtcaactgaacaacaagcaagaagaagccatgaaatatactcaaggccctttattggtgcttgctggcgctggttcaggtaaaacatcggtaattacgcgtaaaattgcttatttggtgcaacattgccgtattcctgcgcatcgtattacagcgatgacctttaccaataaagctgcacgtgaaatgaaagagcgtgtcactaagcttttatcacgtgaagaagcaaaaggtttgtccgtttcgaccttccatacttttggtttaaatcttttacgtttagaacttaaaaatttacctttaaaagctaatttttcgattttggatgcagatgactgtaaacgtattttgatggatttgatgcatcgcgataatttatcgggtgcagagagtaaagagctaattgccaaggcaatgaagaaaatttcagattggaaaaacgatctgattttgcctgaacaagcacattcgacgtgcgaaactcctgaagatgtccagtttgcccatctttatcaactttatgaacgtaatttacgtgcttacaatgcagttgactttgatgacctcattgttatgcctacccgcttattgcaagaaaatgcagaagtacgtgacaaatggcaaaaccgtgttcgttacttgctagtggatgaatatcaagataccaacaccgcgcaatatattttggtgaaattactagttggcgtaatggggcagtttacagccgtaggtgatgatgaccaatcgatttatgcatggcgtggggctaagcctgaaaacatggctttgcttaaacaggatttcccaaatcttcatattattaaacttgagcaaaattaccgctcgaccagccgtattttgaaagctgcgaactgtgtaattcaaaataacccgcatatttttgataaaaaattgtggagtgataaagggcatggtgaagtcatcagaattattacctgtcgtaatgatgatgatgaagcagaacgtgtagtcaaagacttactgactcacaaacttatgaatggtaagaactggaaagattacgctgtattgtaccgtggtaacttccaggcgcgtgtattggaaacacaacttcgccaaatgcagattccgtacaaactctctggtggtacatcgttcttcgctcgtgcagaaattaaagatgtaatgagttatttacgtcttattattaacccagaagatgacagtgctttcttacgtattattaatacgcctaaacgtgcgattggcccagttactcttgaaaaactaggtttatttgcacaagaaaacaatttgtctttacttggtgcttcttctgaccagcgcttaagtatggtgcttcctaaaaaggcagaaactcaattgcatgagtttgctgactttatctcgacgtttacacgtgagctgttggaagatgatgagcctgtgcctaaagttcgtcaaatgatgaatgaagcgggttatatcgactatattcgtgagcagtccgcaacgcctgcgcaagagaaaagtaagctcgataatattgagaacttgtttagtagtattcaaaacttaattaatcgtgctgaagatgttgatgaaaagaacattgaaagtgtgattcgaaaactagtcttgcttgatatgttagagcaacagcaagaggaagaagacactgataaagtgaacttacttactctacatgccgctaaaggtttggaattcccatatgtctatattatgggtcttgaagaagagctgttgccgcataagaactcaattgctgctgaaactattgaagaagaacgccgtcttatgtacgtgggaattacccgtgcacgtcaaggcttaactttgactttggcagagcagcgtaaaaatggtggtcaaatgaaacagatgaccccaagccgtttcctcgatgagcttccgcaagatgagctcgaatggttagggcgtaaaaagaaaattgcagcaaatgttgatcctaaagaacaggctcaacaatatttggcaaatttaaaagctttattaaagcgttaa

SEQ ID NO: 1541 - DNA, 1272 bp, Acinetobacter baumannii
caaaacccgtcgtcaggtgaagcctgtttaacaggcattgctttacaaggaagaaaggctatggaaaagattgtaattgtaggggcggggcaggctgcaggttgggcagttagtaccttacgtcaaaatggatatgtgggtgaaattcatgtggtctcaaatgaagatcaggtgttttatgagcgtccgccactgtctaagcaagtactttcaaaagaagcaagttatgaaagtttgaatctgttctctccagaacaggttcaagagttcaacattcaatggcacaaaccagaaattgcaacaaaagtcgatcgcgagcaaaagcaggttcatttagaaagtggtcagattttgccgtatgacaaattgctgattgcaactggaagtcgtgcacgtgtacccgtcaatacatggcagttcattcctaatgttgtgactttacgaaatgtgcgtgactgtgaacgtctggctgaaattttaaagaatgcaaaaaatgttgctgtgattggcggtggctggattggtttggaaatcgctgcaactgcacgtaagcaagggaaagatgttcatatttttgaatatggcgaccgcttatgtgcaagaagtgtgagtccggaagtttctgcatttttaaaaaatatgcatgaggctcaaggtacaaaaattcatttagacagcaagagccttcacttagtggaagcaccagatcaaaaagttgaagtggtgaaccatcctcaacatagtcagttatttgattgtgttgtagtgggtgcaggtgccgagattgcgaaagagttaggcgtgcacgctgggctcgatgtgaaagatggcattgtagtgaattgttttggacaaacctcggatcaagacatttatgccgcaggcgatgtcgcgattcatccgggcttgggctattgcattcagtcttgggcaaatgcacaaaaccaggcgattgcagctgcgaaatcaatgctcggaattgaaactgaatataccgatattccttggctttggtctgatcaatatcactttaatatccagattttaggcacgtatcaacctgaaaaaaccaaagaagtggtgattcgccaaggtggtgaagatcaggtgagctatttatatctgggccatgaaaatcgcttgctgaatatgattgccattaatgactcgaagttaatcaagctggcaaagcgttggatgcaagccaataccgttttagatccaaaattattagcagatgctgaatttaatgtcatgaagttaaaaccgtaa

SEQ ID NO: 1542 - DNA, 207 bp, Acinetobacter baumannii
cgtctacagtctattatttaccctctttttatttatattagttatgatggaaaagtaatttcgaaaatcataaagaggttactttgtatgtgcgcgaactatgaacctataaataaagatcgagttcacctactagatctattcgaaccgacattcgactataagaatggtgtttatccgggttacgactgccctcttattttttaa

SEQ ID NO: 1543 - DNA, 666 bp, Acinetobacter baumannii
tgtgaacagtcctatatatttagtattcgggtcgaaacacaaatgtataaatcttatttgtctggttctaaaagtctcttgctcatcgcattgagcatgttgcctatgttggtctcggccaaaactattttaattttaggagatagtattagtgccggttacggaatagaccctaaacaaggttgggtacaattactacaaaaacgtctagaccaacagtatcccaaacaacataaagtggtcaatgcaagtatgagtggtgaaaccacaagtggcgctttggccagattacctaagcttttacaaacgtataaacccgaagtcgtagttattgaattaggtgggaatgatggtttacgaggtcaacccccacaaatgattcaacaaaatttgtcgcagctcgtccatttaagccaacaacaaaaggcgcaggttattctttttggtatgaagattccgcctaattatggcacagcttatagcaaagcatttgaaaccaattataaaactgtaagccaaaaatatcaggtgaaactgctaccgtttttccttgatggcgtcgttggacaaaaacaactaatgcaaaatgacttgattcatccaaatgcccaagcgcagtcaaaattacttaatttagcttatccatacataaaaggtgccctatag

SEQ ID NO: 1544 - DNA, 1329 bp, Acinetobacter baumannii
atacgagagtcttacatgttagagtacgtcagcggattgtggcagacctttttacacagacctgatttttgggccgttttgagtatcattccggtcactgcctttgtcacatgggcacatgtgtggatggctttaaaaatggtgttttacccaatcaagttttggggatttcatttaggccctttaccagtcggctggcaaggtatcgtgccacgtaaagcaggacgtatctctggaattattaccgataatactttatccaagttaggttctttgcgtgagtttttagaggcaatggaccctgaagacatggcacgtattattggtgagcaagtcggatttgaacttgagcatttgattgatgaagtgatgatcgatcgtaatgcagtgctttgggaaaatttaccttattcgattaaacgccgtatttatgctcaagcgcataaacaattaccaggtgtactcagagaattagtgactgagctgactatgaacgttgagtcactggttgatatgcgtgaaatggtggtgagccaaatggaaggtgatcgccgtttaatggtacgtatgtttttaaaagttggacaaaaagaaatcaactttatttggcatattagtgctttaatcgggatgttctttggtgttttccaaatggtggtctggtttgtggtgccttggcattggacagtaccattttgggcgtctatttggggctttttaactaactggattgcaatctggatggtatttaacccgattgaaccgcattacattcgttatccgcaaatatttagattaacaaaagatcgtaagtttccttggattgtacctgttttacgaattggtacttataatgttcaaggggctttcatgaagcgtcaagaagaagtttcagaagtcttctcaagcgtagtgacagaagatctgattacgttaaaatcaattatgacagaaatgatgtatggttcacgcaaggacaaaacacgtcgtattgttaaacgtcatattaacgaaatcatggaaactccacttgttcgaacatctttacagctttctttaggcccaagagagtatgcaaggttaaagacggacttgattgatcgttcaattgaaattacgatgggaccggtatgtgaccctgcactaaatgcaagccgggcacagaagatttttcaaatgtttaaagagcgtattcgtgaactaacaccaaaagagtttcagaatttgttacgtccagcatttcaagaggacgagtggattcttattgtactaggtggggtaaccggatttattgctggtacaatacatttgtttgtggctttcttataa

SEQ ID NO: 1545 - DNA, 183 bp, Acinetobacter baumannii
tacggagagtcaggatcaatcacaatactaccctcaggtgtatgtactgcacaggctgataatgacattgtgaaaattgctgcggcacaaagaagtaaagttttcatgttgttctcgcttttttatcattctcccttttactatagaaatgttttgattacatttcgatcagtttttggttaa

SEQ ID NO: 1546 - DNA, 1251 bp, Acinetobacter baumannii
tttacatggtcttttttatatatcaccaatcaccgttttaaattaaaaattctaattctggagaaaaaaatgcatccaatcgtcattatcggatcaggcatggcgggttataccttagcacgtgaattccgtaagcttaacccagagcaagaacttgtgatgatttgtgcggatgatgcggtgaactatgcaaaaccaaccttatccaatgcttttgcaggaaaaaaagccccagaacagattccattaggtgatgctgcaaaaatgagtgcccaactcaatatgcgtattgaaccttttacttgggtgaaagaaattttagctgagcgtcatgaacttgttctagaaaaagacggcgttatttctcagcaaccctattcaaaattaattttagctgtcggtgctaacccgattcgccttgcaattgctggtgatggtagtgatgacatccatgtggtgaactcactcattgactatcgttctttccgagaaaatctagctcagcgcaaagataaacgtgttgtgattttgggtgcaggtttaattggttgtgaatttgccaatgacttacttcatagcgaatatgatgtaacagtaattgatttagcgcctcaaccattaggccgtttattaccttcacacattgcttcagcattccagcagaatcttgaagaagcgggtgttaaatttgccttaggcacaaccgttgaaaaagtaagtaaaatcaataacggtgaagattacgcggttacattggcaaatggtcagactttggtcgctgatattgtgctttcagccattggcttacaaccgaatatttctctggctcaaagcgcaaatattcaaaccagccgtggtgtgattaccaatagtttacttgaaaccaatcaagcagatatttatgcgattggtgactgtgcggaagttaacggtaccctgcttccatatgtaatgccaattatgcaacaagcccgcgctctagcaaaaacattaagcggtcaacaaacaaatgtacattaccctgctatgccagttgcggtaaaaactccggctgcaccgcttacagttttaccggcacccgttgatgtagatgtaaattgggaaactgaagaattcgacgatggtatgcttgccaaagcaattgacaatgaaggaacattgcgtggtttcgtattgttaggtgcaacagcaggcaagcaacgtttaactttaactaagcttgttccagatcttattcctgcccaagcataa

SEQ ID NO: 1547 - DNA, 1155 bp, Acinetobacter baumannii
  unsure (22): Identity of nucleotide sequences at the above locations are unknown.
ggtcgccttccgcgccggctgnaaaacaccagggctaaaaggaccttaactgctgcgattgcaactatttgtgcaaaaacttacggcggtgaagcgaaagattactcacaaatcgactcagcacctgaagaaaaagcacgtggtattacaattaatacatcacacgtagaatacgattctccaactcgtcactacgcacacgttgactgcccaggccacgccgactacgttaaaaacatgatcactggtgctgctcagatggacggcgcgatccttgtatgtgctgcaactgacggtccaatgccacaaactcgtgagcacatccttctttctcgtcaggtaggtgtaccttacatcatcgtattcttaaacaaatgcgaccttgttgatgacgaagaattacttgaattagtagaaatggaagtacgtgaacttctttctacttatgacttcccaggtgatgatactccagtaatccgtggttcagctcttgcagcgcttaacggtgaagctggtccttacggtgaagaatcagttcttgctcttgtagcagcacttgactcttacatcccagagccagagcgtgcaatcgacaaagcattcttgatgccaatcgaagacgtattctcaatttctggtcgtggtacagtagtaacaggccgtgttgaagctggtatcatcaaagttggtgaagaagtagagatcgttggtattaaagatacagttaaaacaactgtaactggcgtagaaatgttccgtaaacttcttgacgaaggccgtgcgggtgagaactgtggtatcttacttcgtggtactaagcgtgaagaagtacaacgtggtcaagtacttgctaaaccaggtacaatcaagccgcacactaaattcgacgcagaagtatacgtactttctaaagaagaaggtggtcgtcacactccattcttaaatggttaccgtccacagttctacttccgtacaactgacgtaactggtgcgatccagttgaaagaaggcgttgaaatggtaatgccaggtgacaacgttgaaatgtcagtagaattaatccacccaatcgcaatggacccaggtctacgttttgcgatccgtgaaggtggtcgtactgtaggtgctggtgttgttgctaaagtaactgcataa

SEQ ID NO: 1548 - DNA, 852 bp, Acinetobacter baumannii
atgacaatgttaaatgttgataaagcaggccaaattgccgagttgcaacaacgtgcctaccacattcgccaacatgctttacgtatggggcaagtacaaggccaaggctatgttggacaagccttgggtgcagcagatctactggcagtatcttatttccatgccatgaaatatcagccagaaaaccccgaatgggaaggccgtgaccgtttttatctttctattggacactatgcaattgcactctatgcagccttaatcgaagcaaaaattatcccacttgaagaacttgaaacctacggtgcagatgacagtcgtctaccgatgtcgggtatggcttcttacacaccgggtatggaaattacaggtggctcattgggtcatggtcttggaattgcagtcggtgcatgtctagggctaaaacagaaaaagtcggatgcttttgtttataacttactgtccgatggagagctaaatgaaggctcaacgtgggaagccgtgatgtctgcttcgcattggaaactagataacctgattgccattattgatgtgaataatcagcaggcagatgggcactcaagcgaaattttagcgtttgagccaattgttgatcgttggcagtcatttggttggtacacccaacgtgtagatggcaacaacatggaagctttgcttgaggcattcgatcaagcacgaaactatgagggagcatgcccacgcgtcattatttgtgacaccaaaatgggtaaaggcgtgtcgttcttggaaagccgcgaaaaaactcacttcattcgtgttgatgaacatgagtgggacgacgctttaaatattttgacccactacggacagtaa

SEQ ID NO: 1549 - DNA, 669 bp, Acinetobacter baumannii
atgaggatgttttttatgcgcattatcttactcggaccacctggggcaggcaaaggtactcaggctcagttgatctgtaagcgctacaatatcccacaaatttcaaccggtgatatgctccgtgctgcaattcgtgaaggtactgaattaggtttaaaagctaaaagtgtgatggaatctggcggtttagtttcagatgaactcattatcggtttagtaaaagaacgtattgctcaacctgactgcgtgaatggttgtattttcgacggcttcccacgcactattcctcaagcagaagctttggaaaaagaagggatcagcattgatcatgtaatcgaaattgatgtacctgatgaagaaatcgtaaaacgtctttctggtcgtcgtcagcatccagcttctggtcgtgtttatcacgttgtatacaatccacctaaagtggaaggtaaagatgatgaaactggtgaagatcttgttcaacgtccagatgaccaagaagaaacaatccgtaagcgtttagcgtcttatcacactgaaacagaacaattggttggtttctaccaaggtcgtgctgcttcgggtgaaaatgcgccaacttatgacaagcttgatggcttgcgtacaattgaagatgtacaaaaagatttgttcaacatcttagacaaataa

SEQ ID NO: 1550 - DNA, 1119 bp, Acinetobacter baumannii
agtgaggtgttggtaagcctcggtgaaagccgtatattattctacaaaataatgacatattttgatttacttggggaaattatggatattacagagctactcgccttctctgtgaaaaatggcgcgtccgatttacatctttctgctggcatgccaccaatgattcgtgttgacggtgaagttcgtcgtattaacttaccagctctagaacataaagatgtccaccgtcttgtttacgacatcatgaatgataaacagcgccgtgactatgaagaaaaactcgaaactgacttttcttttgaagtacctaatgttgcgcgtttccgtgttaacgcatttaaccaaaaccgtggtgccggtgcagtatttcgtaccattccatctaaagtcctcaccatggaagatctaggtctaggacaaatctttaaagatatttgcgactatcctcgtggcattgtactggtgacaggaccaacaggttcaggtaaatcaactacgcttgcagcgatgctcgattatattaacgaaaaccgctatgaccatattttaacggtggaagatccaatcgaatttgtacaccagtctaagaaatgtctcattaaccagcgtgaagtgcatcgtgacacacacggctttaatgaagcacttcgctcagcactgcgtgaagaccctgatattattttggtcggtgagatgcgtgaccttgaaactattcgcttggcattaaccgctgccgaaacaggtcacttggtgtttggtacactacacaccacgtcggcagcaaaaaccattgaccgtgtgattgacgtattccctgccgaagaaaaagacatggttcgtgccatgctgtcagaatctttacaagcggttatttcacaaaccctgcttaaaaagaatggtggtggccgtgtcgcagcacatgagatcatgattggtattccggctattcgtaacttaattcgtgaaaacaaagtcgcacaaatgtactcagccattcaaactggtgcaaatcatggcatgaccaccctcgaccaaagcttaaaaggcttagtcgctcgcggtgtgattagcccacaaaccgcacgtactgcggcaaaacagcctgaatccttcctataa

SEQ ID NO: 1551 - DNA, 393 bp, Acinetobacter baumannii
agaacaggcccagaagattcaggaagacgcagacaaggacaaggctttaattctgggaaagtcatggagctctacaaataccaaaaaacgtatgcgtcgaaaacgccgcacgaaatcgagcaaatcaagttcttaggcggccgtattccggatccgccagaatattcgtatgcggctgattcaattctttcggcatttagcactatatgtcgatccagacgttatgagcaaagcataccgttatctttagatcagcaggctatcaatgtctatgctgagcataatgatttgccagtggctgctcatatttttaatgactgtatttttgcgttggataatttgtttttggaggagtgccataagaagatatcaaccaaaagcaaaggtaagtga

SEQ ID NO: 1552 - DNA, 963 bp, Acinetobacter baumannii
ataaggataccctcaatgagtgctcgtcattctcggttaattattctcggttctggccctgcgggttatagtgcagctgtttatgcagcacgtgcaaatcttaaaccaacacttattgcaggtttacagcttggcggccaacttacaacaacaaccgaagttgacaactggccgggcgatcctgaaggtttgactggtcctgccctaatggaccgtatgcaagcacatgctgaacgctttggtaccgaacttgtctatgaccatattaatgaagtggacttaaatgtacgtccttttgttcttaaaggtgatatggatgagtacacttgtgatgctttaattattgcaactggtgcgacagctcaatatcttggcttagagtctgaacaaaaatttatgggtcaaggcgtgagcgcatgtgcaacatgtgatggcttcttctacaagaaccaaaatgtgatggttgttggtggtggtaatactgctgttgaagaagcactttatttatcaaatattgctgaacatgtgacacttgtacaccgccgcgattctttacgctctgagaagattttacaagatcacttatttgctaaagaaaaagaaggcaaaatcagtatcgtttggaaccatgaggttgaagaagttcttggtgacaatactggcgtaacaggtgttcgcttaaaatctacaaaagatgacagcaaacaagaagtacaagttcaaggcttattcattgcaattggccataaaccaaatacctctatgtttgaaggtcagctaaatttacgtgatggctatatccaagtacaaagtggtacttcaggtaacgcaacagcgacttctgtagcaggcgtttttgctgctggtgatgttgctgatagtatttatcgtcaagcgattacttcggcgggttcaggctgtatggctgcactagatgccgaaaaatatctagataacctttaa

SEQ ID NO: 1553 - DNA, 1737 bp, Acinetobacter baumannii
acacttcaacctaaatcacatatgccgagcagtctttatagattgctcaggcaaactgttagtaaaaaaaggatagttatgaatattaaagaatatgattacattattattggcgcaggatctgccggaaatgtactcgctgcgcgtcttactgaagacaaagataccaccgttttactgctagaagcaggtggaccagattatcgcttggatttccgtacacaaatgccggcagctttggcctaccctcttcaaggccgccgctataactgggcttatttaaccgacccagaaccacatatgaataaccgccgtatggaatgtggtcgtggtaaaggcttaggtggctcatctttaattaatggtatgtgctatatccgcggtaacgcaatggatttagaacaatgggcaacccataaaggccttgaaaactggacttatgccgattgtttgccttactacaaaaaagccgagactcgtgacattggtggcaacgactatcatggtgatagcggccctgtatcagtggctacaccaaaaaatggcaacaacgtgctattccatgccatggttgaagcaggtgtacaggcaggttacccacgtactgacgatttaaacggttatcagcaagaaggttttggtccgatggaccgtacggttacacctaaaggtcgccgttcaagcactgcacgtggttatttggatatggcaaaaggtcgtccaaacctgactattctgactcacgcgacgaccaacaaaatcttgtttaaccaaaagcaagcaattggtgttgaatacattattggtgctgatcaaaacaacttgcaacgtgccttagttaaacgcgaagtattactttgtgcaggcgcaattgcgtcaccgcaaattttacagcgttcaggtgtaggtcaaagcaccttcttaaaatcaatggacattgatgtggttcatgatttgccgggcgtgggtgaaaacttgcaagatcacttggaaatgtacttacagtataaatgtaagcaacccgtttctttataccctgctttaaaatggtataaccaacctgccattggtgccgaatggttattcaatggtacaggtattggtgcaagtaaccagtttgaagcgggtggatttatccgtagctcggatgagtttaagtggccaaacattcaataccacttcttgccagtagctattaactacaacggtagtaatgcagtaaaagaacatggcttccaagcgcacgtgggttcaatgcgttcgccttcacgcggtcgtatcaaacttaaatcgaaagacccgtttgcgcatccaagtatcttgtttaactacatgtcgactgaacaagactggcgtgagttccgtgatgcaatccgtatcacgcgtgaaatcatgcatcaacctgcgcttgacccatatcgtggtgatgaaattagtccgggcaaacatttacagacagatgcagagcttgatgactttgttcgtaaccatgcagaaacagcttaccacccgtcttgtagctgtaagatgggcgaagacgaaatggctgttgtagatggtcaaggccgtgtacacggtatgaatggtttgcgtgtagttgatgcctcaattatgccgctgattattaccggtaacttaaatgcaaccaccattatgattgccgagaaaattgcagaccaaattcgtggacgcgaagcgttaccacgttcgactgcaccattctatgtagcatcataa

SEQ ID NO: 1554 - DNA, 666 bp, Acinetobacter baumannii
ccctgggaaccgtccattattcccagatccacaagcttaaggggaatatgcatggtttcaccatatctgcattcttttgctttatttttctctttgctcaatccttttttaatgagcatttatatgattggcctcatccgccattcagaaaccaaggtatttaacaaagccttaattcaagggagcttgattgcttatatcgtctttatgctgtttgcatggggtggtgaagcaatctttagtaaatacctgaatgtacgctttgaggctttccagatttttggtggtcttatctttttggtgattggttaccgctatgtgtttcagggtgcagataccattggtgaaatgcgcggtgcacctgaacatttagccggcaccattgccatgccttttatgattgggccgggtaccattagtgcagctgtggtgacaggtattgaaatgtcgattggtgctgcggcacttgtgatcgggtttaccatgtttttaacatgcagtattttgatcttgatgaaattttcacatgatcatttgcgttacaaacatgcaaaatatatcgatcgttatttcgatattgtcgggcgtttatctgctttattaatcggtacgattgctgttgatatgattattaatggcgttaccggactgatccataaagtatag

SEQ ID NO: 1555 - DNA, 483 bp, Acinetobacter baumannii
tgtattagaccaagtaaaaatagttttgttgggaggagaagctatctacatataattttttcttttttacgtatttacagtatttatttacatttaatcaggataagtatatttaaagatgaatatgaaaatgtgaaatctatgaagttaaaaattttaacaatgatgttatgtgtggcattgctcagcggatgtacgaaacaggcagaatctgaggcacctcaaattgattataaagctcaatttgaagagtcggaccgaaaaattggtgaatttttagatcagttagataatccaaatacccctcaagaagttaaagttaaaattttatgtcatgactatcctgaggtgtataaaaaacaatacatgcctgcattaataaaagtttcaccaaaaccgtatactgaagaaaaattattgtcagatttgaaaagtgcaactgactactataaagggactttggggataaaatgcaatgaataa

SEQ ID NO: 1556 - DNA, 831 bp, Acinetobacter baumannii
caggagggaccaatcatgaaatcatatcacccgaagtcccttttaaatgatctgcaatattatattactccacctcatgattgcagctatttagaaaataaatcagcacgcatggtgtttttagacccgattcatcggattgatgtggtgacgctttctgaattatcgcgattaggttttcgtcgtagtggcgactttgtataccgtcctgaatgtcatttatgcaggcagtgtttatcttgtcgtgtacctgttgccgatttccaaatgaacagcatgcaaaaaaaagcatggaagcgaaatcaagatctcaccatgactgttctaccaacacggcaagcctcacaaattcattatgatctatatgaacgttacattaacgagcgccatgccgatggtgatatgtttccaccaagtttagatcaatttgaaaaattcttggtccatagctgtacagatagtttcttcttagaactatggaaagacaatcgtcttattagcgtttcgacttgtgatttaatggatgatgggttatctgccgtctatacgttctttgacccagatgaacaccgtagatctttaggcgtttattcaattctgaatcaaatcgaatatgtaaaaacactcggtttagaatatgtctacttaggttattgggttccccactcagctaaaatgaattataaatctcaatatacgccgctagaacttttactagatgggcaatggcgccgcttaaatagatcattatcaccagaagagatcaatcagttgggcaattccctcatgaccacattaccttctgaatggaataatttaattattaaataa

SEQ ID NO: 1557 - DNA, 864 bp, Acinetobacter baumannii
agcataatgccccaattcgaaccctgttttatttataggaaaacgacacgaatgagcctagagattgaagaagattcgcaagaatcagaaacaacaaaaaatgatgatcggtatttagtaccagggcttgtgcgtggtttagccatcttgcaagcatttaatcaacaagcacaagaaatgacgattacagaaattgccgaaattttggaagtgaaccgttctagtgcatttcggcttatctatacacttgaagcttgcggttacttaagaaaggcttcacaaaaaacatatgcgcttgattcaaaagttatggagcttggttttaacagtttatcaaagctttcattacttgatttatcaacgcctttaatgaaagaactacgtgaccagaccaaacttgcagtacacctgaccgttttagaaggtacacacattgtttttgtaaataacgttcaatctatgggtacgtttaccagcaatattagtttaggtactcgctggcctgcccatgctacagttattggtcaaatgttattatcagatttaccagaggcagaagtacgacaacgctatcgcaattttaatgactgggatagttactcagaacttaccccaaccagtttaaaagcgttattgcaaaaattgaattatgtaaaaactcaaaagtcgatggtgagctggggacattacaaccatgacatggctgcttgtgctgctcctatttttaaacaatcaaatggaaaaatggtggctgtcctttcagtgagttgcccaattaccacttatgatgagaagacctttaaagaagatatcgccgctctggtcatcgcaacggcagataaaatttcaaaatttatctattaa

SEQ ID NO: 1558 - DNA, 1236 bp, Acinetobacter baumannii
acgtattcgccaaaggagcaaaactcgatgcaacaacaagtgattattgtaggtgggggtatggtgggtttaagcctttccctcatgctggcgaaggctaatatcgcggtaaagctattagaagctgtgaaatacccaaactatgatgatcaaaatgttgccccttatcattccagttttgatgcacggaatacggctttatcacgtcgtagcgtacagatttatcagaagttagggctatgggatgccttacaacagcatgccacgccaattttgcaagttcacattactgaacaaggcagttttgggaaagcacgtttaattgcagaacaagagaaagtcgaaagctttgggcaagtcattgaaaatgcatggcttggtcgagttttgttaacacaagtacgtcaacaaccgttgattgagctaattgatggcgtacaagtcactgctttaactcaagacgctgaacaggtacatatcgaagctcagcgtggtgatgaacttttaaagcttgagtcaaaattattaattgcagcagatggacgcgattctttctgtcgtcaagcaattggtgttggtgtcgatgtccacgactatgatcaggttgcgatcgttacgactgttcagacttcaaaaccgcatgagcatgtaggatttgagcgttttagtgcattagggcctttagctttgttgccattaccgggtgaataccgtcgctcagtggtatggcctgttaaaaaaggcactgaaggtgagtggttgggcgaagaaaatgaccaacactttttagatgctttgcaaaaaacttatggtgacagagcgggtaaatttgaaaaaacgggtaaacgctttagttatccgctttcacaagtgcttgcgcataaacaagctgtcggacgcgttattttaatgggtaatgcagcgcatacaatccatcctgttgctgggcaaggttttaatttatgcctacgtgatgcagatgtgttgctacgttatttagtgaaccagttaagcgcatctgatgatattggtaacccagataatttacttgcctatgaacaagcccgtttatctgaccagcagcgagtaattaaattctgcgataccgtagttcggggctttagtaaccaaaacccattattaaaattaatccgtaatacgggattaattgcatttgatgtcattccgggtgtgaagccactggtagcaaactatgcaatggggttaaaagcatga

SEQ ID NO: 1559 - DNA, 549 bp, Acinetobacter baumannii
gagaatacgcctttagttgtatgtatagagactcctatgtttgagcaatctcctgaatctttaagcgatatcgaaattttagacattttacagtcgatgaaaaaagataagctagatacggaagccaatgagatcatccgtaacgggggaaaagcaggacgtcaggaagcacataagcaggctttggtggcactaaatacaaattttgaagagaagtttgtagaggcggttactcttgcactaggtttaaatgcagctcaagctaaaaaaattcgctataaaaaagatcgaattcgtattttaaaagcgcgtggtattgattatcttgctattgatggcgcagagacagcgcaagttttggcacaaatttcacaagcaattgtccgagaagatgcaatagttactcatgacttgcataatattttcccattttggaaagaaggctttccaatggtgcaatttgataatgcctataaaattttacaagaagatattagcttgcactttcatgcgttcttagacgccatgattgagtatgtaaataaataa

SEQ ID NO: 1560 - DNA, 204 bp, Acinetobacter baumannii
aaggcagctttgagcaaacttatcagtgcggagagtctcatgaaaaaatatcaatgtatcgtttgtggatggatttacgatgaagcagaaggttggccacaagacggcattgcagctggaacaaaatgggaagatattcctgatgactggacttgccctgattgcggcgtttcaaaagctgacttcgaaatgatcgaaatctaa

SEQ ID NO: 1561 - DNA, 774 bp, Acinetobacter baumannii
tatacggctttcaccgaggcttaccaacacctcactttaggtgaaaagcaaaaaagttttttgaaaatgagaaccttgtcaatgaattacctgcaagatgcgcgacagcacgtattacagcaaatcagaacagcttgtgaacttgctcagcgtgcgcctgaaactgtgcaacttttagccgtatcgaaaactcatccgagtgaaagattgcgtgaaatgtatgcagcagggcaaagggcattcggcgaaaattatttgcaagaagctttagataaaattgatgctttacaggatttggatattgaatggcatttcattggtcatgttcagcggaataaaactaagcatttggccgagcagtttgattgggttcatggggtagatcgtttaattattgcagaacgcctgtctaaccaacgtggtgatgaccaagctgcgcttaatatttgtttgcaagtgaatattgatgggcaagacagtaaggatggttgtgcaccggaagacgttgccgagctggttgctcaaatgagtcaactaccgaaaatcaggttacgtggtttaatggtgattccggcacctgacaatacagctgcttttgtagatgccaaaaaattatttgatgcggtaaaagaccaacatgctcacccagaagaatgggatacattgagtatgggaatgtcgagtgatttagaagccgcaattgccgctggttcaaccatggtacgtgtaggcacagctttatttggggctagagactattcacaaaaaggctga

SEQ ID NO: 1562 - DNA, 1323 bp, Acinetobacter baumannii
ctattcaagttgtggatgcgagtaaaaaagatgccgaacatcaatccgacactgaatgtacctcaggctaattttttgcagatggaaaagaagttccgcgcatttgtcgctggctttggatcgggaaagacttgggttggatgctccagtttatgcaacaaagcttgggaattccctaaagtacctttgggttattttgctccaacttacccgcagattcgcgacattttctttccaactattgaagaggttgctttcgattgggggcttaaaactaaggtttatgaaaccaataaagaggtggatatctattatggtcggcaatatcgaacgacaatcatttgccggtctatggagaaaccagcaacaattgtaggttttaaaattggccacgccttgattgatgaacttgatgttatggccaaggtcaaagctcaacaggcttggcgtaagatcatcgcacgtatgcgttataagcaagctggtttgctcaacggtattgatgtggccactacacctgaaggttttaagtttacatacgagcaatttgttaaagaggcaaataaatcagaggctaagcgtaagctatatggaatgattcaagcttcaacttatgacaatgaagctaatcttccagatgactacatatcatcactttatgagtcttatccgccgcaattaatttcagcttatttaagagggcagtttgtcaatttaaccagtggtgctgtttaccccgactttgatcgagttctaaaccacacggatgaagaaattaagaaaggtgagcctttactcattggtatggattttaacgtgcttaaaatggctgctgtggtttatgtcattagagaagggaagccaagagctttagatgaactggttggcgtgagagatacaccgacgatgtgtcaactgattaatgagcgctttccagatcacgatattactgtgattccagatgcttcaggtcaggcaacatcatcaaagaacttcagtgaatctgatcatgcaatcttaaagaaaaatggattcaaagttgaagttaatggtgtgaatcccggtattaaagatcgtatcactgcagttaatgcacaaattctgaatgctgagggtgaacgacacttaaaagtgaacacaaacaagtgtcctaactttacggctactttagaacagcaagtctatgatgattttggaatgccagataaaagcgctggtttggaccacgttggggacgctggtggatatccaatagctaagagattcccagtcatcattcagaaaatatttaaacggcgcgcaatcgctggtttttctcgttaa

SEQ ID NO: 1563 - DNA, 924 bp, Acinetobacter baumannii
ttatcatttactgatggaaatcataaatttagagctatcggtgaaataaatgggaattacgaattattaactgatagtgaagatgcaccgagatatgttcaaaagaaatcagttaaatggcttaaattatttaaaccgagcctaaatgtagaacaactatttgacaaagttctatcgcagcaaacaatttataacttagcgaattcaataaatatttccaaacttaaaaaccttttagatagtcatcaaaaggaagataatgataaaaaattcgtgctgattattgacgaaattaacagaggtaatatttctcgtatatttggtgagctcattacattaattgaagagtcaaagcgtcagggggctaaagaacagctatcagttacattaccatattctaaatatgagcttacagttccaaataatctgtaccttattggtacgatgaattcttctgaccgctcattaacaggtttagatatcgcattacgtcgtcgttttaccttcattgaaatgccgccgaaaccagaattattggcaaaagtaacggttgatgaggttaatatccaaaaattattgactgttatcaatcaacgtattgaaatattgcttgatcgggatcattgcctaggtcacgctaatttcatgagcctagagcaacagccaactttagaaaatctctcaaacatttttaagcagaaagttattccacagcttcaagaatatttctttgatgattgggcaaagattaatttagttttaaatggtaatggaatgcttaagccaaagcctgtggatacatcagcaatattcccaaatgtagattctgaggaattagggtactttgaagataaaaaaatttgggaattggtgccgaattcatttaactctattgaaagtttcaaaaagattattcagtactaa

SEQ ID NO: 1564 - DNA, 312 bp, Acinetobacter baumannii
agccgatttacaagcattaactgcctaggaaaaaccatgactaaacgtaaacctaagaaggatgcgtcaatcaccatccatatgcctacagaccacaaagaacagttggcttcattggctgaaatgctaagagcaggacagggtgcaagtgagtatgtgtacgaaactttaatcaagcctcatctccaacaattgaaagctgagacaaagattaaacaaaagattttcggcttaacagagaacgataaaaaccatgagctgcattcagatttatccgtgcgctcagaaacagcagacattaaaaaagcctga

SEQ ID NO: 1565 - DNA, 519 bp, Acinetobacter baumannii
gtcatgcctacattagatgaaatgacaaccgtaactgacgatcagtcagaattaaccatgtcagttttaatgacaccggacatggcaaatttttcaggtaatgttcatggtggaacaattctaaagttgctagaccaagtggcctatgcttgtgcaagtcgttattcaggcagctatgtcgtaacgttgtctgtagacaaagtaaattttaaagaacctatttatgtaggcgaactcgttacatttttagcgagtgtgaaccatgtgggacgtacttcaatggaagtgggtatccgtgtggaggctcaaaatattcaaaagcgtaccgttcgtcataccaatagctgttatttcacgatggttgcggttgatgagcatggtaaaccacgcgaagtgcctaaattaaatttagataccgagtggaaacgttgccgatttgaagcggctgaacatcgtaaggtgttgcgcctacaagagaatcataacccttcttgcagcatgtataagaaaacttcttaa

SEQ ID NO: 1566 - DNA, 525 bp, Acinetobacter baumannii
aaaatgactacacaacaattcgaatcgtggaaacagccggaaggcgcttctttagaagattggttaaacacacgtattgcccgctttgagactcgtaaatatgactttgaggctttgaagttccaagccgattacgacccgaaatatcgccgtgctcaaatgcgctatatgggtacgggtgcaactggtgttgcaaatgacagcaatactgtacctgcagagaactttacgttttcgactatggtgctaccaccacagtgtgaaggtcctttgcacattcaccacgacgttgaagaagttttctttatgctccgtggcgaaattgatttgtttattgagcacaacggcgagaaattccagacccgcttaaaagagcgtgacctgatttcaattccaccgggtatctaccgtggtttatttaacccaggtcaagaagatgccttgatgtgcgtgatgttgggaacaggtaaaccaacaattcctaactatccaccagagcatccattgtctcaaatcaaacgttaa

SEQ ID NO: 1567 - DNA, 1092 bp, Acinetobacter baumannii
aagctcaatacgcgactacgaatctttaaaaaagaatccacttttatgcaaaacagttccggaaagcaaacgaaatatcaccgtgtagattcaagcagcctttcatttaagctgtttttggtctacgacatctttatggtgtttattatcattttcaatctgttctgtcttgcagccaatttctttttaatgagcagtattggggcatggttctttgaacatatccatttgccccaagtattgtctttctaccgtacccatttacacccgtgggttatcacctctgaagcctggtttattggttttctaattattgaactactggtccgttggggaattgctatcgtttataaacatcataagcgttggttcttcttccctttcattcactggtatgaaattttagctattattcctcagctacgttttctacgtttattccgtgccgggattattgcttaccgtttacacgagcttggttattcggttattcctgaaagctggagaaagacaggtctcttttattaccgtgtggttatggaagagttgtcggaccgcgtggtgattaccgtaattgacggtattcgatacgagcttgaaacgagttctagccataaacaaattattcatgatttggttaatcatcatcgtgaacaatttaccgtaaccctaacttccctattacaagaatctttagcaactgctttaaaagaacaaaagcctgcaatcacccgagctgtcggacaaatcgtagatcaggcaatagaagatacgcctgaattaacacaattattaaggcttattccacttgtagggggacgtattgagcaacaaattcaaagtattggtcaacgtcttggtgaaaatatcagtgctggtttaatagaaccgttaattgaaggttcagccacacatcctaattcaacttatcaattaatttctcaaaaaattagccatataaatattgataaccatgaacttgagcagctggttgagtctgtcgtttttgaaacactagaagctgtccgtaaacaagttaaagttaaacagtggcaacaaacactcgcggagtatgatcgaatcaaagaataa

SEQ ID NO: 1568 - DNA, 1347 bp, Acinetobacter baumannii
agaataaataccatgtctgctgccaaaatcggattactgtctcttacagcgctggtatttagttctatggtggggtcaggcgtatttagcctcccccaaaatatggctcaagtcgccaacggctctgcccttcttgttgcatggctcattaccggagtcggcattattttcttggctctctcattgttgcatttaacccgtcaacgaccagatctagatggcggtatttataactatgcacgcgaaggctttggagacctcatcgggttttgctcggcgtggggctattggttgtgtactaccattggtattgtcggttatgtagtgattgccttttcaggcgtcggcatgtttaccgacagcaaagaccacgttatttttggtgaaggtaatacgctctactcactgattggatcaagcatttttgtatggctggtgcactggttagtaagccgaggtattaaggaagctgcgattgtgaatttactggcaaccattgccaaaattattccaatggtggttttcatcttctttaccttcattgcctttaagtttgatctattcaaactcaacttaaatgatttttctttaaaagttcccctttggcagcaagtaaaagacctaatgctcattaccctttgggtatttaccggtattgaaggtgcggtggttttatcatcacgtgcaaaaaaccgtcatgacattggcaaagcgaccattttaggtgtgttgctggcattaagtttttacgtgatggtgacagtattagcttatggtgtggtgagccgtgaagcgcttgcaggcatgcacaacccatctatggcgaccattttgcagcaactcatcggtctaccgggtaccatcattattactatcggcttgattatttcagtttcttcgtcttatttaagttggactttatttgccactgaaattccatatctagctgcaaaaaatggcgcattcccgaaattatttttaaaaaataatcaaaataatgtacctatttcatccctttggctgacaacgcttgtggtgcagggctcactcattgccgtgtattttttcaataaaaactacactcagcttttattgatttcatcggtgatgattttgctgccttattttctggtatcggctttttatcttaaagaatctattcgccacaaacgcacgccgcatattgccattgcaagtgtcgcttcaatctatgcactttggttgctctatgcagcgggtttagacttactgctgttgtctggtgtgttgtatttggttggcttggttattttttcaatcagctactttgagcataaaaaatcgctcaaacaaaaccagcttaattaa

SEQ ID NO: 1569 - DNA, 408 bp, Acinetobacter baumannii
atgataagtacaaattatgttcctttatggcatatctctccatttcaacatgttcaatacacattagctcgaaatcaaattcacatggatctgttattcgaggacatgaataacgttgatacgttcttgtctgttgaaggcgcagcggcgcaagttgatttctattctaatggtgcttatgcagctgttcagttgggagatacctcagaaagaaaattgatagagatctatggcttgcttttacatgaagctgttcatgtttggcagaaagttaagaagctcatgggagaaaaagagcctagttcagaatttgaagcatattcgattcaagcgatcgctcaagacctttttaaaatgtatgaagaaagcgagttaaatgatgggatggaaggggaaaaagccgactag

SEQ ID NO: 1570 - DNA, 501 bp, Acinetobacter baumannii
caaataagcacaccgcccctccccaggtccgatgtgcttttgcaaactgcgagatcaattatgaacgtaaaagctacccctttcaactcctttgcatttgtcagcatggctgctcttgcaatctctggtggttctttagttgcttgccagctacaaccagctttccaaacaaaagaagctcctactctatttactccaaaaacgcaaccaagtacttacggtgtgttaaccgcgaaaatcacaggtaaacattctggcgttgccgtaatcaaattagatagtttccgtttaaatgttagctttgattttgaagctcatccagacagttacggcgttccgggttctgaatttaccgctgttgatattactcaactcacggtaaatgaaattactgatgttaatggtaagtcatataacgatttcaccgaatttgaagacatccgaaacatcaatgtccttctaaaaggcttcatcgaacgtaacaagttggtggaggcttaa

SEQ ID NO: 1571 - DNA, 1428 bp, Acinetobacter baumannii
aattatggcacttcttcaagaggtgcattcataatggtaaagtatcagaaatatactgaatataaagtttcgggtgttgaatggttgggggagattccgagtcattggagattatttgcattaaaaagatctgttgataaatgtactaatggattttggggtgctgagcctgatggaattaatgatctatgtgttttaagagttgcggactttaatcgagataactttgaaataaacctcgataaattaacttatagatcagtacttgctaaagaagcagagagtagacttcttaaaaagggtgacttgcttattgagaagtcaggagggggtgaaaaaactttagttggttgtgtagtccagttcgataaagattttcccgctattacatcaaactttgttgctaaaatgacgcctaatcgtaatatggatagtcgctttctgacctattcttttgctcacttgtatgcaggtcgggtgaattatcctgccattaaacaaacaacaggtattcaaaatttggattccgaggcatatttaatggagaatttttgctttccaccgagagtagaacaaactcaaattgctttgttcctcgaccatgaaaccgcaaaaattgacactctgattgccaaacaagaaaagctaattgaattgctgaaagaaaaacgccaagcggtgattagtcatgctgtaactaaaggtttaaacccgaatgtaccgatgaaagattcaggtgtggaatggttaggagaagtgcctgagcattggaaaataaaagagaataaatatcttttagattttataacaagtggttctcgtggatgggcgcaatattatgccgatacaggggcattattcttccgtatagctaatttaacaagagatactattgagcctaaattagactccttacagtttgttgaacaacctcaaggcagtgagggtgagcgatccaaaattaaaattggcgatttacttatttccattacggctgatttaggctctgtttgtgtagcaaattcatctattcaaaatggttatgttagtcaacatgttgcattatgcagaccacaaaaattatgtgaacctagatggttagcatattacatattatctgacactgctaaggagcaacttttaggttccggatatggtggaacaaaaattcagttgagtttagaagatatcagagaacttgttatagctgttcctcctaaaaaagagcaaatgcaaattgcaaattatattgatgaaaaattaagtcaatttgagtatcttataaaaaaagccgataagttagtaggtattttaaaagaacgccgtacagctcttatctccgcagccgttacaggtaaaatcgacgttcgcaactggcaaaatcctaataaaaataataatcaagataaaatggagttaagtgcatga

SEQ ID NO: 1572 - DNA, 330 bp, Acinetobacter baumannii
aaggcaaggtttacaaaatcattgaattggatgttgtggaaaaaggagccagccatgagtgagtttaaagtcggggattacattgtaattgatcaaaaatatgacaagaccttcatgcccgttttgcaaattatttcagaaggtaagaactatttctattgcaatgatgggcaagtacataaatcgcaaatggaacaatggcgcaaagctgagccagaagaaatagcagcaggccgccgcattgataaaccatcgaatccgagggaattagaaaccctagacaaaccagaaaaccacatttcgccgaattgcgaggtcaaaaatggataa

SEQ ID NO: 1573 - DNA, 789 bp, Acinetobacter baumannii
atcgtattaacattagttaatgtttttggaatatttgttatgtctttacactctcgaattaggcaaaaacttgaagaaaaaaaattaagagccgctgatttagcaagagcaacaaaaaaatctcctgttgctgtaaagaaatggctagatggcactagcgttcctacagcagaaaacttgaaagtcattgcgaaatttttaggtgtgagtgacgattggttgctttatggtggaccggttgaacaggaatcgaacaatttacctcaattaaatgttattaacattgaagcctttaagcagaagtacaatattccagatagtgaagatgctgttaagtttgttcaaacatcagataaaccattccctattcaaaaaagatacgttcccgtcaaagcttattcaaagatgggaatggatggctatttcacagatatgggttatgaaggcaatgctggagatggctatgttccaactcatacagcgggtccaagagcctatggcattaaaggcactggcgactcaatgtttccagcaattcgtaatggctggtatgttgtatgcgaccctgatgcagatcttgtgccaacagaatttgttcaggtgtgtttgaaggacggaaggtgcacaattaaggaatttgtaggaataaatggtggtgttttgagtttattggccgttaatggtggcgaacgcctatcttttgacatggatgaagttggaagtattaccgctattacagatatcgtgccgccaagtcagcatagacaagaacatccttattcgcattaa

SEQ ID NO: 1574 - DNA, 1257 bp, Acinetobacter baumannii
aagaggttaaccatgagccagattgcacaaccaatcacaattcgaaataccacatttaaaaaccggattattaaaggtgcaatgagtgaggcacttgcaaactatgaaggccagccgaatgaattacatttaggtttgtatagtgcatgggccaaaggtggtttgggctgtgcgattactggaaatgttatggtcaatgtagaggccaaaaacgaacctggggtagtggtgattgaaaccgagcgtgacctagagcgtttaaaagaatgggcagcagtcggtaaacaatatgggatggtacaacttatccaattgtctcaccctggtcgtcagtgtccaaagggcctaaataaagaaacagttgcaccttcggcagttccttttagcccagctttagcgactatgtttggtactccacgtgctcttacgcatgaagaaattttggatattattaaacgttttgcgaacgctgctcgtatttgtgaaaaggcgggttttgaaggggtacagttacatggtgcacatggctatttaattagccagtttttatcaccattaaccaataaacgtacagaccagtggggtggttcaatcgaaaaccgtactcgctttttactagaagtttataaagcagtacgtgaagcaacttctgataattttattatttccgttaagctcaactctgccgacttccagcgcggtggtattagcgaacaagatgtgatttcggtatttaaagcagttgatgaagcagggatcgacttaattgaaatttcaggtggaacttacgaagcacctgcaatggctggtgccaaagctgataaacgtaaggcaagtactattgcacgtgaagcgtatttcttagacttcgctgaaaaaatccgtcagcatgtaaaatgtaaacttatggtgacaggtggcttccgtacagtagaaggcatgaatgctgctctagcaagtggggcatgcgactttattggtattgctcgtccacttgctgttgaaacagatttaactgaccgtttaatcgcaggccaagacgttcgctacgccgtaaaaccaattaaaacaggtttaccttttgtcgataaaatggcaattatggaaattatttggtacgcggcacaatttaaagccattgggcagggtaaaaagccaaatcctaaactgtcacctttaatcgtgtttttaaattatgccaagggtaatattaaggctgttgttcaaggacgcgtgaattcacgtaagtcagcgtaa

SEQ ID NO: 1575 - DNA, 201 bp, Acinetobacter baumannii
cttggtgtaaccatgaaaattagtgatctcatgacataccacggctgcaaaaatcggaaagagttgtctgaaaaaactggatattcaactgtgaccctctggaagtgggaaaacaacggtataccagccagaactcaagcagtcctgcaagtcaaaaccaaaggcaaacttaaagccgatttacaagcattaactgcctag

SEQ ID NO: 1576 - DNA, 405 bp, Acinetobacter baumannii
atcttggcaacattacctgatgcaaaggcagaatcagtgcgcaaggctttaactgaagctctgaaatatttacctgcagaactgcgtaaaacgttgacctatgaccgtggacgtgagatgtcagaacataaaatactcgaagaagatttaggcatagatgtatatttctgtgacccacattcaccctggcaaaaaggcacatgcgaaaatatgaatggtttaattaggcaatatttacctaaagggattgatttaaatcaggcagatcagcattatttaaatcaagttgccatgtcactgaatactcgtcctagaaaggcgttagattggcttacaccattagagaaatttgctcagcttgttgattatcatatggcttttgaaactgtcgcacttcatgtttga

SEQ ID NO: 1577 - DNA, 801 bp, Acinetobacter baumannii
atgcatcaaaccgtatcgagatgcaggaagaagctcatggctaatgtagcgttgttgcaaggcaaaaaagttttagtgactggtgctgcacgtggtttagggcgggatttcgctcaagccattgctgaggcaggcgctgaagttgtaatggcagatattttatctgacctcgtgcaacaagaagcacaagccttacagcaacaaggactcaaggtccatgcagtcactgttgaccttgccaatgcagactctattgaaaatgcggttgcaaaaagcatggaagtattacaaggactagatggccttgtgaactgtgcagcgcttgcaaccaatgtcggtggaaaaaatatgattgattacgatcctgaactttgggatcgggtcatgaatattaatgtgaaaggtacatggttaattacaaaagcgtgtattccacatttaaaacaatcggctgctggcaagattattaatgttgcatcagatacagcactttggggcgcaccgaacctgatggcttatgtggcgagtaaaggtgcaattgttgccatgacgcgttcaatggcaagagagttggggaagttcaatatctgtgtcaacaccttgtctccaggtcttactctggttgaagcaaccgagtatgtgccacaggaacgtcatgatttatatgtcaacggaagagcgattcaacgccagcaacttccacaagatttaaatggaacagcattgtatctactgtcggatttgtcctcttttgtgacaggtcaaaatattccggtcaatggcggttttgtctttaactaa

SEQ ID NO: 1578 - DNA, 3702 bp, Acinetobacter baumannii
agatcggggttttctatgtctacgcttgccaccctaaaagcgcttcttgctaaacgcattctgattattgatggtgcaatgggaaccatgatccagcgccataaattggaagaagctgactatcgtggtgagcgttttgctgattgggcacatgacttaaaaggtaacaatgaccttttggttttaacacagcctcaaatcattcaaggtattcatgaagcctacctcgatgctggtgcagacattattgaaaccaacagctttaacggcacacgtgtttcaatgtctgactatcacatggaagatcttgttccagagattaaccgtgaagcagcacgtttagccaaagcagcttgcgaaaaatattcgactccagacaaaccgcgttttgtggcaggtgtactggggccaacatctcgtacatgttcaatctctccagatgtgaacaaccctgcttttcgtaacattagctttgatgaactaaaagaaaattatattgaagcaactcatgcactaattgaaggtggtgcagacattatcctgattgaaactgtatttgatactttaaactgtaaagcagcgatttttgcagtcaaagaagtctttaaacaaattggtcgcgaattaccaattatgatttcagggaccattaccgatgcatcaggccgtactttaacaggtcagacagcggaagctttctggaattcggttcgtcatggcgatttgctttcaatcggttttaactgtgcccttggtgcagatgccatgcgccctcacgtaaaaactatttccgatgtcgcagatacctttgtttcagcgcacccaaatgcaggcttaccaaacgcatttggtgaatatgacgaaactccagagcaaactgcagctttcttaaaagagtttgctgaaagcggtttgattaacattacgggtggctgctgtggtacgacaccagaccatattcgagctattgccaatgcggtaaaagacattgcgcctcgccaagtgcctgaaacagtacctgcttgccgcttaagtggtttagaaccatttaatatttataatgattcattgtttgtaaacgttggtgaacgtactaacgttactggttctaaaaaattcttacgtctcattcgtgaagagaactttgcagaagctttagaagttgcacagcaacaagtcgaagctggcgcacagattattgacattaacatggatgaagggatgctcgattcgcaaaatgcgatggtgcatttcttaaaccttgtagcatccgaacctgacatttcacgtgtaccgatcatgattgactcatcgaaatgggaaatcattgaagctggcttaaaatgcgtacaaggtaaaccggttgttaactcaatttccttaaaagaaggttatgacgagttcgtcgaaaaagcccgcctctgccgtcaatacggtgctgcaattattgtgatggcatttgacgaagtaggtcaggccgacactgctgaacgtaaacgtgaaatctgtaagcgctcttacgacattttagtaaacgaagtaggcttccctgctgaagatattatttttgacccgaacgtgtttgcagttgcaactggtattgaagaacacaacaactacgcagtcgattttattgaagcaacgggctggattaaacagaacttaccgcactccatgatttctggtggtgtgtctaacgtttcgttctcattccgtggcaatgaaccagttcgtgaagccattcactctgtattcttgtaccatgccatcaaacaaggcatgaccatgggtattgtgaacgcaggtcaaatggctatttatgatgatattcctaccgagctaaaagaagcggttgaagatgtcattttaaatcagaatcaaggtgagtctggtcaggctgcaaccgagaaattacttgaagttgcagaaaaataccgtggacaaggtggtgcaacaaaagaagccgagaaccttgaatggcgcaatgaatcagttgaaaaacgtcttgaatatgccttggttaaaggtattacgacttatattgaccaagacaccgaagaagctcgcttaaaatcaaaacgtcctttagatgtgattgaagggccactaatggacggcatgaacgtcgtcggtgacttattcggttcaggcaaaatgttcttgccacaagttgtaaaatctgcccgagtcatgaaacaagcagtggcatggctcaacccgtacatcgaagctgaaaagaccgaaggacagtctaaaggtaaagtcctaatggcaacggttaaaggtgacgtacacgatattggtaaaaatattgtaggcgtagtacttggctgtaatggctatgacattgttgaccttggcgtaatggtaccttgcgagaagatcttacaaactgcaattgatgaaaaatgtgacatcatcggattatctggtctgatcaccccatctttagatgaaatggtatttgttgctaaagaaatgcagcgtaaaggctttaacattcctttattgattggtggcgcgactacttctaaagcacatacagcagtaaaaattgaccctcagtatcaaaacgatgcggtaatttatgttgctgatgcttcacgtgctgttggtgtagcgacaaccttgctttcgaaagaaatgcgtggcgcatttattgaagaacatcgtgctgaatatgccaaaattcgtgagcgtttagccaacaaacaaccaaaagcggccaaactgacttataaagagtcggttgaaaatggttttaaaattgatgaaagctacgtgccaccaaaaccaaatcttttgggaacacaagttttaaagaattatccgcttgctacactcgtggattattttgactggacgccattctttatttcttggagtttaactggcaaattcccgaaaattttagaagatgaagtggtcggcgaagcagcaactgacttgtacaaccaagcacaagcgatgttgaaagatattatcgacaacaatcgttttgatgctcgtgctgtatttggtatgttccctgctcagcgtacagacgcagatacagtcagcgtatttgatgaagctggtcaaaatgttacgcatacttttgagcacttacgccagcaatctgacaaagtgacaggcaaaccaaacttgtctttggcagattacattcgtgctgaccgcgagcagcaagactacttgggcggattcactgtatcgatttttggtgcagaagaactggcaaatgaatacaaagccaaaggtgatgactactctgcaatcttagttcagtcattagctgaccgttttgcagaagcttttgcagaacacttacatgaacgcattcgtaaagagttctggggttataaagcggatgaacagcttagcaatgaagaactgattaaagagaaatatgtcggtattcgtcctgcaccgggttaccctgcttgccctgagcactctgaaaaggcagtgttatttgactggttaggttctaccgacaaaatcggtactaaactcactgaacactttgcaatgatgccaccatcttcggtaagtggtttctattattctcatcctcaaagtgaatactttaacgtgggtaaaatttctcaagaccaacttgaagattatgcgaaacgtaaaggttggacactggatgaagcgaagcgttggttagcgccgaatttagacgactcgattgtttaa

SEQ ID NO: 1579 - DNA, 423 bp, Acinetobacter baumannii
tttgataaaaccgtattgcaaacggaaatccgtcttttttgtcaggaaaatctaatgggcttacgtgacgaaattcaggcagatattgctgaagcatttaatgctgatctggcggacgccgttcattcatttacttgtgagcggatctctaaaacaaattgggatcctaagacagaaacttatgttgaagttaaagaaaattattctggccgtggcgttctgtttggctcatacagtcaatatgagatccaaacacttggagttttggccacagataagaaggctaccgtgcttcaaaatgaagtgtccatgacacctaaaattgatgatgaatggattacaaacttaggctcattccgggtaattcatattaaacaagatccagccgcaactatttggaaatgtcagttgaggaaggtttaa

SEQ ID NO: 1580 - DNA, 1428 bp, Acinetobacter baumannii
aacaacaaaactacgaggaatgtagtgataaggagatataagatgacaaatctagcggatgtagaacaaattagtcatcatcaaaaaaatgcggaaattattgcaagactcgaacgactacccgtcaccggacgattgcaatttatgcgaattaccatcggtatcgcgaccttttttgacgcttatactgttcttgcgattgcctttgctttacctcaactcataaccgaatggcacctgacgcctgcctatgtcggtgcgatcattgctgcgggctatgttgggcaactggtcggtgcaatcttctttggttctcttgccgaaaaagtcggtcgtttaaaagtgctgtcttttaccattttactgtttgtggccatggacatttcttgtctgtttgcgtggagcggaatgtcactgttaattttccgtttcttgcaaggtgttggaacaggtggtgaagtgcctgttgcaagtgcttatattaatgagtttattggtgcagaaaagcgcggtaagtttttcttgctctatgaagttttattcccactcggtcttatgtttgcaggcatggcagcgttttttctgatgccaatttacggctggaaagtcatgtttattgtaggcttagttccatctttactagtgattcctttacggtttttcttgcctgagtcaccacgctggttggcttcaaaaggtcgttttaaagaagcggatcaagtcgtcaaaagctttgaagatggtgctatcaaaagcggtaaaactttggctgaacctgtggttaaagaaattaacccgcaaggcatggcaaaaaccgactggcgtgagctgttccgtggcatttaccgtaaacgtacctttaccctgtggggcatgtggttttgcgtgtatatggtgaataatgccatggtgacttggctgccatctctttacaaacaacactttggtctatcacttcaaaccagtttaggttatggctggattacctcgggcgtgggtgtaattgcctctattatctgtgcgttaatgattgataaagtcgggcgccgcccttggtacagtgcagcatttttcttagcgatcattcctctcatgagcctctcggttttaggcgcaaaatcggcgatggaagttgtaattttcgcaacgattagctatgccattttgcaaaccatttcattctctttatacctttacgctgccgaactttaccctactcgcctacgtgcgatgggcattggttttagtaccgcttggctccgtgccggctctgcaattgggcctgttatggtgggtctggtggttggtggttacggtattcaatatgtgtttagtgtgcttgccgttgtggcgctcattggtggcctagtgactttcttgtttgccattgaaaccaaaggccaagtactcgaaaaactctctccttaa

SEQ ID NO: 1581 - DNA, 219 bp, Acinetobacter baumannii
aaaataaaaaccgacgattcgagtgatgagagaatcgtcggtcaaaaacttcatcaagggtttcggctgctaacaaaacctaatccgaaggaagaaagagtcgtaatgaaaggtcaccgaaacaattttgcggatgccgtgcaaaggaagtattcggttgctgcgaccttgttaacctatataacgtcaagagatcaggattggttgacagaaaaatga

SEQ ID NO: 1582 - DNA, 624 bp, Acinetobacter baumannii
ttttgctcgactgtccgcaaatctttgttagatttctccatgaatgaattaagttttattagaaaaaatttaagatctagaagacgagctttaacccaatttgagcaaaaacaggctcagcttaatgttttacattacctaaatcaccttcctatttttcattcatcaaaaaaaatcggtttatatctgcatgcttttggtgaaatccataccgatcttcttatcaaattatgttttaaaaagaacaaacaagtttatttacccatgatttgttcgatgaaccaacgtttagtatgggtaaaaataaataaaaaccaatatttaagtcgtcgtttttcccatcacccattgggaatgaaagaacctatggcgactcgcggaaaacatgtatcacagcttgatttgctacttatgccacttttagcttgcgatcactatgggacacgtattggtatgggtggtggttattatgatcgtacattggcaagtgctaaacataagccctaccgtttaggattggcacatcaatttcaatttattgaacacactttagaacgtcaaagttgggatcaaccgttagatggtttactgactccacagcacttttattattttaaaagatga

SEQ ID NO: 1583 - DNA, 2403 bp, Acinetobacter baumannii
tgctggcggacgcgggttcaactcccgccatctccaccaagattcgaaaagccccaaatattaattatttggggcttttttattgacgaattaaaattaacagttgtacacaaggttttagtaaacatgacaaatacgaacttttctcaggttgctgcttttatttggtctgttgctgacctattacgaggagattttaagcagtcccaatatgggagagtaattttaccttttacattactacgtcgtttagaatgtgtgtttgagagtagtaaaaccagtgtcttagagacaaatgagaaagtgaaggcgatgcctttaccagaagaagcaaaagaaaaaatcttattaaaggcaacaaagggcctgtcattttttaatacctcagagcttgatttgagtagtttagggcaaaagaatattcgggcaaatctcggtaattacatccaacacttttcaaaagatgcgcgtgaaatctttgaacattttaagtttgatgaatttacgggtttattggatgatgcaaacttactttataaagtcattcagaaatttgcttcaaccgatttaagtccagaaaatatttctaatcatgatatgggcttagtatttgaagagcttattcgacgttttgctgaaagttcgaatgaaaccgcaggggagcactttactccacgtgatattgtacgactcaccactggcctcatttttagtcaagatgatgatgccttaaataaagagggtgtgattcgaacaatttatgacccaactgctgggacaggtggtttcttatcttcgggtacggaatatgtttatgagcataatcctgaagcagtgatgcgtgtttttggtcaggaacttaatccagagtcctatgctatttgtaaagcagatatgctaattaaaggacaagatgtccgtaatattaagctaggaaatacattatctaacgatcagctcacttatgaaaagtttgactatatgctgtcaaatccgccatttggtgtggactggaaaaagatcgaagatgaaattaaagatgagcacgaacaaaaaggctttaatggtcgttttggagctggtttaccccgtgtgtctgatggttcactgttattcttgatgcatttgattagcaagatgcgagatgtggatagcactggtcaaggcagccgaattggtatcatcttaaatggttcacctttgtttacagggagtgcaggcagtggtgaaagtgaaatccgccgttatattttagaagcggatttgcttgaagcgattatcgccttacctacagacatgttctataacacaggtattgcgacctatgtttgggtactcagtaataaaaaagatgctgaacgtaaaggcaaagtgcatttaattaatgcatcgaacctcagctcgaaaatgcgtaagtcacttggttcaaagcgtaactatctaacagaatcagaaattaggacaattacccaaaactacggagcgtttgaagcagtagatacactgactttagatggtgaaagtgaacagcaaaaaccattctcaagcaaaatttttaacagctatgagtttggctatcgccgtgtgaccattgaacgtccgttacgtttatcagcgcaattgtctgatgaccgaattgcaactttacgttttgcacctaagccatttaatgccgtgatgcaaaaagtctatgaaaactatggcaaagattggactgaaacaagctatgggcagttgagtgacgatgctcaagttgaaattcgtgctctgattaaagctgaatttagcgaactgaaagaaaaagatattaaaactgtacttgagccaaaactctggcttgaacaacgggctttaatgcgtaaagcacaaagcttacaaaccaagatcggtacagcacagtttgatgattttaatatctttgatgagctacttaaacaggctttaaaagatggcaatattaaactcgaagcgaaagagaaaaagcagttcttggatgcggtaacttggaagaatgttgaagctgaacctgtaattaataaagtcattaaagcacaagaaaacccgctatacggtcagtttaattacaagggtaaagtggttgagtttgttcaggatggcgatttgcgtgatgcagaaaatattgcgcttgatccaagccaaagcaccaccgatttaattgagtcttattttaagcgtgaagtacaaccacatgtagctgacgcatggatcaatgctgataaacgtgatgcacaggatggcgagattggcatagtcggttatgagattccatttaaccgtcatttttatgtgtatgagccgccgcgtgatttggcggagattgatgcagacttggatgcggtgagccgtgaaattatggcacttcttcaagaggtgcattcataa

SEQ ID NO: 1584 - DNA, 714 bp, Acinetobacter baumannii
atatataggactgttcacatcatgccacaacctatcattgctgcccatcaagttacacaaactattcagattaaccaaaatcaatttacgattttaaaaaatattgatttagagatttataaaggggagcaggtagccattacgggacgttctggttcagggaaatcgactttactgggtattttagcgactttagaccaaccctctgaaggtgaggtgtggttatgtggtcaggcggttcatgagttaacagaagagcagcgcgctcaaattcgaatgcagcatattggttttgtatttcagtcttttcagcttttgccacagttaagtgcgcttgaaaacgtgatgttgccgcttcggttacgtaaagattttgattataaaattgctgagcagaaggccttagattggttgcatcgggtaggtttaagccgtcaagcggaacaaacgcctaaagtcttatctggtggagagcagcaacgtgtggcaattgcacgggcacttattgcagaaccacaaattatttttgcagatgaacctactggaaacctagatggtcaaacagcccaagaaattgaacgactactttttgatttaaatgaagagctcggtacaacgcttattttggtcacacatgaccgtaatttggctggactttgccaacgtcatgttgaattaaatgatggccgactaaagacagtacagggtggttag

SEQ ID NO: 1585 - DNA, 552 bp, Acinetobacter baumannii
agcttttattttcgattcttttttcctagcctatcagtactttatatttatttttttgaggttttattcattatgaaaaaatcattattagcaattgcacttatgagtactcttcttgtcgcatgtaataaacatgaaaataaaacagaaacaacctctgatgcatctactcctgtacaaactgctcaatcaaataataatgaagcggtagatacagcacatacagccgagaattctttagattgggatggtaaatataaaggtacgcttccttgcgcagactgtgaaggcatcaaaactgaattagaattaaaagatgataaaacttatgagctaacagaaacctatcttggtaaaggtgatgcaaacccatttgaaacccatggtaagtttactttcgataaagacaatacttctgttattaccttagatgataaagctcaaaaccgtaaattctttattggtgaaaataccgcgaccgctttagatatggaaggtaaaaaagttgaaggttctttagctgaacattatgttttgaaaaaagaagattaa

SEQ ID NO: 1586 - DNA, 411 bp, Acinetobacter baumannii
tcggcaattgcaccgccaccaatcgctgcagcatttttacccgtggctttagcaccaccacctacagcagcagcattttcatttgtagcctcagctcctttaccaattgccgctgagttatcacctgttgcctgcgcaccactaccaattgctgcagaactgttcccagtcgcttttgctccttcacccggtttattaccagagccaattgctgttgaatttgtacccgatgccaatgagttaatacccattgccgatgcgccatcacctgttgcttgtgcaacagcaccgaatgcagcggcgcctttacccgaagcatttgacatgacgccaaaagcagaagaagcatcaccagttgctttagaagtcataccaaacgcagaagaaaacgctcctgtacctacagcttga

SEQ ID NO: 1587 - DNA, 480 bp, Acinetobacter baumannii
aaaatgagtgcagttttaaaaacacaacaaatggattggtctaaatatactattgacggttggttagagcagtttggcgcatggtgtgaaacagttagaatgaaagggggtgatttgccagatgggcttcatatcaatcaaatttactggttgatgcgtgaagctggcaaagaagtacaaaaaagtaaatcttatattcgatgtgagatcagtgattatgaggcggatcaaattcaagcacttttacgaagtctattaaattctgataaaacagattttacaactaagtttgcattaatttgtttaattaaaaataaggttgaaaataaaggattgttgaaggttgctcaagaaacaaaccaatctaaagctcaggtcgcaattatggtgagttgcgctagattttatttattaggtcatgataaaagattaagacaaaatggaggttcaaatgaaaacatacactgtaaaactatatga

SEQ ID NO: 1588 - DNA, 807 bp, Acinetobacter baumannii
atatcaggtgctgtcatgaaaaagttgatgatgattggttttggcgcaatggcagcagaagtgtatgcccacttgcctcaagatctgcaactcaaatggattgtcgtgccatctcgcagtattgaaaaagtgcagtcacaagtctcttctgaaattcaagtgatttcagatattgagcaatgtgatggtacaccagactatgtcattgaagtggcaggtcaagcagcagtaaaagagcatgctcaaaaagttttagcgaaaggttggaccattggtctgatttcggtgggtactttggctgatagcgagtttttggttcagcttaaacaaactgccgaaaaaaatgatgcccatctgcatttactggcaggggctatcgcaggcattgatggtatttctgcggccaaagaaggtggcttgcaaaaggtcacttataaaggctgtaaaagtccaaaaagctggaagggtagttatgcagagcaattggtcgatttagaccatgtttcagaacctacggttttttttactggaactgcccgtgaagctgccatgaaatttccggccaatgccaacgttgcagcaaccattgcacttgcagggcttggaatggatgaaaccatggttgagttaactgttgatccaactatcaacaagaacaaacacaccattgtggcggaaggtggctttggacaaatgaccattgaactggtgggtgtgccgctgccaagtaacccgaaaacatcaactttggctgcgcttagcgtgattcgtgcttgtcgcaacagtgtagaagcaatacagatttaa

SEQ ID NO: 1589 - DNA, 708 bp, Acinetobacter baumannii
tgctttgccgcgctatgccatgctgagcatgaaacacgaaactcaatattcacggttattcagatcttaagtttaggaaaaaggataaaaatcatgacagaacgtagtccattacgagtcggaattggcggaccagtcggttcaggtaaaacagcacttacgcttaacttatgccgtgccttgcgtgataaatataatatggcagtggtgacaaatgatatttataccaaagaagactcaaactttttaacccgtaatgaagcgatgtcaccagatcgtattgtgggtgtggaaacaggtggttgcccgcatacagcaattcgtgaagatgcctcaattaacttggctgcgattgatgatctgtgcgaaaaatttgatggcttagaactcattattattgaaagcggtggtgataatttagctgcgacatttagccctgagctttctgatttaaccttgtatgttattgacgtggcaggtggtgaaaaaattccacgtaaaggtggaccaggtattaccaagtcagatttactgattattaataaaactgacctcgcaccaatggtgggagcaaaccttgatgtcatggaccaagatgcaaaacgcatgcgtggtgaaaagccatttttattttcaaacatgaaaacacaagatgggcttgaagaaattattcaatttattgagaagcaagggctgtttaaggcttaa

SEQ ID NO: 1590 - DNA, 186 bp, Acinetobacter baumannii
ttttttttagcgcagattgcttattgggtgcagttgacatataaatggccccgaatatccaaaatccatagaaagttgttcaactataactatcgtgaaatgaaatacaacggtatcttagacaacaatgaagaaattgtgatgagtgcacaccttaaagtgcatcaaaatattacaaaaaaataa

SEQ ID NO: 1591 - DNA, 2106 bp, Acinetobacter baumannii
attgaatattttatttttcttctattccttgaggattgtatggcaacagataatccaagagcagttgatgatttaacattatctaaatctaaaaaagacccgcttaaccgtgtggttttttatatttcagctctaatcattttaatcttttctctcgttacttttttatttaacgatttcgcaaatcgaaccattaacaccgtccttgcgtgggtaacgtcaacctttggctggtactatttactggctgcaacgctgtatatggtgtttgtaattttcattgcctgctcacggtatggtgagattaaacttggccctaaacactcaaagcctgagtttagtttactgagttggtctgccatgctgttttcggcaggtattggtatcgatttaatgttcttctcggtggctgagccattatctcattatatgcagccgcctgtcggcgtaggccagacctatgaagcggcacgccaaagtatggtgtggacgctgtttcactatggtttgaccggatggtgtatgtatgccttgattggtatggcacttggttatttcagttatcgctataacttgccgcttaccattcgttctgcactttacccaatttttggaaacagaattaatggggccatcggccatagtgtagatactgctgccgtcatcgggacaatttttggtattgcgaccacctgcgggattggcgtggtacagctgaactatggtttacatgttttattaggactgccagagaatatctggatgcagtttgcactcattgccattgcagtcggtattagtattatttctgtgacatctggggtgaataaaggccttcggattttgtctgaaatcaatatttatgtatcgattggtcttttactgtttattttgttcttgggcaataccgagtttttactcaatgcgctggtacaaaatattggtgattatttaactcgcttcccaaccttagccttacaaagttttgcttttgagcaacctaaagattggatgagcagttggaccttgttcttctgggcatggtggattgcttggtcgccatttgtagggttatttttggcccgcatttctagaggccgtactattcgtgagtttgtgtgcgggactttaattattcctctgttatttaccttaacgtggttatccatttttggtaatagcgcattgcacagtgttatttttgaaggcaaccagactttagctgcaacggtattatctaatccggcacatggtttttatgacctgttagcgcagtacccgggttttacctttattgcttcagtcgcaacagtgacgggccttttattctatgtgacttctgccgattcgggggcattggttttaggtaacttcacgaccaagcttacccatattgataatgatgcgccgcgttggttaagcgtgttttgggcaattgccattgggttattaacactcgctatgctgatgaccaacgggattaccgctttgcagaatgcaaccattattatgggactgccgtttagtttcgtgatgttccttgtcatggcggggctttataagtcgctcagacttgaagactacaggcatgctagtcgaagtatgaacgcggcacctgtggtgggtaacgtcgacattctcaattggaaacagcgtttgactcgggttatgcatcatccgggaacgactgaaaccagacgaatgctcgataccgtttgcaaacctgccgttcaagctgttgccgatgaactcattaagcaaggtatgaacgtagatgtgcaacaaacaccacttgaagatgaagaggcgctatatcacctcgatatcactattcatttggaagaagagcaaaacttcgtttatcagatttggcctgtccgttatagcgcacctaactttagtcagcgtgtaaaacgaggcaaacagttctattaccgtctcgaaacctatctttatgaaggttctcaagacaacgaccttgttggttacagtaaagaacaggttattaatgacattttagataaatatgaaagacatatgacattcttgcatattaatcgtattagccctgggaaccgtccattattcccagatccacaagcttaa

SEQ ID NO: 1592 - DNA, 564 bp, Acinetobacter baumannii
aaatatgtagctaaaatgaatactaaaatcacctatactgctttcactggaagcacgcttattgcgagtgactcccttgttgaacttgcaaagaaactaaaagctcttcctaaaacaacagaaaatattctgatttttaatgatcaaacaggtcaacaaattgatcttgatctttctggttcggagcaagagcttcaacaacgttatgctgaaccggaagaaattaaaaaagttggacgacctaaacttggagtaatttcgcgtgaaatcactttacagaaaaaacattgggattggttagatcaacaaagtgcgagtgcatcagcagtgattcgcaagttaattgataaagagttaaataacccaaattctgaaggcaatattatgctagccaaacaagccatcgaccgctttatgtctgctatgttaggcaatatgccaaattacgaggaagcaacacgcgccttatatcaaggtgatcgagatatatttttaaaaatgattcagagctaccctaaagatttaagagaatatttaactttaaaagctcaaaatgttttctaa

SEQ ID NO: 1593 - DNA, 210 bp, Acinetobacter baumannii
attgcccaagctgatgtagatgtgctgaaaggcccttatctaattcagcatattgctgagtttggatcagctgctgttgtaaatgaattttgttctgctcaagctgtgcaatttgctgttgtaccgcgttttgctgctgttgtagtgggcttaggttttgttcaagtacctgtcttttttctttgcactttttatattcatcggcaataa

SEQ ID NO: 1594 - DNA, 915 bp, Acinetobacter baumannii
gacactatggctgcattaccctcactaagacagctatcatatttagttacgttgtcggaaactttgcattttactgaagcagcacgtcgctcttttgttacccaatcgactttatcgggcggcattatggagctagaaaggctactaggtggcgttctggttgagcgtgaccgtcagaatgtgcgtttaacgccattaggtgagcaagttgttgctcgagcccgtgtattgctagcagatgctcaggatttaatgcgtttaagccgtgaaatgagtgaaccattaacaggtgatcttcatttgggtgttattccaacaattgcaccttttatcctgacacggttacttgatgaagtgcatcaacaattaccgaagattcagttgcatttacatgaagctcaaagtgagaagattgtagagcgcctagaacatggtaatttggacatgattgtccttgccctaccttttgacacaagaagtttaaaagtagctgaaatttcaaaagaaaatttatatcttgtttgtagtaaacaagatacaaatgcacttcaagcaaactcacttgatgaccttgacttatcacgtcttattttgcttgaagaaggccactgtttacgtgatcacgtattaagtgcctgtccaattggtgaacgtaaaaacgataaccgcttaaaagcaagttctctaccaacattggttgagatggtttcttccgatttaggctttactcttttaccagaaatcgcaattgaaaatagtatgatcaaatttaatgatcagattactgcaaaaccaattgaagacgcacctagccgtactttagcacttgttacccgtaaaagtacgccgttgcaaagtgagtttgatgttcttctacaaatcatgcagaaaattaccacaaacttacatgaataa

SEQ ID NO: 1595 - DNA, 957 bp, Acinetobacter baumannii
agcctaatggctgagacaaaaattgctgatgtaatcgtacctgagttatttactccgtacgtattaaataagactgccgagagatctgcattatggcagtcaggcattgtcggggagcttgatgaaaaagtcgcttttggtacagaaggtggtactacagtaaatattcctttctggaatgatttaagcggtgagtccgaagtactttcagatggtaaagctcttggggtaaataacatcacggctggtaaagatattgctattttgcatgcccgtggtaaggcttggggtgcaaatgatttatctaaagcattatctggtgatgacccattgggtgcgattgctgatcttgtagcagattactgggctcgtgaatttcaggggtttaccgtaaatacacttaaaggtgtatttgggtctgcaagcatggcaggtaatacccatgatatttcggctggtactggagcagcagccgtaattgatggtcattcatttatcgatgcatcttataaactgggtgatgctgttgataaattaacagcgatttcaatgcactcattcacaatggcagcactagccaagcaaggtttaattgaaaccgtgcgtgatgctgatggtgtggtgctttacaaaacttttatggatcgccgtgtgattgtagatgacggcatgccagttgaaggcgacgtatttacttcttacttgtttggttatggcgcgattggtttccaagatattggggcaccagttggtgtagaaacagaccgtgatagtttagctggaacagacattcttattaaccgtcgtcactttgtactacatcctcgtggcattaagtgggccggtgatacaggtattgctcctaataacgctggtctagcaacagctgcaaactgggaacgtgtctacgatcctaaacagatccgtattgtggcattcaagcacaagatcaaataa

SEQ ID NO: 1596 - DNA, 945 bp, Acinetobacter baumannii
attttatgggcaaaatggatagagaagggcgtgttcatgactgaatcaagacttacacatctcaagcaacttgaagctgagagtattcatattatccgtgaagtagccgcagaatttgaaaatccagtcatgctttactcaattggtaaagactcggctgtgatgcttcatcttgcattgaaggcattttatcctgcaaaacttcctttccctttattacatgtagatacgggctggaagtttaaagacatgatcgcgtttcgcgataacatggcaaaaacacatggttttgatttaattgttcatcagaataaagaaggccgtgaagcaggaatcaacccatttgatcatggcagttcgaaatatacggatattatgaaaacccaagctttaaaacaggctttggataaatatcagttcgatgctgcttttggtggggcgcgccgtgacgaagaaaaatcacgtgcgaaagagcgtgtgtattcattccgtgatagtaaacatcgttgggatcctaaaaaccaacgtcctgaactttggaatctttacaacggtaaagtgaacaaaggcgaaagtattcgtgtattcccgttatcaaactggacagagttggatatctggcaatatatctatttagaaaatattcaaattgttcctctttatttctctgctgttcgtcctgtggttgagcgtagtggtacgctaatcatggttgatgatgaacgtatgcgcttaaaagagggtgaagttccacaaatgaagtctgtacgtttccgtacgcttggctgttatccattaacaggtgcagttgagtctgaagctgatacattgccagaaattattcaggaaatgctgttggcaacaagttctgagcgtcaaggtcgtatgattgaccatgatgaagcaggctcaatggaaaagaaaaagcaagaaggctatttctaa

SEQ ID NO: 1597 - DNA, 3267 bp, Acinetobacter baumannii
ggtttgtgggcagaccccaagaaatattacgcgagttgtttggaagtttttatgtataaaccaaccacatttgtgtggcagccatctgcagcatcattattcaaaattacagtccttagctctgctttagctgcgttgggtattacaacaggctgttcttcgactccgcaatctgcaaaaacctcgaaaacaaaacaggtgagtggagcaggctatcttgatgcaagcagtctggactctttagaagacttactttcagcaacagatatgcgtgctgtagagggtgaccgtttacttattttaaaacacggtgatgtctggaagcgtatggccgtaggcttcaaaatggaccttaatcattgggatccacgtattgaagcacagcgtagttggtttatctcacgtcagccctaccttgaccgcttaagtgctcgcgcaagtcgttatttatatcatactgttaaagaagcagaacgccgtggtcttccaaccgaacttgcattattaccagtgattgaaagttcatatgacccagctgcaacaagtagtgcggcggcggcgggtttatggcaatttattcctagtactggtcgtatttatggtttacaacaaacgggtatgtacgacggacgccgtgatgttgtggaatctactcgtgctgcctatgagtttttaggaagcttatataaccagttcggttcatgggaattagctttggctgcttataacgctggtccgggtcgtattcaacaggcgattaaccgaaatcaggctgctggtttgccaacagactattggtcactaaaattaccgcaagaaaccatgaactatgttccgcgtttcttggctgttgcacaaattattaaaaacccacgcgcttatggggtttcgttacctccgattgcaaacagaccccatttccgtgaagtcaccttatctgcaccattatctttaaatgaaatcgcgtcggtgacgggtcttagtcgtgctgagttatatgcattaaacccaggctatcgtggtgaaacagtagaccctgcaagtccaatgcgtattttgattccagctgatataagtccttcagttgataacaagctaaaagggatgaaagcaggtggaagttcaggctggtgggcaagtgttacttcgccgtctaagccgaccacaacgacttcaacttcagtcacagttagaactactccatcaactccagctcagccagtaagaccatcgacacctgctaaaacaagtagcagctcggtaacagtaaaaactgcaacacctcgtggttctgatgcgctagctgcttttgcagcgtcagctgatgtaccaagtgcaccacgtattcctgttgcggtcactccggctgcaaatatcaaacctgtgagaacggaaccgccaatttcagcaactgaacgcgagaaaattttagcggcagtgcgtgctgaaggggaaaaggaaacagttgatcaggctttggaaccacaagctactcaagctgaaaaagaccaagttgttgccgagttaaaagcacttgcacctcagggtacagaaattgtcgatccgtatgatggcaaaattaagttaaccgcaattcagaccagccaatctgttgctgagcagcaaggtaaagaagtaagtaaaggttttgcttatccaaaaactttagctgaagatgcaactcttgcaaactctgaagatgctcagcgcaataaagataagccttatattaagactgatacagatgttgtggttgtacaacctaaaggtaagcgtagtacttatacagtacaacctggcgatactttagcagttattgccatgaagaatggtgtgaactggcgtgatgtagctaaatggaaccagattgaccctgaaaagactttatttgtaggaaccagtctatatctctatgatgctaagcctcaagaggcggaaactacggcaaaatcggcagctaaacctgatgtctatgttgttcaagcaaatgacagtttaacaggagtggcaaatcaatttaatttgtcagtgaaacagctagctgaatataacgatttgtctgtaacagatggcttgtttgtagggcaaaaattacagttaaaagagcctaaaggtaatcgtgctgctaaagtagagccaaaggcaattcaagcaagtacacgtcgtattgcaacaaagagttatacggttaaacgtggcgaatatttgaaattaattgcagaccgttatgcattatctaatcaagagttggcagacctaacaccagggttatcagctggtagtagtttaattgtaggccaaaaaattaatgtacctgcaaaagaaatcactgttgatgaagttgatgacagcaaggcttctggtaaatatgaaaagcttgcagcaggtccatcatataaaactgaaagttataaagtgcagcgtggtgatacattatcaagcattgcgaccaagtctaaaattagcctagctgagcttgctgaactgaacaacttaaaagcgaacagtcatgtccaactgggacaaactctaaaagttccggctggtgcattagttcctgatcaatatgttgtgcagtcaggcgatagcttaaatgcaattgcagctaaatataacttacaaaccagttatttggcggatttgaatggcttgtcacgtactgcaggccttcgtgctggtcagcgtttaaaattaactggtgaagttgaaacaactagcaaagtttcggctaaaaataccaaagaagaaacaccagagacctacacagttaaatctggtgatagcctaggaaatatcgctaaccgctatcatttacagttagattacctcgctgcattgaacggtttgtctcgcaacagtaatgttcgtgttggtcaacgcttaaaattaacaggtgatttaccaacagtagaaacagctaaaacggatacggcgaaatcgtccccaaaagctgtagttgcaggaaaaaatactgaaaagtacacggttaaagctggtgagtcgttaaatgctattgcgagtcgtgcgggtatttcagttcgtgaacttgctgaaatgaatgcattaaaagcaaatgccaatttacagcgtggacaaaatattgtgattccaaaaactgtagtggaatacaaagtcaaacgtggtgataccttaattggtcttgcgagtaaatatggtttagaaaccactttattggcggaactcaacaacctaacaccgtcgactcaattgcgtattggcgatatcattaaagtgcctaatttatag

SEQ ID NO: 1598 - DNA, 1425 bp, Acinetobacter baumannii
ctcatccatttcataaaaagcttgcctaaccacagcgttaggcaaagggcttattcatgcttaaaaaaggaatttaaaatgaataaatatttgctatggggctgtattggtttaggcagtgtgagcaatgcttatgcagagcttcctcaagaatttggcaagttagaattaaaactcaacacccgttactggaacgatgaaggcactgcccaccccacgcttgctaatccttcgccttcgtcgagtgaatatgaacaaagtgccttagggcttgagttaaattatcagtcaccgtacatgtgggactggctaggtgtagatggctcactctatgcggtcaccaagttatttgactctggcaagccgagcgctcagcttttagaggtcgaaaataacggcaagctcgatcaaaactttgcgactttaggacagctctacatcaaggcaaaacttggcgataaaggagaaattaagttaggccgccagttgcaagactcgctcttgcttaaaagcaccaataaccgcgcagtgcctgacactttttcgggtgcgagtggtcagtttcaactgaatgatcaactacagacttacatcgcctactatgatcgctggaaaccgcgcagcatggactcatttgaaaaactagtcacggaaaatgacgagcgcattgattacgttggtttgctcggtgccaagtatcagtacaaaaactggagcgtaaatgccgaatatttaaacagcaaagattatttaaaaaagtacggggcgattgctcaatataaattgcccttgcatggcttggtgtggacatttaacacgggtgcttttttctcgcgtgatgatggcaagctgtttaaatgtggtgccgagtccgagctggactgtgtcaaaggtcaagacattaacaaccgtgggaatggttattttatcgatgtaaatgtggcccaaaataaccttgaaggtggtattgccgtttcaaagtttgatggtttttggatagaagataactttgctgtgcactccgcccgcaactcggttttaacgcaagaccacggcaccaacccgtttccgacctctgcgaccattggccccgactttaccaataacgatgaaactgcggttgcccttcgcttgaaatataactggaaagactatgtgaaaggtttaaaaaccgaagcgaagtatatttatggctttggcgctcaccaaagtaacatcagcagtgatattgaaggcaaagagcgttactttgacttaacattaagttatgccttgccgtgggtgaaaaacttagatgtgcgttattcatttttgcattatgagtcaaagtttgaaaatgcagacttaggtgaaaaaataaatggcatgacccgtaaagattgggaccagcaccgtgtatttattaattaccgttatacattttaa

SEQ ID NO: 1599 - DNA, 1404 bp, Acinetobacter baumannii
atgatgcattttaaaatgtattgcaccaatttaattcattactatgctgaggaccgtgcattgaaatataacaacctgaatgaattcctgaattacgtgcaagcgcgtgatccgcatcaacctgagtttttacaagctgtcgaagaggtcatgacaagcttgtggccatttattgaaaaaaatccagaatatgccgagcagggattgctagaacgtttggtggaaccagaacgtgtgatccaatttcgcgtttcatggatggatgatcaggggcagactcaagttaaccgtgctttccgtgttcaatacaattcagcaattggtccattcaagggtggtatgcgtttccatccgtcggtcaacctatctattttaaaatttttagggtttgagcaaacttttaaaaactcgcttacaactttgccaatgggtggaggaaaaggtggttcagattttaaccctaaaggtaaatctgatgctgaaattatgcgattctgtcaggcacttatgattgagctttaccgtcatttaggtccaaataccgatatccctgctggagatattggtgtgggtgcacgtgaagtaggttatatggctggcatgatgaaaaagctcagtaatgacacggcatgtgtgtttacaggtaaaggaatttcatttggcggtagcttaatgcgtccagaagcaacaggctacggtacggtttattttgcagaagaaatgctaaaaacacgtggacagtcttttgctggtaaaaccgtttcgatatctggttctggtaacgttgcgcagtatgctgctgaaaaagcaatgttcttaggtgcaaaagtggttacgctatcggactcaaatggtaccgtttatttaaaaaatggttttacagatgagttgcttgctgaagttatggaactcaaaaatatcaagcgtggccgtatttcagaatttgcttctaagcatggctttgaatattttgaagggaagacaccttggcatattcctgtagatattgccttaccatgtgcaacacaaaatgaattaactggcgaagatgccaaaacgctcatcgctaatggggtaatttgtgtggctgaaggtgctaatatgccatctacacttgaagctgttgagcattttattgaagctaagattttgtatgcgcctggtaaagcttctaatgcgggtggggtggcaacgtctggtttagaaatgtctcaaaatgcgattcgtttaggctggacacatgctgaagtcgatgaacgcttacatgcaattatgaaagatattcatgccaactgtgttagatacggtactaaagaagatggtactgtgaattatgtagatggtgccaatattgctggctttgtaaaagttgctgatgcgatgcttgcacaaggtatctattaa

SEQ ID NO: 1600 - DNA, 483 bp, Acinetobacter baumannii
atgaaaatttacacccaacgtcttgaagatatttctcctgatcaggcatttgaaacggttgagctaacgtttgatacccgacaaaaatcacgttttcgagcggctttagcaagtggcgtagatatcggtgcggatttgcctcgtactggcattttgcgtagtggttcatatattgcaacgcaagagggcgatgtattgcgagttgatgcaaaacctgaacggttaatgcaagtcactgctcagactgaatttgacttgcttaaagcggcttatcatttaggtaatcgacatgtgccattaatgctgacaccaacagctttatattttgagcctgatcatgtgcttgcagaaatggtggaaggtttggggcttgctgtgacagaaaccgatcatccatttgaacctgaaagcggtgcctatgcacagcatagccatgaccatcgtttaagtccaatcaaagctttacaccatgtccactcataa

SEQ ID NO: 1601 - DNA, 1653 bp, Acinetobacter baumannii
ggtcccccttacatgaaaaagtttttgaaataccttctggtattaatcattcttattttaattgcgggtattgttttcttgtttagaccgattgcgtcaaaacaagtacaaactgcaaaagatgagccagttgttgatgctgttcttgttggcggcggtatcatgagtgccactctcggtacttatttcactgagcttgaaccgaattggcaaattcgtatgtttgagcgtcttgaccaagttgctcaagaaagttcaaacggctttaacaatgccggaacaggccactctggctttatggaaatgaactataccgaagagaaaaacggtaagatggaaattgccaaagctgaaaaagttgcttctcagttcgaagttgctaaacagttctggtcatatcaggtaaaacaaggcgttttagctgaaccaaaaacattcattaacccagttccacacattgctttcgtttggggcgataacgttaaattcttagaaaaacgttatgctgccatgattcaaagcccgcttttcaaaggcatgaaatttactgaagacccagctgtgattaaacaatgggcgcctttagtcatgaccgatcgtgatccaactcaaaaagttgcagcgactcgtatggaagttggttctgacgtgaactatggttcaatcactaaacaattagtgaatcacttaaaccaaaaccctaacttcaaattacagacttcaactgaagtgactggcatcagccaaaatgatgacaaaacttggacggtgtctttcaaaaatttgaaaactggtaaaacagaccacgttaaaacgcgctttgtatttatcggtgcaggtggtgccgcggttaaattattgcaacttactggtttaccagaagcgaaacaatatgctggcttccctgtaggtggtgagttcttaattactgacaacccagcaattactgctcagcacacagcgaaagtatatggtcgtgcggaactcggtgcacctccaatgtctgtaccacatattgatacacgttatatcgacggtaaaaaatatgtattgtttggaccatttgcaacgtattcaaacaagttcctgaaaaacggttctcaacttgacttacttgcgtcaacaaacaaaagcaatgttttaccaatgaccactgttggcttggaaaaccttgatcttgttaaatacttggttagccaagtgatgatgtcagatgaagaccgtctcaatgaacttcgtaaatactacccagatgcgaaagctgaagactggcgtttaagccaaggtggtcagcgtgttcagatcatcaaaaaagaaccgggtaaacctgcaacgcttcaattcggtacagaaatctttgcgtctaaagatggtgctgtaactgcattgttaggtgcgtctccgggtgcttcgacttctccatacatcatgcttaacttgcttgaaaaagctttccctcagcaaactgaaggtaagtggaaccagaagcttcatgaaattgtggtttcttataaacaagacttaagcaaagaccctgtgttactcgacaaagttcgtcagtacacaagctctacacttggcttgaactatacatctccgttcaaagctgcaaacgatgaaactgctgctgcccccgttgcaaaagcaaactaa

SEQ ID NO: 1602 - DNA, 753 bp, Acinetobacter baumannii
agcacatattattttggttttatgaaaacactgcctctatctcaatatattttcccagatccggaggaatcagatccagatggtcatggtttaatttgtataggcgctgacctctccccttccacactctatgaagcgtatacacatgggcttttcccatggtttaatgaagatgaacctatttgttggtggagccctgaaccacgctgtatcatttatcctcaaaactataaaccgagtaaatcgcttattcgtaacatgaaaaaatatgattacaccattacggtaaatcgtgcttttgagcaagtcattcgctcatgttcactacctcgaagctatgctaatgaaacatggattagtgaagatattattgaaggctattgtggaatgtttgatgccggttatggctatagcgtagaagtctggcaagaagagcagctggtaggtggtttatatggggtaacgatcggtaaaggttgttttggcgagtctatgtttagtacccaaaccgatgtttctaaaatggctttttatactttaatgttaatcggtcaagaaaatcagcttccttgggttgactgccaacttgtaaatagtcacttaattagtcttggggcttgtacactttctcggcaagaatatcttaaatcgttacaagatgtaattattcacccctctatcaattggaaaaagtatcaagaacgtgtattttcaagtaaaacaatagcattaaatgcaaaattaatggaatga

SEQ ID NO: 1603 - DNA, 192 bp, Acinetobacter baumannii
  unsure (103): Identity of nucleotide sequences at the above locations are unknown.
acggataattataaaaaacggagtacaaatgtcatgaataagaatgtagagctaataaattacattgatgtagctgagacagtttacgaacgggtatatgaanataataaaatttcaaataatttgattgttaatctaaatctcattatggctgagattaagaatcaagctgcacaaaaaagatcaaattga

SEQ ID NO: 1604 - DNA, 966 bp, Acinetobacter baumannii
acaactttctatggattttggatattcggggccatttatatgtcaactgcacccaataagcaatctgcgctaaaaaaaattacacgtggactcactgtaggtacagtcatcacaggtagcactttttttcatggaccacctgtcttagctttaggtttaacaaagctatttaaaaagtcttcaaaaattgatgaaaccaatattcaaattactaatagctggcttggtgtcaataattggctcattgatcatgttttacctaatttaaaatgggacattagcattgacgaaggccttgatctgaatatgcaaggtcgttatttaatgacttgtaaccatcaaagttgggttgataccacggtaaaccagtatttcgggttaacccgtatgccacttacccgcttttttaccaagtgggaactcatctttattcctttcgtgggtcaagcttttaaaatcttaggcttcccaatgatgaagcgtcatacaaaagagcaaatcgcgaaaaaccctgaactcaaagaccgcgatatgatggaagcacgtaaagcgtgtgaacagctcttaagtcaaccttttacattattaaattatttggaagggactcgttttactcaggaaaaacacgaccaacaaaaatcaccatataaacatttattaaaacctaaagcaggtggtttagctttggcgttaaatattttgggcgataaaattgatgctttagttgatatgaccattgtctatcctgatggcgtaccaggttatggcgatttctggctaggcgatgtttcaaaaattgcggtcaatcttcgaaaaattgaaataccagactgggttctcgggggcaattatgaagatgacccagtttaccgtgaacgttttcaacaatgggtacatgaactctggactgaaaaagatcagctcatcgaaaaaatgaaagctcaatacgcgactacgaatctttaa

SEQ ID NO: 1605 - DNA, 594 bp, Acinetobacter baumannii
gcagcttctcttatgtcacctctagaaattttcgcggtcttaattagcctcattggagttggattaacggtaatccgtaatatgtggtgctggctgtttaatttctttgcttttgtcctatatgcctatttgttttacgaatttaagctttatggcgaaacgattttgcaattcttttttatggtcgtaaatttttatggcttttactattggctcaaaggaaaacagcaagatcatgacattcgaatcgagcctattgcagttcaaacagctatcattcaaatgattattgccgcggtaggtggcttagtctttggtttggttcttaaaaactttaccgatgcggcagtgccaatgcttgactcacagcttgcagcatttagcttgcttgcaacttactggaccagccgaaagcatattgcgacatggatcctttgggtatttgtcgatattgtttatgtcggcatgtttatctataaagatctgtttttaacttcagccttatacgcagcctttgtattaatggcagcttatggttggtatcaatgggaaaaggttaaaagaaagcagaacttaggtgctgggcagctttag

SEQ ID NO: 1606 - DNA, 1587 bp, Acinetobacter baumannii
ctatttatatataaaaaatacttaagttatagaaaacttaatacaccgttaaaaaatgtaattgcacagtttaacaattgcaaatttgcgataaaaaaaattaatgtgttgctcataaataactttgagaattgtgctgacatgtttttaagaaaaacactttcgattgcattattagcaactgcttcatcggctgtttttgcacaaggtttagtgcttaataatgatgatttacgtaccgacttaaactggttaaatcaacaaggtgttatcagtattagcacctcaacttggccgttaagtggtgatgaaattcaaagagcactttctcaagcaaaagtgacgcatccagcccaacaaaaagttattaattcagttcttaatgcattaaaagcagataataatacagttaaagtgggtgcttttgctgaaactgatatcaaaaatattcctcaagcattcggtgataatcagaaagctcaataccaaggttcgttagagtttaatgctggtggtgaaaactgggatgctaaaatccgagttaatgcggaaaaagacccgcaaattgatagcggacatgatgttaatgttgaaggttcatatgtcgcaggtaaactctggaaccaatggatcgttgcaggccaaattccaacatggtggggccctggacatgatggtagcttaatccgaggcgatgcaagtcgtcctgtatatggcgtgactgcacaaagagctgtacaaaatgcttttgagacaaaatggttatcttggattggaccttggcaatatcaagcatttgctggtcaattagatgattataaggcagtccctgatgctaaattaatcggattacgtgtaactgcacaaccattaccatatatcgaactaggtgcatcacgtgctattcagtggggtggagacggacgccctgaaagtcttagttctttatgggatgcatttgttggtaataaagataatggaggaactggtgaaccagatccatccaaccaaattgctggctttgatggtcgtttattgctgcaaccgctattccaagttccagtcagtttatatggacaatatgtaggtgaagatgaagcaggtggtctaccttctaagaaaatgtacttagctggtgtggactattcatctagctacaataacatgccgtaccaactttatgcagagtgggcagacacgcgtactaatggtgatgtaagaggtatctcttatgctcattcaacttataaagatggttattaccaacatggttacccattaggccacgcgatgggtggtgatggtcaaatgtattcagtgggtggtgatatccgctttgatgtcatgaaccgtttaagtggtcgtgctatggtagttaaagttaatcaatctaacttggcaattaataaagcattccctaaagatgatgaaattaaagcgcttgatttaacttggacacatttcatcaaacctgatcttccattaaaaattaatggatgggtaagtgattcggatcttgaaggtaatgatgcaggtgcatctattggtattgaaattcctctagagcgtaaaatgtttggtttctaa

SEQ ID NO: 1607 - DNA, 396 bp, Acinetobacter baumannii
aaatatgatttaaataatatgaacaatattgcctattttgaaatccagtcttcaaaccctgcccgcgatgcgcagttttatcaagctgtgtttggttggcaatttaaactcgatgaaagcttacctattgaatattaccgcatagaaacaccttcaattatgggtggactattaaaacgccctgctcaaacaccgccaatggaatatggcaccaatgcatttacctgttcggttcaggtggaaaacttcgatgaagtggctgcaaaaattttagcgcaaggtggcattgtggcaatggataaattcgctattccgggccgcgcttggcatggttactttgtcgatttagaccacaacgtttttggtatttttcaggtcgatgaaaatgcagcttaa

SEQ ID NO: 1608 - DNA, 348 bp, Acinetobacter baumannii
aacttaaaatatagcggtttattttttctcattgagatatccccaaatcatcacgagaataatatgaaattttataaaactattttagttttaggcctcgttgtcggcgattacagcgtttcgggttgtgacctccgcacgcagcaggaatttgaaaaaatttgcctgtcgggtgggcatacccaagccagttgcgactgtatataccaacggcttgaacaagtttattcgcctcagctcatgcaacgcctagaacatgtcagtttgcaaagtcctgctctcccacaggactttgcccctactttttttagtgtgatgcggcggtgcgataaaagcgacatgggctaa

SEQ ID NO: 1609 - DNA, 606 bp, Acinetobacter baumannii
gttggcggatattccattactgtcaaccgactgctgtattgtagccccataatgctggatttgtacaaaattatgggtgtttatcatgcttttaaatttaggcaacgtatgagtgatgaaaagaaaaattggacggggaacatacaattaggcgcaaaaaccgacctaaatgtggttctcaaccaattgtgtaaggcgtttaatagctgtccattttttaagcatagtggaatgattatgcgtgtggtagatgggcacattgaaggctatgttgaaatgcaacctgacctcattggcaatttggcttttcaggttttgcatggtggtgtggctgcaactttgctcgatagcattggtggaattgtggcaatggaacatctctatcgccgttcaacccccgaaaccctgcctgaaaccattaaacaggttacacgcttggcaactgtcgatatgcgtgtagattatttggcaccggggcgtggtaaatattttattgcacgtgccgaagtcctacgtttaggccgtaagggctgtaccatgcgcatgaccatggtcaatgatgaagataaagccattgctgccggtattgcctcatatgcctattaa

SEQ ID NO: 1610 - DNA, 405 bp, Acinetobacter baumannii
cttatggcgtattgctgtacgtatcgtattgccgctttcaattattgtggcaatgattgctgtaattggacaaagtatctaatggaacgcacacaacaagtttgggtcgcttttgcggtaccggaacaacagtttttaatttctgttccatttgaagagggaatgactgctgcacaggcagttcaagcaagtggtttatcaaatcaagttgatttgcctgaaccacttcagctcggcatttttggagtaaaagtagaaactgatgcggtagtacatgcgggtgatcgagttgaggtttatcgaccattaacgattaatccaaaagatattcgccggaaacgtgctgcgaaaaaccctgtaggcagatacattaaaggcaatcgctttaagcaatcagctcaataa

SEQ ID NO: 1611 - DNA, 636 bp, Acinetobacter baumannii
ttcccccatctgatttttttctgcttaatggttatgctttctctgagtgtgttttttaaaggtttaggtattggtagcggcctaattgtagcaattggtgcccaaaatgcttttgttctaaagcaagggcttaaacagcaatatgtattttggttatgtttaatctgtgccctgtccgattcaattttaatcgcctgtggtgtattaggttttgccgaaattatgacagcatcacccatcttaatcacagtcgctaaatatttaggggcaacgttcttattcgtctacggtgcaaaagccttctatgccgcgtttaaaactaaccaaggcatggaacttgatagcagccaaaagcagactttaacccaagcgcttataacctgtcttgcctttacttggctgaatccacatgtctatttagataccattgtactgattggttcggttgcgacacagctagaagataaaatcagttttgccttaggcagcattcttgcctcttggatcttctttttcagtctaggctatggtgcaagatttctaaaaccattatttatcaatcccaaagcttggaaaattttagatttcatgattggttgcgttatgtggagtatcgcaatatcacttctcatctaa

SEQ ID NO: 1612 - DNA, 837 bp, Acinetobacter baumannii
gtttttcttcattatcgcatcgttttaagcaagctattttcctctatgaatccatctatttctctcatacgcgagattgatgcgttattaccacaaacacaatgtggtctgtgtgggcaccgtgacggctgtctaccttacgcaaagtccattgctgaaggtgaagaagcaaataaatgtgttcctggtggacagccagtggcagatgcactggcacaattattaaatcgcccattattacctgctgaaacgagtgtctggcctgtacaggcggatggacgcccacaacgcatgaaggcaattattcgcgaagatgaatgcatcggatgtacaaaatgtattaatgcctgcccagtagatgccattattggtagtggtaagctcatgcatacaattttgactgatctatgcacaggttgtgagttatgtattccaccctgcccagttgactgtattgatctggtcgaagacactcaagcattgccaagcgaacagcaacgcattgcagaacaaaatgatttacgtcaacgttattacgctcatattcaacgtgaagaaaaacgccgtattcaccgtaaaggcccagtggtacgtgctgaaatagatactcagctgtttgcacagttctctcaagcacttgatgatttaccttcaattcagctcatcgagaagccaaaagaagcgattgtaagcgatgcaaaaaccacaattgaattagcgaaaattcgtacacaaattaaaaagttggaaaagcagctcagtgttcgagaagatgccaaaaagcgtcttcaacttgatgaactacaacagcaactcattcaattacaggaggtctga

SEQ ID NO: 1613 - DNA, 969 bp, Acinetobacter baumannii
gtattccttcaaggaatgaataacatgaatagcgccttacaatttagtatttcaccgtacactccatttatgcaggaaaccaaagtcaatttaggcaatggtatcgagctacatgtagaagtaggtggaaaaccagaacatccgactattttgctgattatgggtttaggtgcccaaatgctattttggccggactttttctgcaaatcactcattgatcaaggttttcgtgttattcgttttgataaccgtgatattggcctttcttcaaaagtccgccatcaaggtaaacgtttaaataccatgaaattgatgggacgttttgctttagggctaagaaaccagggggcgccttatacgctctatgatatggcagatgacgtttctatgcttctcgaccgtttaggagtaagcaaagcacatgtgattggtgcctcaatgggtggcatgattgcccagattctcgctgcaaaatatccggaaaaagtagaaaaattaggtttgatgtttaccagtaataatcaaccgtttttaccgccgccgttccctaagcaacttttaagcttgattggcaagccagaatcacgtgatgaagaaggaattgtgaatcacagtttaaaattattccaattgattggttctcctggttatattaaccatattgaagccgttcaaactgcaagaaaactttatcaacgtagctactatcctgctggtgtacttcaacagtttttagcaatattatgtacaggttccttactgcaactggaccgtgaaattaagcaacccactttagtcttgcatggctctcgtgaccgcttacttccaccgagtcacggtaaggccgtagcaaaagcaatttccggtgctaagtttgaattaattgatggaatggggcatgatatccctgcccattttattccacagcttagcggtttatttgcgcatcattttaaatcatcatactag

SEQ ID NO: 1614 - DNA, 501 bp, Acinetobacter baumannii
atcatacttcatctaaattctattgcctattccaacttgagatttgttgagagaccttttttcatgcctatttccaatcaagatttgcgcaaagctggacttaaagttacccttccacgaattaagattttggaattattagaaaattcaaaacaacatcatcttagcgccgaagatatttacaagactttgttagagcaaggggaagatgtcggacttgcgacagtttaccgtgtgttaacacaatttgaagctgcgggtattattcaacgtcatcattttgaaaacaaccattctgttttcgaaatcatgcaagaagatcatcacgatcacttagtatgccaaaactgtaacaaagtcattgaatttactaatgatgttatcgagaaagaacagcattctgtagcagagcaacatgggtttaccttaacgggtcactcattaaatctctatggttactgtaatgaacctgaatgtcaggaagcattgcgcaaaaaataa

SEQ ID NO: 1615 - DNA, 1617 bp, Acinetobacter baumannii
gcaatgtctcatcaatcagacttaatcagccaagacattctggcgtatttaaaacaacatgaacaaaaagaccttttgcgctttttgacttgtggtaacgtagatgatggtaaaagtaccttaattggtcgtttactttatgattcaaaattgatttatgaagatcaattgcaagctgtaacacgtgacagtaagaaagtgggcacaacaggtgatgcaccagacttggcattacttgtagatggtttgcaggctgagcgtgagcagggtattaccattgatgttgcttatcgctatttttcgactgaaaaacgtaagtttattattgctgatacaccgggccatgaacaatacactcgtaacatggcaacaggtgcatcgactgctgatcttgcaatcatcctaatcgatgcgcgctatggtgtacaaactcaaactcgtcgtcatacgtttattgcgagtttgcttggaattaaaaatattgttgttgccattaataaaatggacttggttgaatattcatctgaacgttttaatgaaattcaggttgaatatgatgcgttcgtgagccaattgggtgatcgccgtccagccaatattttatttgttccaatttctgctttaaatggcgataacgttgtaaatccatcagctcatactccttggtacaaggggcaaaccttaatgagtattcttgagtctgtggaaatcaaccgcgagtcaagtaaacatgaattccgtttccctgttcaatatgtaaaccgtccaaatctcgacttccgtggctttgcgggtacagttgcattaggtgaaattaaagttggtgacgagattgtggcgttgccttctggtaagcgttctacagttaaggaaattgttacttttgacggtaaccttgagcaggcagttgcgggtcaagcagtcaccttaacgttaaatgatgaaattgatattagtcgcggtaatatcttagtacgtgcaggcgagcaaccattaatttcaagaagtgttcgtgcttcagtggtatggatgaatgaacacccacttgtaaaaggtaagttgtacaatattaagattggtacacaaactgttccagcaaaagtaactaatgttaactaccgtgtaaatgtgaatacgctcgaacacactcaagttgaagagcttgagttaaatgcgattgcagatgttgtggttgagtttgatgctccagtcgtgtttgaccgttatcaagattcacgttacacaggttcatttatttttattgaccgtttaagtaacgtaactgttggcgcgggcatggtaaaagccgcggtagagtggacggctcatagtaatcctgttactgctgaagatcgtgctgctcgtttaggtcaaaaacctgctgttattggtgtttctgcacagttaattgaaaaagctcaagctttagaaagtttactgattcagcaaggtgtagttgcgatcgcgaaaacaaacttaacagctgagcaattggttctattacgtgagacgggtgttattattatcacaaccgctgtggatggtacagataccgagataactgctgaaacggtagaagaagcagtagagaaaattgtggaattagttcgtctttaa

SEQ ID NO: 1616 - DNA, 789 bp, Acinetobacter baumannii
gtcagaactcaggaaataaagcgtaaaagaggattcaacatgttactacaaggaaaagtggcattaattacgggtgcagcatcagaacgtggaattgggcgagcaaccgcagaaatctttgtacaacaaggtgccaaagtcattattgttgatttagatcttgctcaaagccaaaacactgcaaaggcacttggcgaaggacatatgggtcttgctgcaaacgttgcaaatgaagaacaggtcaaagcagctgttgaacaagcactacagcactacggcaagattgatattttaattaacaatgctggcattactcagccagttaaaacactcgatattcagcgcaatgactatgaccgcattttagatgtcagcctacgcggaacactgattatgtcgcaagcggttattccatctatgaaagcaaacggtggtggaagcattgtgtgcctatcttcagtttcagcacaacgcggcggtggtatttttggcgggccacactatagcgctgctaaagcaggcgtgttaggtctggcaaaagcgatggctcgtgagtttggtggtgaccagattcgtgtaaattctcttactcccggtctaattcagactgatattactggcggtttaatgaatgatgaccgtcgtcacgacattctggctggtattccgcttggccgtttaggtaaagcacaagacgttgcaaatgcagcactatttttggcaagtgacctgtcagcttatttgactggtgtaacactcgatgtaaatggtggcatgcttattcattaa

SEQ ID NO: 1617 - DNA, 186 bp, Acinetobacter baumannii
tgccagactcagcaataccaccaaaatcaaaatgattttcaaatcattctcctgcacttaatgaaagaaaagagccctcacaaagagggctcggtattacaaataatattaaattatttgtctaagatgttgaacaaatctttttgtacatcttcaattgtacgcaagccatcaagcttgtcataa

SEQ ID NO: 1618 - DNA, 462 bp, Acinetobacter baumannii
attatgtatcactatgaagaatgcggtctgagcaatatttggctgcgcaatggatttacaattgaaaatgatgaagactatggtgaactcgtatctattgaatctgttcatgagcttcataatgccattgggttgttcttaattacgcaaaagcctgacttgaatggtgaggaaattcgttttttacgtaaagaactaaacttgtcacagaagaatcttgctgggcttttaggagtcagtgagactagtattagacattgggaagctgatcgcggtttaattggtaaacctactgagctattacttcgtgcattatataaagagcatgttcaaggtgatggcaaactaagaagtatgattgagtcattaaatcatcaggaacgaactttagtaccaagtgaaattagtttttcatatggaaataaccattcatggcatcaaaccaattgtgaaatagcttag

SEQ ID NO: 1619 - DNA, 264 bp, Acinetobacter baumannii
tttgaaaatcattttgattttggtggtattgctgagtctggcactattgttatttttactgtatcaaagctacaaaatgctgagaaaagtacaaaaacaagcgaaagaagaaagaaaacagcaaaagcgtttaaagtaactaaattgggtataagctatacccaacttttattctgcctcaatatttttaactgcaatttgtttttgagcaccaaattcaaagcggtccggccagttgcatacatcggcaaccacacactctga

SEQ ID NO: 1620 - DNA, 1302 bp, Acinetobacter baumannii
aaaatggatcaggacttaactttgcaggacgcgaactatcttaataaagaagataaacgaactcttaccctttcttcattgggtggagctttagagttttacgattttgtgatttatgtgttttacgccaaaatcatttccgacctctttttccccagcacgcttagtccgttttgggccatgctcaatacttatggcatttttgcagcaggttatttttttaggcccttaggcggggttgtcatggcccattttggtgatttggtggggcgtaaaaaactattttcgctttctattttgctgatggcgctgcctaccctgtttatagggattttgcccacttttgaaaatatcggatatttggcacccctacttttgttacttatgcgtgtggtacaagggattgcgattgggggtgaaattccagctgcatggacctttgtatctgaacacgtgcctgaaagaaaaatcggactagcaaatggtttattaactgccggactgtctttaggaattttactaggcgcgctcatgtctttatggatttcacttaattttagtgaaggacaaatccatgactgggcgtggcgtattcctttcattgtgggtggtatttttggactcgttgcactttatttaagaacgtatttgaaagaaacccctgtgtttaaagccatgcaggcccgtaaagaaatttctaaagaaatgcctgtaaaacaagtcttaaaaacgcataaaacagccgttgcaattggcatgttatttacatggtttttaacgggatgtgtggtggtggtgattttagccatgccaaatttgttgattggttcatttggctttgagcgcgcacagacttttgaaatgcaaagtgcagccattgtcatgcaaatggtgggctgtattttagcaggctattttgctgaccgttttggctgtggcaaagtcatgatggtcggtgcgcttgccgtggcacttacagcggcagctttttataacagtttaggtcatgcggcacattcaactatttttggtttatatatgttgttaggtctatgctcaggtactgtcggtatggtgtcgagcagtatggttaaaatgttccccgcgcctgttcgcttctcgggcatttcattttcttataatttatcgtatgcaattgttggcggtatgacgctgcctttagttcattggctcagtcaatatagtgatattggtgcgatgtattatattttcgcgctaaccattttggcctttgtaactgcctttgtgttttggaataagtttgaaaaaaacaggtattaa

SEQ ID NO: 1621 - DNA, 2004 bp, Acinetobacter baumannii
agtccaatccaagctgagccgaaattgttcaggcacagctttacaggcataatgatgggtggggaaatacattcgataaaggaatgcacaatgacaaaatccagccattatttagtgcttacaataatgggactgctgagcggttgtcaggtcattcatttaaaagaaagtaacttaagcagtgctttaaaaagtaaaaatgaaagcattttgaccgataatactttaagtcatcaaacccaaaacttgctgtatttggtcaaagaaagtgaaacgtcttgtctgcaaaattttaatgtctgtttaaataaaattcagggattgtcagaaaatagcagccgagaagaacgttatgcggcgctgagtgaaatttatttggcaaaagctttagatgttgggcgtagtagccagtgcaatgccactcttaaaagtaacagttgtgttgagcaagagcttgcgttgtttgataaaagcttgcgctatagctatgtctatttatttgactctgaagagtcgccttttgatcgggtatttgaccatcgccaaaatcaggtacgtattttttataacgtcgccttgtcgaagctcatgaccacgtattttaatcatttaaatacgcttcatttcccacctttactaaaagcagatgggcatgagtaccacgttaactttgatcatgctgtagatgtacagcatattgaagtcgatacctttcgctctagctataacatgaacttttcagggtttaatactgtcaaccgtaaggatggcttaggcgcggagtttattgtggggcgtaaggagcatgatgtaaatcatggttttattttagatcccgacgctttttatgctcaccagagtaatcccaacattcatttaccacgtttctttccagtcacggctattgcttacccaaaacaaaaggccacagccgatcaggtcattgatggggcagagttagaaattgccatgtttgacccataccgacaggaccgcgtaaaagttgaaggcgtggactatccgctcactgccaactattcggcgccttatgggctatggttatcgaaatataatttaggtgcagcaggctattggtctttaattaataaagaagccaatttgattatgccgcatttatatatgctggaaccctttaaccctaataagaaaattattgtgtttattcatggcttggcaagcagcccagaggcatgggtgagcctaaccaatgacattatgggtgatgccgaattaagacaaaactaccaggtttggcaggtgttttattcaaccaatatgccgatttttgaaagtcgttttcagatttattctttgctgaatcaggcttttcaaaacgttgctaaagacagttatgccgcacatgatgccgtattggttgggcatagtatgggcggcgtgattagccggttgctagtaagcgatgcagatgtttctgatttagccatgcaaaaaatgaatgaagcacagctaaagcgtttaaaagaaaatccggttattcgagaacgttttcagttcaaagatttgccctattttaagcgggttatttttgtttcggcgccgcatcatggtactgactatgctgaccgatggtttacccaaattgctcgccgtattattcgtttacctgccgacttttttattgccgttgaaatgagagatgagaaaaataccaaactcagaaaaggcttaattgaaaatggagcgagtaatttaagtcgttcttctaactttatgcagttgacccaagccattcaaccctcgtctaacgtggtctatcactcaattatgggcaatataaatggcactacagataagtcaaaaatgagtgatgggattgtgccttatcaaagttcacatttgggtggggagcagtcggagctgattattaaaggtgggcattcgattcaaactagccctgaggcaattttagaattacgccgtattttacgattgcatttaaagcagtcacagccttcaaaatag

SEQ ID NO: 1622 - DNA, 1329 bp, Acinetobacter baumannii
tttgtgagtctctttcaaaatatcattatcatcgtactgctcatcatcgcagcaggctttttatctttaactgaaattgctctagctggtgccagaaaagtaaagttaaagattttagccgaagctggcgaagaacgtgctcaaaaagtacttgatttacaagaacaatctgcagacttttttgcagcgtcccaaatcggcttaaatgctgttgcaatcttaggcggtatattgggtgaagctgcgtttcgtcctttttttgtgaacttagttgaccgtttctatgaaggaccttggacgcaaactattggatttgccctatctttcacattggtaacttctttgtttattttattcgccgatttaatgccaaaacgcttggcaatgatcgcacctgaaaaaattgcaattagtgtaattaaccctattcagatttttatcaaaatctgtaagcctctagcatggggaattaatgcaattgccaatttgctatttcgcttgtttaaagtaaataccacacgcgaagacaatattacttttgatgatatttcagcagtgatggatgcaggtgctcaagcaggtgtactacaaaaacaagaacatcactttattgaaaacgtatttgagcttgaagaacgtacagtcccatcaagtatgacaacacgtgaaaatgttgtttattttacgcttaacgagcatgaagatagcattcgccaaaaactggcagaatatccttattccaaatttctggtttgtaacgaaaatattgatcaagtgattggctatgtagatgctaaggatattcttgtacgtattttaaacaaccaatctttaacccagctcaatgaatcgactattcgcacggttctaatgatacctgatactttaacactatcagaattactcgatcgcttccgctcaacaaaagaaaagtttgctgttgtaattaatgagtatgcgcttgtcgttggggtaattacgctaagcgatatcatgattactgttatgggggattgggttacccctatggaagaagaacagcaaattattaaacgtgataataattcttggctgattgatggtagtacacctattgaagatcttaagcatgcgcttgaaatggatgaactaccagatgaagagaattatgaaacactagctggtttcatgatgtaccgtttacgcaaaattcctcgtccagccgactttgttgaatttggtggttataaatttgaagttgttgacgtagaccattttaaaattgatcagctattagtaacacgtgtattagaaaaaaatgatttaccatctccacctgatgaaaattga

SEQ ID NO: 1623 - DNA, 3087 bp, Acinetobacter baumannii
aatgtaggtcttcacatctctaaaccaataattaaatgggttacaggacagtatatgactgcggtgtcaagtgtttatgcacagcgcttattgatgacattattcttggtctcttttgggatttatatgtttctggcgacagtaacatatacaccatttgatccgggctggatgcatatttcaagtgatactcagcaagtatccaatgcaagtggtattgccggtgcatggattgcagatttgctgtttggctttttaggttgggcaagtttacttattccaatcttcctatttgttgaagcgattcaagtctggtggccacatagttttctaaaccgcccattccgttatgctgcgcagttcttcttaattcttgttgtgtcgagtttgctttaccttcactggaatgtacctgcagatactttagataatgcggcaggcgggattattggttatgagttggggcaaagcttatctcaactgttaacaatttatggtgcgacattatttctacttgttttcggagtggtattgttcactttggcatttggggtgcagtggagcaaaacatgggttacgctcaaagcaatgcctggttatttacaagatttattctataaaaatgtatctcctaacgaatctgcttatgacttaaccacacagcctgcgaataaagcagcaacggtaaaagttgcagagatgcctaaagcagaagaagttacggatgaagtagagctaaatgcccaaccagaaaaagctcaaagcaaagcaagctctacacgacatgatgaaatagcagagcgtttatttgccgacgttttagctaaagaacaaagccaacctgaaacaattgaagaaaaaccaactcctcagccagaaaactttgagcgtacacttgagcaagcacagcagcttaaaaaagacagtgagcgtttagtggctacgggagaggtttggcgtgctttacagcgtgatgatgtaagccataaacaagaaattgatgcgctgttaagagctgctgatgattcaagtgaacagccttcgactcatgagcaatttcagcaaacagtttatcaggctaaacaaaatcaaccatcgaatactcatcaaggtttagattggaatgatgatgagatttttgatgaactacttgctgcagttccaaatagtaaaacagcaactgacgtgcatacgccatttgtgcaagatcatcatgttgaaccagaagttacgccgcaagctcctcaaacattagttgagtcatctgtacctgtatcgaatttaaatcagtcacctaaaaatttatctaatgaagaagtctttgatgattttgacgacttattgattgatgaagatatcccgccagcaactcaaccgatcaaggcaagtagctatgcgcaatcttcagcttttgtaaaagcgcctattcaaactacgattggtgcagagaagctgtcaaaagaagaatttattgaagcttggcaggaaactgctggaaagcctcaggatgaccttgaggatgagtttgattttgatgcgcctttaacagatgcatcaggtcgaccaatgtctcgtgccatgcaggtggccaaaaagcgtttagatttaccaacattaccgggctttgaattgcttgataaggttgacccaaataagaaagttaactttaccgaggaacagctttcccgtttatctgaattacttgagatcaaattacaagagtttaatgtgaaggctcaggtggttgaagctcagccgggtccagtggttacacgttttgaattagatttggcaccgggtgtgaaagcatctaaagtgactaatatttcccgtgacttggcacgttcaatgtctatggcttctgtacgtgtggtagaggttattccgggtaaaccatatattggtattgaagttccaaatagtgctcgtgaaatggtacgtttgattgaactattggaaacacccgcatatcgtgacccaagtgctctcattagtatggcaatgggtaaagatatttcaggtaatccggtactaacagacttggcaaaagcaccgcatatgttggttgcgggtactacaggttcgggtaaatctgttgccgttaactcgatgattttatcgatgttactcaaatatacccctgaccaattgcgtctgattttaattgacccgaaacagcttgaattagcgaactacaacgatattccgcatttattaacacctgtcgtcactgacatgaaagatgcagtgagtgcattaaactggtgtgtaaatgaaatggaacgccgttataagcttatgtcgttcttaaaaattcgtaagttaagtgactacaaccgaaaagttgaagaagcgcttgcaaatggagaagacttgattgacccgacatggaaaccaagtgactcggcgacacaagagcgtgcgcctcgtttaacgccattaccatctattgttattgtggcggatgagttcgctgacatgatcatgcaagttggtaagaaagcagaagaaatgattacgcgtttggcgcaaaaatctcgtgctgctggtattcacttattgcttgcaactcaacgtccatcggtagatgtcattacaggccttattaaagccaatattccaacgcgtgtagctttacgtgtaaacagtaaaattgactcacgtactattttggatgcaggtggtgcagaagacttgttaggccatggtgatatgctgttcttagggccaggtaagattgagccagaacgtgtgcatggtgcatttattagtgatgatgaagttaaccgtatttgtgatgcatggcgtgaacgtggcgaaccagactacgtagatgagatcttaactccatttgatgaagagcctgcttcacgtggctttgaagaaggtgatggtggttcagaccgtgatgcactttatgatcaatgtgtatcgtttgttttagaaactcgaaaagcttctacgtcttcattacagcgtaagtttagccttggttataaccgtgccgctcgtatcattgaccaaatggaagagaatggtattgtgagtgctatgggggccaacggtaagcgcgatattttagtttaa

SEQ ID NO: 1624 - DNA, 1680 bp, Acinetobacter baumannii
ttttttttgcaaaggggaatttttatgtctgagcataattcgattcaatttgatccaacagcgttgctcatcattaaaaatgaaattgataattcaataaaactggtggaaggcgctgtaagtaccttaattgaagaacaggctctcccttttggtattgatgatgcattagaacaatttaaacaatgtactcaagtcttacgtctcattgatattccgtatttggcaaaaatcactcaatattcaaccgagttgatgcaaaagattatggcgaatccagagcgcatcaatacagatgacgttgttgctttaagtgaaggcacaaccatggttaaacgttatattgagttcatctgtttacgtgaagtcgaagtacctcagtttcttttagacaccttaaataatttagaaaaagccttaaataagccactaacctcttctggacaacagattgcgtcaaagctttcaacagtttcacttgagttaccgttacccgaagtgcttattgaagtgcttattaatgaaagaactcagtttatccatcagctttataaattatcactacatcaatttttaaataaaactgaaagtgctcgagactttcaagcatttaaactgattggcggttatttagtgagtatggctcaaggtcaaccaagccagcaatactggcaattggtaaactctgcctttagtcatattgatgaacttgttttaaatgatgctcgcctacgtgtgttcattaaccttgaaaatgccataagtttatttttagcttcacctgaaggctttgaagcaaacttaactgctctagcagatatcctgagtattgtgattggacaagaagaccaacttgcgcagcaaatccgtagtcagttaaacattggtcatgagtttctcaccgacactcaactcaaaaccctgagccaacatttgtatggtccagactttgataccatgcaaacagtaagtcaattaatcttaagcgaaatgaacaaagttcgtaatgatattgaatataactaccaaaacatgtcaccagaaaaagctcatcaactacaaagcaatcttatgcagcttgctcatacttttaaattactcaacttaaacgaggctgcttcagagctttctcaacaagccagcagtttaagccaaatcaatatattgagtaatgaaaactatgctcagcagttgatgaaaagcattttatctgccatgaatgccattggtattttggtgcgccattattcatctaaccgtctacaaattcgtgtgaacaataccaatatctctctagatcgtttagatgaagcacatcagacattattgaatgagaccaaaaatttaaccgactttgtatgccaaagtttgactctctatgccaacgatcaaactcaaaatattgaagcaattgcaggctctttaaaagagttggctggcgcggctgaatttttaggaagtacagttcaacaaaatgctttacttgaaactgccaagtttgtacaacagcaaatcgatcaaaatcagcctttcaatcatgatcagattcactgtatttttaacgttttagctgggctagatatgttagttgacaatttaaaaaataaacagcctgttctacaatccatgtttgatgtagcattgctaagtagtcaacaacttcaaaaaaaggcagcttaa

SEQ ID NO: 1625 - DNA, 456 bp, Acinetobacter baumannii
caacagctgcaaactgggaacgtgtctacgatcctaaacagatccgtattgtggcattcaagcacaagatcaaataacaaaaaggcgggttacaccgccttattttttggagatccacaaatgggactttcatcatttaaccgtgcacgggaaagacaacaaatgacagaaacaaaaattgctgaactcgaagaacaactggcaactgttaagggcgaatttattgcttttcaaaatgatcctgaagcaatgaaagcacgtattgctgaacttgaatcaggtaataatggtcaaaaaccagaagatgtccaaaagcccagtgatactcaaccacaaccaattaactatgcaggtctaaaagttgatgagttgcgtgcggtcttgactgaaaaaggcattgcatttgaagcaggtgctaaaaaagatgaacttttagcattaattccaaaggaataa

SEQ ID NO: 1626 - DNA, 1842 bp, Acinetobacter baumannii
tactttatgcaaaagttatattctcaactgagcctgctagtcgggctcagtgttttttcgcaagttatattctctgctcagcaaaccacgccgtatatcgcaattcattctaagcctaaatatctggcaatggctgctatgccttatgccaacccgaatgcacctaaaggcggagtattgagtcaggctgcgcaagggacatttgataacttaaacagtatgaacggtaagggaaatgcgacagaaggggtaaattatctttttgataccttaatgacccagtcacttgatgaagtgggcgtgttatatccactcttggcagaaaaagtttcgtatgatcctataaaaactcagtcagttactttttatttaaacccaaaagctcgatttagtaatgggctgcccgtaacagctgaagatgtgaaatttagctttgatacctatcaaaccaaatctaattttggtctacaaatgtatcttgcagacttagcgaaaacacaagtgataaacccacatcaagttaaattcacttttaagtccagccataatcctaaaatgccatttgttgtggcgagtttaccgatttactcaaaagtagattggcagaaacgcgattttacccgtattagcttgcaaccgattataggttcagggccttacgtggttgagaaaattgatgcaggtcggagtattagttataaacgtaatccaaattattgggcaaaagacttacctattaataaaggacgctataacttcgatcatttaaagtatgtttattatcgaaattgggacattgcattcgaaggttttaaatctgggcaatataccttgcatgaagaaactaatccaaaaaaatgggtcactgactatcattttccggctgtaaaagcaggcttggtaacgcaatataaatttagacatcataaccctattgcaaccgagagttatgtttttaacacacggcgcaaacctttcaatgacatccgctttagacaagctttaacttatgcctatgattttgaatggcaaaataaagctttgttttacggacaatatcaaagactacaaagttattttgaaaatagtgatttggcagcgacaggtcgtccttcaaacaatgaactggccatattaaagcctcttttgccaaagctttctccaatcatgcaaaaagctgttttggctgattggaaatatccagcctcagatgccagtggttttaaccggcaaaatttattaattgctagacagttattgattcaagcgggttataaaattaaagaagggcagttatatacgcccgaaggcaaacctgtaaaaattgagtttcttattcagcaagatggcaaacaaagaacactgatgccatttgtaagaaatttaaaaaaattaggaattaatattaatttacggcaggttgatgcgccgcaatatttagagcgtacacgccgttatgactttgacatgactacgatgaatttgccgcaatctttaaacccgggcaatgagcaggctcagttctggggaagtgcagcagcagttcaaaatggcaactataactacgctggtattcgtaatccggtaattgatgaggtcatttcaaaactggtgactgccaaagaccgtgaacagcaaatcacttatactcatgttcttgaccgattgcttcgtgcaggatattaccagatcccgacttatggaaaaggggattattggtatgcgtactggaatatgtatcagcagcctaaagtgaaacctgtgctctctgccggtatagagtattggtggagtaatgcaaaccaagctaagaaagttgctcaatatttacatcaacaataa

SEQ ID NO: 1627 - DNA, 1122 bp, Acinetobacter baumannii
cactgcatgcatattgcaatcattggcgcgggcataagtggattaatgtctgcgctggagttggttgaacaaggctgtaccatcagcatttttgatcaacaacaagcgggacaagcagcctcttgggctggtggaggcattctctctccgatgtatccgtggcgctatgtgcatgcagtgaaccaacttgcccaatttggcaaagcctcttatcaagcatggaaccaaaagctctaccctgttacagggattgattttgaaattcatgacacaggcatgctgatttttgatgaagaagattttgacgtcgggctttcctatgccgagcagcatcaagagccgatgcagcgctgtgaatatttacaaagagatgcgctagagcaagttaatcctcatatctccgatcagtttcaagaagcgatttatttccctgaactgtctaatattcgtaatccacgcgtattacagtccctgattagctatttaaagcaacatccaaatgttgagttttttgaatacactcctgttaaaaaactgattcaacaaggcgacgtgatacaagcgctccaaaccgaagatggtcgcaaacatacagcagaccattttgtaataacttcaggcgcttggagccattactggaactcacaattacaactcgaaattccagtcgaacctgtgcaaggtcagatgctgttatttaaaactcctgctcactggctaccgaccatgtgtatgaatcgagtcatgtatttgattccacgtatggacggtcatattgtgtgcgggtctagcatggcacatcgcggctttgacacctctaccgatgaaactacacagcacaatattttagaagcgtgtttagaaatggtgcctgaactggccgatttcccgattgtacatcgttgggcaggactcagaccaagttcaccaaatggcgttccgtacattggcaaaatgcctgaaatggataacctctgggcaaactttggtcactttagaaatggtttgtgtatgggcgcaggttctgcgcaattgctccgtcagcttatgctcggtcaaccgaccttagttgatgccaaagcatattcaccagagcgtttgcaaaataaaatcttagcctga

SEQ ID NO: 1628 - DNA, 2469 bp, Acinetobacter baumannii
aaaacatggcaacctcgttgtcactcattaggagtgcccatgtctgaacttattatgaatgaaaaaactgacttagagcctcaggttccaagtgtattaccactattagccttacgtgatgtggtggtttatccacacatgcagattgcgctatttgtgggtcgtgaaaaatcgatcaatgcagttgatgtggctcgtaacagtgacaatttagtatttgtagttgcgcaaaaagattcgcttacagaagaaattgatcacgacaatttataccagtacggtacagtcgctaagattgtacaagtagttaatcatgaaaatgatgaaaactgcattaaagtacttattgaaggcttacatcgttctaagttgaaaaaaattatcgatgaagatagttatttgactgccgaacatgaattaagtccaatgacgattaatgtagataaggcaacgcaagaaactcgtttacaagagttacgtaatttatttgctcaatatgcagaagcaaaattacgtaatgcacgtgaactggttgctgctgccaacaaaatcgaagacttattgcaattgatgttcttcgtagcaactcgtgtgcctctaaatattgaaattaagcagaaatttttagagtacgatgagtttgaagctcatttgcaggagttgatgaactacttgatgaatcaatctgctgaacagcaaattgagcaaactttacatgacagcgtaaaacgccaaatggaaaagaaccaacgtgaatactttctaaatgaaaaaatgaaagtcattcaacgtgaactttccgacatgaatggcggtgctgaagatgacgttgctgaaatagaaaaacgtcttgctgaagctgatttacctgaacacgtacgtaaaaaagccgaagctgagttccgtaaacttaaagcaatgcagcctgcatctagtgaagctgctgtggtacgtaactatctagaagtgattctagatacgccatggaacaaagcgagcaaagtcagtattaacctgaacaaagcacaagagattcttgatgccgatcattatggtcttgatgacgttaaagatcgtattgttgaatacctagctgttcaatcacgtgtgaaaaaactcaaaggccctatcctttgcttggttggacctccaggggttggtaaaacttcactcggtgaatcagtagcgaaagcaacaggtcgtgaatttgttcgcatggcgcttggtggcgtacgtgatgaagcagaaattcgtggacaccgtcgtacttatattggtgcgatgccaggtaaaatcgtgcagtctttaacaaaagttggtgtgaagaacccattgttcttactcgacgaaattgacaagatggcacaagactaccgtggtgatcctgcttctgctttgcttgaagtgcttgatccatcacaaaacagtaagttcaacgatcactatttagatcttgatcttgacctttctgaagtgatgttcatctgtactgcaaacagcatgaatattccagaagccttgttggaccgtatggaagttattcgtctaccgggttataccgaagatgaaaaagttaacattgctgagcgttaccttgttcctaaagcaattaagaacaatggcctacgtccaaaagagttaactattcatgaagaagcgattcgtgacattgttcaacgctatacacgtgaagctggcgtacgtaatttagaacgtgaagtttctaaaattgcacgtaaagtcgtaaaagaagcggtaagtaaaaaatctaaaaacttacagcttgacgttacctctgccaatcttcctgaatacctaggtccacataaatttgactttggtatggccgaagatgaagcacaagtaggccgtgtaaatggcttggcatggacttctgtaggtggtgaattgcttactattgaagttgcagctgttaaaggtaaaggtaaattcattacaaccggttcactcggtgatgtaatgaaagaatcaattaccacagcaatgactgtagtacgcacacgtgccgatgaacttggaattgaagcatctcgctttgaagaaactgatgtacacgttcacttacctgaaggtgcaactccaaaagatggtccatctgctggtttagcgttaacaactgcacttgtatcagcatttacgggaattgcaattcgaccagatattgcaatgacaggtgaaacaagtctaggtggtcgtgcgatgcgtatcggtggcttgaaagagaaacttcttgctgcacatcgtggtggaatcaagctcgtctttattcctcaagataacgttcgtgatttggcagaaatttcagacaatgtgaaagaaggattagaaatcaaagctgtgaaaagcattgatgaaatcttacctttagcattaacttcgatgccaaagcctttacctaaaacaccgattgtaaaaccggtggaaggctcaaaagcagcgcgtcactaa

SEQ ID NO: 1629 - DNA, 1266 bp, Acinetobacter baumannii
cttatgtggcaaaaacttaaacgtagtttattcctacaagtcctctgcgctctcttcctcggtattgcagtaggtcttgcttttcatgatttctccctagctttaaaacctcttggtgatggttttatttctctcattaaaatgttgattgccccgattgtattctgtgtagtggtactgggaatctatggtgcaaacgatattaaaaaaatgggcaaagtcggtgcaaaaacgattctttattttgaagtggtcacgagtattgctttaattttgggaattattgttgcttatgtctttaaaccgggcgtcggtatgaatatcgatattactcatttagatgctaaagatttaagtacctatactgaacgtgctcatgacatgcatacaggttcagagtttttacttaatattattccgaaaacatttactgccgcttttgctaacggcgatattttacaagttttactcatcgctattttatttggcgtttccctactgttaattcctaaacatttagcagagttggtccgtcaagcgcttgaagctttttcggaagtcttctttaaaattatgggactcattattcgcttggcaccgattggtgtatttggttcagttgcttataccactgcaaaatttggattagattcactcctgcaactcggttatttagttttactcttttatgcgacttgcattttattcgttgtcattattttgggttcaattttaaaactcaccggactgaatatctttaaatttgtcggctattttaaagatgaactcgctattgttttagggacagcctcttctgattctgttttaccccaaatcatgaaaaagcttaaaaacttgggaattaaagattcaacagtcggtctggtgattcctaccggttattcttttaatttagacggcttttcaatttatttaacattaggtgtgatctttattgcacaggcctgcaatatcaatctctccatgcatgacttactggctattttattggtttcgcttattacatcgaaaggcgcacacggcattccggggtcagccttagtgattcttgctgcaacactttccgtaattccaagtttacctgcaattggtttggtacttttactatctgtagactggtttatcggaattatccgtgcctgcaccaacttaattggtaactgtgtagcgaccgtagtcattgcccattgggaaaaagacatcgatcatgcacaagcgaaacaagtacttaatataaaaaattaa

SEQ ID NO: 1630 - DNA, 201 bp, Acinetobacter baumannii
aagttatttaaaagtttttctgcacgtttgacctcacttgattggccaaaaatacacccagttaaaaatacaaacggtactaacacgaaaaagattttcatgggaaaaatttataagagcgaggatgggcgctattgtataaataattccatgctttactgtggttttatgttagacattgatgattttttgactcattaa

SEQ ID NO: 1631 - DNA, 1110 bp, Acinetobacter baumannii
atgaaaattaaatatttaattcttgcgttattacctttttctttgatggcgtgtcaaacagtttcaaacactcaagctccaattgtatctgagcaacaacaaaatttggctactactttaagtgaatatgcttggacttatcaaaatataaaagcatctaagccacttattcttaactttaatgcagacggtaaattagcaattaacactggctgtaatggccaaggcgggacttggaaagttgaaggcaaccaacttgtaacttctccacttgcatcaacaatgatggcttgccaagacgatttaatgaaacaagaacaattgtctaatagcatctttagtgaagcgaaattgccaatcgaaattagtaataacaatggtcaagtaatcttaagcgtgacagataaagcaggtcaaaagcatatttttcaaggcgaaaaagcaactaatactcaagctttaactgattattcatggtcataccaacctgaaaatactaaaaagccgatcgttcttaactttacaaatgaccgtttatcaattgatacgggttgtaaccgccaaggcaccacttggaaagttgaaaacaatacgattgtaacgactgatgtcatgtcaactatgatggcttgtgaacctgctttaatgaaacaggaacaattctctagcagcctcttccaaaaacgtgcgattccatttgaactcaatacaacaaatgttgatcaaccaacattgacagtaactgacgctcaaggccagaaatatacgtttacaggtaaaatgacacctgaagcaaaatatcaatctgaaggtaaaactgttttccttgaagtagcgccagaaactaaatcttgtacgggtgttgcaccacaaacttgcttgcaagttcgtgaagttaaatatgatgacaaaggcgtaaaaacttatgctgacaaaaactggtcattatattatggtcaaatcgaaggttttgaacacaatccaaaccaacgcgtaatcttacgtgtaaaacgttttgaagtgaaaaacccggcagcagatcaatctagccaagcagatgtgttagatatggttgtagaacaagaactggttaaaaagcctaaaaaataa

SEQ ID NO: 1632 - DNA, 3276 bp, Acinetobacter baumannii
aatggagttaagtgcatgagatcagatgcaactttagaaacgatttttcagaaagatattcttgaacaaatgcaaagccacggttggcaggtcggttcgccacaaggttacaaccgtgaaaaagccttatatgaacaagatgttttagactttgtgcaaaagactcaagccaaagaatggcaaaaatttaaaagtatatttccaaatgatactgaacgtcatttcttagacaccgtagtggcacagcttaaaaaagcggacattaacgccaccgatattgaatcccgcagttacgggactttgggcgtattgcgccatggactgaaaactcgtggtacacgtttttcattttgccagtttaaacctgaacatggtctaaacccacacttaaatgaaatttacaaacagaatatttgtcgtgttgtacctgaattagtatatagcccatatgccaacaaagccgaactcgaagcgacaggtaaacaagccaaaaaatggcgtatcgatttagtcctgtttattaatggctttccagtcgcaacgctagaactcaagtctgagtttaaacaagccgtgcaaaatgccatggcacaatataaaaaaacacgcctgccgaaagaccctgaaaccaacaagccagaaccattattaacctttaaacgtggtgcattggtgcattttgcggtgagccagtatgaagtctatatggcaacccatctgaatggtgacaatacttatttcttgccatttaacaaaggcaccaaagaacaaggtgcaggcaatgatgcacctgaagatgtgaatgaatatgccacaggttatttatggaatgaggttttaaccccagatagcttactgaatattattggtaactttattcacttacagattgaagaaaaagaagattgggaagggcgtaaatataaaaaagaaagcctgattttcccacgttatcaccaatggaaagtcgtgaccaaattagtcgaagactccttggcagaaggcacaggacaaaaatatctgatccagcacagtgcaggttccggtaaatctaattcaattgcatggaccgcacatcaactatctagcctatacgatgctaacaataaaaagatgttcgattcagtgattgtagtaactgaccgaacgattctcgatgcgcagttacaagatacgatttatcagtttgaacatgctgacggtgtggtcggacgaatcaacaataaagagggcgatggttccaaatctgagaaattggcaaaagcattggaaatggcgcagccaattattattgtgactattcaaactttccctttcgtacttgatgcaattgaaaatagtactagtttaaaagaacgcaaatatgctgtaattgctgatgaggcacattcttctcaaagtggtaagacatcagttgaactaaaaaaagtattaatgtctgatgaatttgatgaagataaatctacaaatgaaaaaatttcagaaacaatggcagctcgaattggtaattataatttaagttattatgcctttactgcaacgccaaaagataaaacgctacagctatttggacgtttgcccaatccaagtttaccaccatctaaaaccaataaacctgaagcttatcatgtctattcaatgcgccaagcaattgaggaaggctttattttggatgtcttaaaaaactatacaaactataaagtcatatataagttaaagcagaaaattgaagaaaaagacgatcaggtcgatgtaaaaaaagccaagattaaactaaatcaatgggtacgtttacatgaccataatatttctcaaaaagtacgtgtgatcattgagcattttaaaaagaatgtaatgggcctattgggtggccaagcaaaggcgatggtggtaacgagttcacgtaaagaagctgtacgctataagcaagcctttgataaatatgtggctgaacaaaattatgccaatattcaagcgatggtggcattttcaggtgaagtagaatttgctgaaaatgatgcggacagtcgtcatttacttgggcaaaaatttactgaaagcaatatgaatttgaacttgaaaggccgtgaaatgcgtaaggcatttgatagtgatgactttcaagtaatgattgtggcaaataagttccaaacaggttttgatcaaccaaaactttgtgcgatgtacgtcgataaaaaattaggtggcgtggaatgcgtacaaaccttatcacgcttaaatcgtatctatcctggtaaggcagagtccggcacatttgtactggatttctttaacgaaccgcaagatattttggatgcgttccaaccttattaccaaacagcagaactagcagacgtttctaatcctgatattgtctatgacttagctgaaaaacttaaagcagcacgtattttcttaatgaccgaagttgaacaatttgttgatgctttctatagcaaaaataaatccaatgctgcactcgccaatatctgtaaacctgcgatgcaacgttggcagcaaagctatacgaaagcaattaatgattatgatgtgacaaaaaatcgtttggaaattactaagcgaacaggcgaacccgttttaattgccaatgctgaaaatgaatttgccgaagcgaaaaaagcgcgtgatgcactcgaaatctttaaaaaggatttaggtagttttacgcgcttttatgagtttatgtcacagattgtagaatataatgataaagaacttgaaaaaatcagtttgtttgctcgtaacttacgaccgttattgcgtgagcaagcggctgatgaagatgtgattgatttaagtaatgttgctatgagtcattatcgactctctaagattcggcagcaggatatccaacttaaagccaatagtactgaacataaattagaaccagctaatgatttgggtacggcaaagccaaaaaataaaaatgaagaatttttatcagtcatcttgcagcgtgtaaatgaagtatttattactgataagctgacagatcaggacatgattaattatgtatatacggtagcagacaagatgtctgaaaacactaaaatgatgaagcaaattcaaaataatactcgtgaacaagcaatgttgggggagtttgatagtgctttagatgatgctgttttagatagtaatactgcacataatgaacaaactatgcagttgatgagcgatccctctaagatgcgccagtttgcgaatattatttatgatgtattagcaagcaaagagaataaatcggtaaattag

SEQ ID NO: 1633 - DNA, 549 bp, Acinetobacter baumannii
tatctttctaaaatagggggatatatggaagcttgtaatcttaattgggacttggtgataaagtttattcaaataataattccacttggaattgcattatttgtttatcatatttggcatgaacaaaaaggaaaagaggtcgttgcaaacgaagtaaaagaactccttaagaatattttggaggaaatgacaattatttcacttttgagatatgagactcaaaaagatttaaaattaattgaagaaaaaattgaaagattaaataatctcactcaaattaatatgcgcagcgcactttttatagaaaattgtcttcatgaaaaagaattaggcatgttatttactaattataatatggtgtctacagatacttatgttttacttagaaataacgcgttgaaagctaaagatcctaaagaatatatgaattttaatattcaatctagaatcaatttagatgcatataacaaaccaacagaagctataattaaaaagttgtccccatttgcaatatatacaaagaaaataagtttgaaaaagtttaagtaa

SEQ ID NO: 1634 - DNA, 978 bp, Acinetobacter baumannii
ataatttataaaatttggttagatcaaatgaatgactttataactagatatttaaataatctggggcagtggcatgaagttgcattgacaatgactaaagcaatagttgcaataggagtgttgtgcttagttgcataccttataacaattggttatatcccttcagaacttagttttggtgatacattcatttttctattgatttttgcggcctgttctattgtctatgctggattaagtatagtgctatttttatttggtatttcattaatgccagtgacatacatcatcttaaatatagttaataaatacttgccttcgcatgaaaaaattagagatgatttaccatttccaaagatcagtattattacatttattgcatctatttggtttatatacattcttcgaaacttacttttaacgtactggcaagtaagtctttatgtggggtgtacggtaagttggattgctttcttatattatgctttttacgttaatcaaaaagatattaaaatttttagtaagaagtttaaaaatatagaggatattattgatgacattggggcaagcgaacatctaaaaatatttgcaagagataagttaaagaaattagaaacgaatattaaaaacagtatacatgtagctatttttcttattgtgactccagttgcccctatgttttttattcccgatattggtgacacatttctaaactacgccatgcaaaaaactggtgtgagaatagaaaaagcgactttatacatcaaagaaccttatgcaaatttaattgaattgccaaaaacaacaactaaggagctgaatcagtataaaacctttatttttaaagatgttaaagtgttatttcaaggcattggtaaaagcactttagtttcttataaggtaaaggatatggaaaagcagttagtgattccaaatgaatatattactgtagagcgaagcaagaaaattgaagagtaa

SEQ ID NO: 1635 - DNA, 429 bp, Acinetobacter baumannii
attttgcataacaatattaaagataaaaataagagtattgatatgactggatcacttggaaaacttggcccgcatgaaggacaagaactagaattattactctcaggcaaaaaacctatcgcttatttttatgagttattacctattgaatttataaaacatcttgagcaaggatctttatctatgctcagtaaagacattgaaacctcactgcctttccccttttcaattatgctgatctataaagatgcgtctttagcagatttgaatgaactcatgttatgtattgaaaggtcattaaaagcaactcaacttgaagagcgcctagaactcgaccgtagaatcggacaacttttaggttactcagtacaagatatagagttttatattcaacacatttcaaatcgccatttaaaaactaagatctaa

SEQ ID NO: 1636 - DNA, 825 bp, Acinetobacter baumannii
ttttggcataatgactattattctgcttttcaactcaggtgtaatgaaatggaactacaaacccttcccggactgtttatttcacatggttcgcccatgcttgcacttgatccagaacaagtgggtcctgccttacatcgtcttagtgtaaatctgcctactccaaaggcaatcatagtgatgtctgctcactgggaaagtaaagcactcgaagtaagtagttcgactcgtccggaaacttggcatgacttccgtggtttcccgccagagttgtatgaaattcgctatagtgcccccggtcaacccgaacttgcagaagaaattttgaagttgttagcagatgctcattttgtcgcacatgccaatagcactcgtcctcgtgaccacggcgtatggatgcctcttttacatatgtatccagaagcagacattcctgtcgttgaaatttctttacctatgggcttaactgcacaggaaatttatcggattggccaaacgctagcacctttacgtgaaaaacaaattttactgatcggttctggaagtattactcataatcttgctgaactgtcttggcaaggtgacaattcgaaagtacctgaatgggcttcaacttttagaaatacagtggtcagtaagctgagtcatcaagactatgatggtgtactggagtggcaaaccctgccgtttgtgaaacgtaatcatccttcacttgagcattttgcacctttgtttttcgctatgggtacgggacatcgttttacgattgttcatagtagcttcacaatgggctcactaggtatggatatataccgctttgattaa

SEQ ID NO: 1637 - DNA, 564 bp, Acinetobacter baumannii
gaagttaataaaatgaaaaattatttaatagggttagttataactttgggtattagtggatgtgtatctataccgtccatagacttttcgcagcaaaaagttgaaaggtttaatccagttaaaaattggattagtgttgataccgctccagtcaaggatatgccaaatggcaaagaaatcttaaagttgaaagggggaagtgaagtttatgtattctggtaccaagatgaatgggcgttattaaatccaaatatggatagacaacaatggattgatactaaatatttgtgcagttttgctggttgttatactccaccagtcacctatagatattcaaaagggagttttgataacaggcagcctgtttactcaactcctcaaagagaatcaaaaggctataataatactagaactagaagttctactactacacggactccaagaagttatagtaaaacgactaataactcttgttactgcacatctggaacttattgtgttgggcctagaggtggacattactgccttaatagcacaggttcaaaaagatatcttccacgataa

SEQ ID NO: 1638 - DNA, 648 bp, Acinetobacter baumannii
agattggataaacgaatgcaagacgatatttcaggctggacagaatggaacgctcattttgaaggaattgaagaaatttcaagccctagtgagttacatggtttattaacaggtattgtttgtgtgacagaagcgcctacgcgtgaagaatggacacaaatcttaacaactcttaatgtgcctgagttaaatgaagaagctttagctcttttaacagatgaagcagaagatgtagcacatgcattatcggaagatgaattggactatttaccaatgcttccagatgatgaacatcttcttcaagaccgtgtacaagcattgtcagattggtgtgctggcgttgtgctcggttttggtttggcatcgggccatgttcgtacagatgagcgtgagttgatcgaacatttgcaagatgttgcagcagtagaatttgaagactctgataacgacgaagaaggcgaaagcagttacgaagaattgtatgaatttgtacgccttattccagtgagcttatctattggtagaaagaaagtaacagtggctgaaagttcattgttgaaaaacttttatgcaaaaagtaaaacttctactgtaggcaccgcagatcaaaatattgtagaaatgtttacaccacatcgcccaagttaa

SEQ ID NO: 1639 - DNA, 213 bp, Acinetobacter baumannii
ggatgccgtaaaatgaaattagctaaaactttactcgctactacactagctttaactgctgcttcaactttcgctgcttctaagcacgaccaagcacataacactgctggtgaagaaaaagttgttgtttcaactcaagaacaagcaaacactgcaaatgctgcgtctgacgctgtaggttctgcttctgaagctgctcctgcaactcgttaa

SEQ ID NO: 1640 - DNA, 2463 bp, Acinetobacter baumannii
actatgcgtaatctacttaagccacttttgctacaaagctttcgtaccggaggcttatatttacttattattgcgctttcacttgcgatcagtgcaaccaccgctcttaagtttagtaatgaccaagttaaaaatgcggtaagtctacaagcagcgcaaatgttagcagcagatttggttctgtcgaataatgaacctatagacgcaaaatggcaaaaaagggcagatcagcttggcttaaagcagactaatgtgaccatgtttagttcaatggcacatactcaagatcagtttgtcatggtcaatgtaaaagcaatagaacctgcattcccattaagaggaaagcttgagattgaacctatagcgcgtggtatccaaccaggtgaagtatggttgagtcaaagggcagccgatttacttaaagttaaactaggcgatatggtatctattgcagatgcggcatttcgctttagtggcgtgattgtgcgagattcaaatcaagaacttggtttttctggtttttcgcctactgtcattattcatcaagcagatattgctaaaactcatgcaattcaaactggtagtagaatcgattatcgactgttaatgtctggtcagcctgaacaggttcagtcattttcaaggcaatttaagcaacaacatcaaccggcaaatgaacaggaagaaaccatagggttacgtttacgcgatgccagtgaatcaaatagcagattattacgtccgttagaaaacctagatacctttttgcaattggccaatattttaacgattttattgtgtggtatcgccattgctttaacgagtcaaagatatgttcagcaaaaccaagatcacattgctttaatacgttgtttaggtgcgagtaagtttcaaattttatgggcctatattgggttactttgtgtagtcagtgcaatttcgattgtgatcggtagtctcttaggaataatgatgggctatggcttgcttgagctcatgctacaactgattccacaactagagttaagtttctctgtggttggttttttacttggtcccttaccaattgccatttttaccagtgtaattgtgctacttggattcattttgccaagcatttgggagttgttaaatactcctcccatccgtgttattcgtgagcaagccaaatctcgaaaatcgttattctttatgttctttgcgggtattaccagtcttgttatttttagcttagttttaagtgaaaatttaatgctcagtatttgggtactaacagtgattattctgctttgcattttactttacaccgttgtctggctattgcttcgtgctttaaaaaagatgaaaacccgtttgtctttttatattcgttcagcatcgcaaagtgccttacaaattacagcactggctttgggtttaagcctcattaccgtgttaagtgtattaagaacagatttattagagcgttggcaacagcaattaccagagggaacaccaaaccagtttgtttatggcctaccaccatttgatttaaaagcttttgagcaacagttgaaacaaaatggttggcaaagcacaccgttatatccaaacattcgtgggcgattagttgccaaaaatgatgttcctttttcagaagaagctataaaacaaaataacgctctacgccgcgaattaaatttaactcagtcgagtgctttaccaaatgacaatgtcattacaaaaggtcaagcggaatttaatgcagtaggccaagtttcagttgagagtaaaacagcagaaagtctaggaatccagattggtgacaggcttacttttagtctgccagaaggtagcttgcaagctaaagttataaattttcggagcgttgagtgggaaagctttagtcctaattttttctttattttttcacctaaaactttagatgaaaatgctggtagctacttgggcagtttttatgtacctaagcaagatcaacctaaaatgatccatatgattcagcaattctccaatacggtttttattgatgttgatcgaattttagatgaagtaaaacgcttaatgaacgttctagtcaaaatcgtgactgtgcttgcagctttagttggcttttctggaatacttgttttaattgcttgtttaaatctattaatggatgaacgccgtcgggaagtggctttgttgcgttcatttggtctctctaaaaataaaatgaagcagatgctcagcctggaaattggttttttaggtttgttagcaggcattgttgcctgctgttttgctgaggtaattagcgcaattgcaagttataaaatgaatatggctttacagtggcatattgaaatatggttgattttaccacttgtcatgatgttgctttgcgctctgattggtcgatatcgactcggttatctgtgtaatttaccgccactacaaagtttacgtgagctgaaccagatttaa

SEQ ID NO: 1641 - DNA, 558 bp, Acinetobacter baumannii
gcccccagtaaaactcgaattaaatttttcactttaaactttgctttgttactatcaggtcaaaccatgaactttgagaacaaaatggctattcataaatatgaagtaaaaatacagtgggaaggtaatacgggtacaggcacttcatcttatcgttcatataaacgagactttagtattcagcatcctcaaaagatgactattcaaggttcatcagaccctgcctatttaggcgatgtgaccagatggaacccagaagatttattggtcgcgtcagcctctgcttgtcataagctttggtatttacacctatgtgcagtcaatcatattcacgttgtgagttatgtcgatcatgcactgggatttatggaagatacagatccggtcaaacgtggtcattttacccaaattattttaaggcccgaggttgtgttggaaaaaggtgctgaccaagagcttgcagcaaaactgcatgaagaagcacatcacgaatgtatgattgccaattcggtgaattttccaattacatgtgaagccagctttagctttgctgaataa

SEQ ID NO: 1642 - DNA, 1227 bp, Acinetobacter baumannii
cacatgagtaatgaagaaaaaagtggattaaagcattgggtacctgcttttgtccttatggtgtgtgtagtactggcatttttcgacaagatcagtattgcggttttattttcagacccacattttcaaagctcgatgggaattgctgaagataaagccaagctcggatggctcatgacaagttttttacttgcttatggtttttcatcagtctttctaagctttttaggcgacatttttaacccaaagaaaatgttgttctggagtgtaacctcttggggtttactcatgctttgcatgggctttaccaccagctactcaggcatgttgattttacgggttctactcggtttggcagaaggtccgctatttgctttggcatacaccattgttaagcagacttatacagaccgtcagcaggcacgtgcctcaaccatgttcttactgggtacaccgattggtgcattccttgggttcccaattacggcagccgttctggcacaccacgactggcacaccactttttttgtgatggctgcgctcacactcattgcaattttaagcattgtttttggtctgcgtaacttgcaactcaagaaaactgttgagcttgaaggtgaaagtaaacgtactaacttcaaaggccatatcgccaacaccaaagtacttgtgagcaatagcgcgttctggttggtgtgcttattcaatattgccttaatgacttatttgtggggcctaaacagttgggttccttcttatctcatgcaagacaaaggattcaacctcaaggagtttggggtgtattcaagctttccattcattgccatgttaattggcgaagtggttggtgcgtttttatctgacaaattaggccgccgcgcaattcaagtattcagcggtttattactcgcgggcatcttcatgtatgtgatggtcattatgactgagccattattgattattgctgccatgtctttaagtgctatggcgtggggctttggagtagctgcggtattcgctctgcttgcccgagtaaccacctcaaatgtaggtgcgacagcgggtggaatatttaacggtttaggcaattttgcaagtgcaattgcacctgtactgatcggttacatcgtgatgcaaacacatagttttaatttgggaattaccttcttggctgcagtcgctgtcattgggtcgttgttcttggttcctcttttaaaacgttattaa

SEQ ID NO: 1643 - DNA, 894 bp, Acinetobacter baumannii
ggagctttcaatatgaatgctaaagtgaatatcacaaatcgtgcaggggcaagctttcctgtacgtcgtatgaactttgattttaatgatgtgccagaatactggatgaatggttccgctggacttacacattttatgacagcgttatcagcactatttccagctggtgaaaagttctttattgatagtgtgcgtgctgtgcgttatcacccagcaattaaagacaatgaagagctacaaaaagaaattagtgctttcattggtcaagaggcgatgcatacacaagagcatgtaaactttaatgcttctgcccaaaaatttggtcatgatgttgaaactttagaaaagttcaccgatacggctattcaaactgcccgtaaaacttttgcaaagctcgtaaaaccatttggtatgacgcaagaaatggtggacctgactgctactacagcccttgaacattttactgcaaccattgcatctcagcttttagttaatacctatattcaagagttgatgacagataaaacgatgtcaaccatgtggtattggcacgcaatagaagaaaacgaacacaaagcagtcgcatttgatgtgtatgaaggtgtctttggtaaaggtgtaaaagcttatgctttacgcacaagttcacttgtttttgcaatggctcttattttcgcaattcaatcttcgtttgtggttcgtcttttaaagcaagaccataaattaaacttagatgagttgtttgtgatttataaatatggttatagcccgtcgaaaggcattattacaggtatggctaaagagatgttggcttattttaagccaggtttccacccgaatgatttagatacggttagtttgttaaaaacttggaaatctaaacttggactttaa

SEQ ID NO: 1644 - DNA, 693 bp, Acinetobacter baumannii
atggccgtcaaaaatatgacgaaaaagcagattcaaattttctttgaacgccttcgtgaacaaagaccttctccacagaccgaattaaaatattcatcaccatttgaattgctcattgccgttatgttatcggcacaagcaaccgacgttagcgtgaacaaagcaactgataagctctatcctgttgcgaacaccgctgaaaaaatctataacctaggtgtagacgggttaaaagagtacattaaaacgattggtctttataactcaaaagccgaaaatgttatcaagacctgtaagattttaatggagcagtttaacggtgaagttccaagtaaccgaaaagatttggaagctttgccaggcgtaggccgtaaaacagccaatgtggttttaaatactgcattcggtcagccgactatggctgtcgatactcatattttccgtgttggaaacagaacgggcttagcaataggtaaaaatgttctggaagttgaacatcgcctagtaaaagtcattcctaaagaatttattttagatgcacatcactggctgatattacatggtcgttactgctgtattgcccgtaaaccaaaatgttcagagtgtgtggttgccgatgtatgcaactggccggaccgctttgaatttggtgctcaaaaacaaattgcagttaaaaatattgaggcagaataa

SEQ ID NO: 1645 - DNA, 1620 bp, Acinetobacter baumannii
atacaggacaatatcatgactacatatcaaacagcgattgatgcagtacgtgaattaaaagcaaaattcggcaacacttgggcagacattagcccagaagatgctgctcgtatgcaacttcaaaaccgtttcaaaacaggtttagatattgctaagtatacagctgcgattatgcgtcgtgatatggctgaatacgatgctgattcaagcaaatatactcaatcattaggttgctggcatggtttcatcgctcaacaaaaaatgattgctaacaaaaagtatttcggtacgacaagcaaacgttatatctacctttctggttggatggttgctgctcttcgttcagaatttggtccacttcctgaccaatctatgcacgagaaaacttcagtacctgctttgatcgaagaaatctacactttcttacgtcaagctgatgcaaaagaattaaatgacttgttccgtgctttaaataaagcaaaagaagctggtgattctgcgaaagtagctgaaatcacagctcaaattgacaacttcgaaactcatgttgtgccaattattgcagacatcgatgctggtttcggtaacgaagaagcaacttacttacttgctaagaaaatgatcgaagctggtgcttgtgcacttcaaatcgaaaaccaagtatctgatgcaaaacaatgtggtcaccaagctggtaaagtaactgttccacacgaagacttcatcgctaagatccatgcacttcgttatgcattcttagaaatgggtgttgaagacggtgttatcgttgctcgtactgactctgaaggcgctgacttaactcagaagatccctgtagttaaagagccgggtgatatcgcatctaaatatattagctacttagatactcaagaaattgatatctcagaagctcaagaagatgagatcttaattaaacgtgatggtaaattacatcgtccaactcgtttagcttctggtttataccagtttcgtgaaggcactcagattgaccgtgttgtacttgactgtatcactagccttcaaaacggtgctgacttactttggatcgaaactccgactccaaacgtacaagaaattgcacacatggttaaccgtgtaaaagaagtagttccgaatgcgaagcttgtttataacaacagcccatcattcaactggactttaaacttccgtcaacaagcgtacgatcgttgggttgcagaaggtaaagatgtatctgcttacgaccgtgctaaattaatgagcgctgagtacgacaatactgaattagctgctgaagctgatgaaaaaatccgtactttccaagcagatgctgcgcgtgaagctggtgtgttccatcacttgatcacacttcctacataccacactgctgctctttctactcatgaattagcacaaggttacttcggtgaccaaggtatgttagcttatgttgctggcgtacaacgtaaagaaatccgtggcggtatcgcatgtgtgaaacaccaagcaatggctggttctgacatcggtgatgaccacaaagaaatcttcgctggtgaaaatgcacttaaagctggtgacgatgctaaaaacacaatgaaccaattctcagctcactaa

SEQ ID NO: 1646 - DNA, 216 bp, Acinetobacter baumannii
gccagtagcaaaacaagcacgagcttaaagcataatgacaagaggcgaggtgatgaggttaaaggcgtcatagctagtctaaatatctcaacagaagtcttaaaaaaacaaaaggacgaatcgaaattcatccttttgatattttacttatacatcatcaaacttagtttgcttttgcaacgggggcagcagcagtttcatcgtttgcagctttga

SEQ ID NO: 1647 - DNA, 1659 bp, Acinetobacter baumannii
tggtttttaaaaatggcacttaatgtttttaaattcaaaaaaatatgcaaggatgttacactattaaattttaatttgcttttatctatctggctaggtttatttctgaatataggtttttttaaaaaaatccatcaacttacaccttataatggtattaagtcagttcttttcttaggggcgacattagttattttaatagcggcatataatttaatttttcaattaataaattggaaatggactgccaaaatctttgcaattttattgatatttattggtggctttagctcttattttgtaaacacattgggtgtcattatttcacccgaccaaattcaaaatatggtgcagaccgatgtttcggaatttaccgatctaatctctttacgctttgttttatggacagttttttttgttattttgcccatttttttaattactcaagttaaatttaaacaagaaaaagcatcacggttgttattgaagaaagtattctcactggtagcttcatttgcagtggtcggtgttttactttttacttactatgtcgatttcgctgcaatatttcgtgaacaccgtgatttaaaagggatgatttcaccgcaaaatagtatttcatcgcttatgtcttactatcataagaaggctccgaagaaaaatctgcctttcgtgatatatggacaagatgctcatcaagttcagcgcgtccaaaagaacctccctaagttaatgatacttgttgtaggtgaaacggcacgtgccgaaagtttctctctaaatggatatgcaaaaaatacgaatccggagctttctaaacaagatattttcaacttctctcaagtgagctcatgcggtacggcaacagcggtttctgtgccatgtatgttctcgggtatgccacgtgtagattatgatgagcaattagccagtcaccgcgaaggtttactagatattgcaaaacgtgcgggttaccaagtgacttggattgataataactcgggttgtaaaggtgcatgtgatcgcgttgagcaataccagattcctgaaaacttaaagaaaaaatggtgtaaagatggcgaatgttatgatgacattctcattgacagcttaaagcagtatttggctactattgccaaagatgatgaccgcccacgtttgattgttttgcatcaggtgggtagtcatggacctgcatattacaagcgtgcgcctgaggcatatcaaccatttaaaccgacttgtgatacgaatgcgatacagggctgttcgcaaaccgaattgctaaatagttatgataatacaatcgtatatacagaccatgtattaagccaaatgattaatactctaaaagaaatatcgaaatatcagacaggtttatggtatttatctgatcatggcgaatcaactggagaacatggtttatatttacatggttcaccttatgcaatcgcaccgagccaacaaacacatgtaccaatgattatgtggttctctgaaagttggaaacaacataatcttgctcaagtgaattgtttaagccaacaaactaaacaaaagttaagtcaggataatttattcccaagtttgttaagtttgctggatgtaaaaactcaggtagtaaataacaaacttgatatgttgagccaatgtaaataa

SEQ ID NO: 1648 - DNA, 759 bp, Acinetobacter baumannii
ttctatataaatcatattaggcataccatgactgaatttaaatggcaaattgatagtatccgtactgtattattctttaacggagaaattaattttaagaaaaaagaatggtcgaaaaatataactgggcttgaaatttctaatgaaatgacccaatcggaagaaaatggacgtttgattcaatatgttgaaattactaatcttgatagtaataagcaatttaatttggtttatttaaaagatcaaagcttaattgatttacaattagtatttgaaagagatgaaaatttttatactttcaatgaaataatcaaagaggtagattttttttacgaaaaaattagcgtattttttgatcagctcaatgaaaagattattcgtattggtaatgttgttgagcttagtatacctgttgataatgaaaaaataggttgtgatttgttaagaagtaatgtttcttatttaaataacatgcaggaggatttagaagaaattagttatagaactaataaatcatattttattgacaatattaaaattaatcaggttgttcagtattctaatggtcagaaaatgtcattggtgattgatcctaatataggaattcccaaggctaaagtgcaaaaaaatattctaatgaatatagatgttaatacagatgcttctcatagatctgaattagatttcttaaaattcattccattattacaagattcagtaaaaaaattaataagaaatggaggtacttatgttagttga

SEQ ID NO: 1649 - DNA, 780 bp, Acinetobacter baumannii
agtgcatcaaaatattacaaaaaaataactaaactgtttattattaacaaaatatcaatgttttatacttcctttttgtttcattattcattcaacaacaaaacactcaaagtgaggaggcatgcaatgcgtgcattagttatttcaacagtggtaggggcagcagtagtactttctggttgtcaaacaacaggtaataaccttggtggcgttgaatacgataaagccgcattaggtactttgatcggcgcagcagctggctacggtatttctaaatcaaatgcaaactctagccgtcaaaacaaccgtgctgcggcaattggtgcagttcttggtgcagctggcggtttatatcttgaccaaaaagagaaaaaattacgcgaacaaatggctggtacgggtgtagaagtaggccgtaacccagatggttctgttcaattgattatgcctggtagcattacttttgatactaacaaatcaaacatcaagccaaacttctatgcaactttggacaaagtagctcaaacattggctgaagataacaagagcgcgattttagttactggttatacagataacactggtaatgactctattaacatcccattatctcaagcgcgtgctcaatcagttaaaaactatttagctggtaaaggtgttccatctagccgtatcgatgcacaaggttatggttcttctaacccaatcgcagacaactcaactgcttctggtcgtgaacaaaaccgccgtgtagaaatcagcatttacgctaaacaataa

SEQ ID NO: 1650 - DNA, 687 bp, Acinetobacter baumannii
gtccaatcaaagctttacaccatgtccactcataatgctgcgcaattactgcaactactgacattgtcttctacggcattgccagttggagcatattgctattcgcaaggtgtggaaaccgccattgatattggcttaatacacgatgaatcctcggcaattgcttactttgaagaagtgcttgaaatgctgctagtacgctttgagttgcctgtacttaaacgtcttatgcaacattatgatgacccagatcagtttctaatttgggcacatttgtataaggcaagccgagaaagtaaagagctactggccgaatcacagcaactcgcattttctttaaatgcatggattaaagatgttttaaagaaaacagttgaggttaaaaagcagtttggttttgtgcctgtctatgcgcagctttgtggtcgtttagaacttaaagatgtggatgtaattacggcgtatacctttaccgttttagaaaatcaggttttagccgcagtaaaaactgtcccattgggccaaatggcaggacaaagaattttatggcatttgcatgggcgagtaccacaagctgtagagaaggctttaaaacttaaagatgagcaattgagtagtgctttgccgcgctatgccatgctgagcatgaaacacgaaactcaatattcacggttattcagatcttaa

SEQ ID NO: 1651 - DNA, 1356 bp, Acinetobacter baumannii
aagtttcaaaaagattattcagtactaataggggcgaaaatgtctgatctgataactgtcagagaatatgcatacattagcgttgtacatactggatgtcctgaatcaacgatagaccatgcttatatttcagcatctgcttttgaccatttatgtgaactttcggctacattttctaaacatggtgcaaaagtatttgaattagctgggcgtagaaagctcagactagatcaatatgttggagttatcgaaaccaagtgcggtacgcgtattgaaatattgcccaagcatgttgatatcaatcttaatgaatccaatgaaactgcgattgaaaaagaacgtgagctcttaaaaaagatgctcaaagtatctttacatttaccatatcgtgatgctgggcaggctagcctaagtcgttttaaacaacctatacatgagtggatcatagatcagtttctttgtaattttgaaaaactaattcaacgcggtttacgttttgattatcatcgtgtgcaagaagagcaaaagtacttgagaggacaattacagcatgtgaaacatatgcgacaatccccagcaagaaagcatattttcccgattgagcatgacatctatgaagttgatcgccctgagaataggttgattaaaacagcattagatgtcgtttgtaaaaaaacacgaaattctaaaaattggaaacttgctcaagagcttcgcttaatgactggggaaattccaaagagtcaaaatatagttcaagatttcaagcagtggcagtcagggcgtttactcgcactatatgcagagataaaaccatggactgagttgattttaagtgaatatatgcctgtatctactcaaggtggttggcgtgggatgagcttactatttcctatggaaaaactttttgagcattatgttgcttatcatttacgtcgtgagttaaaggagtgggatgtaaaaacacaagtatcgaatcaacatatttgtacttttaatgaaaaaccactttttagattgaaaccggatatttatattcagcacaagtgttccccgtacaaaattattttagataccaaatggaaattattagatcaaaatgatcggaatcgacgctttggattgaaagatagtgatgtgcaacaaatgtttgcctatagtcattattatttagaccatgccagtgaagtaattctaatttatccttatcagaaaaataaatttgaagatgaaatttgctttaaatttaatgttcaaaatgatcaagctatgctgagggttattccatttaatttagataagccatatgactttataaaatctatttcttcatcaaattttgagagtgagatttaa

SEQ ID NO: 1652 - DNA, 864 bp, Acinetobacter baumannii
aagtttaaaaacaatatgtgccagctattaggaatgaattgtgcaacaccaacggatatcactttttctttccgtggtttttcacaacgcgcaggaattacctctgaccatagtgatggttttggtattgccttttttgaagataaggcatgccgtttatttgtagataaccagtctgcagttgaatcaccaattgctgatcttattcgtaattatcccattaaatcacgtaatgtaatcgcacatattcgtaaggcgactcaaggcaaaattacgcttgagaactcacatccttttattcgggagttatggggacgtcactggatttttgcccataatggcgatttacatgattttaatccacccttgagcggacgttttacgccggtagggaataccgatagcgaaagagcattttgttatttattagatcaactggtcgaagtatttggttatgaagaaccaacgcttgagcagatatttgaagtattagaaaagatttctcctcaaattgcagaatatgggacatttaatttctgtttatcgaatgggcaagctttatttagttatgcgattactaaattacattggttagttcgagaatatccattcaataatgcacatttaattgatttagatgttgaggttgattttagtcaggtaaccactcctgaagatcgagttgcagtaattaccactgagcctttaactcataatgaaacatggattgcttatcaacctggtgaaatgattttatttcaacatggtaaacctataaagaaagcgattactcaagttgaaagattaatacgtgaagagaaaaatcctgaacttaagcgtattactcgtgctgaccaatattaa

SEQ ID NO: 1653 - DNA, 492 bp, Acinetobacter baumannii
attatgaaaaagatatttttagctgctttagcaacaattggtttacaagcctgtactacaccttatcaagaaatgggggcttctggtggcgttgaagccactattattgatgataatgtctttcaagtacgcgcatctgtaaacggatatacccataaatcgatagcaaaccagtacgcattacgtaaagctgctgaagtatctaaatcgctagggtgtagttatttctcagctattaacaatacaagccagagttacaatcaaaatatttctaaagttgatgctggccttaagactaccccaaatggtgtctattatgtctcaagtgctggtacacaatataagttaattaaaccatccagaaacaatacctatgtttgctttaatgaaaagccaaacactgttttgcctggtttaatttacaacgttaagtatgttctgggttctccaatgcctacaggtaaattcaaagttccgaatagctggcgttaa

SEQ ID NO: 1654 - DNA, 555 bp, Acinetobacter baumannii
ataatgaaaaatcaattacgcattattgggggcgaatggaaaagacgagttttaccattcgccagtattgaaggattaagaccaactcccgatcgtgtccgcgaaactttatttaactggctcatgtgggacattcaaaacgctcaggttctcgatatctgcacaggttctggggcattaggctttgaagcattatcgcgcggtgctgcatctatttatatgattgagccagataagactcaggcacgatttttaaaagataatattcaattgctcaaagcgcagaattgccatttaattaatgcaactgctcaacaagctctaccacgcttaaaagaacagtttgatgtcgtttttttagaccctccttatagtcttaatttatggcaagagcttgctcacttggcagactcacatattaaaaataatgggtacatttacgttgaagctgaccgagatttatctcagcttcaccttcctgcaacatggcagcaaattaaatcaaccaaagctggtacagtccatgcagggctttaccaaaaagtaagcgaataa

SEQ ID NO: 1655 - DNA, 2055 bp, Acinetobacter baumannii
agacctgaaaacaaagaagcttgcatggcaattgcatggataggcaggcgtatatattggagttatcacgtgaataaaagatattcatttttgttcagtagtttattagcagtcggtttattacaaggatgtggagatgactcctcgtcagatcagcccaaggatgattcaaatacaaccccgcccaatttaattgtagataatgacccgaccagttgtagcaaactggcccaagacggttcaagcgtggtggttggttcaaaccaaaatggtgaccccgccgcgccagaaggtgcttcgggttatagactcggtaacacggttaaatacgcagataaatatatggtggtggcaaacacgccacttgcggtaaaagcaggttgtgatgtgttaaaagcaggcggtagcgcagtcgatgcagccgttgcggtacaagcggtgttaggtttggtcgagccacagtcgagtaccattgccggtagtggttttatgatgtattacgatgccaaaaccaagcaagtcactgcttatgatggccgtgaaaccgcacctgctgcagccaacgaattttatttaattcgccaaaatatatatgacccaaattcacctccgcctgtaccaagtgcccgccgtagcggtcgttcgattggtgtgccgggtgtgatgcgtttattggaacaagcacaaaaagagcatggcaaacttaagtggaaccaacttttgggtgaagcgattggtttggctgataacggtttccgtataccggggcgtttggcagatgccattgcaagtaatgcaagcaatttagcactcgatgcaaatgcaatggcgacctatttctacccagatggatcaccacgtaaagtcggcgagaccatgaccaataaagcctatgccagaacacttgaagcactcgcttcacaaggggcaaatgcactgcacactggtccaattgcgcaagccattgtggcaaaagcagggcaaaccgtgggtgacgacccagcacggactccaattaccccaagtttgatgaccttgcaggatttatcgaactatcaggtgaaaaaacgcgacccgatttgtacgacgtaccgtgaccgttactatgtatgtaccatgccacctccatcttcaggagggattgcagttgcacagacgctgggtattttagaaaactttgatatgtcgctttatccacctaaaaaccctgaaaatgaaggtggtgtgcccgatgtgatgggcgtgcatttagtgtctgaagcagagcgtttggcctatgctgaccgtgacaaatatgtggcagataccgactttgttgctttaccagcacagggtattccaagttttattgataaaaattacttgaagcagcgtgctgcactgattaacccgaaccaaagtatgggtattgcaccagcaggtaatttcaatacagcggcaggtgtggacaccactgttgaacatggcacgactcagttcacgatagtagatgcctatggcaatgtggtttcaatgacatcgactgttgaatcgagcatggggtcattccatatggtggatggtttcttgctgtcaaaccagttaactgactttagcgcgaacccttatgacagcactggggcaccagttgccaaccgtgtagaaggaggcaaacgcccacgtagtactatggcgccaaccttagtatttaaaggcaccacgccagatgaattttatatggcaacaggttcaccaggtggcggtactattattcaatatgtggttaaaactttggtgggtgcattggactggaacttaaatgcacagcaggccacttcgcttgtaaactttggcgcaaccaatagcaaaaacaccaatgtggatagctcgaatgtacagctttccttagttgacctaattgaaggcttaaaagcaaaagggcatggcatctctaacactgcgcaaaccagtggtatttcaacgattatgaaagtaaatataaataatcaaagtaaatacgcaggtggggtagacccacgccgtgaagggatcgtgttaggcaatggtgctttatag

SEQ ID NO: 1656 - DNA, 1347 bp, Acinetobacter baumannii
aaatctcgaaacagaaatgggggattggtaatgtcgaatattcataacatccctatggaacaagcagttcttacagcattgatgactgtagacaaatcatttgatgttgtaagtaacgatcttgatgttgagtgtttctttccagagcgccataagcaaatcttccaggcgattgccgaccttgcaaacgaaaacaaaccttatgacttcgttatggttgagcagcagcttaaacaaaaaaacgtaattcatttgatgggtggttctgaatacctgcttcaaatgagcagtgaagcgccttcaagcttttacaacctggagtcttatgttgcagaactaaacaagttcaaggcacaccgtgaagttgagcatattggtcaaagcattgctgagattgctaaagacttaacaatccctgacgttcacattgcagcagaaagcatcctggatgggaagaaaacttcaaacgatgttgagaaaaccagcttcacatttgaagaggctatgaaccgtgctacagatcgtttaatccaaaaggctgaggctaaagctaacaagcagtacacaggcgtaaagtttaacttaactcacctggataaccttgttggattaattcaaaaaggacacttctgcatcgtgggtggtcgtcctggttcaggtaaatcaactctagctcaaatgttagttattcagacagcagtgcgatacaacgagcctgtattggttgtatctgccgaaatggatgtagagacattcacaaaccgctgtatctcagcattaaccaaaattccttatgacaacattcataacgctgaattatttgatgggatgttggctcaatttgcagatgctcaaagacggttcagttctttgccaatccatatcgaagacaagcaaaagccgacaattgcagaaatacattcttgggctcgtaaagctaagcgcaaatacaaaagactaggatgcatcgtaattgactaccttcaattggttcgtgacccaagtaagaaagaccgttaccaggaagtgagctcaattagccgtgatttaaaagcacttgctaaagagtttgattgcccagttatagcattagcgcagcttaatcgtgagtctgagaaagggaaacgtcctaaagcatcagatctaaaagaatcaggtcagatcgaacaagatgcagaccaaatcatcctagcgaatccaatcattggtgaagacgacctaccgtcaggtgtcaccgaattaatcgttgctaaaaatcgtcatggcaagaaaggcgtagttcgagttatggaccgcttagatatctgccgttttgtgactattcgagaagaaggaatggctgcatga

SEQ ID NO: 1657 - DNA, 468 bp, Acinetobacter baumannii
tttttaggaaatcccatgaaagttcaagttaaattgctcgatccgcgtttaggtaaagagtggcctttaccttcatatgcaacagcagggtcagcaggtttagatttacgtgcctgtttagatgaagcaattgagattgaaccaggccaaactgttttggttaaaacaggtatggcaatttatattcatgatgtgaattttgctggtttaattctaccgcgttcaggtttaggccataaacacggtatcgtgcttggcaacttagttggtttgattgattcggattatcaaggtgagttaatggtttcagtgtggaaccgtggtcaaaccaccttccgtttagaaccgggtgagcgtttagcacagtatgttttagttccagtagttcaggctgaatttgagcaagtagaggaatttgaagaaactttacgtggcgcaggcggttttggtcacactggtaaacaataa

SEQ ID NO: 1658 - DNA, 654 bp, Acinetobacter baumannii
cgagaattgaagatggagcagatcagaccatttccaccgactgattttattgatcaagcagatgaagaagaagcaataagactaacaccagcaccagatctaaaaaaatgggttgtggctaactacttaactataggtggaccacttcataaccctgatcataaccatattgctgagttgcttcatgataatgaagaatttttagcatttgcttgggcctcttctgcatataaaagcaagcaagctatggtgttaggccagtgcgaaaaagtcatgttcaatgttggtggctggcgtaaagctagacaagagcaacagatgcgagactggttcggctttgtgccaacatacttgatcaccattgatgctacattttgcgacaaagcaaatgatcgtgagttttgtgctttgcttgagcatgaactctaccatataggcgtagaacgtgatgaagacggtgaaatgatctttagtagctcaacaggtttacctaaacattatttagctggtcacgatgtcgaagagtttgttggtgtaaccaaacggtggggggcgagtcaaagcgttaaacgtatcgttgaagctgcaaagaatccgccgtttgtttcgaaacttgatatttcaaaatgctgcggaaactgcgtaatcaactga

SEQ ID NO: 1659 - DNA, 1530 bp, Acinetobacter baumannii
acgcttatgaaaacgcaaacaccttttgccgagttaagcggtggccgtttactactggcagcgtttgttattgccttgtcgaactttatggtcgtacttgatacgaccattgccaatgtctctgtaccgcatattaccggtaaccttgctgtttcaagcacacaagggacatgggtcgttacttcatatgcagttgcagaagcgatttgtgtacctttaacgggttggttggcaggccgctttggaacggtgcgggtctttatctttggtttaattggctttacggtcttttctttcctatgcggtttagcaacatcgttagaaatgttggtgtttttccgtattgggcagggcctttgtggtggtccacttatgccacttagccaaaccttgcttatgcgtattttccctcaagaaaagcatgcgcaggcaatgggcctatgggcaatgaccacagtcgtcgggccaattttagggccaattttgggtggtctgattagtgataatctgtcttggcactggattttctttattaacttaccagttggtattgtctgtgtattagcagcaatgcgcttgttaagagtagccgaaacagaaaccatttctttaagaatcgacactgttggtttaggtctgttaattctgtggattggtgcgttacaacttatgctcgacttggggcatgaacgcgactggtttaatagcaccagcattgtggttttagctttaactgccgccattggctttgtggtgttcctgatatgggaactcaccgacaaacaccccgtggtagatgtcaaagtctttaggcataggggctttgctatttcggtactggccttgtcgctcggctttggcgcattctttggcagtattgtactgattcctcagtggctgcaaatgaacctatcctataccgcgacgtgggccgggtatttaactgcaaccatgggctttggtagtttgaccatgtcaccgattgtggcaaaactttcgaccaaacatgacccacgtgcgctggcgagctttggtttaattttgctgggtattgtgaccttaatgcgggcattctggaccacagatgccgactttatggcactggcttggccacaaatcctgcaaggttttgcagtaccattcttctttattccactgtcaaacattgcacttggttcggtgttgcagcaagaaattgcatcagctgcgggcctcatgaacttcttaagaaccatggcaggggcgattggcgcttcaattgcggtgaccgtgtgggacgaccatgccaaagttgcccgtagtgaaatggtgtcaaacctacataccactgaagtacaaaacacacttttgcaaaatggttttacggctgactcgactttaggcattatttcaaatctagtcgataaagaagccattaccatgtcggcaaaccatgtgtttttactgtttgcgatcgtgtttgtctttgcggggctggtcatttggctgtgtccaaaacccaaacaggttagcggtatgccttctcattaa

SEQ ID NO: 1660 - DNA, 1329 bp, Acinetobacter baumannii
atcattatgaaattgcctcaagctgattttcaacatcgcagaaaccgtctagcagaaaaaatgggtccaaacagcattgcgattattgcgacgcgtgaggaaatgtaccgtaatcgtgatgcggattataaattccgtgccgatagtagttttttctatttgacgggttttgcagagcctgaggcagtcgctgtcattgaaacgtttgatgacgttacagactatagctatagtcttttttgccgtgaacgcaatcgtgagatggaaatctggaatggttatcgtgcgggaattgacggcgcaattgaagagtacgaagcagatgaagcttatgcaattgatctgcttgatgaagaaattattgaaaaattattaaataaagagcgtctttattatcgaatcggacacaatgctgcatttgatgccagagtaagccaatggatcaaaaaagcgaatgccgagcatcgtcatgaagccgctccagcccagttagttcaacttgatcgcattgttgatgaaatgcgtttaatcaagtcaccgcaagaaattgagctgatgcaaatcgcttcaacaattagtgctaaggcacatactcgtgcaatgcaaactgttcgccctggcatgatggaatatgcacttgaagctgagcttaattatatctttgggcaaaacggctgtgtgccttcttacaacagtattgttggtggcggtgccaatgcttgtattttgcactatgttgaaaataaccaagctcttaaagacggtgatttggtcttaattgatgctgcatgtgaatatgagttctatgcatcggatattacccgtacttttcccgtaaacgggaaatttagccctgaacaaaaagcattgtatgaggtggtattggcctctcaatatgcggcgattgatgcagtacgtataggtaattcataccgtgagcctcatgaggttgcagtcaaaattttaacggaaggcttagttgatttaggtttgctcaaaggtgaggtgagtgagctgattgaaaccgaggcatatcgtcaattttatatgcatggtacaggccactggttaggtatggatgtacatgatgtcggttcttataaaaaagatgacgactggcgccaatatgaagagggcatggttgttactgttgaacccggtttatacattgcaccagatgacgaaactgtagataaaaaatggcgtggtattggcattcgtattgaagatgatgtggtcgcaacgtcaaaaggcccacgagttttaactgccgatgtagttaaagatattgcagatattgaacatttaatggcgcaagctaaagcataa

SEQ ID NO: 1661 - DNA, 1014 bp, Acinetobacter baumannii
cgccaaatgaaattgaaattggttttaagtactacaatcggcctgttgttcatcacaggttgtagcaagtctgaacataacgctgacgctaaaacggttttaccaaagcatgccattcaatcggctgctttgggttccattgaacagtgtaagagctataccggacttcctacaggctggcttaaaaatacaaccgcaggcatggtattcattccagatgggcattttaattttggttctgaaaaagcttatccagatgaacttaactttggaaaaaaacaacgggaagttaaaggtttctggattgatcaaactgaagtcactgttgctcagttcgcgagttttgtgaaggcaactggttatatcaccgatgctgaaaaacaaaaacaagctgctgttttttctccagacccacatcatcctcagcaatggtggcaacttaagacaggatatacatggagaacaccaaacggcaaaaatggtgctcttcctaatcctcatgaacctgtacgctacgtgactaaaaatgatgctgaacactatgcagtttggctaggacgggacttacccacagaacttgaatgggaatatgccgctaaagcaaactcaccaactgatactcctttacatcaagcacctaccgatgagcaccagcatccacaagcgaattactggcaaggtgcatttccctttgaaaatctgaaccaagatcattttactggtattgcgcctgtcggatgttttaaacctaacggttttaaactattcgatatgattggaaatgtttgggaatggacatcttctccttatcaaggtgcgcatgaccagcacatgggtaattattctgctttaagacaacaagaaatgagcagtactcaatatgtgattaaaggtggatcgtttttatgtgctgaaaattactgctcacgttatcgtaatagtagccgctatccccaagattttgatttagccgctacccatgtgggttttagaacgattttacgctctccttaa

SEQ ID NO: 1662 - DNA, 882 bp, Acinetobacter baumannii
gccaaaatgaatcgaattcaacaaacttttcagacttcttcagcaccattttggtatgcccagttagaactggggttttgttatgaaaactcgcgcaccataatgagtcacagaaagcattatggccccgttcgggtgcaaaaaatgctctggcctgaaaaaacaggtgtatgtcatgccattattgtacatcctcccgcaggaattgcaggaggagaccaccttacttttcaaatcgaaaccaaagatcaagctcatgcggttgtaacgactcctggtgcggggaagtggtacaaaaccaatggaaagcaagcttttcagcatattcatcttcatgtccgagatcggtctattttagagtggatgccgcaagaaacaatgctttttgacggtgctttagcccactctgaaacagatatccaccttgaacaaactgcaagttttattggatgggatatgttggtcttggggcggcaggctcgggctgagaattttgttcagggaagctatcacaaccagtttaaattatggcgcaaaaacaagttattagttgccgatactttatattttgagggaggcgatcgctggttaagctcgtgtttaggaatgaataatcaggcagtgatggctagcttttgggccgtgccccctgaaaaattccgttcttcattctatttagagcaacatattgaactcatccgtgaactcattatgcgtatggatgttcccgtgacgttgaccttattagaagatgtactgtgtgcgcgttttttaggaaatgatgtacggcgatgtcatgatgctttcgcagctatacgggctaaattaagacgttattggtttgatttagatgaagaatttccaagaatttggaaaacttaa

SEQ ID NO: 1663 - DNA, 426 bp, Acinetobacter baumannii
agagaaatgaagacaaattcgttgattattgatttacgccgtcaattgccatggcataaacgctatgcttctacaacaagcacagccatgatgtgggcggcttggttgttgttgtggcgtccattcgtgtttatctgggtattggcagagctgcaaaaaactcatttagtacatcgtttgttcagtgcattcggtgtaggtattgaacatggtattacagcgctgattgcttgtgcagtcgggttgctactctggagtcatgtattgcctgaacgccgtgtagaaggtagtgaacttaacatgaaacagacagatgactatgcgcgctattttgatttgcctgtgcaagaaattgagcagggccgtagccaaaaaattacggtcgttcaccataatgaatttggtaaaatcattagagttgaataa

SEQ ID NO: 1664 - DNA, 696 bp, Acinetobacter baumannii
caaacggtgaaattcatgaaaaaaatattggctgcgggtttaattggtcttgggttggtggggtgcgctactccagcctataattatcaagctatacctaaaaatataagcaaaccgccaattggatcagttaataaagcatttgtaggggatcaaatgcttgaacagggaatggtggttgatcgtgaagttctaaacgtccctgaaaatattaaaattagttttgcttattcacttacttcaggcatttacttaaaaacaggcaaaaatgaaaaagggcaatattttcagccattcaacactgtcagtggtggggggatggttcagaaaaaccctttagctgacccatttaaagtagttatgttagatactgaaggtaagctctgtgtagtaacagtatttaatgcaaaaaactgtactgataaacatcaagctactatgaagacagtagcaattgcatcagataattccttccaacaaacattaatttatagtggaaaatttggaaataaaattaatgtcgggtaccgtgaattctcaagtaatcaagcacgtcctgcattcaataatgatgttgaatatgatttaagccaatctaagcaaataggttataaaggtgctttattggaagtaattgatgccactaatcaagatattacttacaaagttttgaagaactttaacaaggtagattaa

SEQ ID NO: 1665 - DNA, 492 bp, Acinetobacter baumannii
acaaaccagaaaaccacatttcgccgaattgcgaggtcaaaaatggataagtgtagagaagagtttgaaaagcaaaggtactggatagggctatttagagcagatgtcgactttgatgtgactcttggggaatttggaagatatgtttcaaatggttcaagaagagttgatgcaatgtgcttggagtcatttaacgaaaaatgggaagcatgggccaatgcatggcagtcacagcaagcgaaagtggaggagctggaaggtaaacttaaacaggcttatgaagatgttgatacgtttgcagaagcgtatgaacgtgagtgtggttttaaagctcagttggcaaaggataaggcagagctgcaaaagcgggtggatcaacaaggtctaatcattgcaaatgttatgtctattgcatcagaccttcaaaagagctggtcaatgtttgagattggcaagaagttagagcaagcgctcaaggtagggaaaaattga

SEQ ID NO: 1666 - DNA, 309 bp, Acinetobacter baumannii
ttgataaagaaaacaacaacgacgagaaggaatatgtctctttataatttttcagtttttttgggtggattgttatttgtatcaattgcctctgccggctataaaagtaatgcacaccgtgacttttacttaaaatgcgtagccgctggacatagtcgcgcgacctgtctgtgtatttatcaccgtttagagcgccaatattccccaaaactcatgcataagcttggtaagttaagtctacaaagcccagaagtgccgcgtgattttgtaaaaaccatgcttcgaacgatgcaacagtgccagtcataa

SEQ ID NO: 1667 - DNA, 4365 bp, Acinetobacter baumannii
cttaaaaagaactacccactcattgagtgggttttttattgcctagaggaaagtaaaatggcacaagaatcccgtttggtcattgttattgattcgcaaaatgctgaacgtaatgcgcgtaatctaggcaatgaacttgttagcattgaacgtaaaggtgaatttgcatctaagtctatggacagcttgtctgtagccaccagagctttagctggacacatggctggtttattaacagtaggttcagccatttcaaagatggatacatatactggattacaaaatcgccttaagttagtcactaacaatcaagttgaactaaataaagcaacggaagacactttccgaattgctcaaaaaacctattcagcttgggattctgtgttacaggtttaccagcgttttagtgataatgccaaaactttaaacctcacaatggatgacacagcacgtttaactgaaacagtttctaaagctgtagcaattagtggtgcaagcgcagaagctgctgatgcagctttagttcagttcgggcaggccttggctagtggaacgttgcgtggagaagaacttaattctgtaatggagcaaaccccagcactagcaaaggctattgctaaaggtatgggtattactgtaggtgaattacgttcagtagcagctgaaggaaaaattacttcacaagaaattgtaaaagcgcttagaaatgtagaatctgatgttgatgctctttttgctaaaacagatatcacaatcgggcagtctctcacactcctaaacaacgagatcacaaaatttgttggcgaagcaggtaagggaagtggtgcggcacaggtattagctggatcagttcaaactcttgcaagtaatttagatttaattgctgatggggctttagtagttggtattggatatatcactcgtgcaattttgatgaagagcgctgctattaaagagggaatggcttcaactttagcgagccgccaagcatctgtattaaatgctcaagcagaatatgcagaagctaccgctgctttgaatgcagcaaaagctcatctcgcgaatgtgcgagcaacaaatgcagaaacccaagctaaatttggcgcaacagcggcagcaactcgatacgcacaagcacaggcagcagtaactgctgctacaaatgcacaaacagcagctcaaattaagctaaatactgcaacttcaattgcagggagactagctaaaggggcgtttggattaattggtgggtgggctggagttgcaacattaggagtaatgggattagcggcagcctattcttattttaataataaggcagaggaggcaaagcaaaagcttgctgaacaagctaaagttgctgagaaagctgatgaggagttaaaaaaattaactggcaatgataaggctaaagcagttaatgatttaactactgcttttaatgcacaaaataaagcattagagaaatcatcgcgtgctgtagggtctgcattaattgatatcgagaactatgcacgaggaaatagggaggttgaaaaaatttcccaagaagcgagaactggaactatcagctatacagaagccattgaacgtctaaataaaattaagttgcctacagatctatatgaaaatctgaaaaaacaggctgcgcagtatgatgacaatgcatctaaagcaagtttatcagctgagaaacttaaattattaagagttgaagtgaaacttggaggtaatgaagcacaaaatgcggcaattcagcatcaaaaacaagcggatgctttaggaaatactgctactgaagcagaaaaggcaactaaggctttgcaagattatcaagccaagcaaaaagatagcgttattgattcaatctataaatcaggttggcttgataaaggttacactgttgctcaagctaatgccattttagaactgcaaaaagctaaaggaatgagtgcaattttgtctaaagatgaaattgatagcgcacttagaaatctcaagatcatcgaagaacaacaggagcgagaagataaattaactgaagctaaaagaaagcagacgcaggaaattgaaaaacaagcaaaacttactaaacgcttggtcggtatttccggtcaatccggtattggtactggtccacatcttgacgtccgatatggtggctcattgtcaggtcagaaagtttctaatgaacatctggctcgattacaggcgggaggaaaacctttaacttcctacaagatcagttctaattatggtccacgaaaagccccaactaaaggggcttcttcatttcataaaggtattgatttttcaatgcctgaaggaacaccaatcacgaccaatgttgctgtgaaagatatcaagacatggtatgacagcaagggaggtggttatgtcagtgaagtgatctttgaggatggagtgtctcttaagcttctacatcaatctcccaagatgcagagcaaggtgaaaggtggtgcaagtaaaggaagtgataaagcagctggtgatattcaatctcaacttgaacgtcaacaggatttgcaacggtcacttgaaaatgaggtggctagtgaagtcggacggattaacaataatagaaaggcaagactggaggatgttgataaagcaaactttagcccggaacgtactgcagaaataaaggcggaaataaatcgtcgtgcagataatgatattgctatagccaaacaagcccttagaacgaaattggaagactataaggagttccagaaaaccgaggaacagttactagaagagtcctttaaccgtaaaaagttcaatgcagctcatgaccttgaattaagtaagtttgagcagaagcaagctgttgaattgctggaacagcaaaaacagcaagagttagggttattaaaactagctcaggaacagcggttgtttcaagcccgtttatctctgctttctgaaacgcaagccatgcaggaacgttacagactcgaacgggaggaaattcttaagaataccaagctttctatagaagagcggcaaaagctaatcgcattatctaaagccaatcaggataaagagacacgcgataaagtgaataatgctgctcaaaactggggtggtatccaagcggatatgaatggtaccggagaatttttcagacaggatcaggaacgatttagccgtttaaatgctgcaaatgatttagcagatagtcaatttgctgctaccgacctgaatgagcaaaactctttagatggtttgaatgctcaattcgaagctggactaattaagcagcaggatttcgaaaaccagaaaacagcaatcattcaagctgctcaggaccaacgcaatcagattgctgccgaatatgctcagaatgctcaggatattgaagataaatatcagcaagatcgtttgaacacccaaattgcatttggtggccaaatgatgggttctcttacatctatgtttggttcaatgtttggagagcaatctaaagcttacaaaatcatgttcgctgcagataaagcttatgcgattgcagctgctggtattgcgattcagcaaaatattgcagcagcttcaaaagctggttttcctcttaacttaccgttgattgctggggcagttgctcaaggggctagcattattgcaaacatccgggcaatcaaagatcaaggctttgctgaaggtggttacacgggtcgaggtgggaaatatgaagttgctggagctgtgcacaaaggcgagattgtatggtctcaagaagacattaaaagatgggggggagttggtttagttgagaaaatgcgtaagagtacaaaccctgaagcttttctcaataacaatgcttcagctgatagtgtcatgcgccgtgcaatgatgagctctagtgcctttatagaaagccaaaagcaagctgatatctttaatcaaccggttcaagattctcagattatttataagggtaatagaagcgtacctatcgcttcttcttcggccagttctgatctataccacgatggcaaggtctacttctcatccaatggtttagttctggatcgctcaaatctggatgatgttcaggactttacttcaggacgtgcttcacgccctcaagctgagattaagccttcaattgagccagcttcatcgataatcaatttcaaaattgaagtgattaatcaggtgagtggggcgacagttgaagccgaacaactggatgagcaaacagtccggatcattgttaaagatgaaatggataagcagcttccaagaacggtaccgaagcttgtaagtgatcaaattggtaatccaaactcaactattagtcgatctttgactgagaataccactgtaaggcgtaaccgttaa

SEQ ID NO: 1668 - DNA, 357 bp, Acinetobacter baumannii
acgaacgggaatattatgatcactgaattagaaattatcgatttaaaagtaggcgaaggtaaagaagcggttaaaggtgccttaattacgactcactatacaggttggttagaagacggcactaaattcgactcttcccttgaccgcggaaattatttcgagtgtgttattggtacaggccgtgtgattaaaggttgggaccaaggcattatgggaatgaaagttggcggaaaacgtaaacttatggttcctgctcatttggcttatggcgaacgcaaaatgggtaaaattattccggcaaactcaaatttgatttttgaaattgaattatttgatgtaaaaactcgcgatgattga

SEQ ID NO: 1669 - DNA, 1593 bp, Acinetobacter baumannii
tgtatacacctgtatattaaccttatcgtacaagcgagatattttatgtccagccagagttcagccgaaggtctacaatttccgattcacgcctcgatcaaaaagcaaagcacgtctcttacaggccaagagattttgtcagaagctttatctattgtagataataaaactgctcaacagattttggctgaaaaaaattggcgaaaaaattatcctatttactttaaggcacttgttaagcacggaattactaacagcaataatccaattaccattgcaaaacagggattgcataaggctcatcatctttttgattattaccgcgatggtaaacactatcttttaaaagatgctctacacatccctacttctacacctttaaatacagtaagatttaaaggcgaaagtgaagctgcaccagaatggtatgttccatataaaggccaaaaactgagcgggcaaagcttacttgaccaaattcaaaaatgggaaaatgcaggtattattgaaccaagccatgctaaggctttacgtgaagctgctgctcatcctgaatggtttgatttatctgaccgtacgatggtgttatttggtgcagcctcagaagcaggaccattaccttggctagcaaaatggaaagcgaatattgttgcaatagatttaccaaacccacgagtttgggggaaaattctaaatacaatccagcaaggaaacgcaacgcttattgcaccaagtattgaaaaaattgactcttcggcaaaagcttcagcattgagagataaattgggtgccaatttattaacgcaaataccagaaattgcccagtggttagttcaatttcctcaaaaattagacttggctgctattgcttatttagacggagaaaaacatgtccgtgtttctatggcaatggacagtattatgcaatatgtgagtgaacataaacctgatacaagcttaatgtttatgtgtacgccaactgatgtttatgcagtacctaaagaagttgcagaagctgctcaggagaaatttaaatctcgttcacaactacaaaaaatggctgtgaaaggtgtttctacactctcactcaaacgttttttccaagcaccttatcaagatttgattactagcgaaaatggcaaaacttatggtattgcagactgtttggtagttgaacaaggaccgaactatgctttggcaaaacgtattcaacaatggcgtgcaacacttgcccgacatcaaggtcaacgtgtaagtattaatattgcaccatctaccacaactcattcggtcacaaagaatccgctccttaaagctgcttttaatggcgcagaactttttgatgtagaagcatttagtccagaaaccaccaatgccattatggcggcgttatggattcatgacttaagaaatgattcttctgttgcaaaccctgaaaccgtactcgaccaccctctagagttgatgatggagggagctaaccatggcggtttatggcgtgtagcttatttggcgcgtacagctcttccttttgctgccatctatggctttgcagccgagaaacttccatttaggaaattttctaaaaaataa

SEQ ID NO: 1670 - DNA, 1380 bp, Acinetobacter baumannii
tcaatgcaccttctcaggtgcttttttattggtgtttttatggcagttactgataaacatccgcagtatattgctgcacaaaaaagctgggagattatgcgggacgccgttgctggtgaagagcagatcaaacaggcacaaacaaagtacctagctaaatcggccggaatgattgaggctgaaaagcaaggtgatacgactggagagatttataaagcctatctaagtcgagctcagtatccattatgggttcaggattcattacgtacgatgattggtttagtttcaaagctggaacctaatatcgtaattgaaagttctctgttaaagggtttgatagagaatgcaaccaatgatggttttgggcttaaacaactctttatccgtatttgcctagaattacttgaatatggtcgctgtggtttgcttgtcgatgttgatggggctggtgtgccatatttcgctctatatgatgcgctatcaatcattaactggaaggaaaacagcattggtggccgtaaggatctaaagctgttagtgctcgaggaacaattcgaaaatagtgaagatgagtttgggcatgatacaaagacggttcaccgtgttttatctatggttgatggtgcgctaactgtacggttatttgatggctctgttgaagaagataaaacgccagatctcggcggtaatcagctatctttcacgccgtttgttttctgtggcacgaccgataattctccacaagttggaacggtaccattgcttaccatggctaaggcagcactcaagtattaccagctaagtgcagattattaccagtcacttcaccatacagctcatccgcagccttggattaatggacttgagggtgatgaagatattagcgttactggtgtgatggctgtctggagccttcctggtgaatctcagtgtggttatctcgaaatttcaggtagcggcattgaactcaccaaaaaggaaatggatgcacaaaaaaatgctgctcttgaagccggtgccaaggtagtcgataccaatacacaggaatcaggggaagcgcgccgtgcacgtcaagatgatcagcaagcaagcttacatagcattgtgacgtgtgctgctgcggctattgagcaggcaatcaaatatgctgcccaatggttaaagttggatccgtcaaaatatacattcacagtcgaaccagaatttattgtccagcaatacgacatcaatcttgctaagcaactatatgaaggtgctatagctggaaagaattcgttccagacgtattgggaatatatcgctactggtaagttgccagctcatgattttcaggaagagttgaagcgtgttgaaagtgagcgagatagtatgccgttgtag

SEQ ID NO: 1671 - DNA, 867 bp, Acinetobacter baumannii
aatatgaacctgattgaacaattacaaagcaaaattgagcaggcgagaactctttataaagagttccgtctgtatgatttggggagctttgctttaaaccgttttacaccaaaagatggttttgagcaggttttaaatgtgcgttatggcttaaagccacgccatcgtctagatatttatcgttctactaagcgcttagctcatcgaccactcattgtttttgtacatggtggtgcttggcaacatggtaataaacgagactatttatttataggtgaagcgtttacgaaagaaggttatgacgttgctgtcattaactatcagctcgcaccgaagaatatttttccaagttatgtagatgacttaacgcaagcgttaaactatttacaccagaaccaagaaaaactggaaatctcgacagagaatattgtgcttatggggcattcggcaggtgcatttaatgtgatgtctgctgtttatcacccaaaaccaaatacaattcagtgtttaggtaatattaaagcaatttttggtttggcaggtccttatcattttgattataaaggtgatccgcttgccgaagatgcttttgatcaaagcatttcttataaagaagtgatgccatattattttgtaaatcaaaatcatattaagcattatctgctcatggctgaaaatgatcagcttgtaaaaaaagaaaatacctttgatcttgatcaggcacttagacaaagcggaaatcacagtcatatcgctgtgattcctaaaacaggtcatattacaattttggcgagtttatcgagttttgtaagtcattacttccgaactaaacggaccattttgcactttctggatgaagtattttaa

SEQ ID NO: 1672 - DNA, 192 bp, Acinetobacter baumannii
aggggagctgaaagcatgatcgaatttgcagattacacctcaatgatgaagctgcgtagagcgtacaacctcggcactcgcaataaagaaacaagagcagcagcgaacctctatgagaaattaagaaagctgaaaatgctagaccagcttaagcaggaagccatgactaaacgttacaaggaggcggtatga

SEQ ID NO: 1673 - DNA, 843 bp, Acinetobacter baumannii
tttttcaatgattgtttaaaagataatgaaagacaaataaaagagcgtgaaaatatgtcaaatcaagaaggaaaagtcagccgtgaaactcgcggacatatttttttaattggcttagatcgcgcagcgaaacgtaatgcctttgatagtcacatgattaaagacttatcactagcgctcaccgaatatgaaaataatgacgccctgcgctgtgcgattgtttttgctcacggtgaccattttacagctggcttagatttggttgagttacaacctaagcttgctacaggtgtttttgactttagtgaaaacgaaattaacccttggggcacaataggccgaaaactgagtaaacctttgatagtggcagtgcagggttattgctataccgctggtatagaactatttctcaatgcagatattgcgattgcgagtgaaaatacccaatttgctcaaatggaagttcaacgtggcatcttaccttttggcggagcaactgcacgttttactcaagccgcgggttgggccaaagccatgcgctatttgctcactggtgactctttcgatgccaaagcagcttttgacatgaacctcattacagaaatatgttcagaaggtacggagcttaaacgtgctatagaacttgctgaacatatcgcgcaagctgcaccacttgctgtaaaagcgaccctcgcctctgctcgtgaggcagtcaatgaaggttacaaagtggcttttaaccaactgcaaaaccatcttcaacctttactcacaacagaagatgttcaagaaggtgttttcgccatgctgcaaaaaagacctcctgtttttaaaggtaaataa

SEQ ID NO: 1674 - DNA, 264 bp, Acinetobacter baumannii
atgtcacgtttaactaaattagatcgaatgacacatgcagaaaaagaggctgccaagaaagaattttgggaagctgctgataatcagaccttcccgcctgaaacggttgcaatcgtaatgcacgtatcattaccatggttgcagaagaaaagatgtgaaggcggtggtattcccttttcgaaaccgcacaaacgtcaggtaaattatgtgaaggctgatgttttggcgtatattgaacaaaacaaaatggcacatactgcataa

SEQ ID NO: 1675 - DNA, 792 bp, Acinetobacter baumannii
tttatgtccgattctcttattcagtccgatttgtctgaactagtaattggactctcttctgaacattcttaccgagaaatcacgcctacccacacgcatacacgtgctcagtttttatatgcgtccactggcaacattcaggtgtttacacctaatcatgtctggattgtgccgcccatgtgtgcgttatggattccggcaaatgtagagcacagtgtgatttcactgagtcacgtgaagttaaatacagcattggttgaagtaaatgcagccgcactcatgggacaacattgctttattattcgagtaagcaacctattgcatgagcttttaatacgtttaaatgaaattgaacgagaggaaacgccaaatacagcaacctctcaagagctttcccgttctttacaaattttgatttttgaagaaatccatcgggccaatttgttgcctattcagattccgtggccgaaagacaaaagactcttaaaaatttgccaagagttattacatacgcctgacagttcaaaagatttaacagattgggccgatgatattggtgcgagttctagaactttaatgcgtatgttccagaaagaaacggggctatcttatcgggcatgggtacagcaaatgcatattgcacttgccttgagtaaaattgcgaatggcgaatctattgctcaaatttcagagtcactggggtataccaaccccagtgcgttcagtgcgatgtttaagcgacatctaggtaaaacacctcagcagtttagaagtgctgcgatgtcgctataa

SEQ ID NO: 1676 - DNA, 468 bp, Acinetobacter baumannii
ggagctgccgaaatgccacagtatctcatgtttgcggaaaatatttataacaaaattaaagatgaggaattgttttcacatgactgtattgaaaatatgaacttacttatgacatgtatacgcagagaaattgagggaacagaatttaaattaaaatataattttattgattttgttgaattgtttagtaaacaattagatgaatgtaaagtaaaaatagatgtgagtttgattcctcctcataattcagaaggtgagtatattttatggttagctggatttatcgaaaaaattacagaaggtggacctaaaccacctccgcctataaagaaatttattccagagtatatgagcttgaaatatgaattagattttttacctttaaatgaggaaaaaattcaaaccgaaggtaaagaaattacggattactttaattcaaagctttataaggcaacttttaagaaataa

SEQ ID NO: 1677 - DNA, 1092 bp, Acinetobacter baumannii
aaccttagcgaaaacggggatgacagcatgaaaaatattttaactgctcaagaagcatttgcagcacttcaaaaaggtaaaactgttctatgtcgtcctattggagacatgttggacttttctgacttagatcaattccccgcttctgtttttggtaaaccgggttttgaattctgcatcaaaatcgaaactattgagctggctggcattacattcacaaagccattaactattgatgaatatgaggagggacaggatgtttttgtaattactacatattcgccttctatttacgtcgtgaattttagaaccaccgcattaattgaatctattaatagcggctttgttcaacgtgatgcagaaaacgccaagcttcaattaaaagcactatctaaagcgttaggttttgaagttagtgacgattttagtgttattcgcctaggtgacgaaccaaagaaacagcgtgctaagaaatcaaaaggtgcacagacagtagttgtagaaaagacttctgaaattgttgatgaagttaaacaacctacaattgttattactgagcaaacaaatgtaactacttctgaagactcattggtgcaatccgaagatatttcagaaaatataggatcagctttagatagtgcgattgttattacagaacaaccttatgtgtcttcacctgaagattttttaactcagcctacacctgagcaagaaaaaaacaatgagtatcagcaaaccctagatactcttctacagcgtgtaaaagagtcaaaaacacctgcagaagtaaatgcggtttatcgttatacccgcacatgggatgacgaacaaatgaagcctatccttctcgccactcacaaacgtcttgaagagctagaaaaagaaaaggcatctgctaatgagccaccctctttaatggttcaaatccaaactgcaccagaccttacaacgctagatgctttggaaatagacgtggctgcacgagatccgcagattcaacctagactcatggattttgttaagaaacgccgctttgaattagaaaatgcggcatcaaacgaacctgattatttactggaggaacctttctaa

SEQ ID NO: 1678 - DNA, 1140 bp, Acinetobacter baumannii
caaaatagcgagaatacaattatggattttaatgacttgctcaacctgatggttgaaaaaaaatcttccgatctctttattacagatggcgttgcgccctctatgaagattaacgggcaaattgttccaatttcaaaaaatagtctttctggggaagtgattggtcaactgttacattccatcatgagtgaaaaacaacgcaaagaatttgcagacactcgtgaatgtaactttgccattatgaaccgtgaaaaaacggcgcgttttcgtgtcagtgcttttcagcagcgcgacatgccgggcatggtactacgtcgtattgaaactaagattccttcaattgatgacttgcagttaccacctgtacttaaagatttatcgatgaccaaacgtggcattattattttcgtaggtgcgacaggtacaggtaaatctacttcattggcttcaatgatcagccatcgtaaccataactctaagggccatatcattaccattgaagacccgattgagtttattcacgaacatgcaggttgcatcattactcagcgtgaagtcgggatcgataccgactcatttgaaattgccttgaaaaatacactacgacaagcgccggatgtgatcttaattggtgagatccgttctcgtgaagtcatggactacgcgattggctttgctgaaacaggccatcttgtattagctaccatgcacgccaacaacgccaaccaagcgctcgaccgtattattcacttttttgaaagtgaccgtcatagtcagctttacatggacttgtcacttaacttaaaggcaatgattgcgcagcagctcattccaacaccagatggtaattcacgccgtgcagcaattgagattttaattaactcaccattaatttcagactacatccgtaaaggtgaaattcatgaaattaaagatttgatgaaacgctcacgtgaacttggtatgcagacctttgaccaagctttatttgatttatataaagctggtcaaattacctacaaagatgcacttaaacatgctgactcaccgaacgatttacgtttaaccattaaacttgcagatgaaggtcctgatcaattatcagacgggaaacagcatttaacttttgaccgccagtaa

SEQ ID NO: 1679 - DNA, 423 bp, Acinetobacter baumannii
gtagctccagagtcaagtcttatgagtctttctattggccaattatcaaaaaaagcggatgttccaatcgacactattcgttattacgaaaaagtaggtgtgctggaccgcattcagcgctcagaaaataattatcgtgtttacacagaacaaacactcgcagacctattatttattaaacattgccgtgaattagatatttctctcagtgatattaaaacgctaaaagaaatgaaagctcagccgaaacgggcttgtacggaagtcgataacttggtgaataaatacttgatagaagtatcggaaaagattgagcgactgttgcttttaaaagaaaccctaatcgatttaaaacaacactgctctaccgaccgtacagtagatgaatgcggcattttaaaagaactacaaaaccatccttaa

SEQ ID NO: 1680 - DNA, 348 bp, Acinetobacter baumannii
aagaaagcagaacttaggtgctgggcagctttagttgggagaataagcatgttgttgagtttagatgcttataaacaacaacagtttgatcaaattgctgcaaaaattatggttgagcctgaaaaatatatagattttaattcagtatcggatttttataacgctgcttggctcaaggactttccacaaggcactcaggcctctgcgacaggtttagatgatggggcagaagagttttatgcagtagtacagtttaaacagcagtacttaaagtttgatattaaagaaaatcattcaacactgagttttcagaatatgaatggtgaaacttttaagtgtaatttttaa

SEQ ID NO: 1681 - DNA, 1347 bp, Acinetobacter baumannii
tggtcacaagaggatactgtggccaaatgtaaagggattcgcatgatggatacagtattttcatctgaagtagatacaacggttcgtaaatcggcgtatcgaaaaattgcatttcggctcatgccatttttaatgctttgttatttttgtgcctatttagatcgggtaaatgtgggttttgccaagcttcaaatgatgagcgatttacagtttagtgaagctgtatatgggctgggcgcagggattttctttattggttactttctctgtgaagtaccaagtaatattgtgcttcataaagtaggtgcacggcgttggattgcccgaatcatgattacatggggcattttgtcaggctgttttgcttttgttcaaactgaatggcaattttacaccttacgttttttacttggtgtcgctgaagctggactagctccgggtttgttgctctacctcacttactggttcccatcttaccgccgcgcacgcatgaccgtactgtggtttatcgcgattccaatttcgggaatgattggtggcccactttcaggcttaatcatggaccgaatgagcggcgtacatggctggtttggctggcagtggatgtttgtaattgaggccattcccacagtgcttgttggcttgcttgtacttgctgttttaaaagattcagttcaagacgccaactggctaacccaagacgaaaaaaacttggtgaagcaagagcttgctcaggataaccagcacaaagaaggccatgctagcgtcaaagagttcatcgcagataaacggttatggctactggcaggtatctacttttgtgtcgtgatggggcaatacgccattacattttggctaccaactcttattcgtaattcgggcattagtgataactggcatatcggtttgctcacaagcctgccttatatgtgtgccattgtggtcatgattttggcggggcgtagcggcgaccatttccaagaacgccgctggcacttaattatcccgatgtgtgcaggcgctttagcactcacatttgcaactttattcgcttcaaatctaacgctctctttaatttgcctttgcatcgcagcctcaggtgtgctgacggcatcctctttattctggatgttaccgaccaactttttgggtggtgtttccgcagcggcaggtattgcagccgtcaatagcttcgccaatcttgcaggattttgctcaccttatttaatcggttgggtcactaccaacacaggttcaaatgcaatcggcatgttcttaatcacagcagtattaattttcggtgccagtctggttctgcgtgttccggcaaaactggttaatcgttaa

SEQ ID NO: 1682 - DNA, 768 bp, Acinetobacter baumannii
gattggcaagaagttagagcaagcgctcaaggtagggaaaaattgattttttatgttgaggcaattggcgggccggatgacggcgaattaattgcaactgaactggatgtctattttgcaatgccgcctcaagaggaatgggattggtggtctcaaaaagaccccgttaatactatccttcctacaattaattattaccatgaaagagtcccaacaattccgttaaacagtcccaacgttgggacacggaatctttcaaagaatctatcagaagaatctaaaaataaaaaaacatggttgagtttgaaaaaacttggtgaagaaattcttttggcaactgatcaggaaacttacgagcagatcaaaaacgcgacttggttcgatcgagagttacgagcatttgaactctacaacgccgagaagaatctttgcgatgaactcatgaattaccactttgcagattggttaatcaacgcatgtggaaaataccaagcacgtgaacaatctaaaaaaacaaattctggaacgcaggtccgagtcccgcagggagaatcaaatactcttagttcaaaacagatttactcatttgctcaaaaactttctgtacatcctgagtttgcaagcaaatacgctgaaggtaacgagagctatgaacaacttgctgcacgtgtcgcagtgaaacttgcagatccagagcaacaacaaaaattgatgccatacctcattcaggttggatttcaacaaaaaggtaaaggagaggcggcttga

SEQ ID NO: 1683 - DNA, 306 bp, Acinetobacter baumannii
ggtcttgaagaccatagcgatgatgcaatacaaatcattgtggggagtgtaaaaatgacagatatcaatgattatgaagatgcagaagattctgctgtagatgaagatgaagccaaagcggctgaaagtggcgcagctgatgaagaagcaggcaacttaactgatgctgatcttgcagaagcagaaacgcttaccgtaaccgcgaaacaaaaacaacgccaagcgttggaagatgaagtcgctgcgtttttagctcgcggcgggagaattactgaagttccgccagatgaacatagcgatcgttaa

SEQ ID NO: 1684 - DNA, 891 bp, Acinetobacter baumannii
  unsure (751): Identity of nucleotide sequences at the above locations are unknown.
aactttagtttattaagcaaatcaccaaaaaacagcccttttaagggtgtatgtatgaccataataggagtggattcggtggccaaaattgttgtcgtaacatcaggcaaaggtggtgtaggtaaaactacaacgagtgcatcttttgcaacaggtttagcccttcgtggtcataaaactgttgtgattgactttgatgtaggcttacgtaaccttgatttaattatgggttgtgagcgtcgtgttgtttatgatttcgtcaatgtaattaataatgaagcacgtctgcaacaagcccttattcgcgataaagatatcgaaaacctttacattttgccggcttcccaaacccgtgataaagatgctttgagcgacgaaggtgttgctcgtgtaattgatgagctttctcaagaatttgattacattatttgtgactcacctgcggggatcgagcgtggtgcaattttagcaatgtaccatgcagatgaagcaatcattgtgacgaaccctgaaatttcttcagtacgtgactctgaccgcatcatcggaatgttagatagcaaaactaaaaaagttgaacacaacgaaggacgtatacgtaaacatttatgtattacacgttttaaccctgaacgtgctgaccgtcaggaaatgctgacgattgatgatatttctaaagatattttacgcgtaccgacattaggtgttattcctgaatgtccaagtgtattacaagcatcaaacgaaggtnagccagttattctgtattcagaaactatagctggacaagcgtatgatgacttggttgctcgctttcttggcgaagaccgcccttatcgacacatcacagctcaacctaaaggctggttagcacgactatttggagcgtag

SEQ ID NO: 1685 - DNA, 324 bp, Acinetobacter baumannii
aaatatctggagaaattaatggaaccagtttccactagcggttttacagcacttttaaaattatatgggattgcaatcatggtgactttagcagtcggtttggttgcagcagttgtattaatgactcgtatgccacgctcaccacaagagtgggcagttggtttgatctgtacggttgtatcaagtttggctggcggctcattcattattgtgaagtggggacttcatgaatgggttactgatgtatgggggatgattgctctacggtgggtttttctttgtttgtggtttacccggttgggctttagtccgttggatttttaa

SEQ ID NO: 1686 - DNA, 273 bp, Acinetobacter baumannii
gacaaaatggaggttcaaatgaaaacatacactgtaaaactatatgaaggcgttagtcgggagaaagttaatgaaactttgaaatactaccctgattattttggtaaaatatcaataattacaaatgtaattaataataaattgcaattaacactaaaagcatttgaaggaatcgacgttataactgccaatgatctaatgattaaaatcgttgaacgtttaaaagcttctcaattagtagaaaagcataatttagacttgttgactgtctag

SEQ ID NO: 1687 - DNA, 750 bp, Acinetobacter baumannii
gcctcttcggaggcttttttatggttaaaaataataattactacgggtagtttgagattttatcaaatagtaaaaaatgctaatgtgtgcttctcaataaataacaatgaaacaaatctggaggacaacatgttagtcgcgttaattacgttagcttttattcatttttgtgcgcttattactccagggcctgatttttttctggtatcacagaccgcagtgagccgatctcgtaaagaagcaatgctggttgttgcaggaataacagtgggtgttatgttttgggcttctttagcactgatgggcttaaatattatttttgagaaaatggcttggttaaagcaaggtttacttattgccggcggtttatacctatgctggttaggataccaaatgttgcgttcggcattttcaaaaaatcagcaggaagaagtgacaactgttgaattaccgaaagcgccgtatttattttttatgaagggattactcaccaatttatcgaaccctaaagctgtgatctattttggtagtgtattctctttatttttagcaaaccctcagcttgatcaagtccattggctgctttttattattgtgtcggttgaaacaattttatggttctgctttgtgacttttattttttcattaccgagttttagagccgcttaccgtaatttttcaaaatggattgatggtatttcaggtggtatttttaccgttttcggtattttcctgattggaaaccgataa

SEQ ID NO: 1688 - DNA, 1032 bp, Acinetobacter baumannii
cccactacggacagtaaggaatataccatgagccagttagccaatcctcctaagaaaaaactaaccacttcggcaatgattgcttctattgctgccgagggccaaccgaccaaacccgcaccatttggacatgcactgaatgccttggcaaaagagcgtgacgatatcgtgggtttgtcagcggatttatcaaaatatactgatctacatatctttgccaaagaaaacccagacaagtttttccaaatgggcatggcagaacaacttttgatgagcgcagcagcaggacttgctcgtgaaggatttgttccttttgcaacaacttatgccgtgtttgcatcacgccgtgcctatgactttatttgtatggcaattgcggaagataatctgaatgtcaaaattgtggcggcactcccggggttaaccacgggctatggcccaagccatcaggcgactgacgatattgcaattttccgtgctatgccgaacttgatggttatcgatccatgtgatgccttggaaatcgaacaggcgattcctcagattgccgcgcataatggccccgtatatatgcgtttattgcgtggtcaggttccgttagtgctcgataaatataattaccaatttaaattgggtaaggcacaggtgattaaaccgggtaaagatttactcattatttctactggtttattgaccatgcgtgcgcttgaggcagctgaagaacttgaaaaagagggcattgaggtttcagtgctgcatgtgcctaccattaagcctttagatgaacaaactattttggaagaagtcgcaaaaggtggccgacctgttttaactgccgaaaatcattcagtcattggtgggttaggagaagctgttggctcattacttctaaaaaatggacaacatcctcgttttgacatgattggtttgcctgatgcatttttagatgcaggggcattaccaactttgcatgatcgctatggtatttcaactgaagctgttaaagaaaagattaagtcacatttgaagtag

SEQ ID NO: 1689 - DNA, 1266 bp, Acinetobacter baumannii
aaacgaagttttacaggtaaaacaaataaagttccagcaggacgctggaactcaatcaaggatgtagagatgaaaaagacttcattgatcatggcattcattgcaccgcttacgctgggggtaagcgtcaatgcatttgcaaaagactcattgcttgaatggaaaagtgatgatggtacggattcattaaagttaggtggggtggttcggttaaatcaacgttatgaagattgggaagggccaaaccgcggtttcggtaagctctattttgatattttcagggtagatctcaaaggtaagtttgatgatgcctatatcaacgccagctatctatttcaagaccaacagaaaacgtccattgaaaaagcgtacgtgggctataacctagatgccaataacagcattgaagcgggcctggtttataaaccatttacgatttatccctatccgcaaaatggctggacctatcatattccattctttttaggatatggcaataacattgcaccggggcttaactggaattatcacgacaaagattgggatgtaaaactcggttattacccgcaaatgttagaaaccaacttgcgttattcacctgaaagtgcaacttatgatgacttggcaggaaatgcatttccatctcaaaaagcttatcagaatgaaaaacgtcatcagtttaatacccgcattgtgcgcaagttagaaactgatttcggtaagcaagagtttggtgtctcgggtgcaatcgctcagctacataacaaagtgactgataaagacggtaaatattatgcagtcggtttgcataccgaaaacaactacaaacgctttaatttacaaagctcagtcattcactatcagtacgatgctaaaaatccggatggtgtaaatagtgacatgaccttaatgggcaataatggttttacacctgcttatttcattgcttcggaaggaaccattgccagtttaaaccttgcctatacgttgcctgtgaccaatatgggcaagctaaaagccattaagttttataatgattatagttatcttgataaaaaacgtgatgattggtcagactcgcaaatgaataccacagggatgatgtttattgcttcaccatttatggtttgggcagattatacgtggggtaaaaactctaacattattggtggggcaaccaactcaacgggttatacctctgcaacttcaccaaatagtgataaatggttataccgtattaactttaatatcgggtttactttctaa

SEQ ID NO: 1690 - DNA, 234 bp, Acinetobacter baumannii
aatttggtacttaaaatgaatatctgtgttggtggtgaactagatgggcaagtgatcgaaaaagaaggcagattacttaaggcttctgacattgatccatcattcaaaactgagtactacaagcaagtttttaaccgtgacaacattaattatcatttttggctaccaatagggtccaacttgcatgaaatgtcaaagcgagttttggatattttgagagcatcaaaaacttaa

SEQ ID NO: 1691 - DNA, 807 bp, Acinetobacter baumannii
tgggtgtcactaggagcgttcattatgctggaaaaatttaatcaatatcgccaaacctggactttacctttaaatcgccataaggctaacaatcaaacacaattccgctttgaatgggttgataatttaaaagaattacaagatgtacaacggtttcgtgcacaacaatttagtaaacaattcggcattcagtttgaagataatttagatcaagatatttacgattttggctgtgagcatgctgtattaagagaaaaatggacaggagagattgttgcttatacacgacttaagctcttccaaggccatgaaatagggcaaagttacagtgctaatgagtttgatattgtcccacacttgtcacatttgccaaatgtattagagatagggcgtacttgtgtgcatccacgttttcgtaatggtaaggcactttcaacattatggctgaatcttgcacctaaagtattgtggtcaatgcgtgctaaatatttgatgggatgtgtcagtattcatctgcaagataatttggctagagcgtactatacgcaccgtcaaattcagcagttaccggacattaaaaccatcgatattcgttctaagaaaatctatgaacctgaatatccggagtttagtttccctcaagatgagcggatgccgaaactattccaaatgtatttgagtatgcagtctaaattatccaaagatgccttctttgatgctgaatttaactgtctcgattactttgtatttttagaagtgaataaaattgccacttcgtttgtaatgaacaaaatggctcagcgataa

SEQ ID NO: 1692 - DNA, 1566 bp, Acinetobacter baumannii
gctatgccacttcatttttacttaaccgaggcagagatgacgcaacaaaacgctcaatcgacttctgaaccaactatttccgaaaacgatttaattgcacagcgtcatgccaaattaaagcaaatccaagatgttgcaaaggaaactggaaagagtccttggccaaatacattcaaacgtgaacattacgctgctgatttacaagaacaatttaaagatcagtctaaagaacaaatcgaaagcgctgaacatgtttatgtaaaagttgctggccgtgtcatgttaaaccgtggttctttcatggtgattcaagacatgactggtcgtatccaattatatgttgaccgtaaaggtttaccaaaagatacgcttgaaactattaaaggtttagaccttggcgatattattgctgctgaaggttatatcggtcgttctggcaaaggtgacttatatgtacaccttgaaggttttgaacttcttacaaaatcgcttcgtccattgccggataaatttcatggtttgaacgacacagaagttaaatatcgtaagcgttatcttgacttaattgtgaatgaagaaacgcgtaagacttttgaaattcgtgccaaagtcgttgcaggtattcgcgcatttttaactaatgaacgtttcatggaagttgaaacgccaatgatgcatgtgattccgggtggcgcgtctgcacgtccgtttgaaacgcatcataatgctttagatatgccattattcttgcgtatcgcacctgagctttatttaaagcgtttagtagtgggtggttttgagcgtgtgttcgaaattaaccgtaacttccgtaatgaaggggtgtcaacacgtcataaccctgaatttaccatgatcgagttttatcaggcatatgctgattataaagacttgatggctttaactgaaaacatgcttgaaaagttagctcttgatattttaggtacaactgatgtgccttaccaaggtgaagtgtttagctttaaaggaccattcaagaaaatctctatgtttgatgcgattttggagaataatccgcagttcacgcctgaaaatgtaggcgatcgtgaattccttgcaaaatttgttcgtgaggaattaaaagaagaagttaaacctggttttggtttaggtaagcttcaaacaatcgtatttgaagaaacggttgagactaaacttcgtcagcctacttttattactgagtacccagcagagacttctccacttgctcgccgtaatgatgataatccgcacattactgatcgttttgagttctttattggtggccgtgaattggcaaacggctttagtgagttaaatgatccgattgatcaggctgaacgtttccaagcgcaagttgctgaaaaagatgctggtgatgatgaagcaatgcattacgatgcagagtttgttgaagcacttgaatatggtttacctccaacagcgggtgaaggtattggtattgaccgtttggttatgctttttgcagatgcaccaagtattcgtgatgtgattttgttcccgcatatgcgtcgtaaagaaggttaa

SEQ ID NO: 1693 - DNA, 1188 bp, Acinetobacter baumannii
cgcggcaaactatcgtttcggtggtttgctttttttattgtgcaaactttgattttcatgcatgagacgggcaaaatatctatagactttttcaaggaatgcataatgcaggacatacctatgtcacgatggttatcgcctcttatggcgttttgcttatcttttgtcatcatggccactttggcacccaccatgggaatccagattgatcgtcaaatcgatttctggttattgtggtttggcactatgttgttattggcattaccagtttgttatttggaaattgctttagcaaaacgatcaaaaacaaccgctttaaatgcgttatcgagtttaactcgtgaagctgatagttcccctaaatggcgtgtggttggctggcttgctgttgtttttattcctttcttagcgggtaacgttctaagtactgcgagcaatatattagttgcacagtttgccccaagcatttccggtcaaattatttttgcaggccttgcagttgctgccttggtattatcttttattccacgccaaatactcattttattaatgaccttaggagtaatcgcttctattgtgttggcaaatatgatgggctcgactttacaaccttggcattggaccagtgttgagtttaaggagtggggtaatgcaactgtacttgcacttgtcgcgagcgggttaggtttagggctttactggcaaaatagtgtaggtgctgttcaggcgcaagaaggagcaacaaaaactgttcttccaatttggttagctcagctcattgctgtggttgcttttggctttttctcgcttcaggctcaattacccgttttaacgtggatatttactggtgtaatgacatccgcgttatttgtgcagttggctagagaacaacttgctcagcgtcagcttatgcctgttttacaatgggtgattattgttgtagcaattgtagtttgggctgtgccggaagttcataatttattcacgctcattcttatgctgtggggcttacttatttgcttaatctatgcaatttttgcaggttggattatgaaaattagccacttgcgtaaatcgatgaatttcagcaatgagcttttttataacttatggcgtattgctgtacgtatcgtattgccgctttcaattattgtggcaatgattgctgtaattggacaaagtatctaa

SEQ ID NO: 1694 - DNA, 903 bp, Acinetobacter baumannii
tttaggttttgtatgttggatagtaagcagtgtgaagcttttctggcggttgcagaagtcggaagttttgatgcagcaggagagcatttatgtataactccctctgctgtatcactacgtgtacaagccttagaaaaatatttagggcagattttaattatacggggccgcccttgtgtactcacacaagcagggcaaatcttgctccagcatttacgtcatacaaggttaatggagcaaaatctattacaaggtttaatgggcaaatcttctgaatcagaattttataaaattgcgttggcttcaaatgcagactcattagcaacttggcttttacccagtattcagcaaacactttttaaagaaaaaatagtattagagctaaaaattgacgatcaatctcacacgcatactttgctagaaacaggtcaggtcaatgcatgtattacagcagaagagcaagtgatggcgggttgcttagctcagcctcttggtaaaatgcgctataaaatgctggcatcggccgagtttgtaaatcggtggtttagtggtggaattaaccgagaagttttaagaaaaacaccggcggttatttttaaccataaagatttaatgcattcagaggttttattaaaaggatacggtttaccaatgcagagttatccttatagttttattccggcaacagatgctttcgttaaagcaattcaactaggtttaggttatggcatggtgcctgagcttcaggttcaaccattactcgaaaatggaacacttgttgatattatgcctgaggctcaacttgatgttcctttatattggcatcactggaaaagacagtctaagcaacttgatgtactgactgagaccattgttgaatcagcaaaacagatattaagataa

SEQ ID NO: 1695 - DNA, 7515 bp, Acinetobacter baumannii
aaatgtatttgtacatttttattggtcgttgagttcggtatttgtctgagaagttttatgaataaagtttacaaggtcatttggaatgcttcgattggagcatgggttgcaacctctgaaattgcaaaaagtaaaacaaagactaaatcaaaaactttaaatctatcagcggcagttttatcgggtgtaatttgttttgctccaaatgcttttgctgggacaaataccgaagggggagtaggccaaggaacatccatttctggtgcaacttcatgtcgtgaaggaagcgctaatacggctaatcaaaaagatattgctattggctgcggagcacaaactcaagaccgaactggctctaacatcgcaaatcgtaataatccatataataattctaccggtgcttatgctggcgcaatgaaacaaggcggagcaatcagtgttggtacgggggctgtggttgagaaaggcctaggaacagcaatcggttcttatgcgacgactcaaggtatttcaggtgtggcaattggtacgggtgctttatcttctggaaatactgctcttgcagttggtcgtcaatctgcagcgacagccgacttctcacaagctattggtaatgttgctgctgcgacgggtaaaggttctttagccatagggcattcagccactgcagaaggttaccgttcaattgcgattggctcaccagatattgaaaatgctgaccctgttgctgggcaggcaggtgctgcttatcaaccaaaaatggctactaaagcaacgggtaaagactcgattgcatttggtggaggtgcggttgctactgaagaaaatgctttagcaattggtgcattttcagagtctaaaggtaaaaaatctgttgcaattggtaccggtgcaaaggcacaaaaagataatgcagttgttattggggaccaagcagaagctagtttcgaaggcggcgtagcaattggtaaaggtgcccgttctgaagcggaaaacagtattgctttaggtaaagattcaaaagccagtcaagcaactggtgaaagtttcttgactaaacaatcagcaccaacaggtgttttgtcaatcggagatattggaacggaacgccgtattcaaaatgtggcagatggtgcagcagattctgatgctgcaactgtgcgtcagttaaaagctgctcgtacccattatgtcagtattaatgacaatggtcagcaaggtggtaactttgaaaatgatggtgcgactggtcgtaatgctattgctgtaggggtaaatgcttctgctgctggtcgtgaggcaatggcgattggtggtagtgcacaggcaataggttctggtgctattgcaatgggaagtagtagccaaactgtaggacgtggggatgtcgctataggtcgtaatgcatcgactcaaggtgccgaaggggtcaatagtaaccaatctgttgcgattggtgatcagacgaaagcaattggggaccagtcagtagcaattggtgccgacgtgattgcaaaaggaaattcatcagttgcgattggtggcgatgacgttgataaaattgcacgtgatacggaattaagtaatacctatacggaaattactggtggtactttacaggcaggtaaatatccaacaaccgaagcgaatcatggttcaactgctgttggggttcaagctgtaggtacaggagcgttttcttctgcgtttggtatgacttctaaagcaactggtgatgcttcttctgcttttggcgtcatgtcaaatgcttcgggtaaaggcgccgctgcattcggtgctgttgcacaagcaacaggtgatggcgcatcggcaatgggtattaactcattggcatcgggtacaaattcaacagcaattggctctggtaataaaccgggtgaaggagcaaaagcgactgggaacagttctgcagcaattggtagtggtgcgcaggcaacaggtgataactcagcggcaattggtaaaggagctgaggctacaaatgaaaatgctgctgctgtaggtggtggtgctaaagccacgggtaaaaatgctgcagcgattggtggcggtgcaattgccgatcaagaaaatgcagttgcagttggccaaggtgctcagtcattagttgaaggtggtgttgctttaggcgcacgcagtaaagtagaagccaaaaatagtgttgctttaggccaagatgctgtagcgacagaagcaacaggaacttctttcctgactaatcgtgatgcttctcaatctaatggtgtgatttctgttgggtcggctggaaaagaacgccgtattaccaatgtagaagatggctcagctgactcagatgcagtaacagtacgccagcttaaaaatgttgatagtcgtgttaatcaaaatacgagcaatattggtaagaatacccagaatattactaacctgaatcagaagttagatgatacaaaaacgaatctaggtaatcagatcacagatacaaacaagaatctgaatgatgccaagaaagaccttggtatccagattactgataccaacaccaagttaaataccactaaagatcagttaacaactcagattaacgacactaaaactgagttaaacaacacgattggtaatacgaaaactgaactaaataccaaaattgacaacaccaagacagagcttgaaaacaaaggcttgaactttgctggtaacagcggtgcagatgtacatcgtaaacttggtgacaagcttaatattgtaggtggtgcagctgcttcaactccggcggctaagaccagcggtgaaaatattattactcgcacaactcaagatggtattcagattgaactgttaaaagactcgaagtttgacagtgtgactactggcaacaccacattaaatacgaatggtttgacgattaaagaaggcccaagcattaccaaacagggcattaatgctggtggcaaacagattaccaatgtagccgatggtatcaatgccaaagatgcagtaaatgttgatcagctcaccaaagtcaaagagaacttaaatggcagaatcactgacacgaataatcaattaaatgatgcgaaaaaagatttaggtaatcaaatcgcggataccaacaagaatctgaataatgccaagaaagaccttggtgaccagattactgataccaataccaagttaaataataccaaagatcagctaacaactcagattaacgatactaaaactgagttaaacaacacgattggtaacaccaaaactgagctgaatagcaaaattgatagcaccaagactgagcttgaaaacaaaggcttgaactttgctggcaatagcgggaatgatgtccatcgtaagcttggtgagaagctcaacataatcggtggtgcagctgcttcaactccggcagccaagaccagcggtgagaacgttattacccgtaccactcaagatggtattcagattgaactattaaaagactcgaagtttgacagtgttaccactggcaacaccaccttaaatacgaatggtttgacgattaaagaaggcccaagcattaccaaacagggcattaatgctggtagcaaacagattaccaatgtagctgatggtatcaatgccaaagatgcagtaaatgttgatcagctcaccaaagtcaaagagaacttaaatggcagaatcactgacacgaataatcaattaaatgatgcgaaaaaagatttaggtaatcagatcgcggataccaacaagaatctgaatgatgccaagaaagaccttggtatccagattactgataccaacaccaagttaaataccaccaaagatcagctaacaactcagattaacgatactaaaactgagttaaacaacacgattggtaacaccaagactgagctgaatagcaaaattgacaacaccaagacagagcttgaaaacaaaggcttgaactttgctggtaatagcggtgcagatgtacatcgtaaacttggtgacaagcttaatattgtaggtggtgcagctgcttcaactccggcggctaagaccagcggtgaaaatattattactcgcacaactcaagatggtattcagattgaactgttaaaagactcgaagtttgacagtgttaccactggcaacaccaccctaaatacgaatggtttgacgattaaagaaggcccaagcattaccaaagaaggcattaatgctggtagcaaacagattaccaatgtggctgatggtatcaatgccaaagatgcagtgaataagagtcagttggacaatcttgctgccaagcaaaatgcaaccgatgatgctgcggtgaaatacgatgatgccaaaaccaaagataaagttaccttaaaaggtaaagacggtacggttttagataatgtgaaagcaggccacatttcatcgacttcaaaagaagcagtaaacggcagtcagattcacaagatttctaacagtattaaaaacagtattggtggaaataccgttgtaaacccggatggtagtctgacgaccaataacattggtggaacgggtaaaaacaacatcaatgatgcgattagtgaagtaaaaaatacagctacgaaagcgaagactactgtaactgaaggcgacaacattgttgtaaaagaaactgttaataaagatggcagcactaactatgaagtagcgaccaaaaaagatctaactttaaatagtgtaactacaggtgataccgtactcaataataatggtttaaccattaaagatggcccaagcattaccaaagatggcattaatgctagtggcaaacagattaccaatgtagccgatggtatcaatgccaaagatgcagtaaatgttgatcagctcactaaagtcaaagagaacttgaatggcagaatcactgatactaataatcagttaaatgatgcgaaaaaagatttaggtaatcaaatcgctgataccaacaagaatctgaatgatgccaagaaagaccttggtaaccagattactgataccaacaccaagttaaatactactaaagatcagttaacaactcagattaacgatactaaaactgagttaaacaacacgattggtaacaccaaaactgagctgaatagcaaaattgacagcactaaaaccgagcttgaaaacaaaggcttgaactttgctggcaatagcgggaatgatgtccatcgtaagcttggtgagaagctcaacataatcggtggtgcagctgcttcaactccggtagccaagactagcggtgagaacgttattacccgtaccactcaagatggtattcagattgaactattaaaagactcgaagtttgacagtgttaccactggcaacaccaccttaaatacgaatggtttgacgattaaagaaggtccaagcgttactaaagaaggtattaatgctggcggtaagaaaattaccaatgtagctgatggtgtaaatgccaaagatgcagtgaataagagtcagttggacaatcttgctgccaagcagaatgcaaccgatgatgccgcggtgaaatacgatgatgccaagaccaaagataaagttaccttaaaaggtaaagacggtacggttttagataatgtgaaagcaggccacatctcatcgacttcaaaagaagcagtaaatggtagccaaattcacaatatttcaaacagtattaaaaacagtattggtggaaatacagttgttaatccggatggtagtctgacgaccaataatattggtgggacaggtaaaaacaacatcaatgatgcaattagtgaagtaaaaaatacagctacgaaagcgaagactactgtaactgaaggtgacaacattgttgtaaaagaaactgttaataaagatggcagcactaactatgaagtgtcaactaaaaaagatctgacattaaatagtgtaactacaggtgataccgtactcaataataatggtttaaccattaaagatggcccaagcatcactaaagatggcgttaatgccggcggtaagaaaattactgatgtggctaatggtgtaattgcacaaaattctaaagatgctgtaaatggcgctcaggttcaccatatctctaatagcatcaaaaacagtattggtggaaataccgttgtaaacccggatggtagtctgacgaccaataacattggcggaacaggtaaaaacaacatcaatgacgcaattaagtctgtagatgaaaaagtcactaatggtgtaaatgacttgactcaaaaagggctaaattttggtgcgaatgaccagaaaacaacccaaggcaaagcagttcaccgtaagcttggtgacactatcaatattgtaggtggtgcggacgcaaaaactgctgaagataaaactagtggcgagaacatcattacccgtaccacagaagatggtgtcaaaattgagatgttaaaagatgtgaagttcgatagcgtgaatgtcgggggccatgtcttaaatcaacaaggtctaatcatcaagggtgggccaagcatcacagtgaatggtattaatgcaggtggtaaacaaattaccaatgttgcagacggtattaatgcaaaagatgcggtgaacaaaggccaattagacaagcaaattaacgaagttaaagatcaaattggtaaagatattggcaagctttctgatcatgctgtgcagtatgacaaagataaaaatggcaatgtcgacaagaactcagtcactttaggtggtggagaaaaaggtaccaatctgaaaaatgtagctgacggtaaagttgctgaaggctctaaagatgccgtgaatggtggtcaattatggaatattcaaaatcaagtcgataagaactcgaatgatattaagaatattcagaataacatcgacaacatttctaatggtaaagctgggttagttcaacagcaaaaaccaaatggtgaaatcacggtcggtaaagatactggtggtactagcattaatatggctagtaaagagggtgatcgtgttgttcaaggtgttaaagatggtgagattaaagctggttcgaaccaagctgtaaatggtggacaaatccataaaatttcagaaagcatcaaaaacagtattggtggaaatactacgattgatcctaaagatggctcaattacaaccaacaatattggtggtacaggtaagaacaatattaatgatgcgattgggaccttaaaccagtcgaaccaagaattgggtaacaaaattaccaatctgggtgatcagttacaacaagtgttctatgacaccaataaacgtattgatgacgttgagaaaaaagctaatgcaggtattgccgctgccatggccttagaaaatgcgccgtttgtagcaggtaaatatacctatgctgttggtgctgcatatcatggtggtgagaacgcagtcggtgtgaccttacgcaaaacctctgacaatggccgctggtcaattacaggtggtgtggcagctgcttctcaaggtgagccaagcgtccgcgttggtattagtggtgtgattaattaa

SEQ ID NO: 1696 - DNA, 1752 bp, Acinetobacter baumannii
tcaattccttgttttgattgcaaaaaccatctgattaaactcaagcacaattcttttaataattcagatgatacaatgaagtacaaagctcttctatctagtctttccattgctttatttagcttatctttagctggatgtaacgataatgattcacaagaaactgcggtaagtacaccaaagcagccgaatattttattcattatggccgatgacttaggctattcagatttaggagcttttggtggtgaaattcataccccaaacattgatagtttagcgcaagaaggtcgaattttaactgactatcacactgcacctacatgctcgcctactcgttcacaactcatttctggtactgatcaccacttggctggtataggtgctatggcagagcttacccctgatcatttaaaaggacaacctggctacgaaggctatttaaatgaacgctcactatcgattgctcaggtgctcaaagataatggttatcgaacttatattagcggtaaatggcatttgggattaacacctgaaaccaatgcacatgctaaaggttttgatcattcatttaccttattacaaggtttagaccaccactttaaacaagccccaagtgcctttaaacggaactcgacgtataccgaagatgggcaaattattcctgtttcagcattgcctgatgactttttctcgaccaattattttaccgacaaattacttagctatttagagtcaggcaaaaatagtggtaaaccattttttgcctatgcagcctacacagccccccactggcctatacaggcaccagcagaataccgtgaaaaatatcgtggtgtttatgacgttggttacgatgctatccgtaatgctcgtattgcacgccaaaaacagcttggaattattccagtaaattttgaggctgcagaaccaattgcaactcaaaatgcaccacaaaaatatggcaagtggaatgagttaacagctgaacaaaaagcgcttgaagcacgcaaaatggaaatctacgcaggcatggtagaaaatcttgatgccaatgtaggccgaattattcaatatctcaaacaaaataatctttacgacaacactttaattttctttgtttctgataatggcgcagaaggttttgttcgcggaagctatggcagtgaatcaggttttgataattctgtagcaaatgtaggtacccctacttcttaccattatattggaccacgttgggccgaggtcagtgcagcacctttccacttatggaaagatacagctggtgaaggtgcaactaccgctcctgctattgtgaaattaccaaaccaaaagaaagctgaagaaaccaatcatagctttgcatcggtactcgacgtttttccaacgttattagattatgctcatattccagtacctcaagggcaatataaaggccgaaccattaatacgccaagcggttattcttggaagtctgtacttgaaaataaatcacaaacgatacgccctgccaatttcagttttgccgatgaattgcatggtagtaaatatgcaaaacaaggcgaatggaaaattgcacttcaaggtcgccctgaattaagaacaggttcttgggagctctataacattgccactgatcgtggagaaaatcataatgttgcgcagctttaccctgcaaaagttcaagagctattagcggtttatcaaaaatacactgaacaaaatggcgtacaggaatataacgccaaatga

SEQ ID NO: 1697 - DNA, 1518 bp, Acinetobacter baumannii
aaacgcaattgcaatttgcgaacaagcctttgcaggagagacaaaatgagtgatgtacaagttcatcaattgtatatccatggacgctacgttgaagcaaccagtggtaaaacatttaatagtattaaccctgccaacggcgaaattatcgcgactcttcaacaggcatctgaacaagatattgaagctgctgtaaaaagtgcccaacaaggacaaaaaatctgggcagccatgaccgctatggagcgttcacgcattttacgccgtgctgtcgatattctccgtgaacgtaatgatgagcttgcccgtcttgaaacactcgacaccggtaaagcctacagcgaaacatctaccgtcgatattgtgactggtgcagatgtactcgaatactacgcaggacttgcaacagctattcagggcgaacaagttccgcttcgcgaatcaagtttcttttatacacgccgtgaacctttaggcgtagttgcaggtattggtgcctggaactatccaatccaaatcgctttatggaaatctgcccctgcccttgctgccggcaatgccatgattttcaagccaagcgaaacaaccccacttactgcattaaaacttgcagaaatctatacagaagctggcttaccagacggcgtatttaacgtggttcaaggtgctggtcgtgaaattggtcaatggctcacagaacatcctgtgattgaaaaaatctcattcacgggtggtgtagaaacgggcaaaaaagtaatggcaagcgctgctggctctacactaaaagaagtgactatggagcttggtgggaagtcaccactcattatttgtgaagatgctgaccttaaccgtgccgcagacattgctgtcatggcgaacttctttagctcaggtcaagtatgtaccaacggtacgcgtgtatttgttccaaaatcacgtttagccgactttgaaaaagcggttgtagagcgtgtaaaacgtattcgcgttggtgacccaatggctgaagacacaaacttcggtccgctcactagcttcccacatatggaaaaagtgttgtctttcattgagtcaggcaaacaacaaggcgctaaagtattaatcggtggtggtcgtgcgaccgaaggcgagcttgccaaaggcgcttatgtactaccgactgtatttagtgactgcactgaccagatggcgattgttcaagaagaaatttttggacctgtcatgagcatcttaagctatgaaaccgaagaagaagtgattcaacgtgccaacgacacgacctttggtctagctgccggtgtggtcactcaagatatcagccgcgctcatcgcattattcaccaaattgaagctggtatttgctggattaacacttggggtgaatcacctgccgaaatgccagtcggtggctacaagcaatctggtgtgggccgcgaaaatggcttaaccacgcttgggcactatacccgtatcaaatctattcaagttgaacttggcgattatcaaagcattttttaa

SEQ ID NO: 1698 - DNA, 837 bp, Acinetobacter baumannii
gaaactggttgggagggcaatgctctccttgctcgacagattaaagagattatagagatgaacaaaacaatccaaagcttagtcgtagcagcttttgctggtttcgcagtcacaacttatgcaaatgaacaggctcagccacaggaaattcattttccagcgattgaaaagagttatttgaaacaagtaaaacgttatgaataccaagatattgctcgtttagatacaggactaaataaagatcaaattcgagctttactaggcaatccacaatttagtgaagggctttttgcagtaaaagtttggaactatgtattagatgttcgtgttcctaacacaaaccagtaccaacgttgccagttacgtgttgattttgataagcactatttagcagaacgtttatcttggagaggtgaagcatgtgaaggtttggttgcttggggtgaaaataatcaggcaccagaacgtagcactgtaattgcagatcgtacagcgagtgtcctatttgcttttgatcgatttgatgcgagtgcgattgaagaaggtactaatagcgttgtgaaaattgctgagcaaattaagaaaagtccaacaacaaccccaattattgtttctggattcacagacccattgggtaagtttagttataaccaagagttatcatctaaacgagcgaatacggttgccaagttactggtacgacaaggtgttgaaccaagccgtatacaaatacaggcgaatagccagaccgacgtatacaagcagtgtagtgataacaatagttcacaacttattcaatgtttagcgccaaatagacgtgttaatataagttggtaa

SEQ ID NO: 1699 - DNA, 1068 bp, Acinetobacter baumannii
aggaaatcctgttatatgggttcatatattctaaagcgacttcttttaatgattccaacgttgttcattattttattgatcaactttgtggtcgtgcaaattgcaccgggtggaccagttgaacaggcaattcatgaagtagataggggcttaggagcagggcgtatattaggcactgaaatgtattatcaaggtgctaaaggtttaagccccgaaatggtcgagcaaattaaagcacaatacggatttgaccatcccccagtagaacgttttttactgatgttaaaaggctatttgactttagactttggacaaagcttttttaaagataaatcagtggttgagctgctctgggaaaaaatgcctgtgtcaatttcacttgggctatggagcactttgctgatttatcttatttcaattccacttggaattaaaaaagcgaagcaacaagggacatggtttgatcgttccacttctttattgctagtggtgggttatgcagtacccagctttgtctttggcatactgcttattgtcttttttgctggtggttcatattttcagtggtttccattacaaaacctagtgtcagataatttttatcaattgagttggttcggaaaaattacggactatttatggcacatgacgttgccgcttattaccatggtgttgggtggttttgccagcctaacttatctaaccaaatattcatttttagaagagcttaataaaccttatgtcctggcggcttatgcaaaaggtttaaatagccagcaagtcttatataaacatgtattccgtaatgccattttagtggttattgctggattgccggaagctttagcaggcattttctttgtgggaaatctttttattgaaattatttttcacctagatggtgtggggttgttgggctttgaagcaattgttcagcgagactatccggttatttttggcgtattgtttttcttcacgctgtttagcctgcttttacgtcttatttgcgatgtactgtatcaatggattgatccgcgtattcactttgacgcacaaggaggcaaataa

SEQ ID NO: 1700 - DNA, 1113 bp, Acinetobacter baumannii
cggggtgactgcataatggcaaatctagtctttaaatattcttgggatcatcgaccattcccttataactcagctcaaggtaagcggcaatttatgctgccttttgcttcgggcattccaaacctcactccagactggactcaagttacgggcttaggtacagcggcaacaagaggtgttggagtagaaagcggtaatgtagcagcttatggttcttatggtttatctaacttaggttatggtggatctccaacttcagaagccggaaatgatattgatgctggttataaagcagggggacaaaagactcgttttaagaatgcacccactagtatttatacaaatccctatatagctgcttatgcaccttctatcgtggttactcgtggagaatttacaggtacggagttatttttaccatattacacctcaacacgcgccaattgtatggctgtaattgcatggaattatgtgccatccactgacaccttaagtaaagcagagcaaatcgtttatacgagcaagaacaatatcgtttatacgaccgataacagcgcgaccagcggcaaattggttactgttgagacttctggcgaacttcgctccaaggggttcactgttgattcgaacggggtttacaaggcagcttcaccgattgcaagactatttgctgattcacttgaactcaatgaagatgcctcaaaacagccgattaactttgaaaagttaggtacaggtgactacctgattaaaggttctctgggatttgctaaagagggctggtacattgaaatgcctaaagatgcaaacggtaatgttcttgttgctgtgtcttatgagcagcatgaagatggggatattgcagtaaaaacctacaagaaaaaatttgatatcgaaacagcctcaattattcctgatttcgataatcctgtagatattccagaaactcgctggattgatattcgattgcatgaagaacccgaaccagagcctgaagaaccgttgagtgaaacaccattggagttccagcctactaacttatctcaggcagtagctgcagccttgaatggtgtggaaccgccagtgatctccgacacagatgcaacacattaa

SEQ ID NO: 1701 - DNA, 225 bp, Acinetobacter baumannii
gaatcaagctgcacaaaaaagatcaaattgaagtacagctcaatagactttgaacattgtttaagtttgcctttagctgatcgcaagataaaagtagatttaagtcttatacctcattttgaagatcgtgaagaaagtattttgtggttaactaactttattggaaaaatttgtgagcccagaaagatgcaaagacagaaaaaaaacttcattaagtacctgtga

SEQ ID NO: 1702 - DNA, 480 bp, Acinetobacter baumannii
gtatcactatggaaacatggcttaattgatcagcatgagaaatttaaaaaacgagtcgcaagttctgatatttctgggtataaaaaggtttttaaaaatgaacttgtaatggggttccctatagatgaaggtgttctaggatttcaaaaatattacgatgctgctgccgtaagcccagcatacaaaatctttagattaaaacgagaagttaatgtagaatatttggatttgattttgagatctaattctctaagaaaaatatacaaaagtaaaatgcaaggcagtgtagagagacgacgcagtattcctgatgaaatgtttttgaatattgagatcccgaatcctcctgaagaggttaaagatcaaatagtaaaacaacataaactaataaaggaaattgagaatagtctcaaggaaaatcaaaaaaaattgcgtctaaagacagaagcattatgggaacttcctcaaaattacaactaa

SEQ ID NO: 1703 - DNA, 336 bp, Acinetobacter baumannii
atccaaatatggatagacaacaatggattgatactaaatatttgtgcagttttgctggttgttatactccaccagtcacctatagatattcaaaagggagttttgataacaggcagcctgtttactcaactcctcaaagagaatcaaaaggctataataatactagaactagaagttctactactacacggactccaagaagttatagtaaaacgactaataactcttgttactgcacatctggaacttattgtgttgggcctagaggtggacattactgccttaatagcacaggttcaaaaagatatcttccacgataaactgtataagctttaa

SEQ ID NO: 1704 - DNA, 348 bp, Acinetobacter baumannii
aaatcgtcatggcaagaaaggcgtagttcgagttatggaccgcttagatatctgccgttttgtgactattcgagaagaaggaatggctgcatgaaaactttaaatagaacaaagaaattgaactttgatgaccagcttagcttactcgtgtttggctgtcatgcatcagcgcctttcagtgtcaaagacgtgaaggaatcagtgtttgatttcaatcgaggaaccatctacagcaatcttcaaaaatttgttgaatggaaatatttcgaacgtgttgggaaaaatcattacaaggcaactcaatacgcaaaagacatcctgaatgttaaaggggagctgaaagcatga

SEQ ID NO: 1705 - DNA, 372 bp, Acinetobacter baumannii
atgatgggatggaaggggaaaaagccgactagttttagtcttgaggtatctaaagcagcagaagaccatgtgaagcatattgtcatggatgctgtgcaatccttggttaatctaagtcctgttgatactggggcttatcgtgcttcacatatggtttcggttggatctggtgactatggcatacgtggacttgaaactaacccaattcaagatgctgctattcaagctgtaaagattaaattgggcaatttggtctacatacagaacaaccagccttatgctgaacgcttagaaaacggttggtccgatcaagcaccgcagggcatttatagcacgacgtttacttacattactcaaaagtacggtggctaa

SEQ ID NO: 1706 - DNA, 639 bp, Acinetobacter baumannii
aattttatttttataattatattaaatgagagcggtctattgagtttaattaaaaatatatgcattttattattaagttttttattggcatcatgcttatattctccatatactaagccagacgcaatttacgtatttagtgctgtcaccaaaactccagaaggtgttgtattttttaataaaaataaacgtcatcaaggaatgattttttataaaaaatcattatcactcctatataatcttggattattttctaaacttaattttaattttagaggttgttcagagtatgctgaaattacaagatgtgtgtggtctgcggatattgtattaaatcattcggaggctgcaagttatgggagcttgttattaaatgattattgggaagtagaagataaagagggactattttatatacgtactatagatgccgccaaacggtttaaacgattattaaatacaaaccagtcttatattaaatttttttatacggctccagatggaaattctgagaatgttggtagatttgtatctgccaagaatataaaaaataattatattgaaattatacctcagaaagttttaatttttaaaaaacctagcagggttagtcgcatacttcatgtcgatatgagataa

SEQ ID NO: 1707 - DNA, 1014 bp, Acinetobacter baumannii
ggttttattttcggtattttttttatgaatctggagcgggtagatcttaatctattaatatatcttgatgttcttcttcgtgaaaaaaacgttactcgcgcagccgaacagcttggtgttactcagcctgccatgagtaatattttacgccgcttgcgtaatttatttaatgaccctctcctgatccgctcatctgaagggatgacaccgacagaacgtgcacttgaattacaaccgcgtattcgtgatgctctttctgacctttccatgattttggaaccgcgtaccgaattccgcccttataccagtaatcgcgttttccgtattatgacttctgactatgcagaagccaccctagtccctcgtcttgttaaagctctccgctcagaagcaccaaacgttgtactcgattttcttactccaagtgatgtgtcatatagagacatggaacaaggtaaagttgatttagccattaaccgcttcaatgaaatcccgcaaagcttccaccaagttttggtttggcgtgatagctttagctgtattttaaatgacaaacaccccgctgtgactcatttaaatctaaaaagctatttagatgctcaacatatttgggtatctaaaacaggtatgggtgttggctttggggtaaacccagataaacaaggtggcttgggctggattgatcaagcattagaacgtattggtcaacgccgcaaaatttctgtatttacgcgtcactatcagatgccggcattacttgctcaaaatgttgacttgatcgctactcttccaactcggatggcgcgtttacaagcacaaaatccaaaattagttattaaagatccaccgttttacattcctgagtttgaacttaaaatggcttggtgtccattattgcaccatcacccagctcatcgctggttacgccaactcattctatttgttgctcgccaaatgatcgaagaggaaaatcgtgaattcctaaccaataattcacaattttcccactattaa

SEQ ID NO: 1708 - DNA, 2022 bp, Acinetobacter baumannii
tctatattgctattgagacgctatttcatgattacccgctttgcatctcctttgttgaacctcacgcttggcttggctctagcaggcttgtcaggtatggcattagctaaccctcctaaaatagatgcttcaacacttacggtcattgggtatcatgaaattaccgatactaaaaatgccttaattcctcaatatgcggtcaccactcaacaatttactgagcatgtcgattggttgcaaaaaaatggctttcattttattaccgtagaccagttaatccgtgctcatcagggcaaggcagcacttccaaccaagccagttttattaactgtagatgatggttatcagtctttctaccaaaatgcatatcctgttattaaggctaaaaaaatcccagtggtacttgcggtagtgggttcatggttagagccaaaagcagggcagaaagtcgatttttcgggtgaagaaattccacgtgataaaatcttaagctggggtgagctcaaagaaatgcaagatagcgggtttgttgaaatcgcaagccatagctatcatttacaccgcggtattacaggcaacccacaagggaactctgaaccagcggcaacgacacgtttttatgatgtaaaaactaaaacttatgaaaatgacagccaatatcaggctcgtatttataatgacttaaaaaagaaaaatcagctacttaaagagcatggtatacgttcaccacgtattatggtgtggccatatggtcgctataatatgcaaacggtccaaattgctaaaaagcttggtatgccaattaccatcacgcttgatgatggcgcagatcatgcgaaacaatctctacaaaatatgagccgtattttggtagagggcggaatgagtactaatgatttggctcaagagattaagaaccgtgaattaaacttaacggataacaaccgtccgcaaaaaatcatgcatattgatctcgactatatttatgatccggatccgcaacaacaagaacgaaatttaggtcacttgttagatcgaattaatgcgatgggtgtaaatacagtttatttgcaggcattttcagatccggatgctaatggttctgccgatatggtatatttcccgaaccgtcatatcccaatgcgtgcggacttgtttaaccgtgtagcatggcaaattcaaacccgtacgcctgtaagccgtatttatgcttggatgcctttattggcttgggaattaccaaaaactgatcctgtatcaaaagatttagtcgtgacagagcaggcaaaagctggtgaacacctaaatatggggtatatccgtttaagtcctttctcacctcaggcacgccaaactattcgtgagatttatcaagatttggccaagtcagcatctttcaatggaattttattccatgacgatgtcacattatctgattatgaagatgcaagcccagatgcattaaaagcttatgcgaaacaaggcttaccaacagatttggcaaaaatccgtgaaaacgatcaagatttgcaaaaatggactgcatataagacaaaatatctagatgattttgcaatgcaacttgttgaagacgtgcgacaatatgagccgttcttgcttacagctcgtaacttatacgcgcaagttgccttaaaaccatatgcggaaaactggtattcacaatcgcttgaagagtcattaagacgttatgattttacggctattatggcaatgccttatatggagcaggtcgataacgccgatcaattttataaagacatgattgatcgcgtgaaaaaatatccaaatggcattaagaaaacagtttttgagctacaagcaacaaactggcgtaacaacgaaaaggtaccgtcaactgaaatggcagcaacaattcactcactctatcagcaaggtgcaatgcacgttgcatactatccagatgacccaatcaaagatcatccggacgtgaacgtgatgcataaagcatttgctgaaaaatcatctcgtcttgtgccatag

SEQ ID NO: 1709 - DNA, 1041 bp, Acinetobacter baumannii
  unsure (148): Identity of nucleotide sequences at the above locations are unknown.
gtaaatcatcgatgggctttactgcggaaaaagcaatttcttttgactttgaccgtggtgctcaccgtactggtgaattacgtcgtggtgcggttgtacagattcaacaatggagtgatgttgcaaaccttactccgcaaggacttancaccatataaaaacgtagtgattgataccgtgggtgcaatgcttgaatgcattaaaacccacctgttacttacggcaaataaccgtcaaaaagatggttctttaaagttaaaggctcaaggtctagcgaaccaaaccttcaagcaatacatcaatactttgatcagtttaggtaaagatgttgttttcattgcacacgcatcagaagatcaaaacggtgatcaaattatttaccgaccagatctaggtggtaaaaaccgtaacgagctttaccgtatcgcagatgtcatgggttatctaacaactgttactactggtgaaggtaaaaatgcccgcgttattaatttcaaaccttcgcctacacatcatgcgaaaaactcaggtgctttaggcggtgaaaccggtgaagtatgggtacctgatcttaaagcacaccctactttcttggctgacctgattactcaagctaaagatcacattaacaccttaacgcctgcacaacttgcagcagctaaagcccaagaagagctagaaaactggaaacaaagctgtgaggaagcagagcatgcaggtgaccttaatcaattaactgagtcgcttgataaagaacatatgtattaccagaacatgcgccaagcaatgttaatgagggctaaagcattgaattgcacgtttgataagcaacgtggcacttggattagtccacctgaatttaacggtatctcagatcaacaaagagatgaacttcaaaactttattgctgaacgtggcctcgatgtaaaaacagtttgtgagcacttaggtatcgatgcccttatccaaattgaagcggcaaaacttaaggcagttaaacaagaaattgaaaccttagcgaaaacggggatgacagcatga

SEQ ID NO: 1710 - DNA, 879 bp, Acinetobacter baumannii
gttttcaatcgaaatttagcgtccttaggggcgattttttattgccttgagataaggctttaccccaatcaaacgagaggtttgaacatgtcattgccatttattgttgattcacttgatgcaatcaaagaagagcaccgtgctttatatgtcgaggaaaacgggaagtttcgccttgacttggaaggttatgaagatccaaaaggtttgaaatctgcacttcaaagcgagcgagatgctgctaagaatgcaaagttggaacttcaaaaacttcagaaacaatttgaagggattgatcctgaaattgttaaaaaagtctttgcccaaattgaccaagacgaagaagccaaattaatcgcggaaggcaaagttaacgaagtgattcagaagcgtaccgagaagatgcgtgaagaacatgaaaagttactgaaggctgaaaaagaacgtgctgataaagccgaagcttatgcacaaaagttcaagcaatcagtgattcaaagccaaattgtacaggctgctattgaacttgaagcactgccagaagcgacccctgatatcgcctttttagctcagacaaagtttgcattagatgaaaacggcaaagctgtggcagttgatgaaaacggggatgtggtcattggtaaagacggtcagacaccgatgaccccaaaagaatgggttgaatctctacgcgagcaaaaaccgtattactggcctaaacctaatggcatgggcgcacctggtagcaacaattcaaaaggtcagccagacattctcaaagccgatggctcggtaaatatgaccaaattagcgcaattacgaaatgaaaatccgcaactagctaaagagctagcggcaaaacacggtattaaactttaa

SEQ ID NO: 1711 - DNA, 381 bp, Acinetobacter baumannii
cgatggctgcttttgggttcttcgttattgcaaaagtcgtttggtcattttttcatggcgtttcacctgaaaccgatggtcatgggggcaattggggtaatcgctttaattgctaacgtttctgttgctttaatgctttatgcattccgcgatggcgatgccaatatgcgctctgtctggttgtgtagtcgaaatgattctatcgccaacattgctgttgttttggctgctgtaggcgtgtttggaacaggcactatatttccggatttattcgtagcctttgttatcgcatatttaggtgtatcttcgggttatgctgtgattaagcaatcattacaagaaagaaaacaatcaaagttaatgttgggttcagaagcttaa

SEQ ID NO: 1712 - DNA, 1011 bp, Acinetobacter baumannii
tttgagccgcttgtgaaactgattgcccaaaaaactgttcctacccatattatttcagggtttttaggggcagggaaaacgacattattgcaacatttattaagtcagaaaccgaaatatgaagtgtgggctgtcttaatgaatgaatttgggcaaatcggagtcgatcaacaactcctacctcaagatcaaggctatgcagtcaaagaactattgggcggctgtttatgttgtagtagccaacttcctatgcatattgctttggctcgcttgttaagtgaacaaaagccagaccgactctttattgaacctacagggcttggacatccttcgcaattatttgatcagttaacggaaccacattggcaaaacagcttagctatgcgtgcactagtgactgtggttgatggtagtcgtttgcatgacaccaattgggtcaagcaaaacctatatgaagaccaattaaaagctgcacagattgtggtggtctctcatgccgataccatgacttttgaagatgaacaggcacttgttgagcttaaagaagaataccaaccttatcagcaacaatggctaaagactgaacatggtcaacttgaactggcgcaaattgatgtgtctgctcgtttaactgcacgctctatacagcctttactcaagctgcaaaagcaaatgactgaagccgaagttgcaaaagaaattcaccaactgccttaccattatgttgagtcggcgcagggttatatagtcgcgggttggaaatttcctaagcgttggaaatttgagttttatgctttgctcgatgtgttgtgtgcacagcaagactggctacgtattaagggaatttttaatacagatcagggatggaagacctttaactttaatcctgagcagtttaactataagtctggtgaagagggcattgataaccgcattgaaatgattagccaacatgaacatgactggctggcatttgaaactgaactattagcttgcagaattgaagaatag

SEQ ID NO: 1713 - DNA, 1368 bp, Acinetobacter baumannii
aattttgcgcgatgttgtaaatctcctcatttaaggttactgaccatgaaaacccctctcccagattatttggcaaatgttatagaagcctgtgacatcgataatagcggtcatctcgccgattatattcctgagttggcaaatgcaaacccaaatcgattagctttagcaatgtctacggtagatggtgaaatttattcggtcggcgatgatgatgttgaattcaccatacaatcgatttctaaaccttttgtgtatgcttacgttttacaacaacttggtattgatgcagttcttgcgaaagtaggggtagagccttcgggggaagccttcaatgaaatttcattgggtaaagatggtcgtccaaaaaacccgatgattaactctggcgcaattactgtacattccttgattcaggtcaaacatggtttgcatagtgcagaaattctacgccgttttatgagtgagcttgctggtcgcgaattaagttttgatgagtctgtttatgattcggaagtcaaaacagcctaccgtaatctttcgatcggttatatgttgcgaacggtggggattttagaaactgacccagtcgatattgtgaatggttacattcgtcaatgtgcgatcatggttacagttaaagatttggtacgtatgggcagtgtacttgccaacggcggggtcgaccctaaaactggaaagcgtttgttaaaccgatctgtagtgagacaagtgctcagtgtcatgatgagctgtggtatgtatgatgccgcgggtgactggctttcaactgtcggtattcctgctaaaagtggtgtagcaggcggtattttgggtgtgctgccgggtcaagttagtattgctgctttttcacctcgactagatgagcacggtcatagtgttcgaggaattgatattttagaacgattatctcgtgacatgggattacatctcatggaaggtacgccttctgcacaaaccattgtacaaagccattatcgtactgggaaagatgcatcattgagtgtgtatgtgcttcgaggggtattgaaatttaccgaagctgaaatgttgttgcgtattttacaagacgagaccactgatcaaggcacaatcgtgattgatttaacccagatttcacttatccacgatgtgggtaaacgtatgttcttagaaggtgtagatcgtctgattgatgatggccatactcttgttttagtcgatcctgagcaacgattagatcatgcaagaacagctaaagatcgagaacttcatgtttatcatgatttcgatgatttgcttgaaaagcatgagatccctgcaaaaaaaaagacttatagcgacatcgcagcacttctaaactgctga

SEQ ID NO: 1714 - DNA, 2064 bp, Acinetobacter baumannii
aataagcagctatttttctcaccctatgtcattaagtcgatccgtatgaaacagcactttcctttaaaagatatccagcaagaaaagcgcatttatcgaggtcgtatattttttgccgtagggcttgtgattatctgtttattggtactagccagccgatacgcttatctacaaatttttcattatgatgagttctcgacggcatcggataaaaaccgtattcgcctacaaccccttccacctgctcgtggttatatttatgaccgcaatggggttttactggcagataattaccctgtttttaccgcaacattaagtaaagcagatgttgagaacgttgataccgttattgaacaattacagcctattttagaactcactcaagaagatgtagatcgttttaaaagccgcattaaaacagcacgtaaaactgaacgtgtggccattaaactgaatttgaccgagacaaatattgccaaatttagtgaagttaaatacaagttccccggggttagaattgaaacccaaatgacgcgctattatccacatggtgatttatttgctcacgtgattggatatgttggccgtattaacgataaagaattaaaaagtattgataaagatttatatgctggaacaaacctaattggtaaaattggtgtagaaaaaagctatgaagatttacttcatggaacacctgggtatgagtctgtagaagcagatgctcatagtaatattttgcgtcacctaggccgtaaagacccaacccgtggtaacgatctctacttatcattagattatggtttgcaagttgtcgcgtcgcaacaactcgctggtcgacgtggtgcaattgttgcgatagacccgcgtaccggtgaaattcttgcgttggtttcaagtccaagctttaaccctaacttatttgtgacgggtattaatcataaagattatagttctctacgtgacaatatagatcagcctctttataaccgtgcagtacaaggtgtataccctcccggttcaactattaagccaatggaagcgatgggcggtttacattatggaattgttgattgggctactgctatttccgaccctggttatttccatttaccgggtgactcacacaaattccgtgactggaaaaaaaccggtcatggcattgtgaacatgcacaaagccattatcatgtcttgtgatacctatttttatattttggccaatcaaatgggcatcgatcagatgaaccaatggatgcgtcaattcggctttggccaaaaaacaggtgtcgatttaccaagtgaaagtgaaggcttatatccaaatcctgaatggaaaatgcgtacacgcaaatccaaatggatgaaaggtgaaacgatttcagtcagtattggtcaaggcgcatttaccgcaactcctttacaactcgccatggcaactgccattacggcgaaccatggctcgcatgtagttccacatgttttacgtgcaacccatggtgcaaaaccttttaccgtacgtaatgcacctgatggaaaaattaatttcaatggtacagatgaagattggataaaaatgcgagaagccatgattgatgtaattcaatcaggtactggtcgtggcatccgtacaccgctctatcaaattgccggaaaaacaggtacagcacaggttaaaagtattgctcaaggcaaacgttataacgaagctgcgcttagtgaacgccaacttgaccacggtctttttgttggctttgctccggctgataaaccagaaatcgctattgcagttatttgggaaaatggccgtcatggtggttcagcagcccaacttgctaaacccgtgtttgattactggttattaacccgtaagaaaaatccgattcgaccagccaaccatcaggttaatggtggcctgatgactgctgggattaaaccgggtgaacttccaagtggtaatgaaagtgccagctctactccagcgacctctgctccgacttccgcagcagcctctactccacaggcaacaccaactcgtcctgctacaaatgaggtcgatgaataa

SEQ ID NO: 1715 - DNA, 306 bp, Acinetobacter baumannii
aggctggttagcacgactatttggagcgtagatatggcaggattctggagtaaattatttagcagtgaagaaaaaccatcaagtgctcaaactgccaaagatcgtttaaaagtcattgttgcatcagaacaaggtttaggccgtcgtttaagccaagacaagattgaccaaatgaagaaagaaattatgcaggtggtcagtcgttatgttagcggtgtaggcgaacagcatatccaaatgcaagttcgttctgaagcaaacatcgaaatgttagaaatgaatatcaatttacctgaagaacgataa

SEQ ID NO: 1716 - DNA, 537 bp, Acinetobacter baumannii
ttgctctttttttttactcgttttttctatttaagtttctataatacgtttactttgaaatctaaaaatgtgttgaaactcatgattcgtactatgcaagcctcagatattgatagtgttgctcaaattgagaagcttgttcaaacacacccatggtctaggcagcaatttgtagaatctttaaattcttaccaatgtacggtaatagaattaaataataaggtggttggtttttgtattttacaacctgtattagatgaagcgaatttactgctcatggcaattgatcctcaaatgcaaggtaaaggattaggatatcaattgttagatgcgtcgattgagcgtttagaaaatcaccccgtacaaatttttctagaggtacgtgaaagtaataaagctgctattggtttatacgaaaaaacagggtttcaccaaattgatgtgcgtcgtaactattatccaacccaagagggtggacgtgaaaatgccgttattatggtaaaaagctgtactgatgattttgcttctttattctaa

SEQ ID NO: 1717 - DNA, 822 bp, Acinetobacter baumannii
caaaagcatagcatgactcaatatcagcctccgcacattaatcgtaaactcaatgtacaagcttggtggctgaccgccctactgatctcgattaatgtaggtttgttcatctggcaaattatatctggagtggacattagtgacccagctataaaagatgcacttcactggggtgcagattttacaccacttactttttccgggcagccagaacgtctatttaccagcatgttttttcactttggcattattcaccttatgctcaacatgtgggctttatatatttttggtaatgtcgctgaagctttatttggacgtttatactttattggtctgtatttacttgcaggcttgtttggtagccttttgagtagttatattaatattcaaaatgggcatgaattattacaacattttgatcagagcttacttccccatgtcagtgctggtgcttcgggcgctgtgatgggattaggtgcagcattaactgttctttctttattttcgccgctgcctcatcaagcttatatacttgataagaaatcattattaatgattatggcgattaaccttattttcggttttgtcgcaacaggtattaataatgctgcacatgtcggcggtatgattatgggtgccttactcgcactcatttggtatttaagctaccgcactccattaaaaaatttcctaaaatttttaggtctattaggaggacttttaatgactgtcggcttctatgtttactgtaatcagcttaactcaccattacttccactttggcatgaaattttaattcagaacccagaaatactcccctaa

SEQ ID NO: 1718 - DNA, 1440 bp, Acinetobacter baumannii
tctttaaatagaagatacgctatgaatgtaagacactcatttccaaaaaatattttccgtgcttacgatattagaggcaaactttcttatttaactacggacgtcgtccgttcaattgcctatggattggcacaacaatataaacaagcagaacaaactcaactgatcattggttatgatgcgcgcttaacgagtccggcttatgcgcatttaatcgaagagatattagtacagcacggtttaaatgttacaaatattggttgttgctcaaccccgatgatgtactacattgcacgggagtttggtggtaatggtataatggtaacagctagccataaccctaaatcagataatggtattaaatggattttaagaggtgaacctccatctcctgaaatgatccagcaagtaggtgaatttgcgcaaacttatgtacctactcatacaatttcattattagaattatcaactcctcaatttaattcagaattttgtaaaaaataccaacaagcaatctttaacgatattcaactcaagcgccctttaaaagttgtattagatggcctgcatggatcggcagggcattgctcaaaactcgtacttgaaaaaatgggttgtgaagtcattgctttacgtacaactccaaatggtgagttccctgatcatgcaccagacccttcacatgctgcgcatttaaaagaactacgtaaaacgattattgaacagggggcagatattggtattgcccttgatggtgatggcgaccgtgtcgtattgcttgatgaaaaagctaatatacttactgctgaccgtttattgtcactatttgcacaaatgtgtctggagcagcaaccagacaaagaaattgtatttgatgtgaaatgctcgctcatggttcaaagaaccgtagagcgacttggtggtaaacccaaaatgattcgcacgggaagtagcttcctgcgcgcgtatttatcccaatcaaatggtaacgctatttttgggggcgaatacgcgggccattatgtatttaatgatgggcgtggttttgggtatgatgatggtttgtacgctgcattacgtgtaatggaatatttcaccgagtcgaatgcgaccacaatttctgatttattttctaattatcctgaaagatgctgtaccgaagatacttatattggtacccatcagtccgaccctaaacatgtactacaagatattgaaattttaagccatcgtttgggtgctcgaattagtaaaattgatggcgtacgtcttgattttaatgatggttttggcattattcgagcatcaaatacaggtgagtattttaccgtaagatttgacgctgataatcctttacgtttaaaggaaatccagcaaaaatttattgatatgttgcaagagcgttatccgcaaattgcacaagaactttctgaggcctaa

SEQ ID NO: 1719 - DNA, 1632 bp, Acinetobacter baumannii
tttatgaatagtaatgaactttatcaattatgggatgagtttttagagtcatggcctgtacagcgagtagaagcaatgacattagaagaatataccaaagctggtgatcctgattcatttatgaattgggttgagtttagaaccaaaccgcttgcaactatttcgggtacatcttcttttatatttggaatttatagtagaaaagatcaaacagctaaatcaaatacaaaaaataatatctatgaagatcaatatgcttggcgagttgcttatggtcgcaccaaggagagtgcttttcagcatgtaaagactcaaattttagctgtaattaaagcgattcagaataatgatcttcataaaatagaagaaatagatctaattaaaacagtgaagtggaaaatcgcgtttttgtatcaagatcgaaataacttaaaaattattccaacttttgctgagcaaagattacgttatttaactggtgtaggccttaaagataaagatttcaccatagagaaggcgtaccagcaattaataagcgagaaaggagatcaggacttatttgattttaatagtgctttgactcaaaaatatttggaagcaaatccaaaagataagtttaatacgcaaattgcatatgattatatgcatgaacgttatcctgaatttgaaaaaaatactgagtatttatttgttatagaaaataaatataactatgaattagctttagaaacaacaaattttgataaatctagtccacggctatttcttaaatgtataccacctaaatatataaaaggattacaagtaaattcaattcttaaaggaaaaagtcctaatagtaatttagagagtacaaaaacactcacaagagatgatgagttcgtacaagtgatagttacaaacatgcagcaacttgaggcactttgtaattggtgggatgaattaaatgaaagtaatcaagatagctcggaagcatcaaagctggaagtaagtcaaatggaagaaatagcacaacctttaaaccgtattttatttggtgccgctgggacagggaaaacttttaatacaatcaatcatgccctttctattattgaagataaatctttggaagaattggaaaaagaagagcgtaaagatctaaaaaacagatttgatgagtataagaataaaggacagattaagtttgtaactttccatcaaagctttagttatgaagatttcgtagaggggattcgagctgaaacggtagagtatagtgatggtaaaaaaaatattgaatatcctgtagtttcaggtgtatttaaattgttgtgtgacactgctcaatcaaaagtaattttagaaagtcaaaagatcaattttgattctaatacgaatgaaatatggaaaatgtctttaggtagggcaggtgaagatgaagatattttcgattactgtattaaaaaccattgtgtattacttggatggggagatgagctagacttttctaatgctgttaaccgtaaacaaattgaagaaatcatggataaaaatggttatgaagcttatcgaaaagaatatccctcagcttcaaggtttgttaatgacttcaagaataaaactaaagttggtgacttaattatcatttactga

SEQ ID NO: 1720 - DNA, 945 bp, Acinetobacter baumannii
ctaaggagtagtcaaatgattacagggatcgaaattttaaagtttggagttgaagatagagccgcttcaaacaagtttttagcagattttggtttaagcaaaagtgcttcggatattgaaggcacagatctttaccaaacccaaaatggcagcaaaatttatttatttaattgtgatgatgaccgtttgcctgctgccattgaacaaggttcaactttacgtgaagtgacttggggtgttgaaagcacacaagaccttgatgacttggcagctcgtttggctgatgtagacggttttaaacgttctgaaaatacagttcagtgtcttgacccaaatggcatgaccattcgttttgaacaaagttttgttaaggaagttcctgaacttaaaacggaaggtattaaccaatacggcaatattcaacgtgtgaatgcagcaagtcctgtttatgaaaaaggtcaacctgttgcgattggacatgtggtgtttttcacaccggatttggcaactactgaaaacttctatattgaaaaagtaggctttcatttatcggatgcctataaaaatcgcggtgcattcttacgttgccgcggtgaaggttatcaccacgatttattcttacttagcgttccaaataaacctgcgggtctaaatcacgttgcatttgttgtccgtgatattcatgaggtgattggaggcggtttacatatgaaccgttcagagtggtcaacctttattggaccgggacgtcatccaatttcttctgcttatttctggtacgtcaactcaccattgggtggtgcatttgaatattacaccaacgatgattatttgaccgaagaatggcagccacgtgtagaagaacatcgtctagagcttttcaccgagtgggcgattgaaggtggtcttgatgacaaaacccgtcgtcaggtgaagcctgtttaa

SEQ ID NO: 1721 - DNA, 1497 bp, Acinetobacter baumannii
aagcaatacagatttaagaaggatttgatcatggcaaaggaaatttatattgcgggtgaatggcgattaggccgtggtgcagtcattcaaagcctgtttccggcagatcagtcggtaaacgctgagctttcgacagcaacgcttgaagatgtaaatgaagcaattgaaaaagcggatcaggcttggcgtcaaccgagctggagaaacagcttgccgcatgagcgcgcacgtattctctacaaagttgcagacattattgaagcgcgtgtagatgaattatcaaaactacaaacccgcgataatgggaagcctttaaccgaaactcgtggcttggtgatgagcgcggcggcaactgcgcgttatgttgcagcagcatgtgaaacgctaaatgatgagctcaccactcaacgtgctccagactttatgaccatgagtgtgcatgaacctgtaggcgttgtggcagccattaccccttggaactctccaattgcgagtgaagttcaaaagcttgctccagctttggcagcaggaaatgccgtggtgttaaaaccagcagaagcaacttcactgattgctttagagcttgccaaaatttttgaagaagccggtttaccaaaaggcttacttagtgtgttagtgggacgtggttctgtgattggtgacgcaattgctcagcacccattggttcgtaaaatttcttttacaggtggcacaactacaggtcgtcatttggcacacattgctgcagataaactgattactacttcgcttgagttaggtggtaagtcaccaaccatcgttttgccggatgcagatgtcgaactggctgctaaaggtgtggcttacggtatttttagctcggcaggccaagcgtgtattgcaggttctcgcttgtttattcatagcagtctttacgatcagtttttaacgcgtttggttgaaattaccaaaggcttacgtgtgggccatccggaacagacaggcgtgcatttagggccactggtcaatgacaaacatttgcagtcagttgaccgctatgtgcaacttgctaaaagcgaaggtggtcaggttctgattggtggtgaggcacttacgactggtgactatgccaaaggaagctattacttaccgaccattattacgggcttaaataacagtgctcaaacctgtcaggaagaaatttttggtcctgttttagtcgttatgaaatacgacaacgagcaagatttaattgcccaagccaatgacagttgttttggtcttgccgcaggtatttggactgaaagctatcgcaaagcttggcgcatcgcacgtgccttagaagtaggaacggtatggattaatacctacaaaaaattctcgattagtgcaccgtttggtggctttaaagacagtgggatcgggcgcgaaaaaggccgtttgggcattttatcgtacatgcaacaaaagagtatttatatggggctgaatgaacagcctaacccttggtgcgattaa

SEQ ID NO: 1722 - DNA, 300 bp, Acinetobacter baumannii
atcagcaggctatcaatgtctatgctgagcataatgatttgccagtggctgctcatatttttaatgactgtatttttgcgttggataatttgtttttggaggagtgccataagaagatatcaaccaaaagcaaaggtaagtgaccaaattaggtattgccagggactgaaaagcctaatttggtcaaaacgtcaaacaattaagcagttgctcttaaacgcgactcaaaataacgcagtcgatgttacaaaatacttgatctggattgacagaaaattacctttaaggtgttgcgcgtga

SEQ ID NO: 1723 - DNA, 810 bp, Acinetobacter baumannii
gagagattaaggattatgagcttccaagttgaaggaaaagttgcagttgttaccggtggctcatctgggattgggctggctgctgttgaaatactggttgcagagggtgcaaaagttgcttggtgtggtcgcgatgaagaacgtttaaatgcttctaagcactatattttagaaaaatttccacatgccaatatttttaccaaagcatgtaatgttttgaaaaaagaagaagttcagcaatttgccaaagaggtcaaactcaatttgggcaatgtggacatgcttattaacaatgctggacaaggccgtgtttcaaattttgaaaatacgcaagatgaagactggatgaaagagattgagctgaaatatttcagtgttttacatccggtacgggcttttcttgacgacttaaaacagtcggcaaatgcctcaattaccaatgtgaactcgttactggcattgcaaccggaaccgcacatgattgcgacttcatctgcacgtgctgcactgttgaatttaacccattcgttggcacatgaatttactcaatatggcgttcgtgtgaattcgattttactcggaatggtggaatctgcgcagtggaaacgccgttatgaaacccgttcagatttaaatctgtcatgggaagagtggacaggcaatattgcaaaaaatcgtggcattcctatgcagcgtttaggccgtccagaagagcctgcacgtgctttagttttcttggcatcaccattggcatcttacaccacaggttcggcaatagatgtctcgggtggttttaacaaacatttataa

SEQ ID NO: 1724 - DNA, 930 bp, Acinetobacter baumannii
ggcctaataaggagaggcgcaatgccacaagatcagcatctcggcgtcgacaaagcaaaaatcttgattgaagctttgccatatattcaacgtttttctggtaagacgctggtggtgaaatacggtggtaatgcgatgactgatcctgaattggaaagttcatttgcccgcgatatcgttttacttaaaactgtgggcttaaacccgattgttgtgcatggcggtggcccacaagttgactctttcttaaagcaattaggacgtgagtctgaccgtattgatggtatgcgtgtgaccgatgaagctacgatggaagtggttgaaatggtcctaggcggtagcgtaaataaatctattgttaatttgattaataaacacggcggccgtgcaattggcttgactggtcaagatggtaacttattacgtgcccgtaaattattaatggaaaaacaagaagaggacggttctatcaaacatatcgatttaggtatggttggtgaggtgaccggggttaaaactgacgtattagagatgtttactcaaagcgactttattcctgttattgctccattaggtgttgatgaaaaaggtaatacttacaatattaatgctgacttggtggctgggaaggtcgcagaagcattaggcgcagaaaaattaattctgctgactaatattagtggcgtattagatgaaaacaaaaaccttttaaccggtttaacgacacaagaagttgaccgtttaatcgaaacaggcgtaatttacggtggaatgattcctaaagtaggctgtgcccttgacgctgtaaaaggtggtgttgtgagcgcacatattgttgacggtcgtgtaccgcacgcaacattacttgaaatctttacagatcacggggttggtacgcttatttctaaccgtacacaaacaactcactaa

SEQ ID NO: 1725 - DNA, 459 bp, Acinetobacter baumannii
cggagaataaggaagtcgaatatggaaactctaatatatgaagtagaaattaatgcccctatagaaaaagtatgggacgtactctggaatagtgagacctataatgcatggacgaaattctttgctccagattcttcaatgcgcacagattggaaagtgggcggtaaaacatattttctagatggagaaggaaatggaatggtttcgaccattgaagaaatgaaaaagcctgaagtactaatttttaaacatttaggaatgattaaagacgggaaagaagacttggaaagtgaagaggtgaaaggctggagtggttcgctagaaaaatattttttaagtcaaaatggggatactacaacggtaaaagtagaattagccaccttacctgagtacatcggtatgttaaaaagtggcttcgttcaaggctttgaagctgtaaaacaaatggctgaaaaataa

SEQ ID NO: 1726 - DNA, 255 bp, Acinetobacter baumannii
  unsure (245): Identity of nucleotide sequences at the above locations are unknown.
atgaggataagaataatggctctaccgattattactgctgaccaaactttattggttcaagcaattattgtgtacctatacgctgatccgggtttaggtaaatcatcgatgggctttactgcggaaaaagcaatttcttttgactttgaccgtggtgctcaccgtactggtgaattacgtcgtggtgcggttgtacagattcaacaatggagtgatgttgcaaaccttactccgcaaggacttancaccatataa

SEQ ID NO: 1727 - DNA, 243 bp, Acinetobacter baumannii
ggagttgggcttatgagtgagtcaagacatttagtgctaaagcgtcaccctactttgaaaggttatctggttatttgtgatgaagaaactggacaacctctagctggacaaagagcagtacagatgaattctgatgccttaaatggacccgcaacaattactgtaacttttgaagcatatggtgctcatggtgttcgcttagtgagtgatgcaccaaggccaaatcaaacaaaggaaatgtag

SEQ ID NO: 1728 - DNA, 495 bp, Acinetobacter baumannii
gagattcaaaggatgagtgtggttttacctgtcgcgaagcgtggtgaagatattttaaaactaattgcagctcccgtttcggcaaatgagttaaacagtaattggctttatcagcttgctgatgctatgcatgcgacaatgcttgagcgcaatggagtggggattgctgcaccgcaagtttatatctctaaacgcgttattattgtggcttctcgaccaaatccacgctatccggatgcgcctgaaatgaatgctgtggtcatggtaaatccagaaattttagaattttcgagtgaaacgtgtttgggcgaagaaggctgcttaagtgtaccggatgagcgtggacaagttgaacgtgcagaaatggtcaaggtgaaatacttaacacttcagggtgaagcagttgaaacaatttttcacggttttcctgctcgtattgttcaacacgaggtcgatcatttaaatggaatcttgtttgtagaaagaataagctaa

SEQ ID NO: 1729 - DNA, 543 bp, Acinetobacter baumannii
aatatcaaaaggatgaatttcgattcgtccttttgtttttttaagacttctgttgagatatttagactagctatgacgcctttaacctcatcacctcgcctcttgtcattatgctttaagctcgtgcttgttttgctactggcttatcttttgttaagtgggttttatatgtggatgattggcggtacagccatttacgtcagctcagccgtgttatttgtcattactgcctattcttttaagctcggtaaatatcaaaaaccgtgttctgttttaaatgtgctcatgagtgcactcgcgttatatttcagcacggctcatctatttttctcccctatccagttctttatatttttacctgcgctattttttgttgtgttggcttttactcaagtaagtaaagttcgtagtttatctaaagtactcatattaattagtttattgatttggtcaggcgtacattttacgcagcttgaacaactcaaagcgtattatcaaacacagcatactggtgaaagctggcagcaatacggcgcgctataa

SEQ ID NO: 1730 - DNA, 189 bp, Acinetobacter baumannii
atgctccgaagatgccgctgcatgtcgttacccttgaaccctaaagttcaaggtggaggtgacgcatacttgctgggtttcctactcggggtaggcatacgctctaaatatgcagaacaccatcctaaagagatgatatcggctcaggggaatcagaccggctggcgaacatcccagagacagctttag

SEQ ID NO: 1731 - DNA, 327 bp, Acinetobacter baumannii
aacaaaatgaggacgcaaggtatgagttggatctcagtttgtcagcagggtgacgttagcgaagatgagccgaaagccatcgaagttgaagggaaaaaaattggtgttttttttgtcgatgaaaattacttcgctatcgaaaatgtttgccctcatgcgtatgccttattaacggaaggatttatcgaagatcagactgttgaatgtccattgcacgaagcaatttttgacattcagacaggtgagctaaaaagtggacccgggtgtagaaacctatgtacgtacccagttcgtgttgaaggacaggatattcaaattcaactctag

SEQ ID NO: 1732 - DNA, 270 bp, Acinetobacter baumannii
attaagatgagtgcaccacaatataaaccaatgagagaaagtgaagtttgtaatgctatcgggtgggtgttaatagctcttggctttatcgcaggttttttatttattcttgcatttggtcgaattgaagtagcttcttactatggtaaagaaacggtttggtctggagttatgatagcaacaggaatcggaattatatttaatggattccttgcaggctacttatttcaaaaagtagctagtattcttcgttaccatgagaataaataa

SEQ ID NO: 1733 - DNA, 576 bp, Acinetobacter baumannii
ttaaaatcgagtattcttagcgccaaatttttggacatattaactatggcgcttaaagcaacaatttataaagcagatctgaatattgccaatatggatgaccatatttatggcgattatcaactgacgcttgccttacatccttctgaaactttagaacgattaatggttcgtgtcatggcttttgcacgtttcgcaagtgatagccttgagtttaccaaagacctttttgaaaccgatgagcctgcactttggcaaaaagacttaacaggacagttagaaacctggattgaagttggtttaccgtctgaagataaagtgaaaaaagccagtgcccgttgtaaaactgtggcaattgtcgcttatggttctcaagttgaagattggtggaagagaaacagtaaaattaaaacattgagtaatgtccaagtttggcagctagcatctgaaagtacagcagagttagagcagctttgtgagcgtacgatgcagcttcagttaaatgttatggacaatgaatggactttgttaagtgacaagggccaagcgaatgttgtgtggacccaattacagtaa

SEQ ID NO: 1734 - DNA, 1242 bp, Acinetobacter baumannii
aaatattggagtttttcaggtatgacgtcttcaatacaattgaaagatggtattgccaataccgttgcaaatgatcagtctcaaggaatgattattaaaattgtaggcgccgtggcggttgcacatttactgaacgatttaattcaggcagtgctaccagctatctatccaatgctaaaagcaaacttttcgctgagttttgcggaggttggcctgatttcgtttgtatatcaaattacaggctcgctgctacagccttggattggactttataccgataaacatccaaaaccgtatcttctcccactcggaatggtcgtcacattctgcggcattatcttgttggcattttcaccaagttttgctgtgttgttatgtgcatctgctctgattggggtagggtctgccacctttcacccagaagcttcgcgtgtggcgcgtatggcatcgggtgggcgcttcggtacagctcagtcgacttttcaggtgggcggaaacacaggtactgccattggtccattattagcagcattattaattgttccatttgggcagcatgcagttgcgggcttggtgatatttgcacttttagcgatttgggttttatttggtgtaagccgctggacagtaaaccatgctaaaaatcaggtagctgcacgtgcaactcaagcacatactaaattgcatgggcgtaagctcattattgccttaggtacaattagtgtattaatgtttgctaaatttacttacattgccagcattagtaactattttactttttatttaattcaaaagttccatatcagcattcaaacagctcaattacacttatttgcctttttggcagctgtggctgtaggtacatttgcgggtggcccaattggcgataagattggccgtaaagctgtgatctgggtttcatttgttggcatggcgccgtttgcattaatgatgccatatgcaaacttgttttggacaacggttttctcaattattgcaggtttggtgttgtcatctgcttttgcagcgatggtggtttatgcacaagaagctgttccgggccgtgtaggcatgattgcaggtttaatgtttggccttatgtttggggtaagtggtattgccgcagcggggctagggcatttagcggatattaacggcattgaatgggtatttggtttatgttcattgttgccattacttggttttgcaacagcacttttaccaaacacaaaagttaaataa

SEQ ID NO: 1735 - DNA, 1029 bp, Acinetobacter baumannii
cgcacaaggaggcaaataatgtcttttattgtgcggtcacggctgcaaaagtttaggcaacataaattagggtggtcaagctttgttttgtttagccttattttgatgatgtccttagctgctgagctcattgccaacgacaaaccattgttggtgaaatatgaggacgcttattatttgcctgtctttaaaacatatcccgaaaccacttttggtggcgtgtttgaaacagaagcagattataaagatcccgctgtacaagaactcattaatcataaaggctgggctatttggccccttataagattttcttaccagactcctaatttagacttggctgtacctgtgccatcgccaccttctaagcagaactggttaggaacagatgaccaagggcgagacgtgcttgcacgtattctctatgggcttagagtctcattacttttcggcttggctttaacagcttgtgcagcgctacttggtatttttgtgggtgctatacaaggctactatggtggctgggttgatttgttggggcagcgactggtagaagtctggaatggtttacctatgctctttatggtcatgattttggtcagcatgtttaccccaaatgtatattggctattttttattatgctgttctttagctggactgtacttgtgggaattgtccgtgccgaatttttaaaagcgcgtcaacttgactatgtgcgtgcggctcaggctttaggtgtaactgatagagcaattatctttaagcacattttgccaaatgccataagttctagcctatcgcagttaccttttattttgaccactaatattattgctttaaccgcacttgatttcttgggctatggtttgccgccagatgcagcctctttaggtgagttgttgttgcaaggtaaaaataacttagacgcaccgtggttggctttatctgggttttttagcttagcttttgtattgtcattattaatttatattggggaggcggcacgtgatgcatttgacccaagaaaataa

SEQ ID NO: 1736 - DNA, 480 bp, Acinetobacter baumannii
aaaacggttggtccgatcaagcaccgcagggcatttatagcacgacgtttacttacattactcaaaagtacggtggctaaaatggcaatgactttagagcagacaaggcaagctattatcgatcgtatgcaagcttttaccggtattacgcaagacagaatccagtatccaaatttaccaggctttaatgtacctaaagatggtgtttggtgccgcttaacgattgcaggtggtcccagttttacttctggcattgcagataagccatgtactcgccgtaccggtaatatcatgattcaatgctttgatcgacttcatgtgggagaaaaagctttaacggttcttggcgatgctttgctggcacattttgaatatttcacaatcgaacacttagaatgtttgaatggccaatctatttatgcgggtaaagatgctgatttcattcagtataatgtgagcattgggtttaaggtgaattaa

SEQ ID NO: 1737 - DNA, 201 bp, Acinetobacter baumannii
attgcgtctggcttagtatatggagaatataagcatgatgccaataaaaaacttaataataaaatgcatatatttttaattaaactcaatagaccgctctcatttaatataattataaaaataaaattttataccataaaaatttcatttaataatagaatatatataaaacaatcctacacactccactcaaccctataa

SEQ ID NO: 1738 - DNA, 321 bp, Acinetobacter baumannii
ttatttactggaggaacctttctaatgtcgaaacaaactactccagagtttcttttcgagccaaagctgctaccaatgcagcttttcgagaagttcattgtgttcaacgtaaatgccgggtatcgcgggaaaggtacaccacacggcgtgaaccttattaaaggtaataagcctaccctttccttaactgataaaggcgtgatgaacaaagcagctcaagagcggtacaagttaatgcttttgaagtatttcaaagaaggtcgctcagcaatggatgagcttgatcatgaagttaagcgtatatatcagatggtggcgtga

SEQ ID NO: 1739 - DNA, 345 bp, Acinetobacter baumannii
caagttggtggaggcttaatgatgtctaatttcaaaaagcaccctgacggctacaagtcatttttaggccgtgatgataagggcctctactctgttcgtattggctggcaagtgtacgcatctaatgctaatggttcagttctttacaaagttaaagacggatttaagacgcctttaaatgtgttcaggttccaaactgactatccaaaagtttggaatgaactcacacaagaaattgatttccaacgcagaaagcagctcgcaataaaactgcgtgaaacaaatatccctacttatgaccgcaaagcttataaaactaagcgcggcttcaccggctctagatga

SEQ ID NO: 1740 - DNA, 720 bp, Acinetobacter baumannii
gagtctggtggagtgttgaaacgtattgctgtaacagcgctttgtgtcgcaagtttgtcaggttgcgcaagttttatttctggtggaacaggtacagctccagttggaacagatagtggtgtacgtagcttaggccaagtatttattgattcttcaattaagcgtacagcgaatattaacctctataagcttgatcagcgttttaaacaatctcgtattaacatcgaaagcttccatagcacagtattgttaactggacaggtgccagacccatacttaaaacagttggcagaagacaacgttaaagccatgagtgatgtgaaagctgtacataactacattaccgtgggtaacaaagtaagctataacacgatcatgcaagatgctggggtaaccgcaaatacacgtgctttattaatgaaagcgccagtagtatcggacagtaaagtactggttcataccgaagatggtgttttatatgtgatgggtcgtttaaacacagctgaaattaatgacttaaacaatgtgcttcaaaatgtcggtaatgtgactaagattgtaacgctcattgataatattgatttggcgcctgctccggcagcaagtactgccagtgcaacaactacaccagtaattaataacgttcttgctcaaccaacagttcaaactcctgttgcaattgatccggaccaaacagatccagcatcttctgcacaataa

SEQ ID NO: 1741 - DNA, 1287 bp, Acinetobacter baumannii
tgtcattccgggtgtgaagccactggtagcaaactatgcaatggggttaaaagcatgagtgaagtgttagatgtcgtcattgttggtggtggactagttggtggcttaactgctttattacttgcacaaggtggtgtacagcctaccgtgcttgatgctgcccctgtacttgatgttgaaaaaacattaagcgtgatgaacccgcgtgttttagcacttagccaagcgaccatccatttacttaaaacagtcaatgtttgggatgatctggcacgtcaaatgccttatacaggcatgcaagtgtggaacttaaatggctatggtgaaattaattttggccatgagtctgtgcaaagaccaatgccagagcaagccttgggttctatggttgagccaagtgtattgaatgttgctattcaacaaaaaatgattgagcagttaacagattatcgtactcaagttcgcgttacccgtattgagcaaggtgttgggtgctggcatattcaacttgcagatggcacaacacttaaaactaaactgcttattggtgcagatggtgccaattcatttgtacgtgaacaagcttttattgacctagatgtactagattacaagcaagcagcgattagctgtgcaataaagacttccaaacctcatcactatgttgcccgtcaaatcttcttacctacagggcctttagcatatttgccaatggcgagtcttgaagaaagtgaaaatggctactggcagtccattgtctggacactaccagatgattatgccgatgaatattcggctttaagtgatgctgagtttatgcaacttctaactcgtgaaagccaacatatgttgggtgaagtgctcgatgttcgttcaagagcccaatttccattgaaagcgcgtgccgcaaaacaatacgttaaagatggcctagccctcattggcgatgcagctcatgtgattcatccacttgctggacaaggggtgaatattggttgtttagatgcagcggtactctgtgatgcactattgcatgatttaggtcgtggtgtatgggcgcatgaacaaaccttaatgcgttatgaacaccgccgtaaaggacagaatgatgcgatgatgcatagtatgtcggcaattggttggctagaaagcagtgagctatttccattgatttgggcccggaatgtgggactcaagcaagttgaacaaatttcgttcttaaaagagcgttttatgcaacaagcaaatggtttaggggctttacaaaacacccagtatagtcgttaa

SEQ ID NO: 1742 - DNA, 918 bp, Acinetobacter baumannii
atgagttcaggcgcaaaaattcgattatatgcttgtgaagaagcggtgctgggaacaactccggcaaacccgatctggtacacggttcgccgtgtcagtgatggtttatctgaaaacgtctcaactgaagaaagcagtgaagtagtagattcacgttttcgacaaggtggtgtggttactgaagcagaggtaacaggccagttagagtttgaactatctcttggaacatttgacttattcttaagtgctttagcctttaataactgggcagcaaatgctttaagctttggcggtaccgtacgtaaatctttaacactggtcaaagtatttgaagatatcggtcaggtatttatttaccgtggtgtacaggtgaataccggtgaaatcaccattcaaacaactgggaaaatcactggtaattttggactggtaggtagctcatttacacgtcagcaagtcaatcctgttactaatcctatagctgcaacaacccgtccactggtcagcatgccaaacgtggaaaacttactggtaaatggacagacgattcaaggtaaagcgtgtttgcagtctcttacgctttcaattaataacaatcttgaagcaatccgttgtatcggctcaggcaagtacacaccagagttctacattgaaaagatgatggatatcgaagcaaatgcttccttcatgttctcggcaactgcggcagggtggattgatgccattaaaacccgagatgtgtttacgctgacctttgatattaaagacagcaaaggcagtaaatactcgtttaacttccctcaattagaagtgatggaagccaatcacccagatgacgggggtgacgacatcattactttagatatcaactttgcccaagtccgtacagcaccaacgattgtacgtgctctcgtgtaa

SEQ ID NO: 1743 - DNA, 327 bp, Acinetobacter baumannii
acgttacaaggaggcggtatgaaaccagaacagtttattcgtgagtttgggcctaacactttcagaatatcaatgtcatttgtcaacactgctaagtatttggtggttcatgaaggtgaaattgattttacagatgaaatcaagcctcaccatggcgaacgtgtatttgagcgtgatgtggtcaatcgcctcatagagtctttggatttggtcaagaagcttggtggcttacaaggtgcaaaagcatatgttccagatggttacaaatcagatcgtttgaagcaagcaatcaaagaccacgaatcaatatacggaggcggggaatga

SEQ ID NO: 1744 - DNA, 534 bp, Acinetobacter baumannii
ctagacaaaggtgggggtatggctgcacttaaagaacaggtaaaaatatttattgttcaagcgcttgcctgcatggatacccctcaacaggtagctaatgctgtcaagcaagaatttaacattgagattgatcgaaaacaggtacaactttatgacccgacaaaagcggcaggaaagaatttaagtaagaaatataaagacctttttcataaaacccgagaggactttaaaaagaatgtttatgacatcccgctagctaataaagcctaccggcttaaagagcttcagaagatttatgaagactggaagaacaacaggcttatgaagcaaggggttattaaacaggttcgggaagaaatgcagggttatgacctgatgttattaaatcttgagttaaagcagcttgagattgaaaagttaagagagggtgaaggtgatgaagatccaacaccagtcaaggtaactattcaagttgtggatgcgagtaaaaaagatgccgaacatcaatccgacactgaatgtacctcaggctaa

SEQ ID NO: 1745 - DNA, 381 bp, Acinetobacter baumannii
tggtttgaagggggctatatgaaaagtcatgatcatttgcttgataagcaatacgatgacgaacactacaactgtgttcactttgttcatgaagctgcaatggacctatacggcatagatcgggcggaagcacttgaactctttatgcagcctaagggcaaaattacttttttatcttcacggttaaaacttttaaatccgctacccatgcccaaggaaggctgcatagtcgccttccatccgagacaaagaaataagcccccgcatgtggggctttttcgtgggcaaaagattcttcacctcatggaaagcggagtcacttatttgcctgaagaggttgtgatgggaatggggtttaatcgggtcagttattatgattaa

SEQ ID NO: 1746 - DNA, 741 bp, Acinetobacter baumannii
cgccttgaaggaagacttatggctgatatccggattaccggcagaatggttaactttagcaggataaccttcgatacgaatgatcatgatgtgatccgccagcaattatcaaatatattaaatgaaggttcctatcagggaactgtcgttattatagatagtactgttgaacaagagcttattgctttaattcagctgttagtcagcatgggcttacagccgatggctgtcattgacggtattttaggcgacgaagcacgcgccattcagttccctgtattaccggcagatcagccattacaacgtattaaaccaactgcagagcaagtagcaattgtagagaagtctacctctgcacaagcttcagtagaaacaaaaaaaccactaaataataatgcagttgcccatattacctcttatcatgatgaaattttgcgtacaggccaatctcttgtacaagaccaaggcgatattattttaaaagctggcatgaatagtggttccgaagtgattgcttcaggaaatatacatatttatggcacggttcgtggtagagtcattgctggtgcgggtgggcacgctgctgcacgcattttttgccaatctttagaggctgaactcgtttccattgccggaacatattgtgtcgcagatgatatccctaaacatgtggtaaaaaagccagtacatatttatttaaatgaaaagcaagagcttgaatttgaagctctagaactttag

SEQ ID NO: 1747 - DNA, 1668 bp, Acinetobacter baumannii
gaatacagaggattttattatcctcttaccgtctgcatgaattctaatctaccccctgtttcggattcaaaacttgcggcaaacctgcaagcaaaatcgacgaatgtacatgtcccgacacctaagttttttatgccggtgtttctgacgattattattgcaacacttatttatattgggtttcaggtcagtgctgacttagcgcatgttccacctttaagcctttattcagttattcttttatctactgcactcttgattgcactaggctttgaatttgtaaacggtttccacgacactgctaatgcagttgcaacggttatttatacaaatgctttgcctgcaccggttgcagtcatgtgggcaggtttttgtaatttccttggggtaatggtcgcaagtggtgctgttgcgtatggcattattgcattgcttccagttgaacttattatgaacatgggcagtggtgctggctttgcaatggtttttgcattgttgatcgctgcaattctttggaatcttggtacttggttcttgggaattcctgcttctagctctcataccttgattggttcaatcttaggtgtgggtattatgaatcatctgttgagtgcatcgactggcgtaacaaccagtggtgttgatatggatcaggtgattaaagtaggtaaggcattattattttctcctttaattggttttgcttttgcggcaattgtattcttgttggttaaaactattttcaaacgccaattagaattattccagccacctgaagggaataagccaccaccagcaatcattcgtgcaattcttatctttacctgtacaggtgtgagttttgcacatggttctaatgatggccaaaaaggtatgggtcttatcatgcttattttggttggtttagtgccattagcttattcattaaataaaaacctcgatacacagcaggttcaatcattccaccagctttcttctcaaactgcggttttgttaaaccaaaatcaaccagaattgactgacgaaaaagcgcgtgcggttttaactaaatacattcaaaccaagcaacaaacgcctgaagttgtgcctgcattggcaagcatgactgaccatttgggtgagcgtgtttctagctatagcaacttaaaagatattccagaagctgcaattagcgaaatccgtaatgacatgtatttgagcacaacgacgtttaagcgtttggataaggcagaagctttaccaaaaatggatgactcacagaaaaagcttgtgaaagattatcgtagtagcttggattcattcttacaatacattccaaactgggtgaaagtggcagtcgcattagcgcttggacttggtactatggttggctggaaacgtattgtggtaactgtcggtgagcgtattggtaagcatcacatgacttatggtcaagggatgtctgctgaacttgttgcaatgagtacaattgctgcagcagatggtttaggtatgccagtttcaacaacacacgttttaaatagtgctgttgcaggtactatggttgccaataaatcaggcctgaatttcaatactgtaaaaacaattctctctgcatgggtatttacacttcctgcaaccatctgtttgtctggtggtctatactggttgttcttacagtttgtataa

SEQ ID NO: 1748 - DNA, 522 bp, Acinetobacter baumannii
ggattgggaggtctaatggataacgaatatgccaaattctttttcaatcggaaagttgatgtctatcaattggagtgtattgagctttctcatccttcttttatgaatacataccgaatagtccgtaatgatgaccgaggtgtttatgttcaacataaggagggatccggtcaggtctattatgaatttttgccagcatctattcaaagatccggaatgctgggtgatctggaccagacattaacagtctctatatctggtttaggtgatgtaatgccggatgagtttgaacgggtaatcgaaggccaatatcccgatgtaaagccaacagtaaattaccggatttacagttcagacaatctgaattctccaatgttttatttactcggactacaactctcaagtgtcgccatgaaccataaagctgtgacattcaaggctgaatcaccacgattaaataccactaaaactggggacatttttgcactggatcgctttagtggtttgaagggggctatatga

SEQ ID NO: 1749 - DNA, 1614 bp, Acinetobacter baumannii
tttatattggggaggcggcacgtgatgcatttgacccaagaaaataacttaaatgtagatgctagattgctaaatatagaaaacctttcaatctctacgcaagatcagattttattggaaggtctcaatttacacttacaagccagagatacgcttgcaattgtaggtgagagtggttcaggtaaaacaataagctgtttggcgatgatgggattactaccagaaaaattaaaaacatctggtcgtattattattgattcaaaaaatattttagaaatagacgaaaagacgcaaacacacatacgcggccgccaaattgccatgatttttcaggagccttctacggctttaaatccattgcatcgtgttgaaaaaattgtcggtgaaaattttattttacaaggtgggtcaaaagcgaaagctcaacagcaggtaattcaattattaaaagatgtaggaattgctaatccagagtacattttaaaacgttatccgcatgagctttcaggtggtcaaaaacagcgggtgatgattgcggctgcgctagctcttcaacctaaaattttaattgcagatgaaccaactaccgcgcttgatgtgattttacagacgcaaattttagaattattaaaatctttgcaaagcaaatatggtatggcgctgattttaattagccatgatttgaacgtggtacgccgttatgccgatgagctgattgtattacacaaggggcaagttgtagagcaaggtcagcttcagcaaatctttaaaaatcctgcgtcaatttatacccagcaattgttagatcatgatcttggtttcgctgagcaacgttcaaccagtcataagattttatctgttcaacaactcaatgttaaatatccaatacgacgtggtttctttaaccgaattcagggttataccaatgcggttgaaaatgtaaattttgagcttgctcaaggcgaagcattaggcattgtgggtgaaagtggatccggaaaatcttcattggctttggctctggttcgattaattaaaagtgagggacagattaactttctagggcaagatataaaccacttagaacaaaaagctttacgcaagatcaggtcagacttacagattgttttccaagatccatttggtagtctaaacccacgtatgacggtagggcagattattgctgaagggttaaaagtcaaagcgatagctgataaagaaattaaacagcaagttgaatcagctttaataaaagttgagttggctgaaggctttcaacatcgctatccacatgaactttctggtgggcaacgacaacgtgttgctttagcgagagctttagtagttcgacctaaacttttaattttagatgaaccaacgtctgccttagaccgatccacgcaaaaagcgatgattcaattattacgacgtttacaacaaacagagcacttgagctatatttttattagtcataatttaaatgtggtcaaagcactgtgtcataaagtgatggtattaagacatgcaaaagttatggaatatcagccgactgagcagttgtttaatgccccaaaaactgaatataccaagcaattaattgcagcaagttgttaa

SEQ ID NO: 1750 - DNA, 3456 bp, Acinetobacter baumannii
tgggaatggggtttaatcgggtcagttattatgattaaagttatttataaaaaagacgctttgtctgaagaaaagacaattgaacaggctcaaaccattgggcaatggctcacttcaaaatatgaacatatgcctgaacatgtgcgtatctttcatactacaagcaatatggatcatgccgaaatttcatttgcgaatgaagtcacaccaaagaatgcatatgacttaaagcagcttgatttcttaccgggcacttttatcgtagttgagaaccctaaatgggtcgcggctattgtttcgattgtgattagtattgcgatcgcatttttaatgccaacgccatcaatagcacaaacgactcaaaatactaaccagtcttcttcagcaaacaatgaactttctaaccgggaaaacaagatccgggtgaatggtcgtattgctgataactatggagctgggtggaatactcccgacctaatcgcagtaccttacaaggtatatgaaaacaacgttgaagttgagcatgtagtgggctgtattgggcgtggacactataaaatcaatggagcttatgacggtgaaaccaatattgtcgatattgctggcgcatcggtagaagtctttcgaccaggtgtagatattgtttcaggtgagccatatttctcgcttggtaccgaaattaccacgccgccactaacggttcagcatcaaacttctgttaatggccaagttttacgtcctgctgatacacaatctttagaaggtacgaactaccttcattttgcatatccaaacgagattcttcgggcaacggcaaacaacacagatttaaccactaagtttgtaagtaatgaccgcgtagaaatcaccaatgcctcattcacgtttaatggccagacttttgatttaaatggtacttatagcgttctatcggtagctgatgaccgtatgacgttatcaaatccggcggccgttaatgctaactggttaaagcttaaagagttaaataaccaacaaactgcagctttgtcaccaaagatcagttcaataggtgaaaaatggattggtccattcattctggacaatgttgaacgtagccgggtgctgtgtaattttgtggccaccaatggactttataccgtttcttcaggtgggaatcaggccgctgttaatgtcacgattgaagttgaagtaacaccggtaaatgaatctggtgcagcgattggtaatccgatgctgaagcagatcattttgaaaggttcggcaaagtcacgtcagaccgttggtgcaacacttgatatggtcacgtttcaggggcgttgtagtgtccgtgcacgccgtttaactccgactccgacagtcacaacagttgttgatgaagtaaagtggcaggcgctttacggtgcttatcctttacaaagcacagtgtatgaacatgaaacggtttttcgtgcgcgtacttatgcaaccactggagctttatctgttaagtcccgcaagatcaattttgatcttcagcgaatgttgccgacttataaaaacggggcaatgacaacagagctatatccaacgtctagctttgctgatgctttggtatctatggcactcgatgacaagattggccgccgttcgatcgatgagattgatcttgaaaacatctatcggacctataatgatgtagttgattattttggtacgccgctagcggctgagttctgtactaccattgatgatacgaatctatcttttgaagagctggttaccaatctttgtgatgcggtgttttgtactgcatatcggcaaaacaataagctcaagctttattttgaacggccaactgataactcggtaatgctgtttaacttcaggaatatcattccggatagttacaagcatgacctgacctttggcgtgatggatgactacgacggactgatctatgaatacacggatccgaccgacgatagccgtatcaatatctatttaccggataaaggagccaaaaacccaaaagaggtgaaatctgttggtgtacgaaacaagtggcaagcgcatttcaatgcataccggatttggaacaagatgcgcttccagcgcaaatccattacctttgatgcggcaccagaatcagaattactggttttacgtgaccggattgctgtagcggattatcgcaatggtattcatcaaagcggcgaggtggtacagcaagaaggtttaattctcaccctaagccatgatgtcgatttcattgcaggcaagagttatgtgatttatttgcaaatgggggatggtaccgtggacctgattcccgttacgccgggttcagccaagaacaaagtagttttagggcgtttaccgaacggggccttaaagcttagtcccgatgactttgtgaatactatctacaccgtagttaatgacgatactaaaggctcattgccttatctggttgcaaaaagagaacctgctgaccagttctctaataccattacggcaattaattacgatgaacgttattacctcaatgacaaggactttattgatgtgccagtagatgattcaccgatttacattcgatatgaccagctggatataaatctggtgcgtttgtatcagatgcaaagaggggatttgccaacgactggcgaaattagctttgtagttgaagctggtgcgctggtttcaagttcgagttcttaccgacctgagaccagatttgtctataaatttgactacaactctagtcctccaaaacgagagtatatcgttccagctgcatcagaattacctgctattgatactggtgagtttccacctgatctggtggtgaatctgacgattaaaggtgctgttgttggacgtggtggtgatggaggattgccacatttggcatttggtgcatggtctaccgatccagattacaactttaccaaaacccgccgtgatgggtttcagggagcacccggtttgttgaaccggcacagtaaattgaacctgatcattgatggtggaactctggctcgaggcggatctggtggcggcgcaacaccaagcggtatttacactgaattaacatatggagtccaaggtatacccggtggagctggtgcaccatttggacgggtcatgacgggacagcccatttcaaatgactcgcaagactggcgttggtacttaaatggtgactttatggttgtcaaagtaaccgatgctgaagctgcagtgcccggtaaaggttaccgaacccaaaatgaccgttatggatctccattatcaggtgatggcggaaactggggcgaacgtggtaccaagtccactaatgatgaaacgtggaactggcaataccatggaacgactgaaggccagccgggactgggaggacctgcaattgtgggagttgctccacttacaaccaaattaatgaatggagggaaaatcttacaaaccctttaa

SEQ ID NO: 1751 - DNA, 366 bp, Acinetobacter baumannii
aacttaatttttaaccttagcgccttcgggtgctttttttgtgagaagaaaatgatcaaagaagtaacagagcaagagttagctgaaaagtctgtggcaccccgagtaactaaagcgcaaattgattcattgatggagcgtgttacatatacggttgagcaacgccccggtggcacgacatctacttttgtccatgcatttttagatggaaagtttttcctagcaacgggttttagtgcatgtgtgaatgctgaaaactttgatgctgaaattggtgagcgtatggctcgtggaaatgcagaaaagtcagccgaaaataaactttgggagctagaaggctaccgtttatttgcaacaaatatctaa

SEQ ID NO: 1752 - DNA, 1386 bp, Acinetobacter baumannii
cttaaaatttttatgaaaggatataagatgaaaacggttcaactcgaccaattaaaacaacaatttccactcattcaaacattacaagactatcaagaaacattttggtttaatcctcaccattatcctttaaacgaagcactagcgaaagtgagtcttacagaacaagatgtaaaagaagcagaagcaaggctagcgcgtttcgcaccttatttggcaaaagtctttcctgaaactcaagaccagcatggaaaaattgaatcagcgctagtagaaattgcggagatgcaacaagctctatcgctacaaaagcataagacacttacagggaaactttggctgaaaaaagatagccatttacctatttcgggttcaatcaaggcacgtggcggtatttatgaagtattggcacatgctgaaaaattagccatagaggcgggacttctcaagttagaagatgattacagtaaattagaccaagactcatttcgaacatttttttccaaatatcaaattgcggtaggttctactggtaaccttggtttatcaatcggtattatgagcgcgaagcttgggtttagagtgtcggtacacatgtctgccgatgcaaggcaatggaagaaagataagctacgttcacttggtgtaaatgtggtggaatatgccagtgattacggagttgctgtagaagaagggcgtaaggcagccgaacaggacccattttgtttttttattgatgatgagaattcgactactttatttttaggttatgcagttgcaggtttgcgtttaaaacaacagtttgaacaaaagcaaattaaagtcgatgcagatcatcccttatttgtatatttgccatgcggagtagggggcggtcctggtggggtgagctttgggttaaaacttgcttttggtgagcatgtacattgtatatttgcagagcctacccattctccgtgtatgttacttggtgtttatacaggcctgcatgatcagatttcagtaaatgacattggtttagacaacatcactgctgcagatggattagctgttggccgtgcttctggttttgtcggacgtgctatgcagcagttaattgacggttactacaccattcatgatgaatgtttatatgaactcattgcgcttttaaatcaaactgagaatattcaagttgaaccctcggcggcggcgggcatgatggggccatattatgtgcaaactactcctgattatttggctttgcatcaattgtcagctgaaaagttacagcatgcgacacatgtggtatgggcgacaggaggaggaatggttccacctgatgaaatgcaaaagtatttaatgtatagccaaaacaattatttgcacaaaaaagcccaattctaa

SEQ ID NO: 1753 - DNA, 456 bp, Acinetobacter baumannii
gctatttttatgaatcatcctaattcaattttaaaattttcacttgatctaaatagtctttcatttgatgtagacagccaacatattcaccttgagcagggcttaggttttattaattcaaaaagtattagcaatggtgttattgatgagcttgcgattgaaaagatgatttattttattgaagaaatcatcgagtcacagccactcagaaatctcaatataaatggtgtagccgttacggctgataccgccatgacacagctcagtgagttattttttagtgctaaaaagcaaatcagccgtatcgagcttgagcatggttttaatgattttattgagcgtttaagctactacataaaccaagtggcttcagaccaggtttatgtttttacctactttgtatttgttcgagagatgatgcatcacttacgagttgagcaaattcaaatcatttaa

SEQ ID NO: 1754 - DNA, 627 bp, Acinetobacter baumannii
atatttcttatgttgcatttgccgtttaatcacaccattactcttattattattacggtcattttgtctttacttgcttttagcaatcaaaatgtcatgaaccgtttgatcttctggccgcctgcaatgcaacgtggacaatttgatcgattcattactcatggttttatccatgcagatggtactcatttgctctttaatatgattaccctgtttttctttggcagcattatcgaaagtttttatcgccaatatttttatgacatgggttttgtactgttctatttaggcggattaatttttgcgatcttgccaagttacctacaacataaaaatgatgcaaactgggcaagtctaggtgcttcaggagccgtatctgctgttctgtttgcctatattttatttcagccgtggaagctgatttttgtatttttcatccctgtgccagctattatttttgcagttctctatgttgcttatagtatttgggcaggtaaacgtggtaatagccatattaaccatagtgcacatttatggggggcagcttacggcgtaattataacgattttgattgagccaagagtgattcctcatttcttagatcaacttactcgcctacctttttaa

SEQ ID NO: 1755 - DNA, 360 bp, Acinetobacter baumannii
gaatcacttatgagcaattttgtttttaagcgtggtgacacattcaacttaaatctgcagctagttgatatggatgatgcactgcaatatccagccaatgatgtacgtcgagcaatcgatttaacggggtatacctttacttcgcaagttaaaactctggacggaaccgccgtagcaacgttgacttgtgcagcgttaagtcaaagcactcagaaaggttggctcaatattaaatcgggaacaagcactgctacatggcctttaggcttgtgtcagatggatatcaaagccgtcgtgggtggtgtgactcaacacactgagactctgacttttcaggtaattgacggggtgactgcataa

SEQ ID NO: 1756 - DNA, 951 bp, Acinetobacter baumannii
aggcgtattattataaatattaagaaaataaataaggatataagtgaatttttgattcgcttaaaggagtctgacatgaatgctaaagtaaatatttctaatcgtgccggagcaagtttccctgtgcgtcgtatggactttgagtttgctcaagttccacgctattgggcaaattacgatgcaggattaactcattttatgacagcattatcagctctttttccggaaggagagcagttctttgtaaacagtactcgtgctgtgcgaaatgatcctaaactggctgatccagcacttcaaaaagaaataagtgcttttattggccaagaagctatgcattctaaagagcatcttgcatttaatgcttctgcgcaggcgtatggatatgatgttcgtaaaatggaaaaacaaacaggtaaagttattaaagtaggtactgcggttgtaaccaagctaatgaaaccttttggttatacaaaagaaatgattgatttaacaggtacctgtgcgttagaacattttacctcaactattgcggctgagcttttacaaaaccctgaaattcaagccatgttccaagatgacactatgtatcacttatggatgtggcatgcggtagaagaaaacgaacacaaagctgtagcgtttgatgtgtataccaatatgtatgggcagggaccaaaagcttattttatgcgttcaactgctttaatcattgcaatggccttaatctttgctactcagtcttattttactgctaagttacttaagactgatgataaattaacatggaaagataccaaatacatgcttaagttcatgtatggccgtaaaggttttatgactcgtcaaattccagaattattagatttcttaagaccaaaattccatccaaatgattcggatacgacagctttattggccacttggcgtgaaaaattaggtctttaa

SEQ ID NO: 1757 - DNA, 408 bp, Acinetobacter baumannii
aggaaagttatgtacaagttaaagctaaatcctcagaccagcggctatggcgtaacaccgggtgatgatgtgaaacgtcagcagatggacggcggtcgtggtcgctattacatcgatgtaaaacgtaatagccacattgttgatgtgaactggaatttaagtaaaaccgatttcaataaaatgatggcgttctggcgggtataccagaacaagccagcctcattttatgcggatctggtgattgatcagggagctcgtcagcaatacctgtgtaacttcattccgaactcgttcaagaccaatgaagtgaatggcaacctttaccgggtaaatgcacagctcgaagttgttcaaaaccagcctaaccttactgccgatatcgctttgattaaggattgggaggtctaa

SEQ ID NO: 1758 - DNA, 216 bp, Acinetobacter baumannii
gtattacctattgatgggcacatattccttataagtcttgataagttaaaaaattatgttaggctaaaaataaaaccatttaaaaaaagaaatctttatctatttaaatatgaatatttgatatttttaattcaatccctattgctagtgcttaaatattatgccaatatgaagttggagatatttccgaatagatatttcctatttcaggtctaa

SEQ ID NO: 1759 - DNA, 579 bp, Acinetobacter baumannii
ggagtaactatgaacttcattaaaaaatggaacgttgggctccttagcatgttacctgcgttagctatggctcatccggggcatgatcatgtacattcaggttttatggcaggctttattcatccgtttacagggctggatcatttaataatggctttaggctttggtgtcttgctatggtcggcagccaaacagtggaaaattgctggcgtcagcactttaagtatcaccttagtgattggctttttggtaggtgctcaaggttcggtgcccgccaatattgctgaatacggtatagttgcttctttaattattacagcgattgcgctatggacaaaatcaaatcggattttacctatcgctgccgctttactcgcaagctttcatggtatggctcatggtgttgagttagcacatgcagggcatatcgtggcgttagtaaccggtatggttactggtatggcacttatctattgtggtgggcttgcactaggtgcagtatttacacgttatgtgccatatggcaaaaaaattgtaggtgcctgtgcagcagttgttgcagtgattggtttgagttaa

SEQ ID NO: 1760 - DNA, 600 bp, Acinetobacter baumannii
gtgaataatatgcaaggctttattaaaagtttatttattagaatatttttggggttaatgccagtgactgcttatgcggatcagaagtgctatggagatattattgtatttcagaaatttgatgatcaaatgatatatccttattttatacatccttctagagagaaaaataagaagaatgaaacacaaaataagacaatcgtgattcagaaaagaaaacttactcaagaggaattgttagcacaaaagaaaattgacgataatcagttaaaaaaaattgaagaaaagaaaaatattgagaagaaaaagcaacttgatgcagcggtcgcgaaagaaattttagaaaacggtgaaaaaaaatggatggtgcaagttgctttggcacctaatcaaaataaagcaaatatgattcagtcccaattacaggctaaagggtataaagttgttaccagcccaaccacaaaaggaatacgggtcatggtcgaccctgccaatgactacgcaattgcacaaattattcgagaaaaaataattgcagatgatagcttggatttgagatcggcttgggtatttaaatgggcttctctaacagcacagtaa

SEQ ID NO: 1761 - DNA, 312 bp, Acinetobacter baumannii
gaaagagatatggaactcaatccaacagaaaaagataagttactcatttttactgcaggcttagtggctgagcgtcgtaaagcacgaggcttaaagttgaactatccggaagctgttgcatttatttctgcagccttacttgaaggtgcacgggatggtatgacggtgagtgaacttatgcactttggaacgactttattaaagcgtgaagatgtcatggatggcgtaccggaaatgattgctgaggtacaggttgaagcaacttttcctgatggttcgaaattagtcactgttcatcagcccattgtataa

SEQ ID NO: 1762 - DNA, 327 bp, Acinetobacter baumannii
gatagggatatgaaatttaaaatattattattaagttttattgccaccagttgctatgctaatgaaagtacagctgacccagatatttgtaatatcgtaaaaaaggttgcttataacgtgatggaagcacgacagcaaaaagtaccagcacaagatttacaacaaattgccgatgggttagcagatgaaaaagccaagcagctttatcaagacttaattagctcagcttatgctgccaaagtatttaagacaagtttctttaaacgccaagcaattgaagattttcaagcagggtggtatgatgaatgtttacgtagaaatgaataa

SEQ ID NO: 1763 - DNA, 969 bp, Acinetobacter baumannii
ttacactgtataggaagtacgattatgagtttagatttacgtggattaaccccagcacctgtgactccttttacccgtgacggacaagtagaccataatgcaattcaacgtttaggttcatggttaggcagtattgatggtgtgaaaggcttggttgttcttgggcatgcaggtgaaggaacattcttgtcgcaaaaagaacaaatgcaggtcatcgaaagctttgttaaatcggtagatgacaaaattccggtaatcgcagggattacgctcgaaggtacttcggttgcagcagaagaagcaaaacgtgcagtcagcgcaggtgcttcggcaggtttgatttacccttcacacggctggttgcgttttggctatcaaaaaggcgcaccacaagaccgctataaagcaatttatgaagaaagtggtttgccatctattctattccaatatccagatgcgactaaggccacttacgatctagaaactctactcgatatttctgcacagccaggcgtatttgccatgaaaaatggtgtgcgtaacatgcgccgttgggatgtcgaaattccgattattcgccgtgaacgcccagacttacaggtattgacctgccacgatgaatatttgcttcataccatgtttgatgtagacggtgctttggttggctatggcaacattgcccctgaacttttaattgaaatgattaaggcaggtaaagccaaagattacgccaaagctcgtgcgattcacgaccaattattaccagtgactcgcaatgtttatcaccgcggttcacacatggaaggcacagttgcgcttaaacatgcattggttgctcgcggaattttggaccatgccactgtgcgttcgcctctgcttccactcgctgatggtgctgagcaagaaattcatgatgcaatgcgtcaagccggaattggcaaggtcgacttaacccaagccgttgcttaa

SEQ ID NO: 1764 - DNA, 3606 bp, Acinetobacter baumannii
ggatatgtcatgaaaattttatccattcgaataaaaaatctggcatcgcttgctgatgagcattttattgattttgaaagcgcacctctggcccatgcaggtctcattgcaattgtggggaaaactggcgcaggtaagtcgactattctagatgcgatgtgtctggccttgtttaatcgagttcctcgccttaaagacagcgatggcaaattaaaagatgtcgatggttccgagttactaaccaactctcctttaactgttttacgccgtggtacaggccatggttttgctgagctttgctttattgcgcaagatcaaaagcgctatttggctcgttgggaaattaaacgtgcacgtgaaaacccaaatggtaaattacaaagtgtgcagcgccacttaaaatgcttgaccgatggtgtagtacttgccgataaagccaaagcggttgatgaaaaagttaaacaaattacccagctttcttttgaacaatttactcgtgcggtgctacttgcccagtccgaagtaaccgcatttttaaaagctcgagacagcgaacgtggtgaattacttgagtacctgaccaactccagcattttcgccaaaatcggtgaactggcttttcgtaaaacagccgatattgcaaagcagcgtaaacagctggaagagtttttaggccatattgaaattttgtctgatgaagagattgctgcatttaccgagcaatatcagcaagctgaacaaaactatcaacagttagaacaacaaaaacatgtcttagacaaacagcaacaatggtttgaacgtaaagcaaaacttgagcaagaagtacaagctaaacaacaacagtttcaaacccagcaaaatcaccatcaacaactggctagtgaacgtgagcaattaaaacgactcgaagttttctctgaaatacgcccacaagtttttcagcaagctcaaaatttacaaaccctacaacaacttgaaccgcaaattcagcaagctcaaaccaagtttaatgagttggtacaaatttttgaaacgggacaaaaaaaatatcaacttgcagaacaacagctcaaacaaacactcgattttgagcaacagcatcaacatgctttaaatcaagttcgacagtccattcaagaacgcgcttttattgccgatgaatataaaaagtgcaaagaaaaaagacaggtacttgaacaaaacctaagcccactacaacagcagcaaaacgcggtacaacagcaaattgcacagcttgagcagaacaaaattcatttacaacagcagctgatccaaactcagcaatatgctgaattagataagggcctttcagcacatctacatcagcttgggcaatttattcaaaattaccaaacgattgaagaacagctcggtaaccctacccttgctcgccaaaagctatcggaagctaaaagtgaactcgaacaactcacagtttcactaggcaccgttgaacagattgagttaaagcttgaacaacagcgtaaagataaagatcagaaacttgctcaagtcacgcagttagatctgattcaacagaaaataaaaatttatcatgagctatatgctgagcttcagcaattcaccgaaaaacatactcaagcctccgcgcaagaagaccaacttaaaaccgtttgccagttagctgaacaagactaccaaacagcaaaaactgaacgtgaaaagttacagcacatcctgcaacagcaacgtttactacacaccgaaaatattgaacagttacgggccaatcttaaagaaggtgaagcgtgtttagtctgtggaagtacccaccacccttaccgtattgatgacagtgcagtttctaaggccttattcgatttacagcaacagcaagagcaccaagctgttgcactagagcaaactaagtttaatgtatggcaaacccagcaacatgcacttacccaatgtcgtgccgagcttgaacaagttcagaaatatctagctcaactgcaagtaaaacagacacacttacagcaagaacttgaacaagcgtttaacctcaatcaattacacattgagcttaatcaagctcctgaacaaatcttacaaacacttaatgagctgagacaagcgacgcaaactgccataagtttatttgactcagaaaacttacgtttaacccaagccattaaacaacacaatcaacttgttcaaactattcagcgtaatgaaagtttgcttaatacagcacagcaatggcaacaacaagttcaacatattgtcgagtgtttatcagaaaccgaacagcacgcatggcagcaagcaagtagccaaacagctaagcagacttgggctattcttgatgcacgtgctaagcaacttgaactacaagaacagctttcacagcgttttgaacaacagcagcaagaacttaaaatgctgtctgctagccttgagcaaatgaccaagcaaattgatgagatcgatcaaaatctccaagagattacgcttaaaggccaacaaaataatgaaaaagcggtatcgctcattcagcaaatgacaggccgttcggatattaagccgcatgaatggttaattgagcatgacgctaaacgtcagcaccaacaaacggcgtatcatgaggctaaacagcgtttcgaacaaaccagacaacactttgaacaacaaaaacaggcgctcgatcaacttaaacatcagcatcaacacacagaacaacatcaacagcagattgatgggcaaattcaaaactggttaaaagcccatactgattttcaggcatctgatcttacagcactcatacagattaattcagctcaagagcaagatattcgtaaccgtcttaatcatgccgagcgtttattaagtgaagcctcttctgcccttaaaacgatgcaagagcaattaagcgagcacttacaaactcagccagatattgaatacgaaaagctcgttaccctcattcaagacaatattgcaaagctcaaagcacagcttgaagtgcgtgacgggctaaagctgaagcttgaattacatcatcaaaaccttgccaaacagcaaaaatatgctgagcaaattcaaaacattcaacaagaagaacatcgctggagcaaaatttcaggcttgattggtgatgccaaaggtaaagagttccgtgactatgctcagcaatatcacctagatattttagttgaacatgccaaccaacagctggcgatgctttctcagcgttatacgctaaaacgtcttgatcagtcattaagtcttgccattattgaccacgacatggatggagaaacccgctcagttgcgtctttatctggcggtgagtcgttcttaactgcccttgccttgtctttagcgattgccaatatggcatcgggttcaatgaaaattgaatcactgtttattgatgaaggctttggtactttagatgcctcatctttgcatatggtcatgaatgctttagaccaactgcaaaatcagggacgtcaggtcattctcatctcacatattcaagaaatgcatgaacgcattcctgtacaaattcaagtgaaaccacttggcgctggtgcaagtaccattgaaatagtgggttaa

SEQ ID NO: 1765 - DNA, 1509 bp, Acinetobacter baumannii
tataatgtcatttgcatggaaatgttacaagaaattaaaaaaagcttgctttgtaacgatggaaccgaactttttgcgtatacaatacaccaaattcagctctttttctttcagtttaggtttcgatttatgtctcaaacaatcacactgtatgttgatggtgcatgtcgtggcaatccgggtttaggcggttggggtgcatatgtcattaccgagcagggtgaacataaattatttggcggtgaacccgacacaacaaataaccgtatggagcttactgcggctattgaaggaatttctttttgccctcctgatgctcaattaattgtctggacagactcaaattatgtgaagcaaggtattacagaatggattcatggttggaaaaagaaaaactggaaagatgttaaaaatcctgacctatggcaaaaactcgatgccgtttgtgcgggtagaaatattgaatggaactggattaaaggccatgcaggacatgcaggtaatgaaatggcagaccagcttgcgaatttaggtgcagacaaaactgctcaagaacttaagcaaccacagtcagccactgtatcgcaagatataaaaaagcctgaacaggactggttactagacgacccattcggattcgatctggttgaaacaaccgaagatgaaacagtcactttagagcagacacaagaagttaagatgattgttgtggatgaagaaatgaatgtagttgaggctgtagaacaagaagaacaacagcaaaataccaatattcatccacaaattgtgatgactgaagccaagcttaaattacaaggcccaagacaactcatactcgatacggaaacaactggtttctatttccaagatggtgaccgcattattgaagtcggtgccatcgaaatgattaaccgtaagcttacgggtagttcgattcacatttatattaatcctgaaaaaccagtgggtgactctgtccaagtccacggtattactgatgagtttttggtcgacaaacccaaatatgcagaaattgcagataccttatttgaatacttaaaaggcgcagaaattattgcccataacgcaaccttcgatatgaacttcttagatatggagtttaaacgtgttgggttacctgctctttcagaagtttgtgaagttaccgatactttagctttagcgaaaaataagcatcctgggcagaaaaactcacttgatgccttagttagacgttatgaaattccagcgcgtgaccgtactttccacggcgcattactcgatgctgaaattctttctgatgtttacttggcaatgacaggtggtcaagtttcctttgatatggatgccctatcgcaaagtgaaagtgaccagcaaaaaacgaccaaagctagagttcaaattgaattacctgttatttacccttcagatgaagagctaaacatacatgagacttgggtcaaagaatttgagaaaaaacatggagaaccttgcctttttgcaaaataa

SEQ ID NO: 1766 - DNA, 333 bp, Acinetobacter baumannii
atttttcccatgaaaatctttttcgtgttagtaccgtttgtatttttaactgggtgtatttttggccaatcaagtgaggtcaaacgtgcagaaaaacttttaaataactttcaatgtaaaaatattgaaacaagtgaaatttctacaagttcaatcaactcttattaccagcaatctttagcggtgagtaaggaaaaagcgacctcttatgtagaaagctataaaaatggtgaagaattattcgcgatgcccttagatgaagtcgtagaacagcaataccaactttataaagcagcgtgcgattctttaggtggggtttctgcccaaccataa

SEQ ID NO: 1767 - DNA, 186 bp, Acinetobacter baumannii
gaacataccatgactgatgcacaaatcaatgtacaagaaacagtgccaacaacatctgcgtcggatgacaacatgcaaaacatagcgcaaaaaaattcttggtttctttgcgctgattttattgatcgccgctattttatatgcaatctgggcattatttttaaatcactcggtgagtacggataa

SEQ ID NO: 1768 - DNA, 489 bp, Acinetobacter baumannii
atagacaacatgaaaattcgtattctgaccattggtcaaaaaatgcctgcttgggtacttactggttttgaagattatttcaaacgcatccagccttttgttcaaactcaggttattgaactcccaatggcaaaacgcggtaaaaatgattcagaagcagatattttaaaatactgtcaaatcgagggtgaaagtattttaaatgccttaaaaccgaatgagacccttattgctttagaagttggcggacgcgagctcagcacagaaaaactagcagacaccatgaaacaatggatgcttgaaggtaatgatgtggcactcgctattggtggcccagatggcttgtcagatcaggtacgcaaagccgctgcttggcattggtcactttcaaaacttactatgccacaccccttagtacgtattttattaatcgagcaactttaccgagcgatgagtattaatcataatcatccttaccaccgtgcataa

SEQ ID NO: 1769 - DNA, 273 bp, Acinetobacter baumannii
tggcatgacatacacctgttttttcaggccagagcattttttgcacccgaacggggccataatgctttctgtgactcattatggtgcgcgagttttcataacaaaaccccagttctaactgggcataccaaaatggtgctgaagaagtctgaaaagtttgttgaattcgattcattttggctcattttcgataatggcttttttgataagcaaaatatgcaccaaaagcaaaaagtggctattacaaacttagaaacaatttttttattttaa

SEQ ID NO: 1770 - DNA, 1650 bp, Acinetobacter baumannii
ggaacagacatgactgaacgtgtaaatgtaggcgaagcaatcgcaagagttttagaagcgcaccaagttgatagtatttatggtgttatttccatccacaatttacctattgccgatgcagtagggcgccgtgaaaaaatgcgttttgttgcagcccgtggtgaagcgggtgcggtcactatggcagatgcacactcacgctttaaaggcctaggtgtagcgttaaccagtacgggtgctggcgcaggtaatgctgtgggctcactaattgaagcaatgaatgcgggtagccctgtattgcatttaacaggtcaagttgagcgtgaatatctcgaccgtgatgcaagcttcatccatgaaactaaagaccaacttacattcttgcgcgcatcaagcaaagcagcgttccgtattaccagcccagacaatgctgttggcgtgattcgtgaagctattcgtgttgcaaccacagttccaatgggaccggtaagtgttgagctgccgattgatgtgcaggcagcagaaattgatttgccacttaatcttgggccagtcaaagcacttgagttgccacaggcagagcaagctgaaattgatcttcttgtaagcgaaatcaaaaaagcaaaacgcccgattttctggattggtggtggaactttaaatagcgttgccgaagttaaagcaattgcagatttaggtattccagttgtttcatcgactcatgctcgtggggtgttggcagatgaccatccacgtagcttaggtgcgttccataactcggcaggtgttgagcagttattaaaagatgccgacctgatggtggtggtgggttctcgtttacgtagtaatgaaaccaaaacctattcggttgaattccctgaaaatattattcaggtagatgcaaacccagttgctcagcaacgtaattacaaaatccgtaacttcatttgtggcgatgccaaagatgtcttaacacgtgtgttagaacagcttcaaggaacttcaaaaatcgatgccgattacgatgctgctgtagtggctgctaaacaagctgcgattgatgcactgcgtaaacaaatcgaccaatacgctttaatttgtgaccacttacgtgcagctttacctcaagacggtatttttgtacgtgacatcaccatgtcgggtagtacatggggcagtcgtttattcccggtacaagcgccaaaccaaaacatccactctcttgcgggtgcaattggtttaggccttgcaacagcaattggtgcttcggttgctaaccctgataaaaaagtaattggtttagttggtgatggcggcttaatgcttggcattggtgagattgcaactatggtgcaagaaaacaccaatatggtcctaatgattatgaatgacggtggttatggcgtaatgcgtggcattcaaaataactactttggtggccgccagtatttcaatgaattacatacacccgactacaaacttcttggcgaatcaatgggtgtgaaaagctggaaagtcggtagtgcagaagagtttaaaacggttattcaagaggctgtcgcttttgaagggccaaccgtgatcgagctcgatatgaactcgattggaccattaaacttcgcgggtccaccgcaaaagaaactgtattaa

SEQ ID NO: 1771 - DNA, 858 bp, Acinetobacter baumannii
tttagctgcatttgtattgagaggtgtttgatgggtgcattgaagcaggctgaaattattccaatttcaaaaggtagggacaagatgacagacaagttcgaaaagggctatgtgatgtctagtcgtctttatcgtagtgatgtgcgtccatttcttagtgatgcagcacgtaatgtgtatgctgaactggaagaccgcatcaatggttttaaagacaaaactactgattttgtaagttactctcaattgcagggcggcaagcttgaaggttctaaaaaactaagcactactacagttcgtaaaggcctaaaagaattaaccgatttaggcgttgtaactgttgttagttctgattcaagaaagggtaatgaatacagaattaatgaggtgtcattagtcgagcactttaaaaactgcaataccactttagaaagtaaagcactacagaaagtaaagcgcgagcactttactaacgaaagcgccagcactttagaaactaaagacacaatagaattatataaaaatatttatagagaggagagcacacaagaaaatccagttgatgaagttctgaatatctggaaaccagatttacaacaattgaattcttggatgcaaagatcaggtttaccaaaaatcaatcaagctcaagttgaagaattacttcttgaaatcaacccacactacgaaaacaaaatcatcactggtgcagtaacaagcactcagatgtattcaaatttcgtgaagtgggtaaaacgtgatttcaaacttgttgaaaaacttttcaaacaagcagaacaaaacaacactcaagcaatcaatcctgaaaatctcgaaacagaaatgggggattggtaa

SEQ ID NO: 1772 - DNA, 2226 bp, Acinetobacter baumannii
tgcaaatgcattaaaaggaaaaaaattatgtggtggacaaagaaaaaagtagaaagttccaatacaataggtgatgctcttaaaaatataacaggtatacaaagtacttcatttggacccaatgcaggtgcaccagttatacgtagtttgagtggaaatcgggttggagtaattgaaaatggagaatttattaatggaatgaatgcatttagtggacatattaatataccattcgatccaatttttatagaaaaagtgatagtgaacaaaaatacagataatattcgttatggcggaaatgcaataggcgggagtgttcaaatagaatcgggtttaattcctaaaaaaattgaagaaaagccaaacaaattagatattgtctttcggaaaggatttaatgattttgatgtaaaggggttcaattttaacatcaatgatcaaaaaaactggtctacaaatataagatattcagaatatgaaatttcttcttataaaattccaggaaatagtaaagccaaattatgtgaagaccagattttttcaaattcaggtgggatcaatagtgcattagcagcttcctgtcaaaaagatagtagagtccaacatatttataacaagtcgtcacaaccatacatagataaatttatgactgagaatcctgattgggcagatggcgatttttctttttatacagataagcccacatctatatggggaggaaaaacatatataaatccaaaaaatccagagtacatacctaatactccgcaaaatacaataaaaaagatcaatacggatgttacaccaaattattttaaaaaattaggtaacagttatgctcagaatgagaatattgggtttggaacaacatacttttttgataaaggtttcattggattgagtgcagataagaaaaaaagtgaatatggtgtaccaggattttcattacaaaatcaatcttttgctgattcttatgaaacattaccggttggtgtgaaaatagatcaaaatcgttttgtattaaattccaattttatccaaccaatttcctctgcagaagagataagtttgaattttcaacagctttctaataaatctggagaatatgttggtactgcaaaagctaatgagtataaaattgataatcaattaattgaattaataatgaaacagtcatcctttaagggattagatgggatacttggttttagccttaaaaataggaatatcgaaggaagtggtactcagcgctatttacctaatgtaagtactattagtaaagctatattcttacaagaagaattaaatatcaaacaatttactttaaatacgggctatcgttttgaaagaattgaacatgagcttcaagataatgattttaaactagcaagaaatgctagtaattcaagaatagaaaatagaaaatataatttaaaccaatattttatcggaggagaatataaggttaataattttataaatttaaaagttgattatggtatttcagaaagagcacctgaagtgaatgagctctattcaagtaatgttcactattctgttatggcacaagaagaaggcgaccagaatctcaaaccagaaaaatctaaaagtttagagttaggtatgtttttgaattggaataattgggtcatgcaacttgttgggtatcaaatggattttgaaaattatatgtatttatctcattcaggtgttgctgtgcaaaatcgattacctttaaaatactggaaacagacagacactgacgtcaaagggtttgaaattgatttaatttatgattttaatctagctcatattgggaatattaaactaggtggtttagctgattttgttaaaaataaggctgttaatcctacagatataaggttagctaatgatggagtttacctaccaaatatgcctactaatcgttatggcatgtttcttgagtggagaaatgactcttggaaaggtaaaatttcaagtatttactacgatgagccaagatatctaggtaagaatgtaatacaggaagttcctttatctggttacaacttacttgaatttaagatagataaaaaattaaagattaaaaatgcttcatttgatatatttttaaatggtacaaatctgctgaacgaagaggctagaccacaaaactctcctctaaaatatattgcccctctaccagggcgagcatttcaactggggataactatgcatatttag

SEQ ID NO: 1773 - DNA, 348 bp, Acinetobacter baumannii
cggttcagcattcttttactctttccaagaaccttggtgtttgcttgtatgtgtttaacattaactgaagctaaacaaaaacttagagcatttgctagagatactagcaaaatcaagttaactgcacatgcaaaagaaagaatgaaagaacgctgtatctctatgaagcaaattatttgctgttttgagcatggagatattactgaggggccgtacccaaatactcgtggtgattgccagttaaatgtttctgttcgcactgcaggcgaatacataacaacagctgttgcaatcaagcagagcgagaacggtgaattctcagtagtagtcactacatttagagagtag

SEQ ID NO: 1774 - DNA, 2133 bp, Acinetobacter baumannii
ttttgcagcatactattttgcagagattttggttggaaagagattaggttagacatgaatacagcgattacagcaacgaccccaacagaatatagttataatgaccgttatattaatcgtgaattgtctattcttgactttcatttgcgcgtattggaacaggccgtcgaccctttacatccattactggaacgaatgaatttcttactcattttttcgcgtaatttagatgagttttttgaaattcgtgtagcaggtgttatggagcaatttgctctaggcaatgaaagtcgaagcccggacggtttaacgccaagacaagtcttacaaaaaatctctgaaactgcccatactgcaattgagcgccaatatcgtattttaaacgaagaaattttacctaagttacgtgaagaagatatctgctttttacgtcgtggtgaattaacaccagctcaatcagcttgggtaaaaaaatattttcaggaacaggttgcgcctgttttaactccaatcagtttagatccagcccatccatttccgcgtttagtcaataaaagtttgaactttattgtgactttagaaggtaaagatgcgttcgggcgacaaattgatttggctgttgtaccagccccacgttcattgccacgtgttgtacgattaccagatgagttaacgggtggtaaagaacatcatgtcatgttgtctgcaattattcatgaacatgtttcagacttgttcccgggcatgactgcaactggttgctatcaattccgtgtaactcgtaatgccgatttggcacttaatgaagacgttgaagatttggcaaaagcgttaaaaggtgagttaagttcacgccgatttggtcgtgcagtacgcttagaagtaacccaaaattgtccacagcatatttatgaatatctacttgaagagttcgacttaaacgaagaacaattatataaagttgatggccctgtaaacttggctcgtctggtttcgaactttaaacgtcctcatttgcgttacgactcacacacgccagtcgtaccaaaagtgtttaaaaagaccgagagtattttctcggctatgcaaaagcaggatattttacttcatcacccatttgagtcttttgcacctgttattcagttactccgtgaagcagcacgtgacccgcaagtactcgcaattaaacagacactttatcgtagtggtgcagactcggaaattgttcaagttttagcagaagctgcgcgtaatggtaaagaagtgacggcggtaattgaattacgtgcccgtttcgatgaagagtcgaatatcgaagtggctaatgttttacaagaagcaggagcagtcgttgtttacggtattgtaggttataaaacccatgccaaaatgattatggtggtacgccgtgaaaacaacaaactggtgcgttatgttcatttaggaacgggtaactaccatgctatgaatgctcgcatttatactgattacggcctaatgaccaccgataaagacttgtgtgaagacgtacaccgtattttccaagagctcacgggtatgggtaaaatggcaaaactgaaaaagttactccatgcaccttttactctgcatgctcagctcattaactttattgatgaagaaattgccaatgcaaaggctggtcgtaaagcccaaattattgtcaaagtgaatgctttaactgaagttcagcttattaataaattgtatgaagcttctcaagcaggggtgcaagtagatctcattattcgttcgatttgctgtttacgtccgggattaccaaatttatcggaaaacattcgggtacgttcaattgtaggccgtttccttgaacatacacgagtttattactttagtaataatggcgatgctcgtatttactgttcaagtgcggactggatggatcgtaacttatttaatcgtgttgaagcatgcttcccaattgaagatcctgctttgaaaaaacgtatttatcagcaaggactccttaattatttacaagataatcagcaagcttggttgttacagggcgatggtacatgggtacgtgcccagccagccgaaggcgaaaaattgcataatgctcaaagagaattattagaaacttttaaataa

SEQ ID NO: 1775 - DNA, 1155 bp, Acinetobacter baumannii
agtataagcatgaaaaaattagcaattttaggtgttacggtttatagctttgcacaactggcaaatgcagcaacgttaaatgtaaaaccatatggtacgactcaaaatggccaaaaagttgatctatacaccatgagtaataacaatggagtctcggtatcttttattagttttggtggtgtaattacacaaatcctgactcccgatgcccaaggcaaacaaaataatattgttttgggctttgatgacctaaaaggctatgaagtcactgataccaaggaaggtattcattttggcggattaattggtcgttatgcgaacaggattggtaatgctaaatttagcttagatgggaaaacgtataatcttgaaaaaaataatggcccgaactcattacatagcggcaatcctggttttgataaacgtgtttggcaagttaagcccctcgtttctaaaggtgaaaccgttaaagcttctcttaagttgaccagtccaaacggtgatcaaggatttcctgggaaattagatgtagaagtgatctacagtctttcagatcaaaatgaatttaagattgaatataaagccaaaactgatcaaccgacagtcgtcaacctcaccaaccacagttatttcaacttatcaggcgctggcaataatccttatggtgtactagatcatgtggtacaactcaatgcagaccgtatattggtaaccgatcaaaactctttaccaacaggtgaaattgcttcagttgcaggtacaccttttgattttcgaacgcctaaagcaatcgtaaaagatattcgagcaaataatcagcaattggcttatggatatggctatgaccaaacttgggtaattaatcaaaagtctcaagggaaactcaatcttgcagctattgtggttgacccaaaatctaaacggaccatgcaagtcttaaccactgaaccaagtgtccaaatgtatacagccaatcatttattaggaaatattgttggcgcaaatggcgtactctatcgacaagcagacgcactagcattagaaacacagcattttccagatagcccgaatcaaccggctttcccgtctacacgtttaaacccaaatcaaacttataacagtgttaccgtatttaagtttggtgttcaaaaatag

SEQ ID NO: 1776 - DNA, 669 bp, Acinetobacter baumannii
tataaaggcatcagcttgaggaatattgttatgtcgactgagaacaccaacactgctgttgcagaagaaattccgaaccttttgattacaccatctgcacaagagtatttgcacgaattattggcgaagcaaaatactccgggaattggcgttcgaatttttgttgaacatccgggtacaccacgtgcagagtgctgtatggcatatagtgcaccagaagaagtggtgccaacggattataaacaggactatcctgatttccctgcatatattgatgcgccgtctatcccttatcttttagacgctgttattgactacaacaaagatcgttttggtggtcagttaactttccgtgcaccaaattctaaagtgccgcgcgtagggccagatgcatcaattgaagagcgtattacctatgtacttcaagcagaaattaacccgggtcttgcaggacacggcggtaactgtagcttagttgaagtgcaagatgaccctgaacacgggcttactgctgtattgaaatttggtggcggttgccaaggttgttcagcaattgatgtgactttaaaacaaggtgttgaaacaaccttgaaagaacacattcctgaactacaacgtgtggttgaccaaacagaccatacacaagcagaaggtgcttatttcaaataa

SEQ ID NO: 1777 - DNA, 183 bp, Acinetobacter baumannii
agacagctaatgtgtggtgtaaatctaaccattaaatcaaaggaacattacttaatgcaaagaaaaggggcgcttttaacgattgtactggtggcgcttggtgcccaccaccagtacaacacaatatcaactctacaattaattaatatggaggtgacacaaacaaataactatcatttctaa

SEQ ID NO: 1778 - DNA, 717 bp, Acinetobacter baumannii
gcttttataatgaatgcaaaatttcaactcattaaagacattaattataaacccaaagactcacaacttggagtcataattaaaaaggtaacatcagaacaaaatcatactggttttgtatttattgaagataataaattagtactagctcattttggctggcatgaaacctatttttttcaaagacgtaatgactctgacggttatgctatgtactggtttgatttagaaaaaattccagaaagaactcttgtacatataattaatgaacttgaacaaatttctcataataaagatttgaataataatgaagttttctattttcctgctccttatggaatcgtaaattttggtggatctaggatctcaggaggtgattttctaagtacccctaatacggtaggtgatagccttacatgttcagtttttgttaattgtatatttgaacaatccggttttccaatcctagatttagatacctggaaaacaacagagcaggacattgaatggcaaactagtattcttgataaattaattggaaaattgagtccagagtttatgcggatacagcgtgaaaatgtaggtaaagttccgcggttacgtccagaacaaatggttggagcatgttgtgtttttgattatgagctagttgattttgatacagcagatagtgcagcaataattgttttagagcaattagaagcgctaggttgttaa

SEQ ID NO: 1779 - DNA, 1128 bp, Acinetobacter baumannii
acacccataattttgtacaaatccagcattatggggctacaatacagcagtcggttgacagtaatggaatatccgccaacctatcctagtgtaataccgaacatcgagattgttatgacttatacgttcaatcgtcctgcatttccagctactcgcatgcgccgtatccgtaaaaatgaccagttgcgtgcgatggtcagcgaaacacagctcactaccaatcacttgatttatccagtatttgtattaccgggacaaaatcagacccaagatattccaagtatgccaaacattcagcgtttgtcggcagatttgttactgaaaaaagctgaaagacttctggaattaggtgtatccaaactggctcttttccctgtaacacctcaagaagataaaagcctcaccgcagaagctgcatggcgtgaagatggtttagttcaaaccacttgtcgtttgcttaaaaaagaattaccagaaatggtattaatcaccgatggtgcactcgacccatacacgactcatggtcaagacggcattattgatgaaactggctatgtgctcaatgacgagactgtagaatccttgattaaacaagcattgagtcacgctgaagcaggtgccgaagtaattgcaccaagtgacatgatggatggccgtattggcgcaattcgtcaagctttagaagccaatggtcacatctataccaacatcatggcctactctgcgaaatatgcatctagcttctatggtccgttccgtgatgctgttggctctgcatccaaccttaaaggtggtaataaatataactaccagatggactttgccaaccgtgccgaagcgttgcatgaaatcgcgcttgatattcaagaaggcgctgacatggtgattgtaaaaccgggcatgccatatctggatgtggtacgtgaggtgaaagatacctttggtattccgacattcatttaccaagtgagtggcgaatacgcaatgttagctggcgcaattcaaaatggctggttatcagactcagtgattttagaatcgctcatgtgctgccgccgcgccggtgcagacggaatctggacttactttgcagaaaccgctgctgaaaaactcaaggaaatgaactaa

SEQ ID NO: 1780 - DNA, 297 bp, Acinetobacter baumannii
ggagacacaatcatgagtgaacaagtcatggtagagcttcggctgattgaacaaacttttaggcttgcaacgacttctgataaaagagaagagcttgaacgtgcagctgagcttctcaatgaaaaattcaacgatatgcgccgtagtgcacctcgtgttgagcataataaacttgtcatcatggtagctctacagcttactcaagaagtgttaagtttaaataaatctttgcaagaatatgcgcattgtgaacgtttactccagactattttggaagatgttgaacaaatagtgtaa

SEQ ID NO: 1781 - DNA, 1263 bp, Acinetobacter baumannii
aacatgacaatctttgctgctatatggtcgcatgctttaaaattcgttttctattatccattatttatgtcgtatttatggatgattggcgcgatcattttctattggaaggaacgtaaagctccgccttatgatcagccagctccattagaaagctatcctaaagttgctgtgcttattacttgttttaatgaaggggataatgcagaggaaacgattactcatgctttaaaattggattatcctcattttgaagtgattgcgattaatgatggcagttcggataatacaggtgaagtgctggatcggttagctgaacaacatgaaaaactccgtgttgttcatcttgcacaaaaccaaggtaaagccatggggttgcaagctggaagcttaatgaccgatgccgagtttttaattggtattgatggtgatgctttacttgacccgcatgcagcaaagtggatggttcgtcattttcttcaaaatccgactgttgcagccgtgacgggtaacccgcgtatccgtacccgttcaactttattaggtcgtattcaggttggtgagttttcttcgattgtcggcatgattaaacgtgctcagcgtacctttggccgtttatttaccgtatctggtgttattacggcttttcgtaagagcgctgttcaccaagtggactattggtcacctaatatgttgaccgaagacatcgatattacttggaaattgcaacgtgccggctgggacattcgttttgaaccgaatgccttggtttggattttaatgcctgaaactttaaacggtttgtggaaacaacgtttacgttgggcaatgggtggagcacaggtattaattaaaaatattgatgtgttcactaaaccaaaattgaattttttatggcctttaatgtttgagctttgcttaactttagtctggtcatatttaatgctggcgatggctttgttgtggttggtacattttattttaccggtccctgcattagccgttgtgagctctccatttttaccgtatggtagcggtattttattgggggcaacctgtctcattcagtttgctttaagcaaatggatggatagtcgttatgaaccgcatctaggaaaaaactatttctggatgatctggtatccattggtcttttggctaatcaccatctcggcaactattgtggcatttccaaaagtcttacgacgtggagatgagaaacgtgcgcgttgggtgagcccggatcggggcattcgtggatga

SEQ ID NO: 1782 - DNA, 387 bp, Acinetobacter baumannii
ggaaataaaatggctggatgtggatgtgcttcaacatgttctcctacaaagaaagtaagcccgcgctttagaagagcgttatggattgctcttataattaatgcactcatgtttgtcgttgaaatagtcggtggttataaagcccaatctgtttcattatgggcagatgcattagattttgccggagatgctgcaaattatgctctgtctttagtcgtgctttcgatgagcctttactggcgtgcaaccgcagcacttgttaagggtataacgatggctgcttttgggttcttcgttattgcaaaagtcgtttggtcattttttcatggcgtttcacctgaaaccgatggtcatgggggcaattggggtaatcgctttaattgctaa

SEQ ID NO: 1783 - DNA, 408 bp, Acinetobacter baumannii
tgtagcaaaatgcaaaaactcgtgctgacgttattcgtcacttcactcctagctggttgttcaatctttggtgtatataaggttgatattcctcaagggactccattgactaaagctcaagcctctcaagtacaggtcggcatgaatttccagcaagtgcgctttttgcttggtagcccaacagtgactgatcccctcaatccacaacgttgggactatatctacaactatatcccgggaacatatgctaaaaaagcgaaaatccccgcagcacatggtcagcatttaaaaatttactttgatggaactggaaccgtaactaaaattgaaggtttagagactattccagaatcgcaaccaggtttacctgcttccaaagaagcaattttaactgccccaccactataa

SEQ ID NO: 1784 - DNA, 1077 bp, Acinetobacter baumannii
cgcaaaaaaattcttggtttctttgcgctgattttattgatcgccgctattttatatgcaatctgggcattatttttaaatcactcggtgagtacggataatgcttatgtcggtgcagaaaccgcgcaaattacctcaatggttagcggacaggtcgctcaggttttggtaaaagatactcaaacagtacaccgcggtgatgtgctggttcgtattgatgaccgtgatgccaaaatcgcgttggcccaagccgaggcagagcttgccaaagcaaaacgccaatataaacaaactgcggcaaacagtagttctttaaactctcaagtggtggttcgtgctgacgaaattaacagtgctaaagcacaggttgctcaagcacaagccgactatgacaaagctgctttagaactgaaccgccgtgcacagcttgcggcatctggcgctgtgtctaaagaagaactcaccaaagcacaaagtgcggttgaaactgctaaagcagggctagagcttgctaaagccggccttgcacaagcgacttctagtcgtaaggcagccgaaagcaccttagctgcaaacgaagcgttaattcaaggtgtaagcgaaacctcgactccggatgtacaagttgcacaagcgcatgtagaacaagctcagcttgacttggaacgtaccgtgattcgtgcaccagttgatggtgtgattacacgccgtaatattcaagttggtcaacgcgttgcaccgggtacaagcatgatgatgattgtgccgcttaacgatttatatgtagatgctaacttcaaagaaagtcagttgaaaaaagtccgcccaggtcagccagtcacattaacgtctgatttatatggtgatgatgttgaataccacggcaaagtggtgggcttttctggtggtacaggctctgcctttgccttaattccggctcaaaacgcaacaggtaactggattaaagtggttcaacgcttaccggttcgtattgcacttgacccgaaagaacttgctgaacacccattacgtgttggcttgtcgatggaagcaaaagtcgacttatctgcgaagtaa

SEQ ID NO: 1785 - DNA, 882 bp, Acinetobacter baumannii
tttatgaaaattttagatggcggtttaggccgtgaattggctcgccgtggcgctccgtttcgtcaaccagagtggtctgctcttgcactcattgaagcacctgaaacagtaaaagaagtccacctcgactttatcaacgctggtgcagaagtcattacaaccaataactatgcggttgtgccatttcatattggtcaagaacgttttgaaactgacggcgtgcgtttaattaaagttgcgattgaacaagcaaaaaatgcagttaaagaaagcggcaaaaatgtcaaaatcgcaggctgcttaccgcctttatttggttcttaccgtgccgacttgttccagccagaacaggctaaaaaccttgctgagccaattattaacacattggcaccagaggttgatttttggctcgctgaaactcaatcatgcttaaaagaagttgaaacagttcatgcgttattgccacaagatggtaaagactattgggtgtcatttacgctacaagacgaaatcaaacaagaacaagctttacttcgttctggcgaaaacatgcagcaagtggctgatttcatcaaacaatccaatgccaaagcagtattgtttaactgctgccaacctgaagtgatcttgcaagcgattaatgaaattaaagagcttattcctgagtctgtacaaattggtgcttatgccaacgctttcccaccgcaagatgaaagcgctactgctaacgatggccttgatgaaattcgtaaagacttagatgctccagcttatcttgcttttgccaaacaatggcagcaagcaggtgcaagtttagtgggcggttgctgtggtattggaccagaacacattgctgaactttctcaattttttaaagaataa

SEQ ID NO: 1786 - DNA, 1704 bp, Acinetobacter baumannii
gttatgaaaatgtcacgtcgtgcatacgcagaaatgtttggtccaacggttggtgatcgtattcgcttggctgatacagagctttttattgaggttgagcaagatctaacgacctatggtgaagaagttaagtttggcggtggcaaagtcattcgtgatggaatggggcaatctcaacttttagccgatgaagttgccgacactgtgattactaatgctttgattgtagattggtgggggattgtaaaggcggatgttggcttaaaaaatggacgaatctggaaaatagggaaagctggaaaccctgatattcaacccgacattactattcctttaggtgctgcgacagaagtaattgcaggtgaaggacaaattttaacagctggtggtattgatactcacattcactggatctgtcctcagcaagttgaaaccgcgctgatgtctgggacaacgacaatggtgggtggtgggacaggaccagcagcaggtacttcggcaacgacagtgactccagggccttggcatatagcgaccatgttgcaggcgattgatgatttgcctatgaatattggcttgttaggtaaagggaatttaagtttacctgaccccattcgcgagcaaattaaagcaggagtaattgggttaaaactacacgaagattggggatcaacacctgcggctattgataactgtttgagcgttgcagatgagtatgatgtacaggtcgcaattcatacggatactttaaatgaaggtggctttttagaagaaacgctagcggcatttaaagaccgtacgattcatacgtaccataccgaaggagcgggtggtgggcatgctcccgatattttaaaagcaattgggcaaagtaatgtcttgccatcttcgaccaacccaacacgaccttatacgatcaataccattgatgagcatttagatatgctcatggtttgccatcatttagaccctgcaattgctgaagatattgcttttgcagaaagtcgtattcgccgtgaaaccattgctgctgaagatattttacaagacttaggcgcaattgccatgatgtcatctgactctcaggcaatgggacgtgtgggtgaagtgattttacgaacttggcaaactgcccacaaaatgaaagtacaacgtggccccttagagggtgacaatgagtttcatgataacaatcgcgttaaacgctacattgccaaatatacaattaatccagccattacccatggtttaagtcatgaaattggttcggttgaagtcggaaaacttgctgatttagtgttatggaagcctgcgttttttggcgtgaaaccttccatgatcattaaaggtggcatgattgcagcagcgccaatgggtgacattaatgcttcaattcctacacctcaaccagtgcattatcgcccaatgtttggtgcttatccacgtggtgtacataacacctgtattacctttttatctcaagtcgcaattgatgaaaaagttgctgagaagctaaaccttaaaaagttaatcagtccctgtaaaaacacgcgttcaattaccaaagccgatatgaaacacaatacatattgtcctgttatgcaggttcatcctgagacttacgaggtgcgggccgatggtgaattattaacgtgtgaacctgctgacgtgttaccgatggcacaacgttatttcttgttttaa

SEQ ID NO: 1787 - DNA, 459 bp, Acinetobacter baumannii
tgtatgaaaatgaaatgggcttcagaatataatactggtattgacgttattgatgagcaacataaacgaatactggattatattaatgagattgatgatgtaaaagatgatgaggatagacgtcgtattaaagatgtcttagacaatattattgattatacacaatcacattttacctttgaagaaagtttacaagaggaagcggattataaatatagagtgcctcataaacgtgtacatgacttatttattaaaaaaatagagttatatcgtgaacgttttgaaatgggccatacgattgaagcagaattacaagagatcttggctaaatggttaattaaccatattcaacatgatgatgccgattatgtgggggcagtaaaagaaaatatgatggggattattagagaaaaagaaaagaagaaaggaaagaactggttcgcccgttttttctcataa

SEQ ID NO: 1788 - DNA, 492 bp, Acinetobacter baumannii
ataatgaaaattctatttttacatggtttggattcttctcgtgaatcaacaaaatttcatgccattttacatcctgaaaaattttgtattgatgttgattatcgcaacctaagttatgcttcagttaaagacttttatcatcaagcgattgaaacaattaaacctgatttgttagtcggtcatagcctcggcggttattgggctttgaaaactgctgctcaacataaattagctgttattgttgccaacccaagccttacacctaattttcgtaatgattaccctcacctttgtgacgaagaccttgaccactctaatcctaaaatggcctatttagagttaggagacgagcaacttgatatgtatcaagtacaggaaaagctgtcaccatatatgacaatagaaacttatgacggaggccatcatcgtcttgcttatccttctcgtcttaatgatctcattactaaaattcataaaaaatattttgcttga

SEQ ID NO: 1789 - DNA, 360 bp, Acinetobacter baumannii
tggttcgaaattagtcactgttcatcagcccattgtataaaaggaatacttatgattcccggtgaagttattactccagaaactgatattgaactaaatgttggacgagaaactttaaaggttgtggtggctaatcttggcgacaggcctattcaaatcggttcgcattttcatttctatgaagcaaacgatgccttacagtttgatcgtgaggcagtcaaaggttttcggttaaatattgcagcaggcacagcaatacgttttgaaccgggacaaagtcgagaagtagagcttgttgctttagctggtaagcgagaagtatatggttttgctggtcgggtaatgggcaagctggattaa

SEQ ID NO: 1790 - DNA, 648 bp, Acinetobacter baumannii
tttctaaccttgaaaaaacaatggaaatataaaatgcctactgcgcaagaagttttagatcgtttgaaagcaggtaatcaacgatttgtaaatggaaatacttcccttgcaaaaaccttatcgcatcatgaacgcgctgaaatggcaaaggatcaaaatccgtttgcaattgtattaggctgttcagattctcgtgtaccagcaggaatggtatttgatcaaggtcttggtgacttattcgtaatccgtgttgctggtaatgttgttgcgccttcacaagttggtagtgttgagtttgcggcagaacgttatgattgtccggttgtagttgtattaggacatagtcattgcggtgcgattcaagcgactattgatacgttgatgaaccctgatcatccgccttcatctaatttaatgtcgattgtgaaccgtgttcgcccatcagttgaaattttaatgcaaactgatctgaaaaatgatttgaaaaaactttcatgtcatgcagtacgttcaaacgtttttgcttcggtcaatcaattacgtcatggttcggctgtattagagaacctgattgcaaaaggcgagttgattgttgttggtgctgagtattcattagaaactggtgaagttactttttttgacttctaa

SEQ ID NO: 1791 - DNA, 900 bp, Acinetobacter baumannii
gaaaaatcgatgaattatgaattatggaaaatatttttagatgcggtggaactcggcagcttaagcaaagtcgccatgctacataacaccaaccaaccgcaaatcagtcggcaaatgaacgagcttgaagcacaatgtggcggacgtttatttaatcgaactggacgtggcgtcgaactcactgatttaggacagcatttacttcctaaaattcgttcatggctgaacgtaaccgaccaactgaataatgaaattttgcattcgaccgataccccgattggtacggttcgtattgccagtttgccgtctactgctcatccattgttatcgactctgtataaagtgcttcaagagaaatatcccttaattaagctgtcagtccgtgaagggcaaggcgtgcatttagaaaaatggcttgaagatggcagtgttgatttagccatactctatcggtttaatccaacgcctaaacatggggatgtttaccttacccaagccgatacctatttggtcggttgtgaaggcgatgtgctcactcaggctagtgaagtcgattttaaagacgtaagtcagttaccgctggtcaccttttgcagaccaagtaactggcgtaattttttagaccatatggcttatgaaaatggggtagagctgaatattgtgtttgaagccgattcgattagtttacaaacccatttggtttcagagtctcgcatgtacaccatgctgggaccacaagcgttaaagaaggccagccaatacacctcaattcaagccgcaaaaattattaaccctgcgctaaagcgctacatttctttgtctatttctaaacatggctatttaacgcctgcgtgtaaggctgtgatggaagaaattaggagtttggccgatttgctttaa

SEQ ID NO: 1792 - DNA, 699 bp, Acinetobacter baumannii
atacaggagatcaggacgaacatgaaagcctttattgttcgcgtgttgttaatttttattggggcaattctccttattcaactctggattttctcaagtttggtttggtggcgtacacatgaagttgataccaccatgtttatgcgaattgattattggtcagatccatctgagccgatcattcatgaatggcttgactatgatgatattagtgacaatttcaaacatgcaattttagcaggggaggacgcaaaatttattcatcatcatggttttgactgggatggtattcgttttgcgctagagcgtaataatgaagaaggtgaagttgttgctggtggttctaccgtatctcaacaacttgcaaaaaacttgttcttatataataaacgttcatttattcgtaaaggccaagaaactgtagcgacatggatgatggagcgcatgtggtcgaaacgtcgaattcttgaggtgtatatgaactctgttgaatttggcaaaaatttgtatggcgttgaagcagcggcccaatattattacggcaaaagtgccaaaagcttaacgcgtgaacaagctgcttttttagccgcattattgcccgatccgaaatattatcaagatcatcgcaatgatcgtaaactacaatatagaaaacgcgttattttacgttatatgaatagcacccagattcctgaataa

SEQ ID NO: 1793 - DNA, 303 bp, Acinetobacter baumannii
aatgaggagattgtcatggcattatcacagccagcaactttcaatgaagaatggtccgatgagcgtgtttttgcctacctcaaccaacttcctccaaatggtgtgaacgcagacttccatgtgctctaccatgctttcaaacatatgcgtccaaatgattatgaacgtcttctaactaaatttgttgcagatggacgagatattaatgcgactaatccggaaggcgaacgcattcatgacgtgattgctaaattcccacgtcaatcagcaccgtttttagaagttttagcaaagtttgcttaa

SEQ ID NO: 1794 - DNA, 726 bp, Acinetobacter baumannii
aagaacaggatgctgcttatgccagagacgtcaattcaacaagaaacacaaagtacgtgggtaatatgtcgagatcctgttttattgactatggtgggcggggcaattgataccattggctttatcgcgttatttggtttttttactgctcatgtgacgggcaacttggtattggccggggctgcgttggtgaagggtggtgccggtttatggattaaacttgcggctattccattgtttattgtgacggtggtgattaccaaacttttaattgaccgtagtcagaccaaacacaaaacgctgtcttatttatttttatttgaagctatttttctctttgcttttatggctgctgggctttactttgagccatttaaaaatgccgattcgattacggttgcaatcactggtggcctcggtttaattgctttggcgattcgtaatacatcaagcaaaaccctcattaaaaatattagcccaagtaccatgatgacaggtaacactacccagcttgggattgatattgctaacttgcttaaaaataataatgctgccaatcgggcaagtttgcttaaaagtgccagtattgttattggctttgttataggtgctttgatgggggcggtactctatgtctattttgacttttggagcgtagcgccgtttattttacccatactctatttttcttatttggcttcccagcagaagtttaaacaagcttaa

SEQ ID NO: 1795 - DNA, 1044 bp, Acinetobacter baumannii
gcatcaaggatgaaatctatgacaaggctgtccgcatcaattaaagcctctatgaaaaaaactgctactgcactgactttggcttgtagcttattgtcagtcatgagcatttctcaagcgcaggcagccgataatattgatgtcagctttcaaacaatattacagcaggaacgtaactgggcaggactgcaaagcaaaagcctaaaggtgggcgatatcacttggtcatatagtgaaggtggctctagcacaaagccaactttactactcattcatggcctagcgggcagtcgagataactggaaccgagttgcccattatctcacgacaaattatcacgttattattcctgacttaccgggcagtggcgaaactatcgtttcgcaagactttgattattcggttcccaacttagctgaaaaattacgtcgctttgttgaagccgccaatttaaaaggcccaattcatattgctgggcactcactcggcggatctattgccctactctatgctggacaatatccatttgaaaccaaaagtctatttttagtcgatagcggtggtattttccgttctgccaacacaatttatctaaaagatccaacctatctaaaacaacttttagtctctaaaaaaggtgattttaattatttattaaaacaaaccatgtttaatcctccgtttattcctaaagagttcctgcaagctcaagaaaaactgatgattaatcaagcacctcaaacacagaaactggttgatcaattgattgcactcaataaagtctataccccagattcatttgccgtacttactaaaacgattgacgcccctacactcattttatggggtaaacaggataaaattattaatgtagaagtagcaaacgagctaaaacggcttttaaaaaatgcccagcctccagttatcttagaaaacgtaggtcatatgccaattttggaagctgaacagttagttatccaacaatacgtaccgtttttactgaaagtagaaacaaaccagtcgtcaaaaacgacaacaccttaa

SEQ ID NO: 1796 - DNA, 1356 bp, Acinetobacter baumannii
aggcaaaggattgattgtatgctgacattacttggtgttggcatgattttatgcttcatgtatttaatcatgtccaaacgtttaagccctattattgctttaattctcatcccatttattttttctcttattgcctggggccttggtcactactttgaaagcttgagccatatcgagcttaaaggtctcagtgaaatgatgctagatggcatcaaaaaacttgcgcctactggcgtaatgctattatttgcaattttatattttgccttaatgatcgatgcaggtcttttcgatcctccggttaaatggattttgaaaaaagttaaaggtgatcccctaaaaattacattagggactgtttttttaactacattagtctctcttgatggcgatggctcaaccacttacatgatttgcgtggcagccatgctccctctttatcaacgcctcggtatgaatacactgatcatgacagcacttatgttgttatgtagtggtgtaatgaacctgaccccatggggtggccctactgcgcgtgcagcaagtgcactccaagttgacccaagccatatctttgtaccaatgattcttccaatggtgattagtattggctggttattcttcttggcatatttatatggtcgctatgagcaaaaacgtttaggcgtgattgagcttgaaagtcaccatggtgataacattacagtttcaaaagaccctgaagcaactcgtccacatttacgtaaagtaaatatggtactcaccattcttcttatgattgcattgatcaaaggtattttaccgatgtcagtgttattcatgctggcgttctgtattgcaatgctcatcaactaccctgatgttgatatgcagaaaaagcgtatcgctatgcacgcagacagtatcttggctgttgtaggtttaatttttgcggcaggtatttttacaggtattttatctggtacaggcatggttgaagccatgtctaaagaatttgttacaatgatccctacaagtatggggccatatctagcgccaattactgccctggtgagtatgccattgacgttctttatgtcaaatgatgcattcttctatggtgtattgccaattcttgctgaagcagcttcacattatggtattagcccagaagcgattgctcgtgcatcaattgtaggtcagccagtgcatttgttatcacctctcgttccatcaacctacttgttatgtggtcttgctaaagtcgactttgcagaccatcaaaagttcacttttaagtgggcatttatcacttgtatggtgttaatgggtacagcattagtgattggtgttttcccactttttagtacgatgtaa

SEQ ID NO: 1797 - DNA, 933 bp, Acinetobacter baumannii
gttttagggataaaaacggatcatttcatggatagcagtgaaaacaatttcaaccaaatgccctcaattaaaacattacaggcttttgaacaaactgcccgtttcggcaatgttgccaaagcagccgagcatttgaatctcaccccttcggcagtgagtcaccaaattgctaagcttgaagaaatgattgggcagagtttatttattcgtggcgcccgtggtgtgacacttactccttcaggtgaacgctattttcaagatgtcaccaccattttgcataacctaatgttagctacggaaaaagctgccgataaaagccctaaagacagtttatatattcattcatccccaagttttggtttactttggttgcttcctcgccttgagtcatttaaagaaaagttccccatgattcaggttaacctatcgtgttcgtatgaaaatttgcactttacccgcgataagatcgatattgatattcgtcatggtttacccaactggacaggggtagaaatcagaaccattcgtaatgaaaagcttgaagtgcttgcgtcccctaagctactggaacgtagtcctgtgcataaacctcaagatttattaaagaaagatctgattttatctcgttcaaccttagttacttggccccaatggtttgcccatcagggtttaagcattcctgaatttccctacactttgagttttgaccgctcttatatgtcacttgaagcagccacacatggactaggttttgttttggaaagtaatttactcactcaaaattacttagaatctggaaagttggttagagtttttgcagatgagctatcgattccaatctctgctcatcatttggtgtatccacgaacgcatcaatttattcctaaaattgagctgtttttaaactggattcatgatgaattggcaggctga

SEQ ID NO: 1798 - DNA, 1680 bp, Acinetobacter baumannii
gtccggtacttatcacgttattttggaaaaaatacaccgattgcaaggagcaataagatggtgttgaaaagtgatggatattcttcagaccatattcggttaaatcgttttgtattttggagttcggcagtcagtatcggcatttttggcctattatttgttctgtttccagaaaaaagtcagttttggctgacctatgtgcaagagcaggtaaaccactttttcgggtggtattacatgttggtgattgtgctgtgtttaggctttgtggcttggcttgccttctcaaaagtgggacagattcctttaggaaaagaccacgacaaacctgagtttggctatttggcttggacctcaatgctgttttcggcaggtattggtatcgcgctactttattatggtgttgctgaacctgttgaccattttctaagaccgccagaaggtgaggccggtactattcaggccgcccgcaatgccatgacctatagttttttgcactggggtattcatggctgggtgctttatgccttgctgggtgtgacattaggttattttgcctttagacaagatttaccactcgcactacgctcggcactctatccaatttttggagagcgagttcatggtctggtaggcgattttgtcgatggctttggtattttagcgaccgtaatttctttggtgaccaacttaggtattggtgctttggtattggtttcaggtatttgttatttaattcctgaaattcctgataactctgcaactttaattactgcagttttaatcatgatgtttgtggcgacagtcactacagtggtcgggattgaaaaaggcttggcatggttatcacggattaatttacgtttgctctatgccttactcttatttgtatttttaacaggaccgacgaaccatttgttaaatggtcttgtgcaaaatacgggcgattaccttaataattttatgggtaaaagttttgatatgtatttatacaatcaaaaagccagtggctggttgggttcatggactgtattttattgggcatggtggattgcttgggcacctttcgtaggaatgtttattgcccgcatttccaaaggccgaactattcgagaagtggttttgggtgtatgccttattccattaggttttaccttggcttggatctcgatttttggaaatactgcaattcatttaattctcaatcaaaaacagaaagttttaggtgatatggttttaagtgaccctgcgttgtcattattcaaattactcgaatatctcccgtttaatccgtatattgccgggattgttgttgtaatttgtttcgttttatttttgacaccggttgggtctggtacactaatgatcgccaatttgtcctcgaaagggggcaccagtgatagtgattcaccgatctggttacgcatcttttggtctgtggtcattaccattgtaagtatcggcttattattagcaggtagttttaactccatgcaaagtgcagtggtgttatgtggtttaccattttctgtgattattttgctttatatgtttggtctagccaaagccttaaagcaagatgattttgacccgaatgttgcgaaaaagcagttagctatttcaaaagacatttctattccatcgaattgtgaccagaacaaagtgaccgaggttttataa

SEQ ID NO: 1799 - DNA, 372 bp, Acinetobacter baumannii
agaaggcacttgaccaagcgaagaagtttaatgcggagggcgcaaaaaatggacagtagatggattgaagcgcaacgacgtgaaatggaaaagcttatttcaccagagctaatcaagtcgagagatttagcacgtcaaagttacttcgatcatatggaaaaagaaatggctgaccacgtatcgcgctcaattgaaccactcagcggcaaaaagcaaagcactctggttgaattaagggagtcaattgaaaaactggctcagaagtataaacaagatgctcattcatccagcctttttggtgatcaggataaagcacgagtttataaccgctttgctaatgagttggaacattttctgaaaggtggtgcttga

SEQ ID NO: 1800 - DNA, 351 bp, Acinetobacter baumannii
aaaaaaattgttcatctaaaatttaatatttcaaagcgagccattcctatgtcaatagaagatttctttataaaagactctccctctaagagatatcttttaatgagcttagccctattcatgttaataatggctttaattgcttactttaagggaaagttaggatttgaatatgtattttcacttattgcagggtacgccttaatattctttattttaaaaaatgcagcattaccacttttccccccacttacggaaaaaagtagtgatgcaaacgctatggctagaacaacaatagcaattgtttatatctttgctttcatagctctaactatttcttattctttataa

SEQ ID NO: 1801 - DNA, 564 bp, Acinetobacter baumannii
aatagggttgttctcaccatacgattagggaaaatggagaaaataatgagaaaaatttatcccttacttgcagttttgacagtaagcagttgggcacatgctcaagattactcatttcttccagaagcaaaattagcagatcataaagcatctacctggaatgtaggcgccggttttacacaaaaattgttacatctcaatggtgagtgggtaaatccttatggaattgcttacgcaaaagttggtgcatttttaaatggcgataaaactgctggagggcaagtcggattccgctatccgtactaccttactggaacagataaaaatggttactatattggcttttacgctggacatcttgatagcaaatcggttgatggagattataaatctcgtttaggtgctggtgtcgatttggcatatgtattgttgaattcagaaagaattaatacgtttagtgtgggtatcggcgcagcggaaaaattaacggaccagaatggtgatgttgctgcagatactaaaccacaaattcaattttcttattctctaagttttggtttataa

SEQ ID NO: 1802 - DNA, 288 bp, Acinetobacter baumannii
tggcaagacttaatgactgatcaagacgttttagcgtataacgctgagaaagcatcgccagctgttggttggcatgttcaactaaaatatctaggtgatattgctgagcatagtcacggaactctttacctttggcatcaccaatcaagcctgaaattttgctccagcgatgttcttcttgttgaatgttttgaatttgctcagcatatttttgctgtttggcaaggttttgatgatgtaattcaagcttcagctttagcccgtcacgcacttcaagctgtgctttga

SEQ ID NO: 1803 - DNA, 270 bp, Acinetobacter baumannii
atcttttatgtgcaaaattttattttaattcaatttaatttttttattttaatgaatgagttaatttatatatttgaaattgtgattaggataattaatttaacttttaatataaaattatttaaaaataataattatcttaaaaggaataaattatttatcgaaaaaatatcctacatttgcaggatattttgcaccaaaataaatcaattttcatcaggtggagatggtaaatcatttttttctaatacacgtgttactaatagctga

SEQ ID NO: 1804 - DNA, 327 bp, Acinetobacter baumannii
tcctcacatgtacaaggaagcagaacaatgaagacatttaatgaaaagttggcaagctggattcatgcaacaccagcaactgaagcaggtatcaacaatattcaagttccaggtcaatctgaattgttggtttggcaaacacgttataaagaaccgactctctacgaacaagactttgtaaagaacttgattcaggcattttctgcgggcgcaactgagttagatgatgttgtttctgcacttaatcaacagggtttccgctctgaatctggtgatgaatggacttctgagagctttacagaagaaatgcaacgtttaggttattga

SEQ ID NO: 1805 - DNA, 1293 bp, Acinetobacter baumannii
cgtatctgtgtttattttggcttgatatctgtttctatgtccgtacattttctacatacttctgactggcatttggggcagtttttttataatcattcacgccactacgaacaccaacaatttttaagctggttactcactcaaattcaagaaaaacagccacatgccctactcattgctggcgatatttttgatgtcattaacccgggttcacaagcacaaaaacaactctaccaatttttagcagatgcacatcgcattgcaccacacatgcaaacgctcatgattgcgggtaaccatgactcaggctaccgtattgaacaggttgaaccgcttctagaaaaatacaatgcaaaaaccgtaggtgtagttcgctggaatgaagataaaaccctagatctcgatcgactacttttacctatctataaccaaaatcaagatattgtggcgtggtgccttgccctgccttttttacgttcggccgaaattacgggctttaatgaacataccaccaatagcaaaaatgcgattgcctatttgcaccagcaactgattgccgaagccaaacgtcgtaaaacaccagaccaagcgcttattttgatgtcgcatgcacatatgcaaggtggggaaacatccgactctgaacgccccattattattggtaatgaagaagcactttcaacgacattgtttgaagatgctgtcgactatgtcgctttaggacatctacataaaccacaaaaagtaggtcagccacacattcgttatagcggttcacccattccactttcttttagtgaaattaactataagcaccaagtggttgaagtcaaaattgacccagctcaagacacagacagccgtttgcaatttgaagctgtcgaaattccgcgttgcatacaattgcaccgcattcgtggtgagctaaacgaagtgctgcaacaactcaaagccttgcctcacggtgtgattgaaaatattgaccaccgtgaatatgtcgatattgaatattatagtttaacgccgccacagccaaatttacgtcagcagtttgaagcagctctgccacctgaccgctatcgtttagtgcgtatttcacgtcaatacgtgaacaaagacacgactaattcaaatgctacccagcacattgctcttgagccaccaacaccagaaaaactctttcaaaatatttgggaaaaacaaggttacagcgccgatgatgcggtcttaaaagattttctgagcctggtacaagaagcacaaaaacatcttgaaaatgatgcaagccattaa

SEQ ID NO: 1806 - DNA, 189 bp, Acinetobacter baumannii
ggcgtaaccgttaactatgtgaggccgccgaacgggggggcatttcactacctatacgctgtattcgacttgctttctaacgatatgtacaaagtgtttctgactttcgatacactttgtttcatatatttaagatatttaaacgtttatcaagacgacgttatttggcgtgtagtttttctaaagtaa

SEQ ID NO: 1807 - DNA, 384 bp, Acinetobacter baumannii
ttcatgagctttatcactgaacaagaagcgatagaacatgttgaaggctttgatgctttatctgctagtgataaggctcaataccttcagatgtcagaagcttatctattagcacgtaacgttaagctttatgaagatgctacccaagtacctgaacctttaaaaacggcctcctatcaaatcatcaagggcattatgaaaggtgatctatatcaagggcaagaacaggcactaaaacgtaagaaagtcaaagctgatacagttgagaccgaaaaggaatatcaggacggatcagtaaagcttagtgcaatcgagcaattcattcttgatttgataaaaccgtattgcaaacggaaatccgtcttttttgtcaggaaaatctaa

SEQ ID NO: 1808 - DNA, 279 bp, Acinetobacter baumannii
ttgagcgtagttgttatacaggatatttataaggattttaaaatgacaattatcacattgcttgatgttgagacgaagaagaaggtgatagttcggtccgtaatagacccaatagcaagaatagacaaaaaagggaatatacaaattattcaaattcataaatggctatatgatgaatctggagatttcgttgatgaagacttatatgaggcactcaacaatggagaagttggaatatacttaactttgcagtatatgatcattgatattgaaaattaa

SEQ ID NO: 1809 - DNA, 525 bp, Acinetobacter baumannii
acaatgtcagtaggctttttatttttcgaaacatctgcttttgatttgttcaattcaaaaataaaaaggtatagaaccagcattaacagcatttacatttttaattggggaaacaaaaaaattatgttagttgcacagcagttgggccaatgggcggaacaaacagcactaaaacttttaaaagaacaaaattatgaatgggtcgccagtaattatcattcacgccgtggagaggtcgatctgattgtaaaacgcggtaacgaattgatttttgttgaggtaaaagcgcgagggcagggaaattatggtcaagcttgtgaaatggtgaccttgagtaaacagaaaaaaataattaagacggcgatgaggtttttacagcgctacccatcttatcaggatttttattgtcgttttgatgtgatttgttttgattttccacagaaaattgcaaaaacagtacagcaagacttttcgaaattccattatgatctgcaatggatcgaaaatgcatttactttggattaa

SEQ ID NO: 1810 - DNA, 192 bp, Acinetobacter baumannii
agagggccagtcatgaataaaccattagaaacttttgatatagacgcagcaaaggctcgctacgaaaaattacgaggccgatataaccggagtgggctatctaatactgattacaacgagctacttcaattagagaaggcacttgaccaagcgaagaagtttaatgcggagggcgcaaaaaatggacagtag

SEQ ID NO: 1811 - DNA, 189 bp, Acinetobacter baumannii
agagttcaagtgcttccgcccgatctatgccgtataggtccattgcagcttcatgaacaaagtgaacacagttgtagtgttcgtcatcgtattgcttatcaagcaaatgatcatgacttttcatatagcccccttcaaaccactaaagcgatccagtgcaaaaatgtccccagttttagtggtatttaa

SEQ ID NO: 1812 - DNA, 183 bp, Acinetobacter baumannii
cgcgttctggttggtgtgcttattcaatattgccttaatgacttatttgtggggcctaaacagttgggttccttcttatctcatgcaagacaaaggattcaacctcaaggagtttggggtgtattcaagctttccattcattgccatgttaattggcgaagtggttggtgcgtttttatctga

SEQ ID NO: 1813 - DNA, 531 bp, Acinetobacter baumannii
aaatcagaggttgttatggctttaaaagtcggaattattaaaagctcagacgtatcaaaatggtgtgaatataaggattctgatggacaggtacaggctgagttcaaagtccgtggtatcgcatataaaccctttcaggtagctattgaacgagcaggaaaccagatctcgtctaaaggctacgatgtaatggtaaaagatgaaaatgccaagctttaccacgagcttttaatggatgcatgcgcggcccacttaatcgaagactggaaaggtgtggtatttgccgaaatcgtagacggtaaaactgttgagtccgaaaagccatatacacctgagaatgcctcaaagcttcttaatcttggtgatattggtatttcaatctggctattcattaaagaacaggcccagaagattcaggaagacgcagacaaggacaaggctttaattctgggaaagtcatggagctctacaaataccaaaaaacgtatgcgtcgaaaacgccgcacgaaatcgagcaaatcaagttcttag

SEQ ID NO: 1814 - DNA, 660 bp, Acinetobacter baumannii
gaaatggaggtacttatgttagttgatacctattcaagctcattaagtttaccttctttttcgagtaatacactaaattctataaatcgtagtacaactgtagtttctaattataatggagttgctaatcgcgtaaataaaagcgttgaaaatttcattgatcatactgaatcaatgcgtgttttttttaaaagctttctaaataatcaatcagattttcttgcgttttttttatgcttatgtgtcattggttcttttcaatcatatgatcttagacttgatagtaaagataatattatttcacctgagatatttaaagattctaaaaatagtttttggtgggataaaaaacattattttgaaatatataaattagaagcaactaatagaggaagagaggcttctgcatatatgacagtattaatgcatcaagctgtacaagttgaagaccttaagtttttaaataatttttttcaagagttaaataaaagtagtttaacttcatggtctctcatagctttattacgctcaacaaatgtttataaaaatcaaatttcattgtggaaagaaatgtatttatatactcagaacgttgttataaatgagggattaaacccaaaacgtgagatgtatggcttagatcgcggtttaaatatataa

SEQ ID NO: 1815 - DNA, 246 bp, Acinetobacter baumannii
agacttctattaaatgatgaactgaataccgaaatggagggttccagcccaaaattagatgggatgaaactagaaaattatggtgtaaaaaatcaccatatccccaagatttttaaaagacaatcttacgttgtcttctatctagtttcaccccaattctttcttatttcgtttgacttttctaatcatttaataaaaaagtctagtttttactcatcgttgtatctttttattgatacattttga

SEQ ID NO: 1816 - DNA, 2286 bp, Acinetobacter baumannii
atcaatatattgggaatacttatgtcgaagcgtattatccagtcagtgctttctgtttcagtactggcaagcatgatgtctatggcttttgctgcacaaaatgagcaagatcaagctgaaaaaacattagaaaagcctgctgaacctgtgaaattggaaacaattttcgtaacagctgaagagcaagtgaagcaatcgctcggtgtatcggttattacccaagaagatttagaaaaactaccagttcgtaatgatatttctgactatgtacgtcgtatgccaggtgtcaacctgacaggcaatagtgctacagggcagcgtggtaataatagacaaattgatattcgcggaatgggccctgaaaacacgcttattttagtggacggtaaaccgattaactctcgtaattcagttcgttatggctggaaaggagagcgtgatacacgaggcgactcaaactgggtaccagcagaagcaatcgagtcgatcgaagttttacgtggaccagcagcagctcgttatggctctggtgctgcgggtggtgtagttaacatcattactaaaaaagtaacgaatgaaactcatggttcagtagagttctatacttcacagcctgaagactccaaagaaggttcatcaaatcgtgttggttttaatgtaagtgggccattaattaaagacgttttgtcttatcgtttatatggtaattacaataaaacggaagctgatgatgttgatattaataaatctatcggtagtacagcagctggccgtgaaggtgttaaaaataaagatatttcaggccgtttagcttggcaggcaacagaccagcaaactgtcttgctcgatatttcttctagcaaacaaggtaatatttattctggtgactctcagttaaatgcaaatgctgaagcggatgcgattctttcacagctgattggtaaagaaaccaataccatgtatcgtgatagctatgcattaacgcacgaaggtgattggtcttggggtaagagtaagttagttgctcaatatgataagacccataacaaacgtctacctgaaggcttggcgggaagtgtagaaggaaaaattaataatcttgatgataaagccacttcgcgtttagaaactcttcgctttaacggcgaggctaatattccttttgaatactatttaccccaagtattaactgtaggtaccgaatgggttgaagacagatttaaagataatgtctcgacaactcaaggtaaagacagcagtggttcaggttatggcgatcaattagcgaaaggtgatcgtagtaaaatggagtcacgtattgcttctgcatatattgaagataacctgaaagttacagacagcacagatgttgtattaggtttacgttttgatgaccatagtaaatctggttctaattggagcccaagcttaaatattactcaaaaactcaatgattatttcactttaaaaggtggggtagcaaaagcttataaagcaccaaatatgtatcaaaatgccgaagggtatttattaagtacaaatggcaatggctgtcctgctaatattgagtcgcgttgtttattacaaggtaatggtgatttaaaacctgaaacatcggtaaacaaagagctcggtattcagttccaaagagatatcgtgaatgcgagcttaacttggttccgtaatgattataaagataagattgttgcgggtactcatgttgtcggaacagttgatggctcaagtacaaatgcaaatacaggagctgtgaccaatacgaagtggaatattttgcgttgggaaaatacgcctaaagccttaattcaaggttttgaaggaagtttggggttagacttcggtgatatccgctggactaataactttacctacatgatggactcgaaagacaagcaaacagggaacccattatctttagttccaatctatacaattaattcaatttttgattatgacattactgatcaattggatgtaaattttgtatttactcaatatggtcgtcaaaaatcacgtcaatttgcagagaatagacttgaatccggtataggttcaggaggtgcgaattctgcgcttaagccaagtacggtaaaaagttatagtaccgctggtattaatgttggttataagttttcagaccaaattagtacacgtgttggtgtgagtaatctgtttgataaacaaattttaagagacagtaattctattagccaaacttataatgagccaggtcgagcttattacgcatctttaaaatattctttctaa

SEQ ID NO: 1817 - DNA, 198 bp, Acinetobacter baumannii
gcgcacatattgttgacggtcgtgtaccgcacgcaacattacttgaaatctttacagatcacggggttggtacgcttatttctaaccgtacacaaacaactcactaaaccttattattttttattaaaagatcacgctaagtggtctttttttatgccatttaattttggtcatttttttgtcatgagctttgactag

SEQ ID NO: 1818 - DNA, 234 bp, Acinetobacter baumannii
ttagccgtattagcgcttccttcacgacatgaagttgcaccagaaatggatgttccttggcctactcccccttcggtatttgtcccagcaaaagcatttggagcaaaacaaattacacccgataaaactgccgctgatagatttaaagtttttgatttagtctttgttttactttttgcaatttcagaggttgcaacccatgctccaatcgaagcattccaaatgaccttgtaa

SEQ ID NO: 1819 - DNA, 246 bp, Acinetobacter baumannii
ttactttcatttaattcatcccaccaattacaaagtgcctcaagttgctgcatgtttgtaactatcacttgtacgaactcatcatctcttgtgagtgtttttgtactctctaaattactattaggactttttcctttaagaattgaatttacttgtaatccttttatatatttaggtggtatacatttaagaaatagccgtggactagatttatcaaaatttgttgtttctaaagctaattcatag

SEQ ID NO: 1820 - DNA, 213 bp, Acinetobacter baumannii
gcagatacattaaaggcaatcgctttaagcaatcagctcaataagcaaaacccctcaagtatttcactagaggggtttctttttattagaaaaaacgattatagtggtggggcagttaaaattgcttctttggaagcaggtaaacctggttgcgattctggaatagtctctaaaccttcaattttagttacggttccagttccatcaaagtaa

SEQ ID NO: 1821 - DNA, 432 bp, Acinetobacter baumannii
gttggaacattttctgaaaggtggtgcttgatgtcgtcagtcagcattgctgaataccgcaagttatttccgataaataaaaataaaaagcggcgctcagcaaagcaagttgccagacaaccaagtgtgggtgaaatggttctggcaacgcatttaagagcatgcaagattagttttgaacaggaatataagttccaccctgaacgtaaatggagagctgattttctgattactggtacaaaaattttgattgaggttgaaggcgggatctggagtggaggccgtcatacaaggggcaaaggctatataggggatatggagaaatacaactccgcagcaatgatgggttttacagttttacggttcagcacagagcaagtgaaagcaggcgtggcgattaaacaaattgagcaattggtaggtgaaaaatga

SEQ ID NO: 1822 - DNA, 948 bp, Acinetobacter baumannii
ctatatcaattaaaaactgctgtcctcggttttggaggaaatatgaataagaatgtgttaatcacaggtgccagtggctttattggaacgcatttaattaggttcctattacaaaaaaattataacgtgattgcggtgacacggcaggctggaagggaatctgaccatcctgccttgcagtgggtacaaaagttcgaagatatttcgacccgtcaaattgattatgtggtgaatttggcgggtgcaaatattggtgagaaacgctggaccgagtcacgtaaaaaacaactcattgaaagccgtgtaaatacgacccaaaaactgtatgcatggcttaatcaatctcaaatttttcctgaagtgattgtctctggttctgcaattggttattacggtatagatgctcaagaaaagtgggcagaggtgtgtacagaacaaagttcaccacagcctattttcatgtctcagctttgccaagagtgggaacgcgcagcgttagcagactctcagcaaaatactaaaattattcgtttaggtgtagtgtttgggcagggcggtggcattttgcctaaaatgttgcttcctattcgactcaatttagtcggtcaaattggtcacggacgtcaacctgtggtttgggtacacattgaagacgtattaaacgcaattgagtttatattcaagcatcctcaatctgctcaaattcacaatgtcgtggcaccagaaagtgtgatccaaaaggtatttgttgaacaagctgccaaagttttgaataagaaaccactgttgtcagcaccaagcacagtttttcgctgtttgttaggagagcagtcgcaattgattttgaatgggcaatacgtcaaacccgcagccttacaagcagaaggatttgagtttgcttatcctcaattaaaaatggctttagaaaatatactcgcctcaggctaa

SEQ ID NO: 1823 - DNA, 198 bp, Acinetobacter baumannii
gttgcccaattaccacttatgatgagaagacctttaaagaagatatcgccgctctggtcatcgcaacggcagataaaatttcaaaatttatctattaaaaaaagcgacgttaagtcgctttttttaatactcttatttcttcaattaaaaattacacttaaaagtttcaccattcatattctgaaaactcagtgttga

SEQ ID NO: 1824 - DNA, 1431 bp, Acinetobacter baumannii
acttcacaattattgtattgtatcgttaggtattgctttgtattgcttaatttaaagatggctcaacacattaaatttactaaatcggtaatagactctattcctttgtctgaagagaaacaaatcttttacagagatacagtaactataggatttggcttatgtgtgggcaaaactaaaagctattttgctgaaaagaaaatgcctaatggcaagtctaaacgtaaagttattggaaaacatggcgtctatacattagaacaagccagaactgaagctaaacggcttcttatcttgatggatgaaggtgtagatccagttaagcaaaagcgtgatttacgagcttcagcaattcaaaatgatgccttacaaaagctagtccctacccttagtgaagcttaccaatactataaattgcgtaaaaagctggcggaaacatctttaattgcctatgacggatgcatagaaaactactttagtgattggaaagatttaaaacttgaccaaatcaccagtgcaatgattattgatcgtcatctgaagctttcgaaagcaagcccttcccgagctaatcttgcatcaaaatttttacatgctctctttaaccatacgattagcaggtataaggatgagtccgggaataaaattctaaatataaaaaacccggttgttatcgttaaagaagaaaaagctttcaataaaattaaacgtagaaaaggccatgttcgtgcagatcagcgcgaagcatgggcattggctgtggccactacttattggatgggtgaacaaaataacgattttagagcgtacacaaaccaagactttttattcttacttgctctaactggttttagacgtagtgaagcagaatctgttgaatggaaaaatgtagatcttcaatttggtaccatcaaaattattaatacgaaaaaccatgaggatcttttgctacctatgggtgataccctttggcacattatgcgtgaacgaaaaaaacgtgccggtgataacaaatatgtctttaccgatagaaatggtgtttcccatatttcagaccgccgagcagcacgtgacaaagtaactgagaattctggtatcgaatttacgttccatgatttacgccgcacctttggcactatcgcgaacagcttggccataggaagctatacgattaaaaggctaattaaccataccactgacgatgatgataacgatgtgactgatggatatattcaagtttctttcgatgatttaaagaaagctatgaatatgattgaagacgtgattatttctgaaccagtaaaagcattaatcaaaagtcgcttatatttcgagaaaaatgaatcgagaaatcaggctcaagaattaattaaccaccacattcaagtgttagataactttaaaatggcaggccaaattctagatttttag

SEQ ID NO: 1825 - DNA, 474 bp, Acinetobacter baumannii
acccataaattaggcaaaaatatgaccaaattaccttcttactttctctggttttttgctttatgcatcgtgctaaccttaattgtcggtgtgattgcagcactattaccagcgagtgtaggcggtattttaacagccgttccatatttaggcgcaatgatttttgtcttgtttagatttttaaagaaagaacgccgtgcaccgacagtaccagaaaaaaagaaatttactttaggttttaccctcatattttggggctataacttgtgtggtgttttatttggtctgtttttattttcaagaaaagaccctgagattttgcaaaactttatgctttacctcaaacagcctcagttcttaagcattatggtgattatgcttttaatgttagctattccgctttatttaattacctattggttttatggcaaacaagcccagcgcatggcaaacaaaatgtttaatgtgtcataa

SEQ ID NO: 1826 - DNA, 588 bp, Acinetobacter baumannii
tgccgcctttcgggcggttttttacatctgaaggaaaccgaaatgaacattgaacaatatctggacgagttaattaagcgtgagggcgggtacgtaaacaacccagcagatcgaggcggtgaaacaaagtacggtattactgaagcagtagcacgtactaacggctttaagggcaacatgaaagatttaccgcttgatgtggccaaagccatttataaaaagcagtattggacagatccgcgatttgatcaagtgaatgtaattagctcgttagttgctgaagagcttttagatactggggtaaattgcggtaccggatttgcaaaaccactcttacagcgtgctttaaatttgctgaataaccaaggtaaagcaggttggccagatttaacagttgacggaatttatggtccagcaactcttaatgcactcaaaacttatctggccaaacgtggaaaagacggcgaaaaagtcctggtgcgtgttcttaatatcatgcaagggcaacgttacattgaaatctgtgaacgcaatcctagccaggaacagtttttctatggttggatcgccaatcgagttgttatatga

SEQ ID NO: 1827 - DNA, 255 bp, Acinetobacter baumannii
tcaactgtttccttttccccttcagcacgcactgccgctaaaattttctcgcgttcagttgctgaaattggcggttccgttctcacaggtttgatatttgcagccggagtgaccgcaacaggaatacgtggtgcacttggtacatcagctgacgctgcaaaagcagctagcgcatcagaaccacgaggtgttgcagtttttactgttaccgagctgctacttgttttagcaggtgtcgatggtcttactggctga

SEQ ID NO: 1828 - DNA, 669 bp, Acinetobacter baumannii
catgctgaatttaaagcacccataaaagtgctgatgtggacaatcatgacaaaacgcagagtaaaaccagagcatgtgcgccgtgaagaaattatgaacgctgcactcgacgtaatttatgaagtggggttatccaataccaccattgcacaaattgcaaaaaaagccgagttgtcgaccggtattgtcagccattattttggcgacaaacaagggttaataaatacctgtatgcaagaaatgctcaatgttttgcgtcggaaaaccgaacagtacagagcagaagcagattcgcatccggaaagccagattaaggcaattattgactctaactttgacattagtcaggtaaatgaaaaagcaatgcgggtctggttagacttttggtctgcaagcatgcatgtaccggacctgagccgtttgcaaaagattaatgatcaacgcctgtactccaacttgaagttttattttctcaagttaatggatgaacaacaggccagtgttgccgcaagaggtctggcagcactgattgatggattatggctacgtggcagtttaagccgtcacaatgaatttgacagcgaactggcccgttccattgcttacgattatgtaaaaacgcaattgcaatttgcgaacaagcctttgcaggagagacaaaatgagtga

SEQ ID NO: 1829 - DNA, 207 bp, Acinetobacter baumannii
gaagctacttcaattcgaccaaatgcaagaataaataaaaaacctgcgataaagccaagagctattaacacccacccgatagcattacaaacttcactttctctcattggtttatattgtggtgcactcatcttaatctaccttgttaaagttcttcaaaactttgtaagtaatatcttgattagtggcatcaattacttccaataa

SEQ ID NO: 1830 - DNA, 771 bp, Acinetobacter baumannii
tcaacaacttcaaaaaaaggcagcttaatgtctgagttatcacttgcttatatttttcatcatcaacaattattggttgaccaaaaccttcaattacccaaagtcgaaaagttagcaagtgatctgcttttcactcatgatgaacaggtcattgcacgtgacctgttgagtgaagaagccattccggaaggcctgcaactcgttccaattcgtcaacttatttccaactggtcaaaagaacaatttttacaggcaagtcgtgctgtacagttgctcgaatggcgacgtaatcacaagttttgtagccactgtgggcatgctaccgaagtacaccctacagaatatgctatggtgtgcccttcttgtcgctaccaccaatatccgcgtgtaaacccatgtattatcaccatcattactaaaggcgatgatgaaattttattggcgaaatctattcacaataaaaccaatatgtatggcttgatcgcaggatttgtagaagttggggaaacgcttgaagaagctgttcagcgcgaagctttagaagaagtggggcttaaactcaaaaatatccaatatatgtcaagccaaccttggccttttccaagcaatctcatgattgcatttagagctgaatatgagtcaggtgaaatttctttgcaagaagatgaaattgccgatgcacaattctttaaatttgatcagttacctgaaattccatttaaaggcagtattgcacacgcaatgattacgcagattactcaagcgaagtaa

SEQ ID NO: 1831 - DNA, 1110 bp, Acinetobacter baumannii
cgcatggcttcaaaagaagataaatcgctgattgaaatacttacccaacatcaggcgtatttatatagggtgtcttctcaatctgttaatgagctacttaaaatctttaatgatgagtcgacattaatgttggcaaggcttcgggatttgctcgatgaattaaatgactctgaaaaagtggctttagcaagtgggcagtacactactgctaatctcaaagagattcgagatttaatttctcagtggttccttggactaaatacttccttacctgaagcatttgcagtttcagcaactgcaatggctgtatatgaggctaattacacagctaagttatacggcggcaagatcaaaaagccaaatggtgaaaagctgtttactgctgctaagaaggtccctttagttggtggtgctcttgtagatgatcttctaagcaagattgctgaaagtgcacgtcaaaaggtcgaatatgctattcgtgacgggattagctcaggcaaaactaatcaggaaatcgtccagcggattcgtggtaccaaacgccttaattatgaagatggcttattaaccagttccaaagctgatattgaccgtaccgtacgaactgtacggagccatgtggcgaatcaagcatatttagacactttcaataaaatcggttttgagtatgtacgttttgtcagtgtcttagatgggagaacaacgaaattatgtgcttctttggacggatctgtttgggaagtgaatgacccagcaaagcgggtaccgccgttgcatccaaattgccgcagtattctggtgcccgtagagaaagacgggaaattagttggtgaacggccatttgtaatggacgaacgtcgagtgaaggacatcccaaaagaagagcgaagccaattaatagggcagctagatgctaataccacatttaaagagttcttcaaaaagactgatgatttctttcaaagagaatggttaggaccgaagcgttacaagctctataagaaagggaaatttgattttgataagttcttcgatccagaggggcgattatacacattggaccaacttcgaaagttggatgagcaaacctttaaggagttgggcttatga

SEQ ID NO: 1832 - DNA, 840 bp, Acinetobacter baumannii
agggaagaattaaaaatgatgacactcattgaaaagttagcagaatttccggtgaaaacggtcaatgttcaaggccagcagcaagcttatcgggaagctggtcagggcgaataccttgtgctgttgcatggcattagttccggttctgcttcatgggtaaaccaacttgaagtgctgtctcatcattttcatgtcattgcctgggacgcaccgggctatggcaaatcagatgaacttttaacggatcaaccgaatgcgaccgactacgcaaagcgtttggcagggttgttcgatgttttaaaaattgaaaaagcaattgtcgtgggacactccttaggtgccttacagggcagtgcatttgctgcactttgtccggagcgagtgaaacacttggtggtcgctaacttggcgcaaggctaccaacgccacgatgaacaaacacaaattcaggtttttgaaaaaagaccaaaaatgttgaaagaactcggcgctaaaggaatggcccaaagtcgtggacctcatttgatttataaacaagagccacaagccttagctttagtttcagaagtgatgcagcagttgaccttacaaggtttcacacatgcatcgtacttactggcatatgacgaaatacgtaattatttaactgatttaaaagtcccatgcacagtcattgcagggcagcaagatcaaatcactcctgcgttaggtatacaagagcttgctcaggaattgcagttggaacagcgcttcgtcatagaagatgcaggacatttaagttatgtcgaccaaccgcaagcatttaaccaaattatgttgacgattcaggaacaatcgtaa

SEQ ID NO: 1833 - DNA, 663 bp, Acinetobacter baumannii
gcgttccattctgtccagcctgaaatatcgtcttgcattcgtttatccaatctctatacttcgtatatattacctttgattgcaattctgtgcgacctcgttatgttagaacaattacagcgtctacaagcgcatattggcgttttaaaaacacgcttacatcatctagagagtgaaaattctgctctctcggaagctaaagaactggctgaaacagagcatcacgcacaagttgtgcaaaaaaatagcatcatcactaaaaaacaagaggaaattgagacattaactgagcaactcactcagttacaaggccaatttcaacaattgaatcaagatgctaacacacttgcagagcgttacagccgcctagaaaaaagtacgaccgatttaaaaaatcgttttcaggaaattttggcagagcgtaatgaattacgcgttaccaaagaaaaacttcagtcacagcaacgtcaaactcaacaagagttacacgacttgcagcaagatcgtgaccgtttgttacaaaaaaatgaacttgccaaagcaaaagttgaagccatcattcaacgtttagcaattttaggtactgctcaagatcaacatgcgcaagaaattcagcaacttgctcatccaaatgctgaagctggtgaggagacacaatcatga

SEQ ID NO: 1834 - DNA, 414 bp, Acinetobacter baumannii
gaaaggaattcaccaatgaaactaactaaacagcaacgtgctgagctaaaacaaaagtttggtggacattgcgcttactgcggggaattactgggtgaaaagtggcatgcagatcatatcgaagctgttaaacgagatttaattcatgttggcggtggaaagttaattacgggtgaaatgactagaccgcaaaacgacactttagaaaacatgaaccctgcatgtgttccttgcaatacaaacaagtcgtctatgcccttggaagggtggcggaggatgctcacacattatcgtgatgttcagttgttacgagatagcacacatgctcgtcatttactacgttttgggctgattgaaatcaaatctgagcctgtgaagtttttctttgagagttataaagagggccagtcatga

SEQ ID NO: 1835 - DNA, 1092 bp, Acinetobacter baumannii
gttattgattcagggaagaataaaatgaacgcaatcgtatcaacttcacaaagcgctgaagaatatttagaacttggtttacgtgaccaatggcatccggttttagcaagttgggaagtcgctgctaatccggttgggattacccgtttaggtgaaaacattgtggtttggcgtgatgccgaaggtcaggttcatgcgcttgaagatcgctgtccacaccgcggtgctcgtctttcactcggctggaacttgggtgatcgagttgcttgctggtatcacggtgttgaagttcgtgctgatggtgtggttgctgatgtgccagccgttcatgaatgcccaatgactggaaccaagtgtttaaagagctatccggtcattgaacagcatggtgcaatcttcatctggtttggtattgatgcaaatgaacaacccgcaccgcttgagttcccagaacaactggcaagcgaagagtggagttcattcctttgccaagcagactggaaagtaaaccatcaatatgccattgataacgtcatggacccaatgcacggtacatatttgcactgtacttcacactcaatggcagaaggtgaacgtaccgcagagatgaaacaccgcacaactgaaaatggttttgtttttgaaaaagaaggccaaacaggtgtgaactttgactgggttgaatatggttcgaccggtgcaagttggttacgtctttcaattccttaccgtaaacagtttggtccgggtggtgaattctggattgtgggttacgcaacgccaattgatgccaacaatacccgtgtatttttctggcgctgccgtaaggtgagtggttggcaacgtaatgtatggcgcttcttatatcgtaatcatttagaacaattgcattgggatgtattggaacaagaccgcattattttagaaaaccttgcgccaaatgcacgtgcacgagaattcttatatcaacacgatgttggacttgcacgattacgccgtttaatgaagaaagaagctgagaagcaattaaagaaaattgctgcactaaatgcatcaaaccgtatcgagatgcaggaagaagctcatggctaa

SEQ ID NO: 1836 - DNA, 225 bp, Acinetobacter baumannii
atcgaatacacatacgttttgccccgcgtgtgttgtccccatagcacagcaaatgactgcacttactatccccaatctttttttcatttgactttccttagtctggttttattagttagtagctcatttatcaaccaagttttaaattgtttttattttagccatatttttctaaatttggcctatcttgctcaaaatttggatattttcagacgaatagcttaa

SEQ ID NO: 1837 - DNA, 807 bp, Acinetobacter baumannii
agattgctaactcgcttgcgacaagagttctctgatcacgtctttgcgatgtggattcgccctctagtagctgaagaagtagaggggatactacgtctctatgctcctaatccttattggacgcgttatattcaagagaatcatttagagttaatttctatattggctgaacaattgtcggaagggcgggtgcgtcaggttgaaatcttggtagattctcgtcctggtagtattttgtcctttagtgaacagcctgcaacaactacagcagctttacaaactgcccctatacctcaacatgctaaggttaaaagagaaccggaacctgttgctaatactgcagttagttctaagagttcacaaaagaaactattaaatccacaatttactttttcactatttgttgaaggccgttctaaccaaatggcagcagaaacctgtagaaaagtattaacacagttaggtgcttctcaacataaccctttgtttttatatggcccgacaggtcttggtaagactcacttaatgcaagcagttggtaatgccttactgcaagcgaagccgaatgcaagagtcatgtatatgacttcacaaagttttgtacaagattttgtgagctcattacaaaaaggaaaggtagaagagtttaagaaaaattgccgttctttagacttgttattagtagatgatattcatcttttggcaggaaaagaagcaagcctcgttgaattcttctatacatttaatgccttacttgatgaatccaaacaaattattttaacgtcagatcgatatcctaaagaataa

SEQ ID NO: 1838 - DNA, 384 bp, Acinetobacter baumannii
ggtcttttttattttgaaaggcacagcaaaatccgaggaacaatcatcatgaatgcccaagctctagttttgacagataatgctgccaataaggtacgccaactccgtgatagtgaagggaatgacgatctcatgttacgtgtatatgtaaccggaggcgggtgttcagggttttcatacggcttcaatttcgccgaaagcgtaaatgaagatgatgctgaatttgtaaatggcgatgtaaagatgctggttgactcgctcagctatcaatacttagttggctcagtggttgattatgttgaaggccttgaaggttcacgctttattgtgcagaacccgaatgcgacaacaacctgtggttgtggttcttcattctcaatttaa

SEQ ID NO: 1839 - DNA, 240 bp, Acinetobacter baumannii
ctatataatcattttagagttagggagtcttttatatggtttttattcctctataagcttttttattccaaagaatccaaagaatccaaagaatccaaagaatccaaagaatccaaagaatccaaagaatccaaagaatccaaagaatccaaagaatccaaagaatccaaagaaatattagagcaaatactctaccctactttatatttcttcttattttttaatttattttattcttaa

SEQ ID NO: 1840 - DNA, 1026 bp, Acinetobacter baumannii
aaccagactaaggaaagtcaaatgaaaaaaagattggggatagtaagtgcagtcatttgctgtgctatggggacaacacacgcggggcaaaacgtatgtgtattcgatttattgggtaaatcaggtgaatcctacaaaatgatggaagaatgggctcttgcggcaaaaagttggcaagcggacattacattaattccatttcaagatgaagctctggtagatcgtaggctgcgtgagggtaaatgcgatgcagcttatatgacttcaatgcgagcacgaaactacaataaatttgcaggctcgattgatgcgattgggggcgtgacaagtaatgctattgctcaaaaggcaattagttacgttttagatcaacgtaataaacatcgcatgctaaccacacaaaatggaacaaactatgaggtggttggaattgtccagattggactagcatacttatttgtaagagatagaaacctcaactcaattgagaaagtacgtgggactaagtttgctattttgcaatatgacgcagcccagaaaattatggttgaaagtgtaggtgcccagcctattccttctgagattaccgattttgtgaaaaagtttaatagtggccaagtcgaggcaattgctgcacctgcttatgcttataaacctttagaaattggtaaggggattggagcaaatggagctatgtttacttttcctgtggtgaacgtcacaggggatttaattgcaagaagtgataagtttccggccaattttggaatgaagtctcgtgaatggtttattaaacagttgccacagaacttcgcaatggtaaaacggttagaaaccgggattcctcctaaaattaaattaaatttttcagccgaagataagttgaaatatcagaaaatattacgtgaaggtcgccttggcttaacaaaacaaggtgtatatgacgcgacaatgatgagtgtactcaagcgcgcacgatgcaccattgaacggacaaattttgaatgtacgctgactggagagtag

SEQ ID NO: 1841 - DNA, 1236 bp, Acinetobacter baumannii
ctgatgtgtttaggttttgtgatgtcaaatttcttgcccgccgaagaacagcttgccctcatccaacgaggcacgcacgaaattatttcagaagaagatttactgaaaaagcttaaagagaatcgtcctcttaaaattaaagctggttttgaccctacagctccagatttacatttaggacatacggttcttattaacaaactaaaaacgtttcaagatttgggtcatgaagttactttcttgattggcgactataccgccatgattggtgacccaacgggtaaaagtgcaactcgtccgccgttatcacgcgaacaagttgaagctaacgctaaaacttatcaagaacaagttttcaaaatcttagatccgaataaaacaaaagtacgttttaactcagagtggtttaaccaaaagtctgctgcggatcttattcagttggcaagccagcaaacagtatcacgtatgttagagcgtgatgacttcactaagcgttataacaaccatcagccaattgcaattcatgagttcttatatcctttagttcaaggctatgactctatcgcacttgaagcagacgttgagttaggtggtacagaccaaacctttaacttactcatgggccgtacgttacaaagccgttatggccaagaatcacaagtgtgtatcactgtaccaattctagaaggtttagatggcgtaaataaaatgtctaaatctttaggtaactatattggtgtttttgatgcgccaggtgcaatgtaccaaaaagtattatcaatgcctgactctttaatcgaacgttatttcgatttattaagttttaaatctctagatgagatcaaagctttattagatgaaatcgcggctggtcgtaatccacaagaagtaaaacgtattcttgcactcgagttggttgaacgcttccatgatgctgaagcagctgctaatgctcataagagtgctggtaaccgtattacagaaggtgaagtgccagcagatactcctgaagtaactatttcacgtggtgagtttggtggtgaaatctttattgccacgattcttcgcgtagcaggattaaatccaaatgcagcagctgcaaaagatgctgttgcacgaggtgcagtaaaagtagactggaatgtagtagatgcaagtttctctgtaaaagaaaacgggacttttattattcagtctgggaaaaaagcaattgcacgtgtaactttcactgactaa

SEQ ID NO: 1842 - DNA, 606 bp, Acinetobacter baumannii
cgtcagatcgatatcctaaagaataaacagaacttgatcctcgattggtttctcgtttttccctggggactgtcagtaggtgttgaaccacctgatattgatacacgaatcgaaattctgcttaaaaaagctgaaaatagtggcgttgatttacctagaaactgtgcgttatttattgcccaacaagtcgtagcgaacgtacgtgaacttgagggcgcactgaataaagttgtcgcaatttcacgttttaaaggtgctccaattgaccttgatgtcgtacgggaatctttaaaagatgttttagcgatccgtgctcgtacaattagtgtagaaaatatccagcgtgtagtgagtgaatatttccgaattccattaaaagagctggtaggtccaaagcgtacccgaatttatgctcgaccacgtcagttggcgatggggcttgcccgtgaattaacgggggatagttttcctgaaattggaatggcttttggtgggcgtgatcacagtacagtgatgcatgcttgtgaaaaagtcgtcagtttacgggaagaagacccaatctttgatgaagattataagaacttattacgtttgcttcaaagttaa

SEQ ID NO: 1843 - DNA, 1152 bp, Acinetobacter baumannii
atcgtgcgtttgaaaatcgctaaagaaagtttactcaatgttttatcgcatgtggtcggtgcggtagaacgtcgtcataccttgaatattctttcaaacgtcaaaattcagactaatgctcaagcgctcactattacgggttccgatttagaagttgaactcgtagcgagcaccgctttatcagaaggggcttgccttgaggcaggcgagacaactgttcctgctcgtaaattgatggaaatttgtaaatctttgcctacagctgcattgattgatttacaaattactgaagatcaaagatgtattttaaagtctggtaatagccgttttgtgctaggtacactaccggctgaagattatccattgttaaccactgagaatagtcaaggtacgcaagtacaggtgactcaacgtgaattaaagcgtttatttgaaaaaactgcttttgcaatggctgtacaagacgtacgtttttacctcactggtactttattagaaattgatgaaaatcaattgcgtgcagtaacaactgatggtcaccgtttagcactttgtgaaattttggcttcctctacttcatctcagttggtacaagcgattgtgcctcgtaaagctgtgggcgaattgcaacgtttactcagcattgaagatgaacagctcacattgcttattggccgtgaattattaaatgtaacgattaatacgccaagccgtgataaagaacaaggtgatattacagttcgttttacaactaaattgattgatgggaaattccctgattatcgccgtgttattccacgtggtggtgataaacatgttttgattggtcatgacgtatttaaacaatcattacaacgtgtagcaattttaagtaatgaaaaattgcgtggtgttttcctaaacttcaatcaggattctttacagcttcgtgcaaataaccctgaacaagatgaagcaattgaagatttagcgatccaatatcaaagtgccccattagaaatgtcatttaatgctcaatacctactcgatgtgttgggtgtattagatggtgatgatgtaaatatgagcatgactgaggcgaatcagtctgtattggttcaagatccggctcatcctgaccagacctatgtagttatgccgatgcgtgtttaa

SEQ ID NO: 1844 - DNA, 1131 bp, Acinetobacter baumannii
ccagacctatgtagttatgccgatgcgtgtttaatctggtttaactatatgcatcttacgcgcttaaatattgaacgtgtgcgtaatttaaaaacggttgcactccatgggttgcaaccgtttaatgtcttttatggcgcaaacggttcgggtaaaacatcaattttagaagcgatccatttgcttgcaacaggtcgctcattccgtacacatatacccaaaaattatattcaatatgaagctgacgacgcgattgtatttgctcagtcagcaactgaaaaaattggtatgcaaaaactcgcttctggtgagcaactcatgaaagtgaatggcgataccgttgcgactcaaggtcagctcgcaaaattacttcctttacagcatattgatccgcaaagtacggatattattgatcatggtgccaagccaagaagacaacttttagattggcttatgttccacgtggaacctgaattttattttgcttggcaatattactctcgtgcgctaaagcagcgtaataccttactcaaaacacggcgtaatctttcattggctgatttagaaccgtggaacaaaatgttgagtgattatggcgagattttgcactcacagcgtttaagtattgtcgagcaatggaatgtttatttccaaaatgacttaagccaattactccctgatttggagattgagctggaatatagcccaggttttcatacagagcaggggcttatgcaagacttgttgaatcagcatcaaaaagacatcgagagacgttataccgagtatggtccgcatcgggcagatttgcgcttaaaaacgccatttggacatgctgatgatgttttatcaagaggtcagaaaaaactcttgattattgccttaaaactgtcacaaattgcaatgttgcatgcgagtaataaggaaactgtggtattattagatgatctgacagcagaattagacttaaccgcacaacaacgtttaattgaacgattaagccaacttggtagccaggtttttatgacaactttagatcatgcatcggtaaaaaaacatttacatgatctgtctatttcatatcaattattcagtgttgaatccggtcaagttagtcttgctgcaccataa

SEQ ID NO: 1845 - DNA, 1161 bp, Acinetobacter baumannii
cattttttcagcgtcttgcaggggaagttgcatatgagcacaatctatatcggcgtaatgactggcactagtatggatggtgtggatattgttgcggcttcatttgagcccctacagcttcatgccacacttacagttccattcgaacccgagttacgtgatgagcttatggcattaactttacccgatgacaatgaaattgaccgcatgggtaaagctgatgttgctctagccaaaatgattggtcacgggattaattctctcattgaaaagcaccaattagatcgtagtcaaattaaagcgattgggtcgcatggacaaaccattcgtcatcgtccagagcatggttttacgctacaaattggcgatccaaacattattactgagatcactcaaatcccggtcgtttcagattttcgtcgtagagatatggcagcaggtggtcaaggcgctccattagtgcctgcatttcatcaggcattatttcaacatccaagcattcatcgggtgattttgaatttaggcggcattgccaatgtgagcatgttgccagctaacaatccggacggcgtttttggttttgatacgggacctgccaatattttgatggatgcatggtgtcatcgccatacaggtcatccatatgatgaaaatggcgattgggcagcttatggtcatcctattcgttcgttactcgaccgtctttatgctcatgagtatttttctaaagagccacctaaaagtacgggacgtgaagatttcaatattgattggctagatgatcagttaatcgattggcgtaatgatttaacttacgatgagttagaagatacacctgaaaatatccaagccaccttattaaaacttactgtacgtgccattcaaaaagcgatctatcgttctaatatggaaacaggtgaagtttatgtatgtggaggtggagcttataactcttatttattagaacaattacgttggcgcttacgtaagcacaattggtcagttcaaaccactgatgttttaggactctcccctacttgggttgaggctacagcatttgcatggttagcaatgcgttttgtggacggtttaagtggtaatttacctgcggtaacaggagcttcagattttagaatcttaggcacgatcacggcggtataa

SEQ ID NO: 1846 - DNA, 237 bp, Acinetobacter baumannii
tatatatggcttttttttaggcatttttactattttttattggtttttatctttagctatataatcattttagagttagggagtcttttatatggtttttattcctctataagcttttttattccaaagaatccaaagaatccaaagaatccaaagaatccaaagaatccaaagaatccaaagaatccaaagaatccaaagaatccaaagaatccaaagaatccaaagaaatattag

SEQ ID NO: 1847 - DNA, 558 bp, Acinetobacter baumannii
atgaattttattgattttattactaattttgaacaatttttacctattttgattcaggagtatggtgcatgggtttatgccatactctttttgattattttttctgaaaccgcttttgtgtttatgttctttttacctggagatagcttacttttaactgtaggtgcactgtgctcggtggttgaactgatgcatcttggttatatgattactctgctcaccgttgcagcaacattaggctatatcgtcaattattctattggccgccattttggaaaccgtatttttgaagcaaaatcacgttttattaaaaaagaatatttgaataaaacgaaccgctatttcttgcaacatggtggtaaaactattcttttagcacgttttatacctttcgcacgttcttttgcacccctcgctgctggctcaagcaatatgagctatggaaaatttttgatttacaatgtggcaggagctattttgtggatctgtatcctcttaacggctggctacctatttggccatgcactcattcaagttacagattttgtagagaattaa

SEQ ID NO: 1848 - DNA, 2478 bp, Acinetobacter baumannii
ggagaaaccatgagttcagagtctcaatcagcctctcaaacagaacaaaccaatgaaaaggcttatgattcctctagtattaaagtattacgtggattagatgcagttcgtaaacgtccgggtatgtatattggggatacagacgacggtaccggtttacaccatatggtgtttgaggttgtcgataatgcaatcgacgaagctttagctggccactgcgatgaaattattgtcacgattcacgaggatgaatcggtcagtgtttcagataatggccgcggtattccaaccgatattcaccctgaagaaggggtttctgctgcagaagtaattttaacgattctgcatgcaggcggtaagtttgacgataatagctataaagtttcaggtggcttacacggcgtaggtgtttcggttgttaacgcactttcaagtaaattgcatctaacaatttaccgtgctggtcaaatccatgagcaagaatatcatcatggcgatccgcaatatccattgcgtgtgattggtgaaacggataataccggaacaactgtacgtttttggccaagtgcagaaacattcagtcaaaccatttttaatgttgaaattctagcacgccgtttacgtgagctttctttcttgaatgctggtgtacgtatcgttttacgtgatgaacgtattaaccttgagcatgtgtatgactatgaaggcggcttatctgagtttgtaaaatacatcaacgaaggtaaaaaccatctcaacgaaatcttccatttcacagccgatgctgacaacggcattgctgtagaagttgcattgcaatggaacgatagttaccaagagaatgttcgctgtttcacaaataacattccacaaaaagatggtggtacacacttagcaggtttccgcgcagctttaacacgtggcttaaaccagtatcttgaaaatgaaaatattctcaagaaagaaaaagtgaatgtgactggtgatgatgcgcgtgaaggtttaacagccattatttctgttaaggttcctgatccgaaattctcgtctcagacaaaagaaaaattggtatcaagtgaggtaaaaccagcggtagagcaagcaatgaacaaagagttctctgcttacttacttgagaatccacaagctgcaaaatcaattgcaggcaagattattgatgctgcacgcgcacgtgatgctgcacgtaaagcgcgtgaaatgacacgccgtaagagtgcattagatattgcaggtttgcctggtaaattggctgattgtcaggaaaaagacccagcgctttctgaattgtatcttgtcgagggtgactcagcgggtggtagtgccaaacaaggccgtaaccgtaaaatgcaggctattctacctttaaaaggtaagatcctgaacgttgagcgtgcgcgctttgacaaaatgatctctagtcaggaagtaggtacattaattacagcacttggctgtggtattggccgtgaagaatataaccctgacaagctccgttatcataaaattattattatgaccgatgccgatgtcgatggttcgcacattcgtacattgttattaacattcttcttccgtcaaatgccggagttggtggaacgtggtcatatttatattgcacagccacctttgtataagctcaaaaaaggtaagcaagagcaatatattaaagataacgacgcattagaaacttacttgatttcaaatgcgattgatgagcttgctttacatattagtgctgatgcgcctgcaattacaggtgaagcgctggcaaaagtaattcaagactatcaagtttcacaaaagagcttacaacgcttaacgttacgttatccagcaagcttacttgatgcattactcgaagtagatgcatttaaagcagatcaaaaccatgatcaagcttatgtacaacaatgggcggatcaagtacgtgaagctgtacaaagactacagccaagtttgcgccctgaaattacgcttgaaacatttgaacgcgagaatgcccaaggcgagaaatctgcgcattactggccacgtgtaactgtatatgttcataacttgccacacgcttacttacttgacgcaggtttattgaattctgcggaatatgctcgtttattgaagaactcgaagagttggttcaagttaattgaagatggcgcatacttacaaaaaggtgatcgtcgtattcaagtcgctaatttccatcaggtatggcagcacattctgcaagattcacgccgtggaatgatgatccagcgctataaaggtctgggcgagatgaatgctgagcagctttgggaaaccacaatggaccctgaaaaccgtaatatgttacaggtgactattgatgatgcaattgaagctgatcgcatgttctcatgcttaatgggcgatgatgttgaaccacgtcgtgcctttattgaagaaaatgcattaaatgcggatattgatgcttaa

SEQ ID NO: 1849 - DNA, 1053 bp, Acinetobacter baumannii
aatttcttgatgccaaaaacaaaaaatttacaaggaaaggaaaagaatatgcgattttccaaaacgcttttacttgcgatgggactcacaacaatttcatttgcagccgaggccaaacaaaccatatgtgtttttgactttgttggtaaaaatggcgatgtctatgcactcatgaaggactatcagcttgcagcgaaaaactggggagctgatatcgaactaaaagtaaaccagaatgaagcagtgattgctgaagattttaaagcgggaaaatgtgatggtattagtgtatcaggcatgcgtggacgtcaattcaactcatttacgggatcattagatgcaattggtgcgattccagatctcaaacttgctgttaaagtcatgcaaggtttagcaagccaaacctttagtaaatatatggtcaatggccgctatgaggtagtaggtgttattccggtaggagatgcttaccttttagtaaacgaccgtagtattaataccgtagcgaaagctgcgggtaaaaaaatcgccgtattagactacgatgaagcacaaaaaatcatggttcagcaggtgggtgctcaggcagtgagtgcagatgtgactaacttcggggccaaatttaacaatcatcaggtcgatattattggtgcgccagcagcagcttttaaacctttagagttacaaaaaggcttaggtacaaaaggggcaattgtaaactatccaattttacaggtgactggaaatattattattcgtccagacaaattcccagctggttttggtcagaaatctagagagtgggtggctggtcagttaccgcgtgcttttactatcttgggtaaaatgaaagcggatattccgcaaaaatattggatggaagtaccagctgccgataaaccgggttatcaaaagctcatgcgtgaatcacgaattaatcttacacaacgcggtgtttatgataaacggatgatgaaactattatggcaattccgttgtaagcaagacgcgaaaaactttgaatgtggcttacaagatgagaattacaaataa

SEQ ID NO: 1850 - DNA, 1938 bp, Acinetobacter baumannii
gacaagatgattcaatttgaccaagtttctttacgccgcggtggacgtgttctatttcaaaaagcgtctatgcaattacacccaggttggaagattggtctgactggggtcaatggtgcaggtaaatcaacactatttgcagcattactcggtagcttaggagcagatgaaggttcgcttactcgtccttctgtatggactgtggcccatatggcgcaagaagttaaagccctagacatacctgctatcgactttgtcctttctggagatgaagaatattgggatattcagaataaacttgctcaaccagaacaattaacagactcggatttggctaaattacatggccgttttgatgaaattcatggttattctgcgccatctaaagcagctcagctgatggctggcttagggtttctagaacatcaattacgtttaaacgttgctagtttttctggtggatggcgtatgcgtctgaatttggcgcgtacattgatgagtcgttctgacttactcttattggatgagccaactaaccacttagatttggatgcaattttatggttagaagattggctcaaagcttatgagggcaccctcattttaatctcgcatgaccgagatttcttagatgcaattacagaccatattcttcatattgagaatcaggaacttactctttacacgggtaactactccacatttgagaccactcgaagtgaacgtttagcacaacaacaacaagcttttgaaaaacagcaagaagcccgtgctcatttacaaaagttcattgatcgctttaaggctaaagccactaaagctcgtcaggcacaaagtcgtattaagcaacttgaacgcatgcagcaacttgcacctgctcatgtagatacaccgtttacttttagtttccgtgaacctaccaaaatgagttcaccgttgctgaccctagaaaatgccagcataggttatggcgataaaaaaattgctgaaaaaattaaacttcaaattacgccaaactcgcgtattggcctgcttggtatgaatggtgcgggtaaatcaacattgattaaaagcttggtgggcgatttaccattactggcaggtgaacgtaaagcttccgagctactcaacattggttactttgcgcagcaccaaatggacgctttagatggtcaagccagcccaatgcttcaactcgctcggatagccgataaacaaattagtgaagcaacattacgttcttttttaggtagttttggctttagtggcgaacgcatggatactccatgtgaaagcttctctgggggtgagcgcgctcgtttggccttagcactcattgtatggcagcgcccaaatgttttaattctggatgaaccaacgaaccacttagaccttgatatgcgtcatgcgcttagtatggccttacaagattttgagggtgcagttgttctggtttctcacgaacgtcaacttattgccagcgtttgtgatgaactccttttggtacacggtggcaaatgtaccgagtttgaaggtgatttgcaggattatgctaaatggctacgtgaagcacgccagcaacaaatcaatgctcagactgctgtagcacaaaataattcatcttctgccgctccagctccagctaaagtcgataaagaagcacagcgtaaagaagcagctcgccgtcgtgaacaaactcgaccaatccgtaaaaatattgaaaaggttgaatctcaaattgaaaagcttcagccacgtcttgctgaaatcgaagaagctttagcagatacttcattatatgaagctaatcgtaaggacgatttgcttaaactgatgaatgagcaaaccgaactcaaagctaagcttgaacaatatgaagagcaactcttagaactcatgatggaacttgaggaaatggaagcctcatttgaaaactaa

SEQ ID NO: 1851 - DNA, 402 bp, Acinetobacter baumannii
ggagagaagatgatgagtcaaaaaattctagcaagtatgctgatttcatgtgcggctttagtgagtcattctgcatttgcagcagacttggaagccgacatgaaaactttagcgaagagcactaaagcctttgctgaagcaaaagatatcgataacgctaaacagcagcttgtgattatgcgtcaggcagcattatcttcaaaattatctttacctcataagttggaaggtttaccccctgaaaatgtacaggtaaaagagtaccaagcgggtttagatcagttagttgctgaaattgatcgggttacggtttttgttgataagggacaattggaccaagccaaaactgaagcaattaatctggtaaatattcgtaatgaaaaccacaaaaagtttagataa

SEQ ID NO: 1852 - DNA, 1071 bp, Acinetobacter baumannii
ttaatatctgtgtttgaaaggaaacttcaaacaaaaaatctgttccgtggaaggatgaagaaaatgaaaaaaatcgtacttgctatggctgccgcttctgttgttggtttttctgcttcagcgcaagcagcgagtaccgtgtgtgtattcgacctcttaggaaaagcaggcgactcatataaaatgatggaagaatgggctctagctgcaaaaggctggggtactgaaattaacttagttcctcgtcaggacgaggctgttgcagataatgattttaaagctggtaaatgtgatgccgtagcaatgacagctatgcgtgctcgccaatataacaaatttgccggatcaatcgactcgcttggtggcgttcctaataaccaaattgcacaacgtgctattacttatgtattagatgcacgtaatgctgcaaaaatgacaactaaccttggcggtaaaaaatacgaagttgctggtatctctccgttaggttcagcgttcattttcgtacgtgataaaaacatcaactcagttgaaaaagctgctggtaaaaaattcgccgtgttaggttatgacgatgcacaaaaaattatggtgcagcgcgtaggtgctcaggcagttctttctgatatttcaaactttgctgctaaatttaataatggtcaggtagatatggtaggtgcgcctgcttatgcttacaaaccattagaattgaacaaaggtttgggtgcaaacggtgtaatgtggaacttcccagtattacatgtaacggctgatttagtattgcgtgctgataaattcccagcaggctttggtcaaaagtctcgtgattggttcgtaaaacaattaccaaaaagctttgcaatgattaaccgtttagaagcacaaattccaggtaaatataaaatgaacctaagtgctgaagacaaactgaaatatcaaaaaatgttacgtgatggccgtatggatttaactaaacgcggtatttacgatgcaggtatgatgtctgtattgaaaaaagcacgttgttctgtagacaaagctaactttgaatgttcaatgcctggtgaataa

SEQ ID NO: 1853 - DNA, 855 bp, Acinetobacter baumannii
gtaaggcatgttgttatggatttgaccaaccgtattcatcaatacacacgtggggcttggacattcgatgtcattgattcaggccctatagatggccctctcgtggttttattgcatggctttccagaaactgcccatagttgggagcagacttcggaattattgcatgagcatcaatttagaacacttgcgattcatcaacgtggttatagtttaaatgctagacctcaaagccgatttcaatattccttgagtgaacttgtagaagacgtagcaagtttaattaaacaacttggtcaaccagtttatttaattgggcatgattggggttctgtaattgcgtctagtgtagctatgaagtatccgcagtatattcaacatctcactttagtttccgtaccccatcaagctgcttttttaaaagcctgcttaagtagcaatcaactactaaaatcttattattttgcagtttttcagcttcctattttgcccgaacttttatttaagaaaatgcctaaagcaggacgtaagttccttaaaacatctggcatgaccgaacagcaaattaaaatattcgaaactgaatttataaaagaaaataggctaactacggcattaaactggtatcgtggctttttttgggacaaacctgaaaatccttttaaagcaatagacgttcccactctttttatttggggtaagcatgatattgcagtaacagaaaaaagtgccaagttaaattcaggttattttaaaaataattataaggctatttttatggatgcctctcattggattccttatcaaaatgcacctgaactcgtacaatgctttttagaatctatacatgattaa

SEQ ID NO: 1854 - DNA, 183 bp, Acinetobacter baumannii
agccccccggttttggggggggggggggccccccctttttttttttgggaaaaagggggccccttttttttaaaaattttgggggccccggccaaaagccctttaaaaacccgggccggaaaattaaaaagggttttaaggaaaacccccggcccccctttggggggggggggaaaagtttaa

SEQ ID NO: 1855 - DNA, 702 bp, Acinetobacter baumannii
ccaggtcatccacctatgtccaagccttatttgattgctccttctattttatctgccgattttgctcgtttaggcgaagatgtagacaaagtgttagctgcaggtgccgatgtagtgcattttgatgtgatggataatcactatgttccaaatttaacttttggtgcaggtgtgtgtaaggctttaaaaaattatggaattactgctcctgttgatgtgcatttaatggtatctccagttgaccgtattattggtgatttcctagaagcaggcgcagatatcattacgtttcacccagaagcttctcatcacattgaccgttcattacagcttattaagtctggtggtgctaaagcaggattagtttttaacccagcaacaccattgcattatctagactatgttcttgataaagttgaccaaattttattaatgagtgtaaacccaggttttggtggacaaaagttcattccaatgactttagaaaaattacgtgaagcgcgtaaaattattgatgcaagtggccgtgatatccgtttagaagtagacggtggagttggtcctgcaaatatccgtgaaattgcagaagctggtgctgatatgttcgttgctggctcggcaatttttggtcaaccagattataaagttgtgattgatcaaatgcgtgcagagcttgcaaaagtcggtagtgtagatgcttaa

SEQ ID NO: 1856 - DNA, 1392 bp, Acinetobacter baumannii
actatgccacctcttccaaaatctcacatgtttaaaatgtctcatttaaagaaaaaaatctctttagaaagctattactccgctgccgatattttaaaaaaattagaagagttaactggacttgtatatcttcaagatgataacaatcctattattggttttttgccaaaaaattatttaatcactcaaaataaccaaaactttttattcactaaaactgatttaaataaatataagttttcatcttatatagaaaatcttttagattttacacaattccaatctcaagaactaaaaaatagcaatagagaaaaaataagttttaagggtggatatattggttttattagttatgacttttctgcacatcaatttataaataatcaatcacataaacaaccatctctatttataggttcctattattcttttattaaaaaaataaataatgaatggtatttttttagcgatgaaaataatgctcttgaaatctttaactatcttttagctctactcaataaaccttctaataaaatacaaaaaaacaattttaaactagaagaaaatatttatcctcgctggtctaagaatacatacttaactgcttttcataaaatacaagaatatattaaggcaggagattgttatcaaattaaccttactcaagaattcaaagcgaattttactggttcgttattaaataaagcagatgagctatggaatttaaccaatgcaccatattctggttatttaaaattaacagaatttgagttattaagttgctctcctgaattatttattgaatttaatgtaaataagcaaattaaaaccagacccattaaaggtacaatgcctcgttatgagaataaagagcaggatttactttcaaaacaaactttaaaaaattctaaaaaagatcaagcagaaaatgtgatgatcgttgatctattacgtaatgatttgagcatttatgccaatacaggttcggtaaaaacaacaaaactattcgaaattgagagcttcaatcaagttcatcatatggtgagtgagattacggctacacttaaaaatgatattaatcctatgcagatgttgctcactgctttaccaggaggctcaattacaggagctcctaaaattcgggcaatgcaaattattgaagagctagaaggcgcacctcggggagcatattgcggcactttaggatattttaatttcgatggtactggacgctggaatattttaattcgtagttttcaacaatatcaaaaccagctctctatttgggcaggcggcggtattactattgcttcagaggctgaggctgaatatcaggaaagccttgataaaatctctgctatgctgaacttgatgaacagcacagcagaataa

SEQ ID NO: 1857 - DNA, 696 bp, Acinetobacter baumannii
gcgagtaagttaatgaatgacgtaagaaacgatgatcctaattttaacgtaatgggtaattttgatcatggtttgaccttggcattgagtaaaggacgtattctaaaagaaacattacctttacttgctacagctggtattaacttgcttgaagacccggaaaaatcgcgtaagttgatttttccaaccacacataagcaggttcgtattttaattttacgtgcatctgatgtgccaacttatgttgagaatggtgcagctgacttaggtgtagcaggtaaagatgtacttatggaacatggcgctcagcatgtctatgagttattggacctgcagattgcgaaatgtaaattaatgactgctggtaaagtaggaatggaacgcccaaaaggtcgtttaaaaattgccactaagtatgtcaatcttacacgtcaatattatgcgagcttaggcgagcaggttgatgttattaaactttatggttctatggagttagcaccattagttggtttgggcgattatattgttgacgtagtggatactggaaatactttacgagcaaatggtcttgagccattagaagaaatttgcaaagtatcttcacgtcttattgtcaataaagcgagctttaagcgtaaacaggttttattgaacccaatcatttcccaacttgaacaagctgttcaatcacgttaa

SEQ ID NO: 1858 - DNA, 681 bp, Acinetobacter baumannii
atactaaggttgtgcatgaaactgctggcgttggaaactgcaaatgagcaatgttccatttcattaatcgatgaaacccaagaactctttttccaactcgatacgcgagcgaaagcacaaactcagaccattttgccaatgattgagcaaggtttacaacaaaccggacttgacgtagcgggtttagatgcaattgcctttagtcgagggcccggttcttttagtggtgttcgaattaatgcagcagttgctcaggctttagcttggtctcaagatttaccagtaattccagtttctaccttacaggctttagcacaagcggcttaccgacttgaaggtttagaacaggtgactgcggtactcgatgcacgtatgaatgaagtttacattgcaagttttgttctagatgagcaaggcatcatgcagtgtatcgatgaagaaaaattaatgaactacgagcaagcggctgcctatgcaaagcattgcttaatcggttcgggtgctaagcttcttcaaactgacgcagaacatcaaacaatcactgccactgcacaagacattgcttcgattgcacgtgtgtatgcagcgcaaaagcagtgggttgatgctgaacatgctttaccagtttacttgcgtgatgatgcatggaaaaaaattgcggatcagggcaaagcaaattaa

SEQ ID NO: 1859 - DNA, 591 bp, Acinetobacter baumannii
aaattcagttatgctgaggcatctctatactcgatgataattatgagtttctgtgtagcgtgtgggcataaaaccgaacaaaaaattcctttaggtgatcataaagtacgccgtgtttgtactcattgtggaaatattcactatgaaaaccccaaagtaatctgcggtgccttagcgttatgggaagacaaagtattactttgtcgtcgtgcgattgaacctcgttatggcttatggactttgcctgcgggttatatggaattattcgaaaccatggaacaaggtgcggcgcgtgaaactcgtgaagaggcagaagccgagattgaaatagaacaactttattgcatgtacaatattccccgtattgggcaaatttatgtgttgttcaaagcacagctgaaagatggcattttcggtgctggcgaagaaagtatcgaatgtcgactgtttgaagaacatgaaatcccatggggtgaacttgcctttcctagtgttgaacacacattaagacattatttcgaagactgtaaacaacaagtttttccaacacatctagagacgttaggaactcgtttagaccatacaggctaa

SEQ ID NO: 1860 - DNA, 534 bp, Acinetobacter baumannii
attatgatgtatagctatcaaggacagcatccaaaagccttacatgagccatgggatggctgggttgctccaactgcaacgcttattggacaagtagaactaggccgtcaggtcagtatttggtttggtgctgtagtacgtgccgataattgtgtcgttcggattggtaatttttctaatattcaagaaaattcggtattacatactgatgcgggccttgagctaaatattggcgaatatgtcactgttgggcataaagtcatgttgcatggttgtacgattggcgataacagtttgattggtatgaatgctgtcattttaaatcgagccgtgattggtaagaactgtattattggtgcgaatgctttaataccggaaggtaaagtgattccagataactcagtggtaatgggctcacctggcaaaattgtaaaaactttagatgaagaaggcgcagcaaaaatacgcttgagcgcactacattatgctgaacactttaaaagctatgtcgatttgaaagaattccacttttaa

SEQ ID NO: 1861 - DNA, 1677 bp, Acinetobacter baumannii
ggagatatgcaggtgaaatatcctaaattatgtcctttaacggcggcaattgttatctccggtttttctagctttgccaatgctcaattaggacaaaacctagctgttgatattcgctccttatccatggggaatgcagtaactgcagaccctcctggtattagtgcagttcattttaaccctgcagctttagcaaaaattgatgggttgcaaacagatgtacaagggattcttgcaaactttgatattcaaagagaattctcagcaccgcctggatataacgtttttggttattcagatgacccgattgtttgtaatgatggcccagaagtttcagccaatatttgtacagattttaaagactctgttcacggtgatgtggagtacgcgagcctgtatgtacctattcttaaaaaaatggtagatctcggagctggttatccactagttgcccctacagcaggaattgcctataagccaccaggatcaaaagtaacctatgcaacagccgtgtatgcaccgttggttgcaggttttggagctgaaaatggaaaccctggtaactacatgggtcagcaagttgctgttgagcggatcacctatttatcaccatcttttggttatcaggtaaatgatcatttatcgattggcgcttctgtagggatgtcatataacgcccttgcattaaaaaccgacttacgtttccctaatgagatgataggggtattacgtatggttgatgaggtggtttgtaaaccttttaaaaataatagtgacatgatcaccgacttactattatttgggatttgtaacacacaagaaggtatgaatccatttggtaagatgggagcactacaggtttcattagaacaatctttaagcccaagttacaacttaggattgctttgggaaccaacagataattttgggtttggtatggtataccagagctctgccaagatgcgtttaaaaggcaaatatatgattgataatgccaaagcgcctcagcaacttgtgtcaggacttaactcatctgctacgggtcaaattttagctagaattcttgggttgccaggttatgttcctgatattgagtcaggcttagtagcaatggatttagaatatccagcccattttcaggcgggtattaaatataagatattgccagatttacaattgaacttagatgttggatggactgactattcagcatgggataaatttaaatttgaatttgatcgccagatttcattacttaaagttgcaaaattactatctaataatgtgactgataactccttggcattaccattgaagtttacttccccatggagttggggtattggtttagagtattcagcaacagatcgtttgaaattacgtgcaggttatgaaccgcgtgctagtgctattcctgatgataaacgtaataccatggttccaattaataatgcgcaattatttggtctcggtgtgggttatcgttttgatgcggatacagatctagatctttccgtcggtttcctacgtagtcgtgacaatattccagcttgtacgagtacattatcgaataaatgtggtgtcgataatatcttattaaacccatacgctggtttggatgtgaaaactaataccaaagttacagtacttggtttgagctatagaacgaaatggtaa

SEQ ID NO: 1862 - DNA, 849 bp, Acinetobacter baumannii
gattttagtaagagacctagatcattaatgacagtaaaaattttagcggtagatatggatgggacttttcttaattctaagaagcagtacaacaaagcacgttttttaaaacagtatgaacaactaaaacaaaataatatccgttttgtagtcgctagtggcaaccagcttgcaaagcttgttacgtattttccagaaattaatcatgagattgcttttattgccgaaaatggtgctcatgttgtagaggcggggcaagagttagcttttgcccatttaagcaaagagcaattcattgagattttaaatgcgattgacccagtgtatacctctaaaatggtgatctgcggaaaacagagtgcttatgtgcatagcagtatgaacggggaagattatgctaaagtcgctcgttattttgaaaagctgatggttatagatgacttttatgcactagatgacttagtgtgtaaaattacttttactgcgcaggaaaatgaaagttttacaatttttgagcattttcagaagcaaagttttgtaaaagataaggttctagtaccagtttcaagtggctttaattttatcgatttgattcttccggaccagcacaaagcacatggtttgaagctattattgcaaaaatggcaggttcaacccgatcaagtcgttgcgattggtgataacaataatgatatccagatgattaaagcagcaggttatgggtttgcagtcgaaaatgcagttgaagccttaaaagccgttgctccttacacaactgcaaataatgagcaagaaggtgcattacaggtaattgatttggttcttcagcatcaacctccatttgcttaa

SEQ ID NO: 1863 - DNA, 837 bp, Acinetobacter baumannii
ttgttgctcaagtcaacgatggacaacaacccgctcagtcccagccaactgttcaatctgaaaatgagaaaggagctagtcatgcgcatcactaagttattttctcaaatgatatgttgcggtgctttctcgggtatatctgtatttgcttttgctcaagaacctttaacacacgatcatttacgcgaacatggtggacaggtttatcaagcaacaaagattgatactggctggactcaaaatgaagagggtgaaagcagtttttcttctgaattggaaagctgggtgggaacggatgaaaataaattgttcattaaagcccacgttgaaaaagcagagtcagaagaagctaattatggcggttcattactttatagccgcaatgtagctgactattgggatgtacaggccggggtaaactatgaacgtttacaacgggaagacgaaaagcaagatcgctgggctggtgtagtgggcttacatggtatggcgccttacttctttgaaaccgatgcttatctttatgtaggtgaagatcagttatggaagttaagcctagagacagaaagagatttactttttactcaaaagttgattggtaagccctatttaaaagcagatgttgttttacaagatgaatcttgctatgccagcaaaacaggcctgtcgagtttacaagctggctttcaaacccgttatgaaatcaataaaaaggtcatgccatttgttgatttcggttatggttatgaaaaaggtttaaaacaaaccgcttggcaaactggaaccgactcagaacatggttggtattatggagctgggttaacactaaaattctaa

SEQ ID NO: 1864 - DNA, 1926 bp, Acinetobacter baumannii
atgaataaaaaaattttatggccttttgctcttaccacaattgcattgatgttaaatggttgtggtggaggaagttcgacaattaatgagaatccttctaatggatcaggaggagctagttctagtggaagctgttctgtaacgaatagcgattgtctacaattttttttagattacccgattgctggtcttaattttacctgtagtagtactggaagccaaagttttattactaaagcttcaggaaatattgtcatcggttcttgtaaagttggtgatacagcgaccttctatttgcaaggtgctaagaatccaagaaaagtagaattaggttcagttaagttagattcagtctcaaaaattcaaatgactgtgccacctcgtctaaaagtcataaatatggcaataggattaacagggcagactccaacatcgcttagtcctagtgaccctactattcgcgtagcaatggcattagtaaaagttttccaaagcattggcttggaaagaggagataatgtagttggtgatttacaaccaacacaatttactgaagataagaaaaatacattaaatgttgtactgcaaaatatcacggcaacggaatggaaaaatggggcctatgtcaatttgttaaaaccatggttagatgtaagccagatttcagatgagcaggctttcaaccttataacccagttagcaaacttaagtttggttggattatatcaatcagattatattactttggcaaaacctaatttagttgctgaaaacttttatggatgtaatttaacgaatttaaaagattgctcaaaaaatagtgcgaatacccaacatgtatttggcaacttatttttgctatctgaccgtcaaggttatacatttggttatgggttacaatggaaagggactagcactacctcaagtcagctagcaattggagccgtgttggaggtattgacaaaagctaagccaactcaaatgattgccaatgcacagactacttggcttgacccaataaaaacagaaattagatcaactcagccgttccgtttgaaaacttctaataatacaaatgaagatttagtaatttaccaaggtaaattattaaatgattcacttattgccggacatgatagctcgtatttagctttaaccaatactgaaactccgaacccacaacattatgcattatggagacagtccgtaggtacccaaaattataatggctctatggatatttataaggtcagccctgctagtttccttttaaaagatatttttaagacttctaaaaatgtagcaacaggccaaacatatattttccctttatatgcaacattaagattccagttcaatacggctggtattgcaccaattgatttaggtattgtggttgatgaatatggggatattcggactgatatcaaacctaatgcaacggcgaccgatatgtctgggcaatgtggtgttgtttctgataatactatgatcgataacaatggggttcaacagtatcgtataggaacaactggaggaacagaatcttccacaaatgataaatccgttactgtaagaatgattcttgctgagcctcaattagggaatttgaatgggattgtggtaggccttaactcaaatgtcatacaagcaattaaagaaacaggtagccaatctttaacagtaagtggggcaaaaattaacgttgccaatctattacaaggtcaggcaagtggtgcaaatcttacgacttatgataataaaacagttaattggttgaatccatatgccttttatcaacaagtttataacaatattgaaaatgtctcacctgcaccaactgaagctgaaaaagcactgggacagcgtatggctggaacagtaacccttagaaccgctgattgttatcaaattaagacaaaataa

SEQ ID NO: 1865 - DNA, 843 bp, Acinetobacter baumannii
tgcatggaaaaaaattgcggatcagggcaaagcaaattaaaggcactgcgcatgcacatgtattttgaagtagattttcaagaacaagcacagcactaccaagctgtgcttcattctagaggcgtgactgtcgatttacagcctattgaaaaactcaatgcccgttttttacgtttaaatcctgacttggctctttgtgtagatgaaaacggactttggttatctgctaacggcatgaaaatgcagcctgattggaaagctgaaattcctcgtttaaaacgagcaagtcttaaatcggaaatgattgctcgtgcttgtcagttaggtgaaaagccagtactggtcgatgctacagcgggcttaggtcatgacagcttacttatggcttatctaggagcccaaatccagcttgttgagcgccatccgattttatttactttacttgaagattcaaaagctcaggcacagcatgatccatttttaagccaatttatggatcgtattcaactgatcttcgctgactctgcaagctatttacagcaattagatcaagaagaaaaaacagttgatgtggtctaccttgacccgatgttcccacagcgcgatcaaaatcaacaagcaattaaaaaacaagcccaagtcaaaaagcagatgcagcttttgcatttacttttacccgaagatggagaaatggatttgggtgatcatttgctagagctagccaaaaaagttgcaaagcgagtgattgtaaaacgtccacgacatgctatttttttagcaaatcaagagccagcccatcagtggcagggggatgcttgtcgttttgatgcttactttcagtaa

SEQ ID NO: 1866 - DNA, 336 bp, Acinetobacter baumannii
aaattagtgaatgttatggcttgggctattttaattttagcaggtgtatttgaagtgatttgggcatattctatgaaaatgtctgaaggttttacacgcttaacgcctagtattattaccgtagtttttatgattttgagtgtagttctactttcaatttcaatgaaaactttaccccttggtactgcttatacggtttggacaggcattggtgcaattggatcatttttagttggtattttctttcttcatgagcctattggtgcgatgagaatgattgccgctgtactgattgtatctggactggttctaatgaaaatttcatctccatcctaa

SEQ ID NO: 1867 - DNA, 1056 bp, Acinetobacter baumannii
agaagacgttttatgagtgatgcgactttaattgccaacgatgcaaaaaacattgtacaagcgcatttagaccgtttaggtgagccaaaagacaaccgcctaagtgaagaagcaaaacaacaaaagtttgcacagatcgaagcagagctcaaaaaacgtgatgctgtccttgttgctcactactattgcgatccagatgtacaagaacttgccgagaaaacaggtggatgcgtttctgattctttagaaatggcccgttttggacgagatcatgcagcctctacactggttgtggctggcgttaagtttatgggcgaaacagcaaaaattctgtctcctgaaaaaacaattcttatgccgacacttgaagcaacctgctcactcgacttgggctgtccagtcgatgagttcacggcattttgtgatcagcaccctgaccacactgtagtggtttatgccaatacatcggctgctgttaaagctcgtgcggattgggtggtgacttcaagctgcgcagttgaaattgttgagcatctagatagcttaggcgaaaaaattatttgggcaccagatcagcacttaggccgttatattcaaaagaaaaccggcgctgatatgttgctttgggatggcgcatgtattgtgcatgaagaattccgtgcacgtggcattgctaacatgaaagcactgtacccagatgcggctgtattggtccatcctgagtcaccagagtcggtggtagaaattgcagatgcagtgggtagtacatctcaattgattaaagctgcacagactttgccacaccaacgtctaatcgtggcaacggaccgtggcattttctacaaaatgcagcaagcagtaccagataagattctggttgaagccccaacagcgggtgagggcgcaacttgtcgttcatgtgcacattgtccatggatggccatgaatgaacttgatggaattttagaagttttacaaaaaggtgatcaagaaatacacgttgacctagcacttgctgaacggttttcaccacgagctggagatccgcaatggtta

SEQ ID NO: 1868 - DNA, 273 bp, Acinetobacter baumannii
gttgtgtcagaggtctttgcaatgaatagtgaacagctcactcaaattttaaaagaagcttttcctgaggcggaagtagtggtgagcggacaggctggaaaatttgacctccgtattgtggatgatcaatttgaaggtaagcgtactgttgcccgccaacaagcagtttatgcaccattaaatacttatattgcaagtggcgaagttcatgccgtaacaattcgtgcgatgaccaaagatgaatggcgcaaagcaagccttttcggagcttaa

SEQ ID NO: 1869 - DNA, 1353 bp, Acinetobacter baumannii
tgcccacaagagcttagaaaaagagtaaacttggtttttctttttcgccttgtgggtaaattgatgcgacgtttatcgactcaagatcagaacttcaaacaggtttttgctgagcttttagcttttgaaaccgttaatgatcctaatttagttcaaacagtagatcaaattattgctgatgttcgtcagtatggtgatgatcatgttttaaaacttactcaacagttcgatcgacatccagcgcatcaattttccgatctagaattgtctcaacaacaacttaaagccgcttttgatggtttaaatcaagagattcgtgaagccctgcaacttgcagctgatcgtattcgtacttttcatgaagctcaaaaacaagatagctggacttatgtagatgatttgggtaataccctaggacaaaaagtgacgccacttgaccgtgttggtatttatgtaccaggcggacttgcatcttatccttcatctgtacttatgaatgcggtaccagcacatgtggccggtgtacctgaaattattatggttgtgccagcgccaaatggtgaactaaattcactcgttttagctgccgcctatctagcaggtgttagccgagtatttaccattggtggggcacaagctgttgctgctttagcttatggtactcaaactgttccacgtgttgataaaattacgggtcctggaaaccgatttgtggcagctgctaaacgtgctgtatttggtcaggtgggtatcgacatgattgctggaccttctgaaatattagtttatgcagaaggtgtgaataatgctgaatggttagcgatggatgtattatctcaggctgaacatgacacagtagctcaagctattttcattactccagatgaagcattattagaagcagtagagtctgcaattgagaaacatttaaatgaattgcctaaagccgagattgcgcgtacatcgattgaaaatcgtggtgcattagttttggtaaaagaccgtgctgaagcagttgatttgattaatcaggttgcaccagagcatttggaattatgccttgatgatgccgaagcgatgagccaagacattcgccatgcaggggcaatttttatgggtcgctatactcctgaagcaattggtgattattgtgctggcccaaaccacgtattaccgacatctggcacagctcgtttctcttcgccacttggtgtatatgattttcaaaagcgctctagtttgatcatgtgttcaaaagatggtgttaagactttggctaaaacagctgatgtacttgctgttcaagaaaatctcgatgcccatgcacgctcggcgcgttatcgttatcaataa

SEQ ID NO: 1870 - DNA, 1242 bp, Acinetobacter baumannii
caaactctggaagttttaaaaatggctgtcggtgacgtaacaatgccacaaatgcatgtggtaaaaggtgtaaaaattggctcaacagaagcatatgtacgttacccaaaccgacgagatctagtcatttttgaatttgcagaaggttcaaatgttgcaggtgtatttacgcaaaatgcattctgtgcggcacctgttcatgtctctaaagcccatcttgccgaaggcaatcctcgctatttagtgattaatacaggtaatgccaatgctggtactggtcctacaggtttgaaaaatgctcaggatacttgtgcaaagttagcggagcttgctggcgttaacagtttcgaagtacttccattttctacaggtgtgattggtgaacagcttccgatggaacgtttactcgctggcttacagcctgcattaaatagcgtacaagacgctgcatggagtgatgcggcatctggcattatgacaacagacacagtgcctaaaggtgcatctgaacaatttgagcttgatggtatgacttataccatgaccggtattagtaaaggcgctgggatgatccgtccaaacatggcaactatgctgagctttgtggcaacagatgcgcctattcaccgcgatttagtacaaaagctattaaagactacagttgagcattcatttaaccgtattaccattgatggtgatacttcaacaaatgactcttgtatttttgtagcaactggtcaggctggtggtgctgaaattacatcggaaagcgatgcacgctacgctaaagtattagaagtacttgctcgtgtaatgaaccgtttagcacagttaattgtccgtgatggagaaggtgcaaccaagtttattactgttgctgttgaaggcggtgcaaatactcaagaatgttgtgacattgcttatagcattgcgcattcacctcttgttaaaactgcactttttgcatcggatccgaactggggacgtattttagctgcaatcggctatgctggagtgaaagacttagatgtgtctaaaattcaggtatggttagacgacgtgcaaatctgtaaagatggtggcgcagccgaggactataccgaggaagcaggtgctcgtgtaatggcacaaaccgaaattaccattcgtgttgacttaggccgcggacaagccaaagacacggtatatacatgtgacttatcttacgactatgtcaagattaatgcagattaccgttcgtaa

SEQ ID NO: 1871 - DNA, 1263 bp, Acinetobacter baumannii
atattaatggataaatttttaatcacgggcggtgttaagctcgaaggggaagtacgcatttctggtgctaaaaatgcggctttaccgttacttgcggcaatgattcttgctgactctccaattacattaaccaatgttccaaatcttaaagatgtaaatactttggtgaaattaattggtggactgggtgtcacaattagttatgaaaatgacacagttaaggcggatacttctactttagataaccagtttgctccttatgagcttgtcaaaacaatgcgtgcatctattttggtattagggccattattagcgcgttatggaaatgccaaggtttcattacctggtggatgtgctattggctctcgtccagtagatcaacacttaaaagccctagaagcattgggtgcacatatcgaagttgaaaatggttatgtacatgccactgttgatggtcgtctgaaaggcggcgaagtggtttttgatatggttactgttggtggtaccgaaaatattttaatggcagctgctttggcagacggtgtaaccacaattcgtaatgctgcacgtgaacctgaaattactgatcttgcgcaaatgcttattaaaatgggcgcaaaaattgaaggtttagatacggatacattggttgttactggtgtagaaagtctacatggctgtgaatatgcagttgttgcagaccgcatcgaaacaggttcttacttagctgctgctgcgattactggtggacgtgtaaaaaccacccatacagatccttcattacttgaggctgttttagataagtttgaagaaatgggtgctgaagttacccgtggcgatgactggattgaattggatatgttgggtaagcgtcccaaagcagtaagctttagaacactaccgcacccagaatttccgactgacatgcaagcacaaattatggctgtaaatgcaattggccgcgggtttgcaacgatttctgagaccatttttgaaaatcgtttcatgcacgttcctgaattgtcacgtatgggtgctaatattcaggtcgaaggtcatgatgctgttgtaactggtgttgaaaaattacaggcagcacctgtaatggcaacagatttacgtgcctcattctctttggttttagcggctttggttgctgaaggtgatacattaattgatcgtatctaccatattgaccgtggttatgagcatgttgaagaaaaacttcaaggtttaggtgccaaaattaagcgagtaagttaa

SEQ ID NO: 1872 - DNA, 399 bp, Acinetobacter baumannii
atgatgacactgcaacacttacgcaagtatgcttggtttgtgttcctgatgactttagttattgggtggagtggtgtgtttattgctcagacacctatgcagcatgatcttcatactatgccctgtcatagtgagcaaatgaagcatcactctatgcatattcaagctgatgagcagacaacgtgtcatcaatctatggctcaggtttctcaccaacatggtgaacactgccaagactgtaacccggtccattgtcagatggtaaatctggctttacagcaagctgtaccaaatattgaatcatcatttattcctattccatctcaatttagtagtatttatcaggcacagcatttagccggatactggcaagaaatcttacgtccaccaaaagcttaa

SEQ ID NO: 1873 - DNA, 1032 bp, Acinetobacter baumannii
aattctaattgccgaacaaaaagtaagcttaatgacatgccattggtttatactgatggcattgttttttgtgtcagttatggtgcaaagatggctttagaaaaacaagagaatcaaataaatgtaaataaaagctgttctagctgtgggtgctcaaatgtagcagctcaggacttttctgtggcaagtgaacctagggtaaataaaacccaatgggtgagttattatcatattccccgtatggattgtgcagccgaagaacaaatggtacgaatggctttagcttcttatgctgaacatattcaagaacttcattttgatttgcccgcccgccacttagcggtgtatcacagtactcaagacgaaaagattactcagtgcctgcaacgtctaggtttaggagccgagttacaacaaacacagccacattatgaacctgttgaaaaacctaaaaaggttcgagctagttcttcaaccaatgcaacacaaaaacaagttttacaatggttgttactcattaatggggtcatgtttgtcattgagttgatggcaggcattattgcttcatcgacagggttaatcgctgattcgctcgatatgtttgccgatgctgcaatttatggtgttgcattatttgtggtaggtaaaaacctcgacgctcaattaaaggctgcacatctttccggatggtttcagtttggtttagccataatcgttttaattgatgtgctgcgccgttttatatatggcagtgaaccagtttcaattttaatgattttaattgggggattagcgcttgcggccaacattagttgtctttacttaatgagtgaccataaggaaagtggggaacatatgaaggccagttatatattttctgcaaatgatgtcatcgtaaacttaggtgtcattattgcgggaatactggttgcaatcacaggttcgcgttatcctgatttaattattggattgattattgttttgttcgttttaaatggtgcacgaaaaattttacagttaaaaaatgaataa

SEQ ID NO: 1874 - DNA, 573 bp, Acinetobacter baumannii
gcctattggtgcgatgagaatgattgccgctgtactgattgtatctggactggttctaatgaaaatttcatctccatcctaagaggatcaagtatgttgctgtcttataagtatatcaattcgcctgttgggcaattaaagctggttgcgaatgaaaatgctttggtagcagtactttgggacaatgaaaatccaaaacgtgttcgactggcagagctggtcgaacaacttgagcatccagttttattaaagaccgaacaacaattacaagaatattttgaaggcaaacgccgtgagtttacattaccactagattttgaagggactgcatttcaaaagcaggtctgggcggcattactgacgattccgtatggtgaaacaagaagttataaagatattgccgttcagatcggaaatgaaaaagcagtgcgagcagtgggtgctgcaaatggcaaaaatccgatttcaattattgcaccttgtcaccgagtcattggtgcgggcggcgctttggttggttttgccggtggtcttgataagaaagatattttattaagattagagcaaaaataa

SEQ ID NO: 1875 - DNA, 192 bp, Acinetobacter baumannii
atactgcaccgactgcaccgactgcaccgactgcaccgactgcaccgactgcaccgactgcaccgactgcaccgactgcaccgactgcaccgactgcaccgactgcaccgactgcaccgactgcaccgactgcaccgactgcaccgactgcaccgcaaaaaactcagaaaaatacaaaaactgtttcagtag

SEQ ID NO: 1876 - DNA, 882 bp, Acinetobacter baumannii
atattgctcagacacaaacagaggctaaaaacgatgcaactcctgcaaaaaaaccgctgctttgaaggtgagcagcgcatttatcagttcgattctcaattattaaaaggctctactaagtttggggtttatttgccacctgctgctttagaaggtaagccttgttcaactttgttttacttagcgggcttaacgtgtactgaagaaacttttgccattaaagcacatgcacagcatatggctgcccagcttagtcttatactgattacacctgatacttcacctcgtggtggacaagttgcagtaggtgacaattgggatttaggtcaaggcgcaggcttttatattaatgccacagaagcaccttggtctgagcattatcagatggaaagctatttaatcgatgagttatatccacttattttaaaaagttttccagtaaatgctcaacaggtcggtatctttgggcattcgatggggggacatggcgccttaactttagcttttaaatatccagagaagtttaagtcagtgtctgcatttgcaccgatttgcgcgccaactgaatgtgcatggggtgaaaaagcattcagccattatttaggtgcagaccgcgatagttggttggctcatgatgccacagctttagtctcaaaaaatggtgcggtatttaatgaaattttggtggatcaggggttagatgatcaattttatgaacaacttcaccctgaaaaatttaaacaagcatgtttaaaggcaggacagcctttaactttaagacaacatgctggctatgatcatggctattattttatccagacctttatggatgagcatttgcagtttcatgcaatccagttggaaaaggtcactggcgaataa

SEQ ID NO: 1877 - DNA, 2016 bp, Acinetobacter baumannii
ccggatactggcaagaaatcttacgtccaccaaaagcttaatcctttcttacttatttttttagttaaaaggattaaagcaatgtctcataaaacgattagcagcctcgtcgctgtatttggtctattggtttcaccatggactctcgcggcaattaaggaatatcaccttaatattaatgaacaacaggtcaatgttacgggcaaaccccttaaacgaattaccgtaaatggaaaatttacagcaccactccttgagtttgaagagggggatgaggctgttattcacgtccataatcaattaaagaatcaagatacctctttacactggcatgggttgttactgccagggttaatggatggtgtgccgggttttaataattttaaaggaatcgcgccaaatggagattttgtttaccgctttaaggtgaaacaaaatggcacatattggtatcacgcccatagtaaaggccaagagcaagacggtttatatgggccgcttgtgatttatccaaaaggcaaaataccagttgcggcgcatgaaaaaactgatcgtgattatgtagtgatgctttcagattttcataattcttctagcgatagtattatgaagaatttgaagaaatctgctgagtattatcaaaaccgccgtgaaaccgtatctgatgttttgaagcaagttaaagcacagggcttaaaagcaacttggcaagatcgttcgatgtggaatcagatgcggatgttaaaaaccgatatgtctgatgtgacgggttatacctttttagttaacggcaacacacctcagcaaaactggacaggtaactttaaagctggtgataaggttcgattgcgatttattaatgcatcagcaatgtcattttttgatgtcagaattccaaatttaaaaatgactgtcgtaagtgcagatgggcagccagttaaacctgtagcaattgatgagtttcgtattggtacagctgaaacctacgatgtcattgtggaacctaaacagccaaattatcagattgaagcagagtctattgatcgtagtggttttgctatcggtactttgcacaatgaaaatacgcaggctgtggggccagtccaaatgccaataccacgcccacgtgctttattgaccatggatgatatgggcatgagtcatggtggtggaagtaatgaacatgctggccatcaaatgaacatgcaacatgacatgtcggccatgcctgaaatgaaaaaagagacgactcaggctaatcatgatcacacaatgatgaaaatggatcatgacatgaaaaatatgtcatctgacgggcatgatcattccatgatgcacatgacgcatgatatgtcagcgatgtctgaaatgaaccatgatatgcaggcaatgtcagctagcgagcatgaccacgctatgatgaatatgaatcatgagatgcctgctcaatctgagaataagcctaaaaaggatgaaccagtttatggctgggcaaatgcttcaacgccagctggtatgaaagcactgcaatatagcgatttgcaatctttaacacctcagccagatacccgtgcgcccgaacgagaattagtcattcgtttaggtggcaacatggagcgttatatctggaccattaatggcaagaaatttagtgataccacaccactacaagttaagtatggtgaacgcatacgcttgaagtttgtgaatgacagtatgatggctcatccaatgcatttacatggcatgtttatgcaattggaaaatggtcaacaagctgaaaacttaccaaataaacataccattattgttccacccggaaagactgttactgcgttattgacagccgatgctttgggagaatgggcgattcattgccatctgctctatcacatgagtgctggaatgatgaataaattaattgttgctcaagtcaacgatggacaacaacccgctcagtcccagccaactgttcaatctgaaaatgagaaaggagctagtcatgcgcatcactaa

SEQ ID NO: 1878 - DNA, 261 bp, Acinetobacter baumannii
gttttttgcggtgcagtcggtgcagtcggtgcagtcggtgcagtcggtgcagtcggtgcagtcggtgcagtcggtgcagtcggtgcagtcggtgcagtcggtgcagtcggtgcagtcggtgcagtcggtgcagtcggtgcagtcggtgcagtcggtgcagtatttaatttttcttggacatgttgttccagttttttcggtaaatttttagtttgttctttttctttagatgttttttgtacaacatctactataggttga

SEQ ID NO: 1879 - DNA, 867 bp, Acinetobacter baumannii
ggccagttaggctaccatttagaccaagtgcttatgttagagattgctttaggctcagcattgatatattactttgcgacagaagccttcgaaatagaaaaaaaaccgccgggaactgtttattatacagagactgccgattcacgtaatttatcttttcatcgaaatcatattgaaccagttactataaaaccagctgttgaagaccagtttcgtggaattgttcgacaagcctacgattatagttgtgggtctgctgcccttacgactttattaaatggttatgttggtacgagtttaacggaacagcaaacaatgagtggtttgctacagtacggtgagtatcaacgtattattgaacgccgaagcttttcgctccttgatatgaaacgctttgtcacagcaattggtttagagagtggtggttaccgaggagagttttctgatttagttaaactcggtcaacctgcaattgttccgatttcatatgctggttttaaacattttgtcgtatataaagcttataaagatggacgagtatatgtagctgatccagctttagggaatatcagctttgatgaaaatcgttttaaggaaatttgggataataatacgttatttgtaatttcagttcctgaatctcagcgtaaagacttattagcattaaaagattcggatatgcgtcatgtagaggatgcaacagtcaatagatatgcttttgttgatgtgcaatatcccacatataaatatgaccgtttagcaaataaggcttctacgatgcggcgagttttggatactgatactcattcctcaacttataatcagccgatagatacttatatgcgtctttattacaagcgtaaatag

SEQ ID NO: 1880 - DNA, 909 bp, Acinetobacter baumannii
atgctcttgggagagtgctcaatgaaaatgttcactaaacttgctttagtttcttctttagctatcagtgcaaatgcaatggcaatgcaatcaatggatgatgctgcgctcagtgctgctacaggtcaagatggtattaatatcggtattgctttaggtactagtggtatttctatcgacaaattatatttacatgataatgatggtttagctactactacaggtattactggtgctacaggtactgctggtgcgcttgctattagtgatgtaactcttaagcagactggtactggcaatcttttagatttagcaattgatactaatggtgcttcaagtactaatggcgctttcttaaatgttgctgctacagttggcgcggttgacatccatgtaggttcgatcggtgtaggtacttcgggtacggtaaatgaaactaccgctttgcgtggtattacagaaacagctccaactgaaattatctctggcttagatttatctttaggacaaattactgcaaatgtacaattaggttcgacaccacaaggcgctatgattaaagtcgactctgcattgaaaggtggcttaacaatttctaaccttggtattaatgatgctgcgggtggcggttcgattttattggataaagtgatggtgcgtggagctggtaacgctacaggtgatttagacgttaaagctgatatctctgttactggaaatggcctacaagttaagagtactagtgctcaagatatgaatgtgtatgtaggtggtgtacatttaggaacaaatactaaagctagtgatggtacctggggtacaggtgcagttaaagctgcttcaattggtgatcttgaaattcaaggtttaaatgtggcaaatacaactatcacaatatctggtcattaa

SEQ ID NO: 1881 - DNA, 1461 bp, Acinetobacter baumannii
aacctttttatgattgatctcaaaccttccattaacttttggcatgattttaaaagtaaccagcttgccggaatgtggttatttttggggtcaagacgttccttacagatcgtacatccctctattcttcagcttattgtttggggaatattaggtgggtgtaccaactcactttatagttggcttgttgccggtcaaattggagacttcaactcacaaggtctaattggatacgcactttggccttttattgcgcttattgttggtattttcttatcacagcgtattaatcagccgcgtttaatgttggttccagccttattgtggttggttttagataccaatattttattaatacagtgtttaattcaatatttgggatctaatggttatctaaactttattccggatgctatttataacggtattttacctggtttgtttgtagcactttttgtgtggcaaagtttggcggttatttgggtgttctcacgtgagcttaagtggccttggtgggagcgggcgttggttatggttgcgaccattgcgaccatggtggtttggcaactttccgtaaaagatcagcctatttggaaagtggaagattctccacctacttttgccgaagatgctttttatgcacaaagtaaattacttcatgatgctttagagcaagttcaatatggtgagctagctaaaagtcattggtatttcttgggtgttgcaggcgatagttatcaagatgtttttaaatcggaagtggttcgtattaaagaacaattcgatacacgtttcggtacagtcgggcgttcaatgatgctggtcaataatccggatacccgaactgaaatcccgattgcgtctaaaaccagtatagagttggctctacgccgtatgggccagcaaatgaaccgtgatagtgatgtgttatttttatatatgacatcgcacggtgaacaaaaccattttgaaattgaaaatgcacctctagatttggggcaagtcgatccgaaatggttacgtgaaacactcgataaagcggggattcgttggcgtgtaattgtcatttctgcttgttactcaggaagttttattccggcgttacagtcacctgatactttaattattactgcatctgctgcggataaaacttcgttcggttgtaataacgaagctgactatacttattttggacgagctttctttgatttagcgatgcgtgagcagtcttctatgaaggattcgtttaatgccgctaagcaaaccgtaaccaaatgggaagtagctcaaggtgtagaaccttcagagccacaatggatgattggtaagaatatggaacttatgctacctcagttggaaaaatatctttttcctcaaccaaatactggtagcgtaaatattgctcagacacaaacagaggctaaaaacgatgcaactcctgcaaaaaaaccgctgctttga

SEQ ID NO: 1882 - DNA, 1095 bp, Acinetobacter baumannii
gataagactatgactgtatctacagcacaaatgcgtttttggagtcctgaggttcgtgaattagagccgtatgtgccaggtgaacaacctaaaatccagaatctattaaagttaaataccaatgaaaacccgtatccaccatcaccaaaagtagtagaagcagttcaagcggtgttacatgaacaagccgatgtgctgcgtctatatccagatccggatgcgacagcgttaaagcaagcaattgcgaaacaacagaatattgatgtatctcaagtttttgtaggtaacggttctgatgaggtattggctcatatctttaaagcattttttcttcaagatgaaccaatcctgtatccggacatcacttatagtttctatccagtttatagccaattttttggcacaaaaacaaaagaaattcctctcaatgagaatttcgaaattgatgtgcgagattatacccagccaaatggtggggttattattaccaacccaaatgcaccaacaagtattgcgctcagcttggcagaaatcgaacaagtattacaggcaaatccggaccgcgtggttgtgattgatgaagcttatgttgattttggtgcggagtcagctgtaagtttgataaaccgctatgaaaatcttgtggtatgccaaacgacttcaaagtcccgttctttagcaggcctacgagtcgggtttgcgattgctcagacgcacttgattgcagcacttgaggctgtaaaaaatagttttaattcatatccaattgatcgctttgctattgcagcagcagtagcttcttttgaagatgaggtttattttgaagagcagtgtcaaaaagttataacaagtcgagagaaacttgttcgtgatttaactgaacttggttttaacgttttgccatcgaaagcgaattttatttttgctacgcattcacagcatgatgctgggcaacttgcacaaaaattacgtgagcagggcattattgttcgttacttcaataagcctcgcattaatcagtttttacgtatcacggttggaactgatgagcaaaacgcgcgtttagttcaaactttgaagcaagatattctttaa

SEQ ID NO: 1883 - DNA, 627 bp, Acinetobacter baumannii
gtgaatggtatggaagagcacttgctaacacaaaagttacagcaaagattgcgcttttccacccgcatacaagaagcacaagctgcggtacttattgcgattacgaatgaaaataatcctaaggtactgcttacacgccgttcaatacatatgaacaaccatgcgggggaagtttcttttcctggtggcaagcgtgaccctagtgatactagtaatattgttgtagcgctaagagaagctcaagaagagacggctttaaatccatttgatgtgcagttgttaggcgatttgccgatgcaacgtgcaagaagtggcttgtctgtaaaaccgattgttgggcttattcctcctgaggtaactttaattcctcagcccaccgaaattgatcgaattttctttgtgcctttacagcaacttatagagacgcgtccgacgccatatgaagtgcgatatgctcatcaatctttatacttcccaagcttgcagattgataatgaaattatttggggtctcacagcgcgaatgttaattgccttatttaaatatggtttaggctaccaaaaagaatggccatttctactgaatgcaccaacgtttggaatgccaaaattttctcataaaaaataa

SEQ ID NO: 1884 - DNA, 282 bp, Acinetobacter baumannii
gaattgataatgaaaagcacaactcatctattaacaaatgatggaaaacgcattgcaaaacgtctagttaatcattggaaacataaatttgaagtacacgaaactgaacaagattttaaaatcttaatgcctacagcaactattacgcttgcgccagaaacagagcagttaaatgttgctattgatagccagttagatgaccatgaccacttggaaaaagttgtccttgatcatctaaaccgtatggctcaacaagaatttcaggtggaatggcagcactaa

SEQ ID NO: 1885 - DNA, 1479 bp, Acinetobacter baumannii
tttttgcttgttttttggaaagagaaatatatgaaattatctgttggattgaaagttgcgaattcattatcgttaacgcctcaattgcagcaggcaatccgtttactacaactttctagcctagagttagagcaagaaatccaaattcaattagatagtaatccattacttgaaaaagtagaagatgaatcactagcagaaagtttatctactttagaacacaaagaaactgatgaccttacaacagagttgaatgctgatcacttacctgatgacttgcctgttgatactgaatgggatgacatttatacacatcaatccactgctttgggtactcctgagttcgaagaacgtgaagataatcgccaagttcacctgacgcttaaagaacatattttggagcaagtgaacttactacatttttcaaaaatagatcagttgattgcttattgcatagttgatgctttagatgataaaggttttctggatgctgaattagaagagattattttggcagtacagcatttattaagtgagatggatatagatgaggaagtggaagaggatgaagttttagtagtcttaaaacatattcaacgtcttgatccaattggtatcggagctcgtaatttagctgaatgtttaaaagttcagttggagttcttgcctcgagaaactgaatatttgaaagaagccagaagtctacttcaatattaccaattactgattgcgaatgatcttaataaattattgaagcaaacagggctttccaaagaacagttaaaatttgcagttgatttattaaaaacattaaagccttatccaggcatggattttgaaaagcaagaatcagaatatcaaattcctgacgtagtcgttgccaagaaggacttgcattggcaagttcagttaaatcctgatgtgatgccaaaattaagaatcaattctttttattcgagtatgattcgtagggcagatcaaagtgatgataatttatacctacgtaatcaaatgcttgaggctaaaaattttataaaaagtattgatgaacggcacaaaacattattaaaagttgcgacttgtattgttgagcatcaaaaagcatttcttgaaataggtcccgaagcaatgaaacccttagtactaagggctgttgcagaagaagtagaattacatgagtcgaccgtttctcgcgttaccacaaataagtatatgcttactccacgtggactttttgagttgaaatacttcttttctagtcatgtggggacaaccacaggaggtgaggcttcttctaccgcaattcgggcgatgattaaaaagttagtttctaatgaaaatccgcgtaaacctttgtctgataatgcaattgctgctttattgaaagaagagggaatagaagtagctagaaggactgtagcaaaatatagagaatcgttacatattccatcgtcatccgagagaaaagtcttgatctaa

SEQ ID NO: 1886 - DNA, 1356 bp, Acinetobacter baumannii
aacgaaatggtaagactatataaatggatatttagccctaaatttgctatcacaactttatgcgttgcgatagcaagtatttctgtatcttatgcagacggtttttatacaattattgggccagatgggcggcctatgattgtaccaagtaaaagaattgatcagaaaaaacaacctatccctaaaatagaggaaagaaaaccacaaactcagcagaatcaacctatagtagatgttgtacaaaaaacatctaaagaaaaagaacaaactaaaaatttaccgaaaaaactggaacaacatgtccaagaaaaattaaatactgcaccgactgcaccgactgcaccgactgcaccgactgcaccgactgcaccgactgcaccgactgcaccgactgcaccgactgcaccgactgcaccgactgcaccgactgcaccgactgcaccgactgcaccgactgcaccgactgcaccgcaaaaaactcagaaaaatacaaaaactgtttcagtagtcagtgatgatttaaaaacatccacagaaaaaaataaaattattgagagcggaaatgccccttcagtatctaataatgaatggcaaaaaaagttagttctcgttcctccaccaataaagagtacacctcaagctgcaccatcctccgattcttcactcgataaatctaaatttacaactattgatggcgtagagtatgtaaataatgaatatcttgaagatcaagaatttaacattgaaggtaagaagcggttttaccttatgcctgatggtttggggcgcactgaatcagtagagcggaaaaagggtgtaagtcgatcaactttagatcagcttttcaatcgacaaactcaagaccaagactctactgttgttttagcgccgacgtatatgcgtttgtcttcacaagagctagaagcagcttttgaacaagataagtgctttattaaagattataaaaaatcaattaaaacgcttagcaccaataaggaagtaaacttatggccacggaagccattgaaagaaaaatttgaatatgagttggtacagttaaatccttctgttcagcatttaaaagttatgtcttttgcttctagtaatgagaagcctctatattattggccactcgttgtatttttggatgataaaggctgtattctggaaggagtgagtggatttaaaagcaaatcttatccttcgactatgttacagcatgcatcgattcaaggagttttaaaagtaccgccttcagcacattatattatgatgacgcctttatcttctgccgtggatgttacagaaaaagagttaacaaatcagggacaaattcaaatttcggtattacgttaa

SEQ ID NO: 1887 - DNA, 363 bp, Acinetobacter baumannii
cccaaaaaggtgagggatagaattatgcaaataacgattcgtggacatcatttagcaattacaccagctatagaagaaaatattaaagcaaaatttaatcagttaacgaaacatcttgatcaggtgaatagtatgcagattaaattaacgaaagatcatcagattgataagcgctcacataagggtagctctaatcatgtggctgaagcgatagttcgattacctggaattgagctgtttgctcaagcaacagcggatgatatgtatacttcaataaaaaaactgactgaaaaattaaaaaaacaattgttaaaatatcggaaaatgcaatgtacgtattctcaagttgctgtttctatttaa

SEQ ID NO: 1888 - DNA, 1227 bp, Acinetobacter baumannii
ataaattgggtgggaagaaatatggataatcgatggattaaaatgagtgttttggccttaagtatgagtgccattacagggacaatctatgctgaggatcaggtacaacaaacacaggtagaatcatcaaatcagagcacagaggcaggagttgaggtaaattctctagctactgaagcgacaaactcttcttctgttagtacagatgcgggaacacaagcttctgagacatcatctacagagaatgtacctgaaaataatagcggggcaaatcaagctgctagcgccctgcaaaagaaagaaggtgatgcaagtcaagagacaaatctacaagaagtatttacttcaaatgaacgccaatattctttaattaaaaagggtgtaatttcctcttattatgatctcgattatacctattatcgtgatacaagaattgatttggcattagatagtagttctacccgtttaaacagattacgggttgaagaagatgcaaaccatactttgactaatagcttcacagtccagtatggggtactagataacttaactttatcagcaactttaccttttgttgcgaagtctgaaattattcgggatacaacaaccgcaggattgggcgatatttcattaggggcgcgttgggaaccttttcctttaaaacaaggccgtctacctttagttctttttggtagcttatcaacgaagactggtgatagtccgtatgaaattggtttagatgagctttcaacaggtaaaggatattattctgtaggtgtcggcgctagtacccgtaaatatattgacccagttgttttatttgcatcagcctcggcaaattacggatttaaggaaactggtttaaatcaaaacagagggggaggtgatgatgaaaccggtcctcgtattttaaaaagttttgatccagggattagcggcggtttttctttcggttttgcatattcatttaactatgatgtgtctttaacaatgtcgtatcagcaaagcttcaatatggatgccgaattccagtttgaaaatggggaaaactataaatcacccgatcaaagtagcgcgatgttgtcttttgctttaggtgttcgcgtttctcctgagactattgttaatggtacggttggaattggtttaactgaagatgcgccagatatttcacttggcttgtcattcccgttagatattttaggttttaataaaaaacaaaaataa

SEQ ID NO: 1889 - DNA, 198 bp, Acinetobacter baumannii
tttacctgctcaccttaccgatcattttgtatagtacccgaccagtcgtacaacaaagatagtaatgtagagttaaattctctatttatcctaaatagagaagatctatggcctactcccttagatcattctaatttaaaacgtcacttcatgacgccgagcgtatttcactggattaaatttaagaatgcgaaatga

SEQ ID NO: 1890 - DNA, 1722 bp, Acinetobacter baumannii
tacgcgcgattattttgtcgcgtcttgcgatgtattggtttttcaattgaggagtcctgcgtggcccaatatatttatacgatgaaccgagtgtctaagatggttccgccaaagcgcgaaatcttaaaagacatctctttatcatttttcccgggtgccaaaattggtgttctcggtttgaacggtgcgggtaagtctaccttgcttcgtattatggctggcgtagataaagatttctctggtgaagctcgtgcacaacctggaattaaaatcggctatttagagcaagaaccgccacttgatccgactaaagacgttcgtggtaacgttgaagatggtgtgcgtgaagctttagatgctttagagcgtcttgatcaggtatttgcagaatatgcagacccagatgctgattttgatgcgcttgcaaaagagcaggaaaaattagaatcaattatccatgcttgggatgcacataacctaaacaaccagcttgaaatcgcggcagatgccttgaaccttccagcttgggatgcagatgtaactaagctttctggtggtgaacgccgtcgtgtagcactttgccgtttattgctctctaaaccagatatgttgcttcttgacgaaccaacgaatcatttggatgcagagtctgtatcttggttagagcgattcttaaaagatttccctggcacaatcgtggcgattacgcacgaccgttatttcttagataacgttgccgagtggatcttggagcttgaccgtggacacggtattccttaccaaggtaactacacttcttggttggagcaaaaaaatgctcgcttagaacaagagcagaaacaagaagaatcttttgctaaagcattgaaaaaagaacttgaatgggttcgtcaaaatgcgaaaggtcagcaaaagaaaaacaaagcgcgtatggagcgttttgaagagcttaactcacgcgaattccaacagcgtaatgagacctctgaaatctatattccacctggtccacgtttaggtaacaaggttgttgaagtagaaaatatcagcaagtcatttggtgatcgtttactttacgaaaacttgtcatttaccgtaccaccagcagcaattgtaggtattgttggtcctaacggtgccggtaaaacgactttattccgtatgatgacaggtgagcaaaaacctgacaccggtactgtaacacttggtgattcagttaaagttgcttatgttggtcagattcgtgacactttagatgataacaaaacggtttgggaagaagtttctggcggtttagacatcttgaaagtgggcgattatgaaattgcatcacgtgcttatattggtcgttttaactttaaaggccaagatcagcaaaaacgcgtaggtgaattgtcaggtggtgagcgtaaccgtttacaacttgcgaaaattttacagcaaggtgcaaacgttatcttactggatgagccatcaaacgacttggacgtagaaactttacgtgcacttgaagatgcaattttggtattcccgggtacagtcatggttgtatcgcatgaccgttggttccttgaccgtattgcgactcatatcttgtcatttgaagatgaacaaccagagttctatacaggtaactataccgagtttgaagcttatcgccgtgctaagctaggtgatgacgctcagcctcatcgcaagaaatacaaaaaaattagcggttaa

SEQ ID NO: 1891 - DNA, 1941 bp, Acinetobacter baumannii
ataataagattcagctactatttgctttgccgcttttgccgatgtctatttgtatttattaaaaatggagcaccctttggggtggaactctctatgagcaaaacttttgccgaattttctttgcacgaaaccttacaacaagctcttgaaggtttaggttttactaacccaactcctgtgcaagaacaatctattcctgctgctttagaaggtaaagaccttcttgtttctagccagactggttctggtaaaactgctgcatttttattaccgacattacataatttggcaggtcaagatactttcgttccgttcaaagaacgtatgaaagcagtgactcagcctagcattttagttttatgcccaacacgtgaattggctcaacaagttagccaagacgcaattgcttttgtacgtcacatgaaaggtgttcgtattgctgcaattatgggtggtatgccttttggtaaacaaattcaacagcttaaaggtgctcaagttgtagttgcgactccaggtcgtttattagacttagttaaccgtcgtcaattaaagctagacaaagttgatgctttaatcgtggacgaagctgaccgtatgttagaccttggtttctctgaagacttagaagcgatcagtgacttggctgcgaatcgtggtcaaacgttaatgttctctgcaacttttgctgaccgtattattcgtcttgctgagcgcatgatgaatgaacctgagcgtattgcaattgaaactggtcacagcaccaatactgacatcacccaaactttacactggacagatggtttcgaacacaagaagaaacttctgactcactggttggctgatgaaacgcttgaccaagctgttgtattcgcgagcacacaagaagatacagatatgttggctgaagaacttgcagaagcaggtcattcagttgttgcacttcacggtgcaatgccgcaaacagttcgtaaccgtcgtttacgtagtatccgtgaaggccgtgcgaaaatcttagttgctactgacgttgctgcacgtggtcttgacgttccaacaatttcacacgttattaacttcggcttaccaatgaagcatgaagattatgtacaccgtattggtcgtacaggtcgtgctggtcgtacaggtcaagcgattactttagcgacttatcgtgaacgcggtaaaatccgtgcgcttgaagattacttagaagctcgtttaaatgtttctgaaattgaaggtttagagccatctccacctccagctcgtccacgtcgtgaaggcggtcgtggtggtaacggtggtcgtgatggtcgtcgtggtggcggtttcggcggtggtcgtcgtttcgagggtgaaggcaacttcaaacgtcgtgaaggtggtcgtgatgatcgtccacgtcgtagctttgatgataagcctcgtggtgagcgtcctgctttcggtggcgaagatcgtccacgtcgcgagttcaactcagaccgtccacgtcgtgaaggtggttttgaagaccgtccaaaacgtagcttcggtggtgaagatcgtccacgtcgcgagttcaactcagaccgtccacgtcgtgaaggtggttttgaagaccgtccaaaacgtagcttcggtggtgaagatcgtccgcgtcgcgaattcaactcagatcgtccacgccgtgaaggtggttttaacgataagcctcgttttgattcaaatgatgacaatcgtggtaaccgcgtagactataaaccacgtcgtgaaaacggtttcggtgaccgtccacaacgtagctttggtggtgaagatcgtccacgtcgtgaaggcggttttggtgatcgtccaaaacgtagcttcggtggtgaagatcgtccacgtcgcgcagttcgcgaagaacactttaatcaagaatctcgtggtgagcgccgtcgtaaattcgaccgttaa

SEQ ID NO: 1892 - DNA, 2199 bp, Acinetobacter baumannii
ttctcattatcaaatttactttttgcgctgtttaggcctcccatgactcaacgctttgctttttcaacttcaaaaactttgttagcagttactatttttacttcaatgacaacaagtcatgctgaagaaccggcagaacagcaaaattcaaccaatgtgttacccactatttctattcaagcacaaaaagaaaatcccacttcttatgtcgcaacaaaagcaaattcagctttaaaatcagatgcacctctatttaaaactgctcaatcagtttctgtcgtcacccgtgaacaacttgaccaaaaacaagcaagaactttagcagatgcacttgaaggtgttgcaggcgtagaagctgggaaacttggtcgtcgtggttgggacgactttattattcgagggcaaacttcttctgactcggtgtatgtcgatggtttaagggtaggccaaaatacttatgttgccactgaactatctggtatggatcaggtacaaattttaaaaggtcctgcttctattaatttcggtttagttgctccgggtggtatggtcaatttagtgactaaaagaccagaagcagaaagctttgcacgtgctagcatgacttatggtagttacagccttaaagaaggaacattcgatttaaactacagcccaaacaatagtgaaaaaggtgctttccgtttaaatggacgtatctctgatcaagatgatccgaccgattatgtttattttaaaaatttttatatctcgccttcttataattttgacctcggtgataacactgacctctctgtaatcgcaagctatcaacaccgtgaatatattcgtcagcaaggtttacctgtaattggtacattaaaagacaaccctaacggacctatagatcgtagtttatatattggcgaccctaatttcggtaaatatgaggcagatgtttatcgtactggttatacgtttaaacatacttttgataatggctggaactttaaccagaattttgccgtacaaaaaactgaaatggatggcaaagcagtttttgctcgtacaggtagtaacttttgggcaaaagataaacaaggtgaaattgattacacgactatcagccgtaaaaataacagccgacaccaagttattgataacttaagcttcgccatcgataaccgtttaaataaacagtttgatctatatggcatgcagcacgacattaatattggagtcgatgcttttcaggaaaaaagtgattacaccaatgataaatatgatattggtgatttaaatatctataaccctgtctatggtcagaacgtgacattgaagcaaaatgtacgtgatatcaaccgtctcaaatatctggggctttatttacgcgaccgtattcagcttaatgatcaattacttttaagcttatcaggacgtcaagattgggcacaaacccaaactacaagtttagtaactggcaatgcgagtaaacaatcagataatgcatttacgggcagtgcttctgtcatgtataccctcaatgacattgtggcaccttatgtgagctacgctacatcatttactccaaatagtggtactgacgtaaatagcaacccatttaagccagaaaaaggaaaacaggttgaggtcgggatgaaattacaaagtcccgatcaaagaatccaaggtgctatcgcttggtatgatctaaaacgtcagaatgttttggttactgatactgcgaataatggctataaagtacaacgtggtgaacagttaactcgcggtattgaaactgaacttagtgcagaaattttagaaggtttaaaattaacggctgcatatacctacacaattgatgcagaaattagtaaagatgcaaatgcaagcaatgtagggaaagcgctcgacaatattcctgaacacgcttatagcttatcagctcgttacaaatttaatccatcatcaaaacttggttggtatgtaggtggaggtttccgaggtgaaacttataaaaccgttgatggtttagatgtgcatgttccgggctatacagtatttgataccgaagcgggctatgatgctgagcgttggggtgcccaacttgcgattcgtaatttatttgataaagattactatgcaggtgctctcaacgaaaatttggtaactctaggcaatccacgccaaattaactttactgtgaaatttaactattaa

SEQ ID NO: 1893 - DNA, 231 bp, Acinetobacter baumannii
tatcaattatcgcatttatatttggggattactcccatgtacgtttgcttgtgtcgtggcattaccgatcaggatattaaagacgctattgaaaatggcgctgaaagctatcgtgaaattcgcgatttgcttgatcttggtacttgctgtggacgctgtgcaccagaagcacgtgctattattagtgaagaattagcagaaattgctgctcgcatttctgtagctgcataa

SEQ ID NO: 1894 - DNA, 1452 bp, Acinetobacter baumannii
tgcccaacatcatacggtagatgctgcttaccctgcacaataggaaaaattatgcatacttcaaccaccagtaccgtgcctttggaaccgtggacagctcaacaattacaacaggcaacacagggttactggcataaagaccagatccctcaaactgaaattaaacgtattttgactgactcgcgtcatgcagaaagtggggatgcctttttagcactaaaaggtgaacgtttcgacgcgcataattttgtcgcgcaagtggctgcaaatggttgccaagtcgctattgtcgagcggcctatagatgcagaaattgctcagcttgtcgttgccgatacccgtttggctttagggcaacttggtgcgtatcgccgtgaacaaaatgctcaattgaaagtaattgctttaacgggtagtagtggtaaaaccaccaccaaagaaatgctaggaagtattttgtctcgtttagcacctacattgattacccgaggcaatttaaataatgaccttggcgtgccgatgatgttgcttgagcttcgaaaggagcatcagtatgcggtgatggaacttggtgcaaatcatcaaggtgaaattgattacacatcaaaacttgttcaaccgcatgttgctggcattttaaatattggaactgctcatttgggtgagttcggcgggcgtgatggcatttgccgtgctaaatcagaaatctatcgtcatattttacctcagggcgttgctattgttccgcaacaagatgactttaccgctgagattcgtgaagcagccaaaagccatcaaatcatgagctttggtgctggtggtgatgtctttgctacagagattgaattgttgccacaatctgccaatttccagttacatacgcctcaaggttcaagttttgtaagactgccatttgcgggtgagcacaatgtgcaaaacgcaactgcagcagtagcatttgctttggcgttaggtgttagcttggaagatatcgtaaaaggtctagagcaagcacaaggtgcaaaaggtcgtttgaattttattcaaaaagcgcctcatttatttattgatgatacttataacgccaatccaacatctatgcgtgctgcggcacaagtattacttcagcaaaatggcattaaagtcatggtgatgggggatattggggagttaggtgatagcagttggcaagaacatcacgatttaggtcgcgatcttgctgagcttcctttagaccatattattgcagttgggcagtttgcctcagcagctcttgaaggcgcaggtcttcattctactaaattgaaagcatttcagactcaagctgaggcgcttccatttttaatcaatctaatccaaacacatcaaccccagtccatgagtttcctgtttaaaggttctcgctttactcatatggaaacgttgatggctgatttgatggagaaactttaa

SEQ ID NO: 1895 - DNA, 1980 bp, Acinetobacter baumannii
catggaggatttatgccttccaaacaagcgagttggttcgcaaatgttaatcccaatgtctttttgggtacggtcattattattgctttgttcttagcagttgttgtgatcgctccgagttcttttgaacttctcacgcaacagttaaagcagtggatcactgattcttttagttggttctatgtcttatcggttgccttctttcttatcctactcatttatattgcctgttctgcgattggacgtattaaattaggccctgaccatagccagcccgaatatagtaacggatcatggtttgccatgttgtttactgcgggtatgggtattggcttaatgttctttggtgtggctgaacctgtcatgcactatgtcaacccaccaagtggtgagccacagacaattgaggcagcacaacaagctttacgtgtaacctttttccactggggcttacatgcatgggcaatttacgccgtggtcggtttagcattagcttattttgcttatcggcataatttaccgctaaaaacccgttcagcactgtatccactgattggtaaaaagatttatggaccgtggggcgacagcatcgatatatttgcgaccattggtacggtatttggtgtagcgacttctctcggatttggtgttacccagattaactctggtttacattatctatttggtattgagcaaagcaccactactcaggttttactcattatttttgtgagtattctcgcttcattatctgtgttcttaggactagataaaggggtcaaacgtttatcagagctaaacttagtattagctttaatattattagtattcgtttttatcgctggccctagtatttatttacttcaaaccactattcaaaacactgggcagtatatctctaacctttttaccatgacattcaatttatatgcttatcagccgaatggatggattgggggatggacgattttatattgggcttggtggatttcttggtcgccatttgtaggtatgtttatcgcaagggtttcacgtggtcgtactattcgagaatttattgtcggggtactcctcattccaacaggctttaccattatctggatgggctttttaggaaatgctgcgttatttagcattatccatgaacatcaaaccactttgattcaggctgttcagcaagactcgtcagttgctctatttgagtttttaggacacttgccatggtcaggtgtcatgaatattctggcgactattttggtggttttattctttgtgacttctgctgactcaggggcattggttactgactacttaacagcaaaaacagaaaattcacctacttggcagcgcctgttctggacagtgcttatggcggtgttggctattattttactcttggtgggcggtcttgcggcgcttcagtcttcaatcattatgagtgcgttgccttttaccgtagtcatgctgctaatgagttggggattaataaaagccttgcatcttgatgtcactaaaatgatagcaattcaagaagctcgcattacaccacgcgccattcataaccctagaagctggcagcagcgccttggtttaatcatgcattatcctcatagtgaagaagaggtgaagcaatatattgaaaagcaggtttcacgtgcttttgaaaatattcagcatgagtttagacgccgtcatcttgaggtgtcgattagtgaagtggaagatggtatgcagcttcgagtcgatcatcatcatgaaattaattttatttataaagttgtttcacgtgaaacagtacctccaagttttttaattggtcgtacagaagcagaagacggtcaatattttcaagctgaggtatttttgagagaaggcggacaaaactatgatgtaatggactggactcaggaagatttgattcaggatattattgatcagtacgaacgtcatttacatttcttaaatatcgtacgcagttaa

SEQ ID NO: 1896 - DNA, 1002 bp, Acinetobacter baumannii
atggctcaatcatttatttctaataaagaacaaggttttaccttgattgaacttatagtcgccttagctttaggcctaatattagtggctgctgcaacacagctatttattggagggcttttatcgagccgattgcaaaaggccaatgctgaaatccaggacagcggtatttttggtttggaatatatggcacgtgatatacggcttctaaattatggaaatgttgtaaatccacaattaacagatacaacgccttggggaggtattgtattaacaggttcaacagcaacaaatgccaacaatattaattttattccaaaagttgatacaaatacttatattccggaagcgttattaagccgtggtgcaggtgatacggtaagtacagtgaataaccactggaaaggtctttcaaatatacagaatagttcaaatgctgaagaacaaagcgatcaactgactattcaattcattgccccgaccaatatgactaattgtgaaggtgtgaatgtgttagcaggggacctaatagttcaacggtattttttacgtgttgataataatggtagctctcaacaggattatgcacttgcatgtgatgcgaatacccctgaggttagtgctacagcgcaacctgatatcgttaatggattaggagatgcagggcaaattatactgcctcggattgaccattttcatgtcttattaggtgcgaaaaacgcagctggtaattttgcttattacacaattcctcagtatcgggtggctgcacaagctgctcgagatgcgagtccagctgtggctgctccaagaattctgtcaatacaaatatcggtattagcccgttctacaaataatgctcaaaataaagcaatagaccctaatcagtcttttcttatgctagatcagactgtgcatgctgccgataacagaactcgctttttgcgacgcgtatatagcgtgacaattgctttacgcaatgcaatgggggaaacactatga

SEQ ID NO: 1897 - DNA, 1407 bp, Acinetobacter baumannii
atgctccaatcgcttttaacactgagttactcaccccattttacaggaagcgtcggtgaaaaccgtattaaaaccgatgctgatagtctcgaaaactggggtaaagatcataccaagcattttaatccgaacccatcggtcatcgtttttccatcaacgactgaacaagttcaggaagttgtgaagcttgcaaaccagtttaatatcgcaattacaccgtcaggtggacgtacaggactttctgctggtgctgtagcaaccaatggtgaaattgtcattagcatggacaaaatgaaccagattcttgagttcttcccggcagaccgtatggttcgtgtacaagctggtgttgtgactgagcaattgcaaaattatgcagaagagcagggtatgtattatccggttgactttgcgtcagcgggttctagtcagattggcggtaatatcggtaccaacgctggtggtattaaagtcattaaatatggcatgacgcgtaactgggtactcggtttaactgtagtgacgggtaagggcgacattttacgtttaaacaaaggcatgattaaaaatgcaactggttatgcattacagcatttgtttattggtggtgaaggtacattaggtttagtgactgaagcagaaattaaacttgagcgtcaaccacaaaacctacaagttttagttttaggtgttcctgattttgatgcagtaatgcctgtgttacatgctttccaaaaagatatcgacttaactgcatttgagttctttggtgagcttgcaatgcaaaaagtactcgaccgtggtcatgttcaacgtccatttgaaactcaatgtccattctatgtattgcttgagtttgaagcgccatacgaaccgattatcgacaaagcaatggagattttcgagcactgtatggaacaaggttgggtacttgatggtgtaatgagccagagccttgaccaagtagagagcttgtggcgtttacgcgaagatatttctgaatcaatcgcgccgtttattccatacaaaaacgatatttcagtattaattactcacgtacctgcatttattcgtgaaattgatgcgattgttcaagaaaactatcctgactttgaaatttgctggttcggccatatcggcgacggtaacttgcacttaaatattttaaaacctgaaaacttaaccaaggatgagttctttgcgaaatgtcaggtggtgaataaatatgtgtttgataccgttaaaaaatacgatggctcaatctctgccgagcatggcgtaggtatgacgaaaaagccatatttggaatattcgcgctcagctgaagaaatcgaatatatgaaagctttgaaaaaagtatttgacccgaaaggtattatgaatccaggtaaattattcgatctttaa

SEQ ID NO: 1898 - DNA, 744 bp, Acinetobacter baumannii
aaaaaacgatcgttcgttttgacaaaacaatcagacttattcattataatggaaaatcgttcgttatatcatgccatgactacatacgctcttattagaaaacttagtaaagatattactcgctcgattttctttgtgtgcttagcaacgagtgtcgttggtatgtccttaggttcactcgccgcaagttatggcttagcgctctggatcccactttgcctgtccatatttgtgctcgcgggaactgctgaatttatttttattggattcttggcggtagggggtagcccgattgcggctgcaattgcaggactactcgtcaatttaagacatctgccttttggcatagcggtcaatgaaatgattcgaggcaaattctctcaatattttgggtctcatatcatgaacgatgaaagcgttttgtttggtatggcacagcctgatttcgaaaccaaaaaggctgcttactggctatgtggtataggcatcatgctcagttggccgctcggtgtcactgctggttattttattgggagcgctattccagaccctaaaacatttggcttagatgcgattttcccagcgattttaattgctcttactttttctgctttaaagaataaggtgactcgtaaagctgcatttgccggatcaactttagcgttgataaccacaccctttttagcctcaggacttccaattctgatttcgctttttggattgatatggggtagaaaaaaatga

SEQ ID NO: 1899 - DNA, 645 bp, Acinetobacter baumannii
acagatctgtctattcatctatttattcgaataaggataataataatgtttgcctcgatgtttcttttttcttttgcaatgtcgattacacccggacccgtcaatacagttattttatcgaccagcttaaatcatggtttaaaaagatcacttccctatatttcaggtgccaccattggctttaccttacttttgatttttatggcttttggccttcaaagtgtattaactcagtttccagttgtcttaaaaattcttgcagtttgtggaacgctctttgtttgttatatcgggattaaaattattctttctgctgcaaatatttctatttccagtgttcctgtagagcaaatgattattcctaattttaaagatgggttcttattacaatggcttaacccaaaagcgtggttggcttgtgtgtcgggtattaccatgtttactagcattgaaaacccgcagtcgttgccgatctttattattatttatttcttcacatgctatgcatgcttgttcttttggggactatgtggcgataaattttcagtggtactgaatcagggcaaccgtttgaaatattttaatatcctgatgggcgctttcttaattttgtcggcacttttaattttgattgattttttttaa

SEQ ID NO: 1900 - DNA, 789 bp, Acinetobacter baumannii
cgaggttcgtccatgaatacgattgcctggttaggtagactcgttattgagcggattcgagggattggtgttgcggcactgatgctcttacagattattttttcattaccttcagcgggcggttttggacgtttcgtctatcaaatgcatcgtgtaggggtaatgtctttactcattatcacggtatcaggcttatttattggtctggtactcggattgcaaggctactcaatattagtcaatgttggtagtgaatcaatgctaggcacaatggtgtctttaactttactgcgtgagcttgcaccggtcgttgcagctttgctcttcgctggacgagcaggttctgcattgactgctgaaattggttcgatgaaacaaagtgaacagcttgccagtatggaaatgattggtgttgatcctttaaagcaaatcgtatcaccacgtctttgggctggtatagtcagtttgccaatgttaaccgttatttttgctgcgattggtattgttggcggtaaattggttggagttgactttcttggcgttgatgaaggctccttttggagtggtatgcaaaataatgttcaatttggccacgatgttgtaaatggcattattaaaagcattgtatttgctttgctgtgtacatggattgctgttttccaagggtatgcatgtgatccgacacctgaaggcattgcaacggcaatgacccgcacggttgtatattcttcattatgtgttttaggttttgatttcgtgttgactgcggtcatgttcggagggatttaa

SEQ ID NO: 1901 - DNA, 870 bp, Acinetobacter baumannii
agcctaaggtcgaagttgcccctgaactcggttactaaaattgtgaaagcaaaagttcgagcagctctttctcgatttatccctcataaatatgcaattgatgcatcaagtttgggggatagtgaagagcttgcttggacaaacttgggtttttggaaaaatacccaaacctaccgtgaagcttgtcgccaattggctgatcatctggcacaagctgtcaatttaaattcaaaagatcacttactcgatttaggttgtggacagggtgcaagtttattgcactggttacagcactatcatcctaaaagccttagtgctgttgaactacaagcctcatatgttaataaaattcaaaaatttattcctgaaataagtcagattttctgtggttcatttttaaatttaaaacaatttgaatttaaacaatgcttcgatgtggtgctctgtatcgatgcggcttatcacagtcatttaaattcatttttcgattcggttacgccagttttaaattcaaaaggacgattagggtttcactacttgatgcgtgccgactcatgccaaaacatgacagcctttcaagaacaaaagcatcgttatttacttaaagcagccgatgtcacttgggatgccttactcacggaagagatactgagaactaccttggaacaacaaggttttacagatattaaaatcgaagatttatcagaacaggtattattaggtttttcacagtatattcaaaatcaacaagcacaaagccataaccgagggttggcaaattttaaaatccaaatgactgcaaagttatgccaacaactctatcaaaatgggtatgtacgttatattcaaataacagcaataaaaaaatag

SEQ ID NO: 1902 - DNA, 1131 bp, Acinetobacter baumannii
agaattttgttcgtgcatccatacgctcctactttacagcgcgttttattgtttgggctgttttttatcctgatctttttaggatttaacatcctgaagtactttattgtacctgtactttgggctgccattattgcctacatgacttggccgatttatttaagaattcagcatttttttggtgaaaatcgaaataatttaaatgctacagttatgattagcttagtcattttaattgttggtgtgccatttacatgtgctatttttattctacaacatgaaggtcgaaacctttattttgatttacagcgtcaagtcttttcaggtcatttaagcgttcccgattttattcgtaatcttccgtttattggtaaagaaatatctcgcacactcaacgaaattaacacagaccctaatagtactattcaaaatattgcagcttgggtacaaagccatttaagttatgggcgtgtattattaaatgaaattagtaaaaatatcgtcaaactttgttttgcgattttaagccttttcttcttttatcgtgatggccacacgatcttaacccaagtgagtaaagccttggaaatggtgattgggccacgtattcatcattatctcgacacaatttcagaaaccactcgtgccgttgtgtatggcgtgggtttaactgcaattgctcaagcagtactggctggattaagttatttcgtcgctggtgtacctaacccaatggttctcaccattgcaacgttcttattagccctaattccgtttggtactcctgtttcctacttaggcgttggactatggttgttctctcaaggtcaaaccatggaagctattggcgtcatcttatggggtgtgctgattgtaagtagttcagacaacgtgatccgtccgcttgtaatctctggtgcgactcaaattccgtttttattgattatgttcggtgtattgggtggaattgcaagttttggtttagttggtctatttattggccctgttattttagctgttttattagcaatttggcgtgaatggcttcacgagacaattgaccctgaacccatgccaaaaacaaccatgatttatgattcagatgatgatttaccgccatctaaaaactaa

SEQ ID NO: 1903 - DNA, 924 bp, Acinetobacter baumannii
ctttgtgttccagtaaaaatgacgacaaaaaatcaaaaaatttctcgtcgccatatcagtggtgtatttcttttaaataaaccattagggctaagttctaacgctgctttgcaaaaagtgcgttggctttaccgtgcccaaaaggcgggtcatactggtgcattagatccattagcaaccggtttacttcctatttgtttaggagaggccactaaattctcacattacttgctggactcgacaaagcgttatcaaactactgttcgattaggccaaactacaacaacaggtgatgttgaaggcgacattttacaagaacgtcctatcccggttcttagcaaagagcttattgagcaaactttagaaaagtttagtggcgatattcaacaagttccaccgatgtactcggcattaaaaaaagaaggtaagccactatatgagctggccagaaagggtatagagattgagcgtgaagcacgcccagttacgatttatgctttagaactcattgaatttactgaaaatagtatcactttagatgtaacttgttctaaaggaacatatattcgtgtgctaggtgaagatattggtgaggcacttggttgtggtggtcatttaaccatgcttcaccgtattcaaactggacattttgaactcatcccaagttataccattgaatatttggaaagcttaacggaagagcaaagagaagctttgctactgcccgtatatgctccaattgaccatttcttaaaaattcaggttcccgaaggacgggaaaaatatttttgtaatggtctagaaagcaatattgatcattctgcagaagcagaagtgttggttttttcggatgaacgctgtctaggtttagctgaaattaccgataaaaaacggttggtacctaaacgtatcttaaatttgtag

SEQ ID NO: 1904 - DNA, 207 bp, Acinetobacter baumannii
atagagactccggcagggttctttgttttatcaaataatctttttgcaaactcccccatacaagcccaaccagagtctgccgtagtattagataaacctccagaacaattaaaatcagctccaaaagtactacctaaagcagtcgacatgacacttgccgaacgtgtatttgttgtattgttcggttcgccatccgataagaagtaa

SEQ ID NO: 1905 - DNA, 780 bp, Acinetobacter baumannii
ttaataagtccaatcttcttttttaggcttaggaaccaaatcatgactggtatcacatcatcaaaacccttaaatattgttgctgtttctggtggtttgaatacgccatctaaaaccgaaagtctggttcaggccattcttgatgagttatctgaagcaattgatattaaagttcactttattaaattgagtgaaatcggaccgttattaggcggcgcattttatcgcaaccagcttccacagcgcgtacaagatgaccttgcagcggttgaagcagcagatgccttaattgttggtacgcctgtttaccgtgcttcttttacaggccttttcaaacacttttttgacttcgttgaacaaactgcattagtagatgtacctgtacttttagctgcatcaggtggtagtgatcgtcatgcattagtactagagcatcagcttcgcccattgtttagcttctttcaggcgcaaactttaccaattggcgtatacgcaacagatcgcgactttactcctgaatatacggtgaaaagtgaacagttatctgaccgtattacgctagccgtagcgcgtgcattgccaattttagaatgggcgccagcgaaaggtaaacgtgctgaagtggttaaacctaaatctcagcaagcgaatcaagagctcggtattaacaagcaaattgagcaagaagaagtattgccttcagcagctgtaccaaatctcgatgcagcagaatctcgtttgcatcataagtccggtaaatcattaacgcatgttgcctaa

SEQ ID NO: 1906 - DNA, 372 bp, Acinetobacter baumannii
ataaaaatgttatctcaagttgcgactccagatgaatgcctacgctgtggggcatgttgtgcacattttcgggtttcattttactgggctgaagccgagttaatggaagaacatctagttgaacctttgacacctgtctattcatgtatgcgtggaactaatcagcctgagccccgatgtcaggctttgacgggtgaaattggtaaagaggtgggttgttccatatatgcggtgcgtagttctacctgtagagaagtgcagattgcggatgagcagtgtaataaagctcgtttagcgcaccagcttattcctcttattcaagttagcccggcagattcagagaatgatcacgactatgatcaggtgagttaa

SEQ ID NO: 1907 - DNA, 855 bp, Acinetobacter baumannii
agtgagttcccaagctcatatttccttagctatgatgcgattgcgtttatgaaatacctcactaaaagggtatattctttgaaggatatcgcaatgaaaatgatgaaaacagctatcgttactgcaagtgtacttgcttctgcctctatttttgcacaaagtgcgggcgttaatgcaggtgcatctgctcaagtcaacgtacaaccaggtggtcttgttagtggcgtagccaatacagtcaaaaatactgcacatactgtagggaacacagcaaaacatgctggtcacgtagctgctgacacaaccgttaaagctacaaaaaaaacaacaggtaaagtaactgaactttcttctaaagctgctactggcactaaacatgtagcaagtgaagctgtaactggtactaaacattttgctaccgaagcagcaacaggtacaaaaaatttagcgactaaggctgcaactggcactaaaaacctagcagttgaagctaaagcagatacaaaagcgcatcttgatgctgtaaaaactaaggtagcagaaaaacaagctgaccaaaaagaatttactgctgaaaaacaggccgatgctcaagcacgtgtagatgctgttaaagctcgtgtagcacaaaatcaagctgagcaaaaagaattcgttgctgacactaaagctgatgcacaagcaaaattaaatgcagctcaaccggctcatggagttaacgctcaaacaggtgtaaacgttggtgttaatgttgctggtattaatgcaaatgcaaacgtaaatgcaggcgctcaagcgactacacaaaaaggcgaaaagaaatcttttattaaaggtcttttcggtactaactaa

SEQ ID NO: 1908 - DNA, 582 bp, Acinetobacter baumannii
aataagatgtttgccgaaactccctcttcacgtccacctcaactcccgtttaaagacagccctttttcaattcatggtcgctttaaccgaatgagttatttgggtggatatggcctgatttatttagtcacaatcgtgggctattctatactgggttcgtttcttggaaattttcagctctcaagtgatctatttaattttgagttttacagctcgctctccggtataagcgctttaatggtctgggctttctggctatttctgatctatctcaacattattctggtcgttcgacgcctacacgatttaaataaaagtggctggatggggctgctgttatttattccagtcgttcagttcttttttatgctttatttactgcttgcttctggtacagcgggcactaatcaatatggtcctgttcggccttcaacgtttatagaaaaactgatggcttggcttattttaatcgctattttaattagccttatttctacagcaggctttttttactacttctctggtaccgatactattcaaaccccgacacaaatcttacaaaaaggaacggaatacttttaa

SEQ ID NO: 1909 - DNA, 552 bp, Acinetobacter baumannii
cccatgacaccaacacagaatgttcccgaagatcgtattcagattggacagttacgttcagcttatggattaaatgggtggctctgggtgtattccaatacagaacccatgagcaatatgtttgactacttgccttggtacatcgagaccaaggccggttggcaaatcgttgatgtaaaacgttggaaaccacatggcaaaggtctagttgttgctctaaaaggtgtgagtgatcgcacaggagcagaaagcttggttggcgctaatatctggattgctaaatctcaactgccgaaagcagatgtagatgagtactactggtcagatttgaaaggcttaacagtgttaggtcttgatgacgacgaacaggaagtgaacttggggcaaattcatgagttgtttgaaactggagccaatgatgtgatggttgtacgcgctacaccagacagcattgattcagaagaacgcatgatcccgtggcataaagatgtggtgcaacgtgttgatcttgaagctggtcgcatttacgtcaattggggcgtagattattaa

SEQ ID NO: 1910 - DNA, 549 bp, Acinetobacter baumannii
atgtctcagccaatcgaaattattgccaaaggtttaacgcgtgaacgccaaagagcagggctttcattggcagaggttgcgcgccgtgcaggtgttgccaaatctacactttctcaattagaggcagggcaaggtaatccaagtattgaaaccttgtgggcactttgtgttgcactcaatattccatttgcacgtttgatggaagaaccgagcaatcaagtgcaagtcattcgctgtggcgatgggccaacggtgagttcggagattgccaattacaaagcaattttgttggcgacctgtccaccccatgcgcgccgagatgtttatttattgattgttgagccgggcgaagatcgactttcagaaccacatccagttggttcggtagaacatattattgtagtggaagggcgagctttggtgggtttaattgatgaagcggttgagctgggtgttggagactatatttgttatccagccgatcaaaaacatatatttagagctttggaaacaggcacaaaagcgttgttaatctctgaacaaaactaa

SEQ ID NO: 1911 - DNA, 2721 bp, Acinetobacter baumannii
attatggcgttttacggtgactccgacgcacaagaaacccaagaatggcaagatgcattcgattcagttttacaacacatgggaactgagcgagcggcattcttgttggaaaaactttaccaacaagcaattgctaagcatgttccaattcaacgtctcaatacaccttacttaaatacaatttctgttgaagagcaacctgcaatgccaggcgaccaagatatggaacgccgtattcgtgcattgattcgttggaatgccttagcaatggtacttcgcgcgaataaaacaggtgatgatttaggtggtcacttggcgagcttcgcatcaagtgcaacattatatgacgtaggttttaaccatttcttccgcgctaacagtgataactttggcggagatatgatttattaccaaggacactgtgctcctggtatttatgcacgttcattccttgaaggacgtttaactgaagaacagttaagtaatttccgccgtgaagttggcggtaacggtttaccaagctatccacatccatatttaatgcctgactattggcaattcccaactgtatcaatgggtcttggtccaatcatgtcgatttatcaagcgcacattcaaaaatatttgatgaaccgtggcttgatcaaagaagaagatcgtaaagtttgggcatatctcggcgatggcgagatggatgagccagaaagcttaggcgcgatctcactagctggtcgtgagaagcttgataacttaatttgggtagttaactgtaacttacagcgtctagatggtcctgtacgtggtaacggtaaaattattcaagaacttgaatcaatcttccgtggcgcaggctggcgtgtcattaaagtagtatggggtcgtcattgggatccattactagctaaagacacaagtggcgcattaaaagcacgtatggaagaagctgttgatggcgactatcagcgctatcaggtaaaaggcggcgcatatacacgcgaaaaattctttggtaagtaccctgaagctgcggaacttgtaaaagatttaagcgatgaagatatcgataatcttaaccgtggtggtcatgacccttacaaggtttttgctgcatatgcagaagcgatgaaggcaaaaggtcaaccaacagtaatcttggcgaaaaccattaaaggttacggtttatctgaagaaattgaagcggtgaacaaaactcaccaaatcaaaaagatgcaaattgactctttaagatatgtacgtgaccgtttcaatcttccattcacagatgagcaattagaagagcttccattctatcgcccaagtgaaaactctccagaaatgaaatatatgaaagcgcgtcgtgaagcgttaggtggttacttacctgcacgtcgtcgtgagagtgaatctttagcgattcctgatctatctgtgtttgatgcagtgttgaaaggttcgggtggcaaagagcaatcaaccactatggtgatggttcgtttaattgctgctttacttaaagaaaaagcaattaaagaccgcgtagtgccaatcgttccggatgaagcacgtacttttggtttagagggtatgttccgtcagcttggtatttatgctgcacacggtcaaaaatatacaccggaagaccaagagcagttaatgcattaccgtgaagcaaaagacggtcacatgttacaagaagggattaacgaagcaggtgcgatgagtgcatgggctgcgttagcgacaagttattcaaccaataacttgccaatgattccaatgtacatgtactactcaatgtttggtttccaacgtattggtgatattgcatgggctgcgggtgacgcacaagctcaaggtttcttgttaggtgcgactgctggccgtacaacattgaacggtgaaggcttacagcaccaagacggtcattctcacatcttggcgaacacgattccaaactgcgtatcttatgacccatgttttggttatgagttggctgtcatcgtacatgacggtttacaacgtatgtatgtgaaccaagagcgtgtgttctattacttaactgtaatgaatgaaaactacgagcatcctgcaatgccagaaggcgttgaagaaggcattaaacgtggtatgtatttattcgagaaagatgaaaaagcaactgttcagttacttggttcaggtgtaatccttcgcgaagtgattaaagctgcgaaaatcttacgtgatgaataccaaatccattcaaacgtttggagtgtaacaagcttcaatgaattggcacgtgatggtatggcatgtgaagaatacaaccgcctacacccacttgctgaagaagttaaagaatcttgggtatctaaacaattacgtggtacggaaggtatcgtagtttctgctaccgaccatatgcgtgcttacagtgaacaaatccgtgcgtatcttccagatggtcgcccatttgttgcattgggtacagatggttacggccgttcagatacacgtgcgaacttacgtagtttctttggtgttgatgctgcgcacatcgttgttgctaccttgaaaaaattagctgacgaaggtgaagtagacgcacgtttagtgaaagacgcaatttctaactttgagctagatactgaccgtccggttgcatgggcaccgcaagcacatccggaagttcagccagttgctgaatacaatgaaacgcaaacaggtgaggggaactaa

SEQ ID NO: 1912 - DNA, 789 bp, Acinetobacter baumannii
aacttggctttatttttgcaaagatcaaaccaacattctaacaacaataggtttaagcgcatgaagtcgcatttacgtgttcactattttcaacatattgctggcgaaggttttggaagctgctattcattcttaaaagcacaccatgcaacgataacagctacagagttttttgcacttccagttgatctccctttggaaatagaagcattgccacatattgaagatgtggatttgctacttattatggggggaactatgagtgtaaatgatgaggcaaattatccatggttaaaaatagaaaaaagatggatacgtcgttatttggcggcgggaaagcctgcgataggactttgtctcggaggccaacttattgccaatgcactaggagccgccgttagtagaaaccgttatcaagaattgggatggtcgaccgtacaaagggtgccgaatttacctaaagaaagctttttattaccagaaaaaataaatgtaatgcagtggcatagtgaaacttttgagattcctaaaggtgcgattcatttagcagagaactcagtttgtcgtaaccagatgtaccaaattggttcaaatgttcttggttttcaatttcatccagaaatgacacccaaggtattaaatcttcttttagagaacgaacaagagctttctatttttaaaggtgagtatgttcaatctttagatgaactacatcattgcgatattcaaaagtttgaacaaggcaatcaacttttaaacagggcaatagagttcgtggtcaatcaataa

SEQ ID NO: 1913 - DNA, 702 bp, Acinetobacter baumannii
caaatgcagttcgttcacaggcacaagtcgcataaggtgtatggcatgagtgatgtcattaaagacttaagtgaattgcgcttaagctatgaacaaggtgagttgtacgagactcaagttgctagcaatccccacgagcaatttctaggttggtttaatcatgctttagcagctaacttgcatgaaccgtatgcaatgtcattagcaactgcgagtgctagtggtcgtccgcatgtcagaactgtgttgttacgcggtgcgacagaagcaggttatgatttctataccaactatgacagtcaaaaaggtatagatttggcagaaaatccatatgctgaattgttattttattggccaagtctagagcgtcaggtacgagtaggtgggcatgttgtaaaaattcctgaacaggaatctacagactactatcataaacgtccacgtgatagccagattgcagctcatatcagtactcctcaaagtggcaaaattgaaagtcgcgaattgttacaacagcgttttcaagacttgcaacaacaagttcaaagccacgaagtactcgataagccggagttctggggtggataccgtctacagccggattattatgaattctggcaagggcgaccaaatcgtttacatgaccgcttgagttatgaaaaaatcgacggtcaatggacgttgcaccgactgatgccttaa

SEQ ID NO: 1914 - DNA, 210 bp, Acinetobacter baumannii
atatattttactcaatttgctatcgcgacggcggcacggatgccgcctgtttcactgcgttacatggaagtaacgtcagtgaaacgaatgagttttgtcacttttgctcactcaaaagtgaggcattacctacacaactacaacttgagtgaacgctgtatttgcggtcgtgcagttaatccttatccccagcaaccactttataaataa

SEQ ID NO: 1915 - DNA, 1455 bp, Acinetobacter baumannii
attgtcgttacagttttttatatgcaatcattaaattatcggaataatgatgcatcgcaacatggaagttctgcacctttgaaacgagcaatgagtactcgacatttggtgatgatctcccttggcggtgccataggtacaggtctttttcttgggtctggcgacgtaatctctcaagcaggtccaattggcgcaattatctcttatttcttgggcggtctaattgcctataccgttatgctgtgtctcggtgagctagcggttcatgtccctgagtctggctcttttggtgaatacgcacggcgttatatcggtccaggtacggggtatatgattacttggctatattggctgacttggactgcaactttggggactgagtttaccgctgcggccctgttggttcaggagtggtttccatctacctcggtgtgggcttggactcttttctttggcgccttggttttctttcttaatgtaagttcaacccgcttatttgcagagtctgaattttggttggcgcttgtaaaagtaatcaccattatctgttttattggtttggggctgcttgcaattttcggctttattccttatcaggggcatgaaacagcaccattgttcagtaatttgactgctcatggttggttcccaaatggtcttttcccaatttttgccactatgctcatcgttaattttgctttttctggcacagaattaattggggtggcggctggcgaagctgagaatccggcaaaaacagttcctaaggcaattaatgcggctatctggcgcttattgattttctttgttggtacgattgtagtgattagttcactattgccataccacctagcaggtcttagtgcaaatgatgtgagcagtagtccatttgtgactgtatttaattacattggtattccttatgcagaggatattatccgttttgtaattattacagctttactatcagctgctaactcgggtttatttgctgcatcacgtatgatgtggtcactttcagcaaaaaatcaattacctaaaatttttgcgaaactcacgccgtctggaacacctattattgccattattgtgacaatgtttggtgctattccggggttgctttcagaacaatttgcaccagaaacaatttttaaaaatttgttaggtgttgctgcttttacaatggttgtcgtttggattgcaatttgtatttcgcaatttaacttccgtagacagtggtataagtcaggaaaaacagtaaaagatctacgtttcgctgcaccactttttcctcttactccaattgtaggcgggctattctgtatagttacttgtatcagtatggtatttgatccttctatgcaagtgggctttatctgctgcattatttttatcttgctatgctatgtcagctatttcatcttttatcgtaaaaaagatatagctcaaaactaa

SEQ ID NO: 1916 - DNA, 960 bp, Acinetobacter baumannii
tgtgcagttacatttttacgctatgatttaactcctatgtcgcatatttctgtcttactttttgagaccgttgaaagcttattggcagatcgcacaactggggtgtatatcgatgcaacctttggacgaggtgggcatacgcgcttgttattgtcgaaactcgatgaaaacgcccgagtatatgcttttgataaagaccctcaagctctggaagttgcgactgctttagcacaagaagatccaagatttacgattattcatgcaagttttgctgatattaaggaaaaaatgcaggaaattggggtgcaaagtgtcgatggaattatggcagacttaggtgtgtcctctcctcaactcgaccaggctgaacgcggctttagctttatgcaagatggcccgttagatatgcgtatggataactctaaggggttgacggctgccgaatggttacttgaggttgaagaggaagatttggcaaatatcatttatcaatatggtgaagaacgatatagtcgccgtattgctagagcaattaaacaggccggaaaattggatactacggcgcaattggctgaaatagtaaaaacagcccatccaaaatgggaaaagcataaacatccggcgacacgtacgtttcaggcaatccgtattgctattaacaaagaactagatgatattgaagtatttttaccgcaagctgtagacttacttaaaccaaaagggcgtttgtctgtgatcagcttccattcgcttgaagatcggttgatcaaacagtttattcaaaaagaatcaactctagcagaagattctggttgggggatgcctcaacagcaggttgatacgagaagattaaagaaaatttcacgggttcgtgcgagtgaagaagaagtaaaagcgaatccacgttcacgtagtgcatggcttcgggttgctgaacgcttggaacaaaaaggcgcgtaa

SEQ ID NO: 1917 - DNA, 645 bp, Acinetobacter baumannii
cgttatcgtacgtcctaccatcaaggcctgaggggaaataccgtgaatttaaaaactgtttccggctctgctgttgaattgtctgaagtagctttcggacgtgaatttaacgaagctcttgtacaccaagttgttactgcttacttagcaggtggtcgtcaaggtactcgtgctcacaaatcacgtgcagacgtttctggcggtggtaaaaaaccattccgtcaaaaaggtactggtcgcgctcgtgcgggttctattcgtagcccaatctgggttggtggtggtaaaacttttgctgctcgtccacaagattggtctcaaaaagtaaaccgtaaaatgtatcgcggtgcaatgcaatgtatcttagctgaacttgttcgccaagatcgccttgttttagttgaagagttcgctgttgctgctccaaaaactaaagaattgcttgcaaaacttaacgatttaaatgcagctcgtgctttgatcgttacagatgctgtagatgagaacttatatcttgcagcgcgcaaccttccacacgttgatgtggtagatgcaactgcaatcgatcctgtaagcttgatcgcgtttgataaagttgtgatgtctgtagctgctgctaagaaaattgaggtagaactcggatga

SEQ ID NO: 1918 - DNA, 1230 bp, Acinetobacter baumannii
caggttttcacatttactgtgcctgacttttcgataggacgctttatgaatcgatctctatttattatctttgcaactattgctttagatgctattggtatcggtcttatttttccgattcttcctttattattacaagatatgacgcatagcactcatatttctatatatatgggtatgttggccagtctctatgcggccatgcaatttatcttctctcctttattaggtgcgttaagtgacagatgggggcgtagaccggtcttgcttatttcactggctgggtcagcagttaattatctctttctaactttttcacatagcctaattttattgctagtaggtcgcattattgctggaatcaccagtgccaacatggctgttgcaagtgcttatattgtcgatgttttgcacgaaaataaccgcgcaaaatattttggtttaatcaatgctatgtttggtgcaggcttcattattggccctgtattgggcggattcttgagtgaatatggattaagacttcctttctttgcggcagctatattgacagggcttaatcttttatctgcctattttgttttgcctgaatcccgaaaagtgactttggagaacaaacaattatctacattaaacccttttaaaatatttgctggtattagctctattcgtggtgtacttccacttattacgaccttttttatctttagtgccataggggaggtatatggagtctgctgggcattatggggacatgacacatttcagtggagcggtttctgggtaggtctttctctaggcgcatttggtctatgtcaaatgctggtacaggctcttattccgagtcatgcttcaagattgctgggtaatcgtaatgctgtgctggctggtattgcttgttcttgttttgctttagcagtaatggctttcgcccaaagtggttggatgatttttgctattatgcctatttttgcgctagggagtatggggacaccttcattacaagccttagcttctcaaaaggtttctgctgaccagcaaggacagtttcagggagtgatagcatctacggtaagtatggcctctatgattgcccctatgtttttctccactctttattttcagtttcaggaaaaatggccgggagcaatttggttgagcgtgattttgatttacctgctcaccttaccgatcattttgtatagtacccgaccagtcgtacaacaaagatag

SEQ ID NO: 1919 - DNA, 3888 bp, Acinetobacter baumannii
aatcacggcaccaggttcataatggggaatatcatgaaactaaaattgaagaattttaagccaaataatttatggtatgccgtctgttcaagctcaatgatattcacatggctgatgacaagctctgtggtgcaggcaagtgatttacaaatttatgcctcacctacagcaggtaaaaaaacaattgtgatgatgttggatacatcaggaagtatgaccaacaatagttatggtgaaaaccgcttagccatgcttaaaaatggtatgaatgcttttttggctagcaataaccctgtcttaaatgatacgcgagtaggtttaggaaatttctcggcaaatggtgacagccgaagtggacaaattttagtggctgctgctcctttaggtgatgcaagtactttaaatacggtaggctcacaacgttataaattaaaacaagctgttgctaatttaactgcgggaggctcaacaccttcagcccacgcttatgctgaagcagctgcttacttaatggggacaactacatattcagagacgaattatgctattcgtaaagatagttatatcaaacgtgtaagaagatctgataatagaactgaatattcatattgtactaattaccgtgattcgcaaattgatacagccaacctatggcaaccttgtcgttcaaatagttattggagtagctggtcaacaaataatccaggtgtggataatgctactgcttatgatacttcatctgactggacttattactatacttattactacaccacttttaattatgctgtagcaaatgcagatagcggtattccaaaatctaaatcaaatgatacagctagcaatccgaatattgttgtagaccgaaatgctactaactccaatgcagtgtatcagtcacctttacctgcagtagcgaatcgccagagttgtgatgggcaaggtatttacttcttatcggatggcgaaccgaacaatacaacaaatacacgttcggcaagtgtcatgtcgactgctttaggtagtacttttggagctgattttaattgttctggaggtttatctaatactacggcagactctggttgggcttgtatgggggagtttgcaaaaagattatttgataaaacaaagaaccctgccggagtctctattcaaacagcatttgtcggttttggtagtgacttttctagtttgagttcttctgatgtaaaaaatgcctgccgtttaagttcgagaacccagtctgaccgaaaaggagatgatgcgtgttcaccgaatcaatctacaaatgcggtagctgcaccaggttatggaaatggtggttttttccctactcagagttcacaaggcgtaacagacagcgttatcgcatttattaataatttagataaagttcctttagaacccttaaccacaggtgctatctcagttccatatgatgcattgaatcccaaaaatttacaggaatatggttatttacgagcttttgagccaaatccagctaacacgtacttaacatggcgtggaaatttaaagaaatatcatgttgttttatctggagcgaatgcaggtgcttttgaggccaattctggcggattagtctacaatgcaagtggggcttttaggactggaacaaaggattattggaatagctctacttatactgacggaggcaaagtctttttaggtggttcatatgcgaatgtgcctttacccattgctggacaacctgaaacacgtgatgcagaaggaaatatcacaaaatattattacgcagtacaaagtaaaatccgcaacttatttactgatgtttccgccgttgcagcagatggtagcttaacgaaaatttcaacttctggaactaatttgctaaaaattccagctgttccaccagaaggaactaatccttttgatacggtggctaatacagcaagttatgttttaggtaaatttgatccatcaactggacaaaatattttaaaagcttttcctataagcttgaaattaaaaatattaaattatttaggttattcaacagatattaatgcaacaactctgccttcatctttggttacatcgaatgaaccttatttatcgatggggggaagtattcactctttaccggttcaactaacctacaatggaacactagatgataatgggaatttaacatctgcccgagaacaatccatcctctatggaaccatggaaggcggattacatattgtggatgcttcatctggtattgagcaaatggtctttgttcctgcagatattttaaatgattcagttgcttccaaagctttagttgttggtcaaagtgatgcttcagctcccgctcatggtatggacggagcttgggtatctgatccagcctataatattactacagtgggaagtggtagctcggcagtatcaaaagtaactgcaaagcaaatgaatatttatggcggcatgcgtatgggaggaagtagctactacggactagatgtattaagccctacttcaccgaaactgctttttagaataggggcagaccagactgactatagccgtatgggtcaaagctggtctaaacccgtactcgcgaacatccgttataacggttctattagacgcgtcctgattgttggcggtggttatgatcagtgttatgaaaaaccaaatattacgttgactgacgcttgctttaccaatggaaaagcaaaaggaaatgctgtctatattattgacgcaaaaactggtcagcgtttgtggtggacaagtgatacaggttctaatactgataacgccaatatgaagcatagtattgttagccgtattagtactttagaccgtgatgctgatggcttagtcgaccatctatattttggagatttaggcggacaaatttttcgcgtggaccttaataataatcagacaaaaaccaattcgacctatagcagttttggtgtcagagttgtgcgtttagcgaatttagcaacaaatgattcaacttatgatggcacaaatgattatacaggtgggaatgttcgtcgtttaatggagcttcccacagtaacgatccacgattatggaattcacacttttattacagtaggtattgcatcaggagaccgtagtacacctttagacgtttacccactcacaggccgtgaaggtatgctgcctgcaagtgcattaagtggacgtcctgtaaataatgtatatggaattattgatagagactttgttaaaaagaacttaatgtctttaactgataatcagcttgaaacaaaagatattacacggacaggcttaagaaaaaatcctcaaattctaagaacaggtgaaacaagagtagctcaaattttcttcccaactacaggagtaggtaaaggtggttggtatcgctcgctttctagtacgagcgatggtacagaaaaagctaataatagttttcgtattaaaggaggactcaaagcttttgaggaaccaatggcaattacgggtaatttaattattccagtttatgaccctcaaggaacgggaattgttgcggcagatccttgcctacctcgtgttgtgggagaaacagaccgacaaacttattgtttaccatttggagcttgtcttaattctgatgggtcaatcgatcaaaataaagagaatcacagtgggtttgaaacacaaactggtactaattgcccagtaggggcttctgaatgtaataaaaacgttattggctctggtattcgtagcgtaacatttgtaccaacggaggataacccacctacgactaatagttgtgggaaattaaagctgtctggtaatgagcaagggactggacagtggcaatgtacgagtcatttagttcctacgcgttggtatgagcgttatcgttaa

SEQ ID NO: 1920 - DNA, 1011 bp, Acinetobacter baumannii
atagttttaactgcaaatatttacgagaagttcccctgttttattaattttgaggctgttatggaaattgtgttagctaatccgcgtggtttttgtgccggtgttgatcgagccatagcaatcgtcaatcgggctttggaatgttttaatcctcctatttatgtacgtcatgaagttgtacacaataaatttgtggtagatgacttacgccaaagaggggctgttttcgttgatgagctggaccaagtgccagatgattctattgtaattttcagtgcgcacggtgtttcaaaagcagttcagcaagaagcagagcgtcgaggcttaaaagtttttgatgcaacttgtccattggtgactaaagtacatattgaagtaactaaatatgctcgcgaagggacagaagctattttaattggtcatgaagggcacccagaagttgaaggtacgatgggacaatatgacaaattaaaaggtggagatatttatctggttgaagatgaggctgatgtggcagcactcgaggttagacatccggaaaaattagcatttgttacgcaaacgaccttatctattgatgatacagcaaaagtgattgatgctttgcgtgcgaaattcccgaatattcaaggtccgcgtaaagatgacatctgttatgcaactcaaaatagacaagatgcagtacgtgacttagctgaaaaatgtgatgttgtgctggttgttggctcacctaactcgtcaaattcgaatcgtttacgtgagcttgctgagcgtatggggaaagctgcttatctagtagataatgcagatcaacttgaacaatcatggttcaatgatacttgtaaaattggtgttacagcgggagcttcagctccagaaattttaattaagcaagtgattcaacgtttacaagattggggagctcaggcgcctaaagaattagaaggacgtgaggaaaatattacttttagtcttcctaaagaattacgtattcatgtgacccaagcataa

SEQ ID NO: 1921 - DNA, 603 bp, Acinetobacter baumannii
attagagtaactcccatgagcaatattttagtcattaatggtgccaaacaatttgcccactcaaatggtgaattaaatgacacactcacgacattagcgacgaatcatctcactgaactcggtcatgaagtaaaagtcactcgtgcagatagtgactacaatgctgaagctgaagtagaaaaatatttatgggcagatgtcgtgatttatcaaatgcctggctggtggatgggtgcaccgtggaccgtaaaaaaatatattgacgatgtatttacgacaggtcatggttctctttatgcaaacgatggtcgtagccgctctgatgcctcaaaaaaatatggttcaggtggtttaattcatgacaaaaaatatatgttgtcacttacttggaatgcgccaatggaagcatttgacgatgcggatcagtttttccatggcgtgggtgtagatggtgtttatttaccatttcataaagcaaatcagttcttaggtatgagtaccctaccaacatttattgtaaatgatgtaattaaaatgcctgatgtagatagttatgtggaagcatataaagcacatttgaacacactatttgcagcagcctaa

SEQ ID NO: 1922 - DNA, 2220 bp, Acinetobacter baumannii
ggaataacaacgaaaaatatttttaaagattatttaattggggatggtcagacaatgaatcacgtattccgtcagttttctatgggggctgtagctattgcgattatgcaggctgcatctgcacaggtcagcatgaccaacattgtaccaatgcaaattgcaggtcagggcacagaaattagagtcatgtttaatggcttgccaccacaaccacaagcttaccaacttgaaaatccttcacgtttaatccttgattttgataaggcacagcaaggtttaaaacagtctaaaattagtgttgcaactaatgaggcaagttctgtagatgttacttcagatgaccagcgctcacgtttaactgtaaacctaaaagatgctggagcatttacaacacgagtcgaaggcaatactttcattttaaaaattaattctgctcaaacaagtaataagccgctacctgtggtttcagcacaaccacagggagtttcaaatattggctttcagcgtggtagtcagggagaaggcctggttgttgtagatcttttaggaagtaatacgcctgtagatgttcagcagcagggtagtaaagtcgttataagaacaataggtacaaaaatcccgacacatttagcgcgtcgcttaaatgtaaatgattttgcaacaccggtttcaagtatcgatgcttataatgataaaggggttggtgtaataactatccagtcctctggtagctatgaatatatggcctatcaggcagagaataagctcacgatcagtttgaaacgtccccaagataaaaatgttacctctttatataaaacgccgaattattcaggaaataaactttcattagacttccaagatattgaagtacgtcgtgtgttgcaattacttgctgattttacaggcatcaatatggtagctgctgatagtgtacaaggtaatatcacactacgtttaaaagatgtaccttgggatcaggctcttgatattattttaaaaactaaaaatcttgataaacgccgtaacggcaatgtgatttggattgctccagttgcagaattgattaaggcggaagaagaagaagcgaaagctgttgcacaaagtgtcaaacttgcacccttacagactgagtatattcaactgaagtatgctaaagctggcgatattatgggtctcattacacaaggttcaaataatagtaatggcttacagcatacttctggtggagggacctcaacttcaaccaatttaaatactggagttgatagtctaggcaataatgtgggtagtttgcttagcccgcgtggcactattactcaagatgatcgaaccaatactcttattattaacgatactgctcagtcaattgatcaaattcgtaaaatgattgacttgcttgatgtgcaagttaaacaggttatggttgaagcacgtattgtgagagcctctacgtcatttaccaaagaacttggtgtgaagtggggcattctgtcgcaaggtattaccaataacaacaatttgctggttggcggtagtgaaacaactttatggaatttacgcgaaccgaagaaagatgaaactacaggtgggtataaatatacgattgagcgcccagataacttaaatgtggatttaggagtttctaatcctgcaggaagtattgcttttggcttgattagtatgtctgactttatgttagatcttgaattgtctgctttacaagcggatggttatggtgaggttatttctacccctaaagtcatgactgccgataaacaaacagcgaaagttgcaactggtcaacaagttccatatcaatctacaactaactctgcagcaggttcaactgctacaacatcttttaaagatgctttgctgagtttaaatgtgacaccaagtattacacctgatggcaagattcaaatgaagttggatatttctaaggattctgtagcgggtgcggctccaaatggagagttgattttaaataaaaataatatcaacaccaatgtattggtagataatggcgaaactgtcattttgggtggtgtttttgagcaaacaactatgaattcacaaaccaaagttcctttctttggtgatattcctgttgttgggcgtttatttagaaaagatgtaaagtctgatgataaacaagagttgctgattttcgttacaccacgaattgttaatgacactttagcgagaaatcattaa

SEQ ID NO: 1923 - DNA, 645 bp, Acinetobacter baumannii
ttaatggcaacaattaatttactgccttggcgcgaagagctgagggagcaacgaaaaaaacaatttataacgttatgttttggggtggttgttttggggattacaaccgtatttgggggatggttttattttgaccataaattagatgatcaagagcaagcgaatcagctcattatgagcacaaatcagaaccttgatcagcaattaaaaacattaaacggcttacaggaacagcgtgatgccattattgaacgcatgaagttgatccaaggtttgcagagtcaacgtccagtagtggtaagacttgttgatgagttagttcgagtcacaccaccagctatgtatttaacgaaatttagccgaaccggagataagtttacgattgaaggtaaagctgagagtccaaatacagtagccgaactactccgtaatcttgaagcatctccttggtatcgtaatgcttttatgaactctttcttggctaatgaagagaaaaaagataaggctgcaagttctcttcttcctagggtggaagaccactatggtagttttgttgtgactgtcgatttgggggaaatgggcgtggccacaacggatgattctgctaagccatctacaggtgaaagtgtgggggctgctaaatga

SEQ ID NO: 1924 - DNA, 642 bp, Acinetobacter baumannii
cttgtagggttcacgcacctttgcttgaataaaaaaatcagatttatagttataaggatatctataatgccagtatttaataaaaatggtgcagtatgtgcactgacagctttattaacggtcggttgtagcacggtaagtaagactgtatctgatacagcccatgcacttaccacaatgcatactaaaaaagtggtggatgttaatgaagtgacagccaatggtataggtaaaaaaattggtacgattagctttcaagatagtgataagggcttaatcattacccctgctttagcagatttaccaagtggtactcgcggtttccacattcatgaaaatccatcttgtgcccctgctgttaaagatggaaaaccaggcgctgctttagctgctggtagccactataaccctaaccaagctccacatcatggtacgccaactaccgggcatttaggcgatttaccagcattagttgttgacaatactggtgtagctacaactgctgttattgcaccacgtttaaaacttgctgacattcaaggtcgcgctatcatgatccatgctggtggtgataactattcagattctcctttgcctctaggtggtggcggagcgcgaattgcatgtggtgtaatcaaataa

SEQ ID NO: 1925 - DNA, 357 bp, Acinetobacter baumannii
acgcttggaacaaaaaggcgcgtaatgaaaagcagtgatgaaatcgaaaccacagaaaataaagtggtcaaaaaagttgtggtatatgcagtcatggtggcattggtttttatcagtgccatgatggtggtatttcaagtatttgaataccgtcatgattatagagagttaagttcttatatgcgtgaacgtgatgacctcaatgctgaatgggggcgtttattgattgagcaacaaacatttggtgcgactgctcaaattggtacacgtgctgtgacacaattacgaatgttttcgccacctgctgcagaaacggtggtaatttctttaccgatgacctcagagcaaaataagtaa

SEQ ID NO: 1926 - DNA, 732 bp, Acinetobacter baumannii
aacaggggaacttctcgtaaatatttgcagttaaaactattcagtttaaacgcacggtacactacaatagcgaagatattttatcatatcaggaaaaatatcatgtcgggtctattgtttgtcgtttctgctgcatcaggaacgggcaaaacatctttggtgaaagccctacttgaccgtgtgagcaatttacatgtttcagtttcgcatactacccgaggtcaacgaccaggtgagttagatggtgttcactatcacttcacaacaaaagatgaatttttagaccaagtgaaccaaggtggatttatcgaatatgctgaagtatttggtaattactatggcacttcgcaagcaaccgtaaaacaacagttagctcaaggacatgatgtcttgcttgaaattgactggcaaggtgcagagcaagtacgcaagctgtttcctgaatctaaacagatctttattttaccacctactcaattcgatttacgtcagcgtttatctaaccgtggtacagactctgttgaagttattgaacaccgcttaagctgtgctgttgaagacatgcagcattatgtaaatttcgactatatcatcattaatgatgactttaataaagccctacatgagcttgaagccgtcattacagcaaatcgtttagtcttatctcaacaggcaaaaagacatcaaaatctaattcaagacttgattactccacaaccaaaacaggaataa

SEQ ID NO: 1927 - DNA, 2055 bp, Acinetobacter baumannii
ggggacatgacttcagtccatcagttacaaggcgttggatcggcttcagcagccctactcgaaaaactaaatatttttaccacagatgatttgctgtttcatctgccccgtgattatgaagatcgcagtaccattattcctatgaatcaattggtagttggtcgtagttatttactcgagggtgaagtcaaatctgttgatttccctccaggtaaacgtaaatctatggccgcattaatacaagatgaatttggtaaggtgactttacgcttttatcatatttataaaaatttaaccgacaaaataaaacctggtaaccgtttacgtatttttggtgaagttcgcgtaggtgcacgagggcttgagctttatcatccagaaattcaacttattaatgaacatactccccttccaaaaacgcagctcacagcaatttatccaagtaccgatggactaacacaagctaaattacgcgaatatgttaaacaagcgttgaagcatcatagtgatgccttacccgagttactccctaaacaatatacaaaatgggtatgccctccaaagaagctttactttacattcacggagccgccattggatgccaatatgatccaactggctcaaggctctcatcctgcgcagcaacgtcttatttttgaagagctggtcgcacatcaaattagtcttctcactcgacgtgcttatattcgccaaattgcttcacctgcttttccgagtagtaaagtgcttgcaaaaaagctactagaagctttaccttttcaaatgaccaacgcacaaaaacgtgtatcaaaagaaattttaaacgacttaaaacaacatcaacctatgctgcgtttggtacaaggtgatgtaggggctggaaaaactttagttgcagcggttgcagcatgtcacgcattagaagcagattggcaagttgcgttaatggcacccaccgaaattttagcagagcagcattatttaaattttaaacgctggtttgaacctttaggtattacggtagcttggttgtcgggtaaacaaaaagggaaagcgcgggcacacgctgagcaacaaattaaagaaggccatgctgaactaattgtgggtactcatgccttatttcaagataacgttgaatttgcaaaactaggactcgtgattattgatgaacagcaccgattcggggtcgatcaacgattagccttacgcaataaaggcgccgaacagctcaccccacatcaactggtcatgactgcaacgccaattcctagaacactggcaatgagtgcttatggcgatttagatacatcaattattgatgaattacccccaggccgaactccaattcagaccgtcacgattccgctagatcgtcgtgaagaagtactgcaacgaattgcttcaaactgccgagaaggcaaacaggcctactgggtatgtactctggttgaacagtccgaaactttagatgctcaagccgccgaagccacctatcaagaaatgaaagagcgctttcctgaacttaatattggtttggttcatggcaaaatgaaagccgatgaaaaacaggctgtcatgcaagcatttaaaaacaatgaactacagctgctaattgccacaactgttattgaggttggggtagatgtacctaacgcttcgattatggtcattgagaatgctgaacgattagggctttcacagctacaccaattacgagggcgtgtaggacgaggtgcaaaagccagtttttgtgttcttctctataaaccaccactttcacaaaatgggcaagaaagactttcaattttaagagaaagtaatgatggctttgttattgctgaaaaagatcttgagctaagaggcccgggtgagttattaggaacaaaacaaacaggtgatatgggtttccgtgtcgcacgtttagagcgagatgatcatttattgagtcaagcacactacgttgcacaacaagttctaaaagattaccctgagcaagctgatgccttattgaagcgctggcttcctaaagctcctcgatacgcatatgtttaa

SEQ ID NO: 1928 - DNA, 624 bp, Acinetobacter baumannii
cctctaatgacacgtatcgcattgcttgattatggcatgggtaatctgcactcagccgctaaagcacttgaatatgtaggtgcaaccgtcgatgtgacaaatgatccaaaattaattgcacaagccgacaaaattgttttcccgggtgttggggcaatgcgtgactgtatgcaaggcatgcgtgaagcaggtattgatgaagttgtacgtaaagcagcttttaataagcctgttcttgcaatttgcgtaggcatgcaggcactactacaaagctcagaagaaaacggcggtgtagatgccttaggtatttttgacgggatagtaaaacacttccctcaaatggaaggtttaaaagtcccacacatgggctggaaccaagttcaccaaatggacccaagccacccgatgtggaacaacattgaacaagatgcccgcttttactttgtacacagctactatgttgaacctaaagatgaaaatcttgtggctgccacatgtgagtatggcgtgaacttctgcacagcaattcacaaagataatttattcgcgactcaattccacccagagaaaagtcacactgctggtttgcagttactgaaaaactttgtggaatggaatatttaa

SEQ ID NO: 1929 - DNA, 1326 bp, Acinetobacter baumannii
aacgatgtgacaaaaaattgctcgaatgaaaagcaagctcatgtcatatttacaaaaggattgcctactgaaaaaaataatgttgatatgaacttaaatacacaaattctgattgctgccattttaggtttagcctttggcttcctacttaccatgtatccggacactgcttttgtaaagcacagtttatatggattaggcatattaagtagtgtttttattgggctacttaaaatgttgttggtgccattaatttttagctccattgtggttggagtttcaaatttacaggcaggtggacaattaggcccagtttggaaaatcacattcttgtgttgtatcaccaccaccactttggccttaattttaggtattagctgtgctcatgtgtttgaggtcgggcgaggtgtagatatttcaatttttcaggcatctatgcaaagctatcaaacaccagatagtttaaacccggcaactttcttcactaattttattcaaaatactttaattaacccatttaaagcttttagtgacgggaatgttttagctgtcgtcgtgtttgctctatttgtgggtgttgctttagttcatggtggcgaacgttttaaaagtattcgggtattgagtcatcagttttttgaaatgatgatgatgttagtaggttgggtaatgaaattggcgccgttaggtatttttgccttactcgctaaattaatggctaccgaagacatttcagtattaagccgattggcggagtttgctgctgtggtaacaggtactactatttttcatggtgctgttgttttaccgctactgctttggatttttggtcgtatgagtccttggactttctttaaaggcacacgtacagctttaattaccgcattcgcaacgagctctagctctgccactatgccgctgagtatgaaatgcgcacaggaaaacttgggtgtccgtcctcaaactgcgggttttgtgattccattgggtacacagctcaacatggatggcacagctttatatgaagctgctgccgcgctctttgtggcaaatctagttggactagacttaaacctgacacaacaaattgtagtgtgcctaaccgcaatgatcgcatcacttggagcaccaggaattccaagtgcgggtatggttaccatgattatggtattacagtctgtgggtttacctgccgaagcaattgcgattttacttccaatcgatcgtttactcgatacggtaagaacggttgtaaatgtgcagggtgatatgatgattagtgtggtagtagatcgatataccaaagataaagatatcagtatctaa

SEQ ID NO: 1930 - DNA, 831 bp, Acinetobacter baumannii
ttaaacgtgactacgcaaaatttaatgtgccctgtgtgtcgtcaacgacttgagctggtaagcaaaacatggcggtgtgaacagggccatagctatgacattgcaaagcaaggttatgtgaacttacatgttgtacagcacaaacatagtaaaaatccgggagatactcctgagtctgtagatgcgcgccgtgcttttttacaaggtggctattatcaacctttacagcaagcagtagttcatttgctgaaacagcttaaagctaaaatggtacttgatattggctgtggcgagggctattacaccagtgcaatgcaacaggtcgttgaacagtgtataggtgtagatattgcaaaaaatgcagtacaacgcgcagcaaagttaaatgacaaagtgacgtgggtggttggtacaggagcaactttacctgtcatcgatcaaagcatggatgtgtgtacgagtctttttagcccgattccccaaacggaaattctgcgtgttttaaaagatgatggttatttaattgttgtgactccagcaaccgatcatttgtatgcgatgcgtgaggcgttgtttgaacaggttaatcctcatacaccacagaaatttgttgaacaattgcaagatttatttgagttgaaagaacagcaagttattgatgctcctttagtacttgaccagcaggctttaaaaaatcttattgctatgactccctatgcttataaggcatctccagaacgtcgtatgcaattagaacagaaagcacacttacaagtgaccgcatcttttcaaatttatctttttcaaaagcgtaataaaaaagccatctaa

SEQ ID NO: 1931 - DNA, 375 bp, Acinetobacter baumannii
aaaaaagtgaccaaggttgggcactatgtaaggagtttggttatggatcaaagccaagtagaacagattctacgtaatccaaagtttcaaaaaatggtcaagaaaaaaagtgcattaagctggacgctcacaatcatcatgttagtgctttatgtgggctttatgctacttgtgggctacaacaaagaatttttgatgagttcctttagtggtggtgtaacgacatgggggatcccgctaggtttaggaattattgttttatctttcctactttgtggtgtgtattcctatatcgcaaataatacccttgaccaattgagtgaagaagcgttgaaggaagttgaagccatcacgcatgagaaaggactacactaa

SEQ ID NO: 1932 - DNA, 1035 bp, Acinetobacter baumannii
caaatcacgacaagaaagaggtggttagggatgccacaactaaaaaattatacaggctcggtatatggaggactggggcacttattaaaggcttattgcgaagccaatgagttaactattcctgaacaattagaacaaatccaaaatctggaacgctttgactatgtggtttggcgcgacctattagaagttatttataaactggacccaaagccggggttagggctagaaattgccaaatatgtacaacccaaacatttaggtattattgcctaccttgctctttcttgcgataacttaggtgaagccttaattcgttaccatgactttcaccgtctgatttatgacgggagccctttagtggttgagctacaagggcggtatggttctattcgttgggaggcaccagagttacaccctacccagcttaccgatgaaatcgcgattgcgttggtgattcagttcttacgtctttttatgtctcacgaagatgtacagttatatgaagtgcgctttttaaatgcagcccctaaaaatatcagagtttacgagcagtactttcaatgtcccgttcgttttagccagccccgtacagagttacttatacccattaccgaaattcacaagccgcttagcagcgcagaccacacattacagcaactattggttcagcaggcccaagcacttttagaacagttacccaattcaacccaactcgatcagcgtttgcagcattcaattttgactggtctgcaaaagaatcagtatcaaattgaatatattgcagctcaattaggcctatcggttcgtcaactccaaaggcacttacaacaacaaagcaccacctttcaagagcgcgttcaacaagtacgctttatgctggcaaccgaatatttaaaagacccacatttgagcctacaagagattgcacttttactttgttattcagaacaaagtgcctttcaaagagcatttaaacattggaccaagcagacaccacagcagtggagagatcaatttttaaacaaagaataa

SEQ ID NO: 1933 - DNA, 702 bp, Acinetobacter baumannii
ctgtcttattttaaatggaatgtttttatgcttttttctcaagaactctggcaacgtaatttaaatttatatcaaaaaattctcgacctgccttttaatcaggaacttgctaacggtactttagataaagaagctttttgtcattatgttattcaagatgctcaatatttagtggcctatggccgtgtgctggctgttgcagcagctaaagcttttgatgctgacgatattatgcagttttctgatgcagctaaaattgcaattgtggtcgagcgcagtttgcatgacgactttatgaaaaattatggggtaactaaagaagaatttaaaaataccccattgaccttggcaggccatcattacacttcatttttgacagcgactgcttggtctgaaagctaccctgttgtacttgctgcacttttaccttgcttctggatttatgccgaagtcggtaaagacatcgtgagtaagtctgtcccgaacaatccttatcaggcatggatcgatacctacgcaggtgaagagttccatacagcggttcgtaatgtgattgcgacggtagataaagttgccgcacgttgtgatgcagatactttagagaaaatgcatgcagcctataccatgggtgcaaaacttgaatggttattttgggatagtgcctaccatcaaagacaatggttaggtttagatcagatctaa

SEQ ID NO: 1934 - DNA, 435 bp, Acinetobacter baumannii
ttgcttcgtgcaatttctaacagccatggtgtactgttgccacgttctgcaattttcatgtccgtcttattctgtttgcttatattccagagtttatggaatatagcagcggctttttgcgcgcatgaaaatcaagaaaaagcactacatcattttggtcatcatgcagctttaaatgtatatcaaacgtcttcacatactcatgttgaacatactgagactttagatgctgcccataaagcacctttaaacttacaagaccatcatgatcatttaccgacatgttttcatgtcgtcatgacagaagttgcaaaacaagctcaaacccctgttttgcatgtgcatgaactttcacaaatttatcattggtccaattcttaccagtctccacatcttaatgccttaaaaccgcctcctgttttgaccccgctatag

SEQ ID NO: 1935 - DNA, 237 bp, Acinetobacter baumannii
gttgaactcgcgacgtggacgatcttcgccaccgaaagcaggacgctcaccacgaggcttatcatcaaagctacgacgtggacgatcatcacgaccaccttcacgacgtttgaagttgccttcaccctcgaaacgacgaccaccgccgaaaccgccaccacgacgaccatcacgaccaccgttaccaccacgaccgccttcacgacgtggacgagctggaggtggagatggctctaa

SEQ ID NO: 1936 - DNA, 1320 bp, Acinetobacter baumannii
gctagactcgctcaatatttaactcacgaagatgaagtaatcatgacttataaagatgaaaccttagccattcacgcaggctacactccagaagcaaccactaaagctgttgcagtccctatctatcaaacaacttcgtatgcatttgataacacacaacacggtgccgaccttttcgatttaaaagttcaaggcaatatctatacccgtattatgaatccaaccacagccgtacttgagcagcgccttgctgcgttagaaggcggtattggggcattagctttggcatcgggaatggcagctattacttacgcaattcagaccattactgaagctggagataatattgcctcagtctcaactttatatggtggaacgtacaacttatttgctcataccctgccaaaacaaggcattgaagttcgcttttttgattatcaaaagcctaaaagcttacgtaacttaattgatgataaaactaaacttgtttttgttgagtcaatcggcaatccgcttggaaatatcatcgatctagaagaaatttcgaaaatcgcccatgaatatggcgtacctgtcgttgttgataatacagtcgctacccctgctttattaaaaccattccaatatggcgccgatatcgtcatacattctttgactaaatatattggtggtcatggcaatagtattggtggtgcgattatcgatagcggtaagtttccttggggtaaatatccggagcgttttaaagtattgaacacgccagacccaagctatcatggtgtgaactatgtcgaggcattaggtgaagctgcctatatagcaagggctcgcgttgtaccattacgtaatacaggcgcagctattagtccgctcagtgttttcttaattttacagggtctagaaacgcttaatttacggatggaacgccatactgaaaatgcacaaagaattgcggaatatttgcaaaatcatccgaaagtaaaatgggtcaattacgcaggcttaaaagatcatccacaacaccaacttgcgcaaaaatatgtaaaaggtaaaccttctgcaattttatcttttggggttcaagatggccgtgaaggcggtactcgcttcattgatgccctccagctatttacccgccttgtgaacattggtgatgcgaaaagtctggcgtgtcaccctgcaaccacaactcaccgccaactcaacgaacaagaactaaaagctgctggtgtaagtgaagatatggtacgtctttcaattggtatcgagcatgttgatgacctcattgccgatttagaacaagcactttcatccgtataa

SEQ ID NO: 1937 - DNA, 351 bp, Acinetobacter baumannii
acacactatttgcagcagcctaatccggagaaaaccatgcttactattatcgcggaaattcgtactcaatcgggtggacagcaccgccaaaacgtattggatgcctttcagaaaatcattccaactgttttagcagaagatggttgtcatggttatgaacctttggttgaccacatttcaaatgcgagcttccaaaacaaagaccctgacattattgtgatgttagaaaaatgggaaagtgtggctcatcttgaagcacacttagctacacctcatatgcaagcgcatcatgaagcagtcaaagatgatgtggttgacgtcaaaattaaaattttagaaagcggcgtataa

SEQ ID NO: 1938 - DNA, 897 bp, Acinetobacter baumannii
aatggatacgcttttatgcattattctttgtcaaaatcttcaaatttgtattgtagtgggtgttcaatggaacctatggtggtgatggctgcgcgtgcggctcaaacagttggtcaagagcttttaaaagcgcatcaaaatcgtcataagctcgatttgcaagttgaagagaaaggcattgatggtcctgtaacacgtgtagatcgttatttagaacaattgacgattgatacattacgtaaaagttataaaaaccatagcttcttaggtgaagagttcggtttgcaagagggcaaaggccacgatgcagactggtgctgggtgatcgaccctcttgatggcacgcaaaactttattaatggtttccctcatttctgtatttctattgctgttcagcacaaaggtgttactcagcacggcgtaatttacgatccggtacgtgacgaattgttctctgcaagtcgtggtcgtggtgcggtgatgaatcagcgtcgtattcgcgtaaatgtaaaagatagcctagaaaatacattcttggcagtaggtcacccttaccgtgctaaacgtgctggtgaaattgtgtcttatgcagagcagcactttgcttcattattagctgtgactcaagcgggtgctcaaatccgtcgtggtggttcagctgctttagacttagcgtatgttgctgctggtcgtttcgatggtttctttgaacttggtttaaaaccatgggatatcgctgctggtgagcttattatcaaggaagctggtggtgttgtggttgacgcacgtggtggtaatgattcacttgaaaatggtcaagtgattgcatgctcactgaaaatgttaaagccattaatgcaaactgtagttcctgcttgggataaagctgcaaaataa

SEQ ID NO: 1939 - DNA, 1056 bp, Acinetobacter baumannii
ctgatcgtagccaaacactacgggggtatctttgactacgatctaaaaaaagaacgtttagaagaagttttacgtgagttagaagaccctgcgatctggaatgatcaaaaccgtgctcaggcaatggcaaaagaaaagggcgaactagaaaacgtcattaatgtattagatggcttatctacacagcttgaagatgcaaaagcaatgttggatttggctgtagaagctgatgatgaaagcttacttgaagatgttcagtctgaactgagtactgctgaagaagaattagcaaaacttgaattccgccgtatgtttagcaatccaatggacccgaatccttgctatgtcgagattcaggcgggttcaggtggtacagaagcacaagattgggcttcaatgctattacgtatgtatatgcgttggattgaacgtcatggttttaaagcagaacttatggaagtctctgacggtgacgtggctggtatcaaatctgcaacgattcgtgttgaaggtgaatatgcgtatggttggttacgtacagaatctggtgtacaccgtttagtacgtaagtcaccatttgacagtggtaaccgtcgtcatacttctttctctgcggtatttatctccccagaagttgatgacaatattgaaattgatattaatccttcagatgttcgtactgatacttaccgtgcatctggtgcaggtggtcagcacattaacaaaaccgattcggcagtacgtttgacgcatattccgactggtattgtagtggcatgtcagaaccagcgttcacagcatgcgaaccgtgatcatgcatggaaacagttacgtgcaaaattgtatgaattagaaatgcaaaaacgtaatgaagccgctcaagcacttgaagactcgaagtctgatattggttggggtagccaaattcgttcgtatgtacttgatgactctcgaatcaaggatttacgtacgggtgttgaaaattcaaatactggtgcggttcttgatggtgaccttgatcgttttattgaagcgagtttaaaacaggggttataa

SEQ ID NO: 1940 - DNA, 249 bp, Acinetobacter baumannii
aaaagactggctgatcttaagcggaatttttggagctattgtgctgttcttctttttgccagagctttagaaaatggtttaagtaaagattctaagcttgtaatgctttgcgtacttaacaatactttctttgatggtgtaatggtaatggcggatgatactgacctaaaagcaaaccatttacatttattggctcagttacgtaacttgtttactgctgtggctgatgtgagtgtgttgcaggtttaa

SEQ ID NO: 1941 - DNA, 1311 bp, Acinetobacter baumannii
ctatttgaggcaaaccgcttggcgaccccattttggtacaacaccgcacttcatttattaaaaccgttttatcgttggcggataaaaagacgtgcagaaagtctagaattatatcagcaggaatgtctggaaagatttgggccgtttgaagcaccgaagaatgtaaaagcgatctggtttcatgctgtttcagtcggggaaaccaatgctgcacagcctttaattgaatattatctaaaacttgggcagccagtcttagtgaccaataccacgaaaacaggtcaggctcgtgctaagtcactttttctaaaagaaccttatttagatttatttcaagccgtttatttgcctgtagaccagaagcctcttttaaaaaaattttttgagttatatcagccaaagcttttagcactggttgaaactgaactttggccaaatttaatcgatcaagccaagttacagcatgtaccttgtttgctgcttaatgctcggttgtcagaaaaatctgcaaaaggatatggcaaagtctcgggtttaaccgcaggtatgttaaaacagctggactgggtgttagcgcaagatagtgcaactcgtcagcgttatgttgagcttggtttagacgaacacaaaagtcaggtcgttggtaatattaagtttgatatccatgcaccagaggcttttgttaaacaagctgcccaattgcatcagcaatggtatctggaaaatcggcaggttgtgacgattgccagtacacatgcacccgaagaacaacaaattttggaagcactcgtaccttatttaaattcagatcgtgagttggtgtgtattgtggtgcctcgtcatcctgagcgtttcgatgaagtatttgaaatttgccaaaatttaaatttaattacgcatcgtagaagtatgggccaaagtattcatgccagcacgcaagtttatctcgctgacagtatgggtgagctctggttatggtatgccttaagtcaggtgtgttttgtaggcggttctttaaatgagccgggtggtgggcataatattttagaacctatggttttaaatgtacctactgtagttggaccgcgttattttaactttcaaacgattgttgatgagttcattgatgaaaatgctgtgcttattgctcaagatgcacagcaggtcgttgatatctggttagcatgtctggcagaacctgaggcgactgaacagttagtggtacaggcgcataaagtgttgcaacgtaatcaaggttccttacaaaaacatatcggggtgattaatcgctatctggccgaaaaatcatga

SEQ ID NO: 1942 - DNA, 597 bp, Acinetobacter baumannii
aacggtttttatactatgaattcaatttgtattttctgtggttcatctcttggttcaaacccaatctttcaacaaattgctcaattaaccggtgaagctattgctaaacaaggtaaaacactcgtttatggcggtggccgttctggtttaatgggtgttgttgctgatagtgctttgcaagccggcgggcaggtcattggggtaattcctcgtgctttagttgatcgcgagttagctcatcctggactgacaaaattatatgtcgtcgaaaatatgcatgagcgtaaaaccaaaatggcagatctgtcggacggttttattgctttaccaggtggggcaggtacattggaagaaatctttgaacaatggacatgggcacaattaggtattcatcaaaagccgtgtgcttttctaaatgtagctggcttttatgaagatttgcttaaaatgattcagggaactgtagataacggatttagccaagcgcggtttgttgataaattgattgcctcagacaaaattgaagatattcttcaacaatttgagcaatatcaggctcctgctccgaaatggacaaatgccgacgttcaaccataa

SEQ ID NO: 1943 - DNA, 918 bp, Acinetobacter baumannii
ccccagctttatctcttgttaatgctggaaatgattatgaaaaaacttggtttagccactgctgtattattagccatgaccggtgctcatgcttatcaatttgaagttcaaggtcaatctgaatatgttgacacaactgcaaatgataaaaacttcactggtactgctcaaggtacttattacttcaaaaatgttgatgcatctaaaggtcctttagctgaagcagctttcttaaaccaagcatctaacgtttctgttgcttataactatatcaaatatgatgagaaagacactgtaaatgttgaatctcatacttatggtgttaaaggtgaagcataccttccaactccttacttaccagtttatgctagcgcatcttataaccacactatcaatgattttaaagatggcgtgagcgatgacaacggtgaccgttatgcattagaagctggtgcaatgttgttacctaacttcttagttgcagttggttatacaagcgttgctgatcaaatttctttagatgcgttcggtgttaacaaatacggaatcgctaaagcagttggtgaatcagttgctattgatgaaaaacaagatgctgtaactgctcgtactaaatatgttggcaacatcgatggcactaacatggctattggttttgaagcatttggtgtatttgctgaagacaacgcttacggtatgaaaactgaccttttcgtaactcctaagttaagtgttggtgcatcttttgcggatgtgtctgcatttaattctggttacgaccatgtttggggtggtcacactcaatacttcatcactcctgctgtagcagttggtgctgacttcgttaaagcaaatgcgaaagatggcaacccacgtgatacacaaactatcggcttaaatgctaaattccgtttctaa

SEQ ID NO: 1944 - DNA, 291 bp, Acinetobacter baumannii
gacactccttaccgaaaaacaggggaacggacaatgagtgaaaaaacagtccgcacgttaaccggcaaagtagtaagcgacaaaatggacaaatctattgttgtccttatcgaacgccgcgttcaacacccgttgtatggcaaatcaattcgccgttcaactaagttacacgctcatgatgagaacaacgttgctaaaattggcgatgttgtaaccattaaagaaagccgcccaatttctaaaactaaagcttggactttagtggaagtagttgaagcagctgctgagtaa

SEQ ID NO: 1945 - DNA, 3519 bp, Acinetobacter baumannii
ggtttcacttatgtaggtcatatgaacagctggctgattattggggtgctcactctttatattgcgcttttatttgtctgtgctttttttggtgagaagcatgccagtcgtcttagcacgcgtggccgtatgtttttatttagcttaactttaggtgtctattgttcctcttggacattctatggggcaactggggctgccgtacgtgaaggcgttatcttcttacctatttatttaggtccactgttatttgtctggtttggttatgatatctggcggcgtctaggtcgagttcgtcagcatcatgcgatttcgtcaatcgctgactttgtcgcggcacgctatggtaaaagtggtgtactcgcatcgttggtgactattcttgcagttattgcgattatcccctacctcgcgttacagctgcgtgcgattgcgttaagtacctcggtcattatggagcaaagctcgcatattcatacgacgactaacagcgtgttattgctcaccagtgtgcttgcgattttagccatgatttttggtacaaggcagattgcaaacacggagcaacacggcggcctcatgcttgcagttgcatttgagtcatttgtgaagttatttgccttactttgtgtcgctttattttttatttttgaatcaccggccaacctgagccaaatgacctctgatgtaaaccagacttttcaggaagttcagctctttggtgtacccgaaactttctggattcaaacattattggcaggtttagccattatttgcttaccacgtcagttccacgtggctgtggtcgaactccgcgatgagaagcatattcgcggtgctcgtaaatggttcgcggtttatctcattttaactattcttgccattattccgattgcaagctgggctttgcatgccgcaccaaagtttctgaccgtgcctgatgtggctgtgctgtcattgcctttaagttataaccaagagtggctggcattactggcctttttaggcggattctctgcctcaacaggcatgttactagtgtcatcagtagcattgtctattatgctcagtaatgacttgattatgcctgctctatggcgatttaagttgctgtcacgtcacgataagcatttacctaaagttcttaaatttagccgccgtatcagtattgttgcggtgatgctacttggctttttattcttccatttctttaatgacattaaccaactttcagttttcggcttattggcttttagtgctgtagcacagtttgcaccagcactgattggtggtttgtattggcgtggcggaagccgtcaaggcgtctatgcaggacttattattggatttttaatgtggagttatacattactatttccaactattttgcgtagcttgcctgaagcctatcaggaaactgctcaaagtattttacttttcggtcctttcggcattaatgccctacgcccggaatctttatttggttttgagtcatttgcacctttaactcacggtgttatttggtcactcggtttaaatattgttttatatatctggatttcaaaaatttatcgaccaagtgtcgctgagcaaattcaggcagaaagcttcttttattatgaaacaaagcctttaccatcaccgcacacctctactgatttaacctatcttcctcatgatgcggcccgcttaaaagtgggtgatttatttgccctagccaagagaattacgggtgagcaacccactacgcaagcgttcgaaaatttttgtgagcaaaatcacctcaccctcaacccaaatagtattgccaatggcatgtggtggcgttttaccgagcaatatctggccggtattatcggtgccgcttctgcacgtacattgctcacaacagcaatgattaataacggtcttgctttagggcaagtggctaatattttagaccaagcatcgcagtggcaacgttttaatcagaaccttcttatgaccatgattgaccacatgacccaaggggtaagcgtggttgataaaaatatgtgtttggtcgcatggaacaatcaatatttaaaactgtttggttacccaaaagacctcgtttatgtgggctgcccaattgccgacctcattcgttataacgccgaacgcggtgaatgtggtcccggttcagttgaagaacatgtgcgtaaacgccttcactggatgaaagtgggaagtgctcacgaatttgaacgtattcgtaaagatggccgtgtaattcaaatgcgaggaaatccaatcgcaggtggaggctttgtaacgacatttgccgatattacggccttccgtgcgaacgaagccgtgcttgaagcccgcgtaaaagatagaacacaacagcttgccgatgccttaactgaacaacagcttgcacgtgaacaagctgatatggccaatatgtcaaaaagtcgatttattgccgcggcaagtcacgatctattacagcctatgcatgctgctcgtctgtttagtactgttcttgagcaaagtatttcgaccgaagaagaccgccagaccctacaacagcttgaccgagcactctatggtgcagaaagtatgttatctgccctactcgatattgcgcgtttggaaggcggcaccatacagccaaagagacaaccttatccattgcatgatttactcagtgatcttgagttgcagtttaaatcgatcgctgctcagcgaaatatcttactgaaagtccacgatgtgtctttctggattgataccgacccgcagtggattcgtcgtattattcagaactttgtcagtaatgctttgcgttataccgccaaaggtcgagtggtggtgggtgtactccgctctgcgcagcagtctggacatattcgaattggggtttgggatactggacctggtattgccgaagaacaacggattaagctattccaagagtttgagcgctgtgggcatttatcaccttggggtgaacaaggtttagggctaggacttgccatcgtacaacgtatgacaggtttgctaaattaccctgttcatgtttactcagagttgggcaaaggctcatgctttatgattgaagtacctattgtcgagccaccaaaagttgcaacaccagctgtacaagccgtacctttaaaaactaaagcctaccgtattttgtgcctagacaatgatgaaactattcttgaaggaatgagtagtttattaggaagatggggttatcaagttttcaaagcgactgaacctgaacaggcgctagaaattattcaaaaagagaatattcaggtttggctcattgaccagcatttaaaccacaatcaacttggcgttgattttattactcaaaatcgtcaagaagatgttcctgttgccttaattacagcggactcgcaccctgaattaccgcagcaattaaaagaactgaatattgttttactcaaaaaaccgttaaaacctgcttcattaagagcatggttatctgggcttaaaattgccagcacgacagactaa

SEQ ID NO: 1946 - DNA, 954 bp, Acinetobacter baumannii
agtttgaattttataactttaaataaattgataatgcatgcaggcaaagacatggaaaccatacatgatttttatcgccgcttttctttaaccagagatagcgattactcggttccatcgacttcgtttggacattttaacgtgttccaacgcgatgcctgctcgttcctcacgccttatagccgccgcgattattataaaatttcactggttttaggcacaggtgaacttcactatgctaaccgttggatacgagtcgaccaccctgctttgctgttttccaacccgatggtgccctatgcatgggaaattaattcgcctgaacaggcaggctggttttgtctatttaccgaagagtttgtaaaccaagaatctagacaaagctttttaaaagactcaccactgtttaaagttgatggagacccgctatattttttaaacgatcaacaagttgaggaaatttcatttattttcaaaaagatgatgaatgaaataaattcagactacattcataaatacaacgttttaagaaattatttgcacctgattgtgcatgaagccatgaaaatgcaaccgacccaacagtttgaaaaacatagtaatgcttcggtgcgcatttgccatttattctttgagttattagagcgccaattccccatcgactcgccacattttcagcttaaactcaaaactgcaaatgactttgcctatggcttgtcggtacatgtgaaccatttaaaccgagctgtaaaagaagccactggtaaaactacgtctgagcatattagctcgcgcattacgcaagaagccaaagcgttgctacaacacaccagttggaatatttccgaaattgcctatagcttaggctttgaatattcagcatatttcactaacttctttaagaaaaataccggattttcgcctaaaaaattccgtgaagactgtgtagcctaa

SEQ ID NO: 1947 - DNA, 798 bp, Acinetobacter baumannii
tatataaattatgactttaaaagggagtacatcatgagtttagttgtacctgctgaacatcctgaaaccgtacataacgaaacggatcgtgtcgagcgcattttagtggtcgatgacgatgtgcgtttacgtaccctcttgcaacgttttttggaagataaaggctttgttgtaaaaactgcccatgatgcctcacaaatggatcgtttattacaacgtgagttattttcacttatcgtgctcgactttatgttgcccgttgaagatggtttaagtatttgtcgtcgtttacgtcagtcaaatattgatactccaattatcatgttaactgcacgtggtagtgactctgaccgtattgctggtcttgaagccggcgcagatgactatttaccaaaaccatttaacccaaatgaacttttagcacgtattcgcgcagtattgcgtcgtcaggtacgtgaagttccgggtgcgccaagccaacaagttgaagtggttagcttcggtccatggtctctagatttatctacacggacactgactcgtgaggggcaaatcgttacattgactacaggtgaatttgccgtattaaaagctttggtccagcatccacgtgaacctttaacacgcgacaagctcatgaacttggctcgtggccgtgaatggggtgcaatggaacgttctattgatgttcaagtgtctcgtctacgccgcttaattgaagataacccggcacgtgcacgttacattcaaactgtatggggcgtaggctatgtgtttgttccggatggtgctgaataa

SEQ ID NO: 1948 - DNA, 672 bp, Acinetobacter baumannii
gtaagagattatttgaaggagtggttccaggtgaatacgttgtttaaacaaacccttacagcaagtattttgtctactatgattgctggtacagcttttgctgcaccttcagaagcaccacctgactttattaagcgtgttgctgatggcttgatttctcgtttaaaagccgatcatgctaaattgcaaaataacccagcattagtaaaaacaattgtacgccaaaacttagacccgtatgttgattcacaagcgtttactcgtattgtgatgggtacttatgcaacaaaccaatatagtactgctgcacagcgtgctcagtttgaaacgaacttccgtaatacattaattgagaattacggtagtgcatttgctaagtatacaaaccaaacttacacgatgcgtccatacaaggcgacagctggtaaaaaccctgttgtgactttagattttaatcacaatggtgaaaaaattcctgtgtcgttccagttggcagacaaaggttcacaatggaaaatccgtaacatcaatgtttctggtattgatttaggattgcagttccgtaaccagtttgctgcaactgtgaaacgtaatggcggtgatttgaataaagcaattgctacgttccaacctgatgcagatgctgctgttaatcagaataaacaaaaataa

SEQ ID NO: 1949 - DNA, 195 bp, Acinetobacter baumannii
aaattaagttaccaattaaaaaagctaaaagaattcgagaataaaaaagagagcttaacgctctcttttttatttattaaggttgatacatcggacggttatcatttagcgcaatcaatccacgaattgcacgatatacaatccagatccacgcagcaccaattacacccacacagaacacagtcgatgagatag

SEQ ID NO: 1950 - DNA, 1341 bp, Acinetobacter baumannii
gctatgagttattttggaacggatggtattcgtggaaaatttgggcaaatgccgattacgccagagtttgctttaaaactcggttttgctgcagggaaggtattaaaacgaacgagtccgaaaaataaaccacttgttgtattaggaaaagatactcgtttatccggttatattttagagtctgctttgcaggcgggattaaatgctgctggtgtatatgttcacttacttggaccattaccgacaccggctattgcacatcttacccgtgccttacatgcacatgcagggattgttatttctgcatcacataacccatattttgataacgggattaagttcttctcaagtgaaggtaaaaaattaccagattcattgcaggaagaaattaataaagaattagaaaaagatttatttatcgaagacactgcaaacttaggtaaaagtgttcgtgtgaccgatgcaaatggccgttatatcgaattttgtaaatctacattcccatatcattttgatttaaataatttaaaaattgttgtggattgtgctcacggcgctgcttacagcgttggcccttcggttttccgtgaactcggtgctaaagttgtcgctttatacaatgagccagatggtttaaatattaatgaaaactgtggttcaactcatccagagagcttacaaaaagcggttgtggaacatggggctgacttaggtattgcctttgatggtgatgctgaccgtgtagtgatggttgataagttcggtaacttaattgacggtgaccacatcttatatattttagcgactcaggcaaaaaacaagccagcaggtgttgttggtacagtaatgagtaacatggcacttgaagttgcgcttgaaaaagcaaatgttggctttgttcgtgcaaaagtcggtgaccgttatgtattacaagccctagaagaaaacggatgggtaacaggtggtgagccttctggtcatattctgactttagacaagagcacaaccggtgatgcgattattgcagcattacaagtgttaaccgtgatggttgagcagaacaaagcgctgcacgaattggttaacggctttaaactgtacccacaagttcttgtaaatgtacgtttggaacaaatgcttgatccatattctattcctgcattagttgctgagttcaataaagctgaagagcagctcaaaggacgtggacgtattttaattcgtaagtctggaactgagccagtcattcgtgtcatggttgaaggtgataacgagcaagaagtgaaaactttagctgaacatttagcaaatgcagttcgttcacaggcacaagtcgcataa

SEQ ID NO: 1951 - DNA, 534 bp, Acinetobacter baumannii
gaacccctctataaattagtggggttttttaatattaagaataaatcagcagtcatcataatgaataccacttcaattaaaaaattttaccgtatagatgcttaccttgttctttgtcacatccttttgctggcatccggttatggtctatggaagctatatcctcatatacaaaccaaaccagatatgagcggcctgttctttatgattatctctattctaggcggttttgcagggctgattatgctagctataactttgcctcgtttagagcgttctgttcgtaatttatcagtgaacaaatttattttggctctgctgtattgggtttctagtaccattattttcgtgctatttggcatcagcaaattcttcttcaataatccgctagttttactggtttttgttttggtttttttcagcagtgtttatctttcggtgattcgccttgcagatatgcgtaaaaaagactggctgatcttaagcggaatttttggagctattgtgctgttcttctttttgccagagctttag

SEQ ID NO: 1952 - DNA, 1128 bp, Acinetobacter baumannii
ataacggcatatcccctaaggtgtactgtgagtgttatacatccagaatggttacagattttaaaaccgaattttaaggttttaccactaaaagaacggttgctttgtggcgttggagcgctatgtggtttagcaatttcctcgttaattagctggtatgttttaggcggaattaatgcttggtacattgcaccaatgggggcctcatctgttcttttatttgctgtacctaccagtccattggctcagccttggaatgttattgtcggtaatacattagccggaattattggggtcgcctgtgcacagtggattccggatttaaccacggcttttagcgtggctgtgggttttgccatatttttaatgatgaccaccgactcgttgcatccgcctagtggagcagttgcgattacggctgtgttgggcggcgctgccattcataaattaggcttttatttcgttttttatccggttctgctcaactcattacttctactcggttttgctgtattttttaatcgattgattgggcgacattatccggttactgcacatttaaatgagcgtagtaaagatccaactcccactcaaaaagtatcaattcagccaaaagatattgagtatgcattagaacatcatactgaactgttagatatcagccagtacgacttagaaaaaatcattttagaagcgcaagaacatgccaatgaacgtatggtgaaccaatatacctgtcaggatattatgagccgtgatgtgattaaattgcatgaaaatgatgatattcatcaggcattagataaatttaaacaagaaaatctcatgagtttgcctgtagttaatgcagacaaccatttagtgggtactttggcgttatatgaagttgtggaatggtttaaaggggcaacagacccaagaaactcatggcagcattacgtaagacaaattatgagtcgtcgagtagttactgtactgccaactcagccgattcaagaccttgtaccttactttgttgagaagtcttttaactatattccggtggttgaggaacgaaaactgattggaatcattagccgtgcagatatgattgcggctttacaacagcagttaaatcgtaaattgtaa

SEQ ID NO: 1953 - DNA, 1005 bp, Acinetobacter baumannii
aaaatgaaatatagaactttaggacaaacaggcgaaaaagtatcagcacttggtttaggttgcatgggaatgagctttgcctatggtgcctcagacgacacacaaagcattgcaactctagaaaaggccttagacctcggcattaacttttgggacactgccgacatgtacggcaacggcgcaaacgaagttttgctctcaaaagttttagaaaaacatcgtgacaaagtgttcttggcgaccaaatttggcttccgctataaagaagataaccttaacccgaaaaactctttagagtcttatatcgacggctcgcctgagtggattaaagttgcggtcgaaaacagcttaagacgcttaaatacagacgtgattgatttgtattatgcgcaccgtatagacccgaatgttccagttgaagataccattggcgcaatggcagacttggtcaaacaaggtaaagttcgttatttagggctgagcgaagcgtcggctgaaactattcgtaaagcacatgcgattcacccgattgcagcggttcaacatgaatattcgctacttacccgtgagtttgaacaaacccatttgcaaaccattcgtgagttaggtattagccttgtgccatattctccgttatcgcgtggtttaattaccaatacgcttgatgtaaataacctagatgaaaatgatttccgtcgccagttaccacgttatcagggcgataactggaaaaataaccaaagcttggcgcaagcatttagtgaatttgctcaaagcaaaaatgcgacagccgctcaactggctttggcttggattttggcgcaaggtgatgacattattccaattccgggtacgcgtaaaatcgagcgacttgtggaaaatgcgggtgctgtagaccttcatttaacagcggcagatttggcagaaatcgacgcgattattgcgagatacccaaacatgggcgcacgctataacgctcagcaacttgctgcggtcaaccactaa

SEQ ID NO: 1954 - DNA, 186 bp, Acinetobacter baumannii
tggatgactctgtctcagcaattcggacggaatatttatttaaattggttgatgaaaagtggcaattgcaaaataagcaaaagagctaccaatgtgcaagaggaaaaggttctagaggtttccaaacgcagctttgttcttaagcataaaaaagacgataaatatatcgtcttttttatttcttaa

SEQ ID NO: 1955 - DNA, 240 bp, Acinetobacter baumannii
agctgggatttctggcttggactggacattttattatttgatcaattggtatacttttcacatgataatgtaaatacctataaaaaagccacagacaatgctgtggcttttaaatttacagtctgtattagaacaatacgcgtacgcgaattgtgccttcaacttcatgcaacatatctaaagcttcttgagaagcagaagcatctacgtccattacaaggtaaccgatgtcgcctttag

SEQ ID NO: 1956 - DNA, 945 bp, Acinetobacter baumannii
atttcttttcaaaatctagctcatattcctatattagcttgttttgcttttgtcaaaattacaacaagattcccaaaattcagtgttatagtatgcgggcataaaagtgcaggaatgattgccattatgaataataaaactcctctctcgactcaatcactgattgaagtgaaaaacttgagttttaaccgaggggaacgcgtcatttatgacaatattagtttaaatatacgtcgaggccagatcacggccattatgggaccatctggtacaggtaaaacgaccttattacgcttgattggtggacagcttgttcccgatcatggcgaagttttgcttgatggcaaagatattgctcaaatgtcacgtcaggaattatttgcagcacgtgcgcgtatgggaatgctgttccagagtggagctttatttaccgatatgtcggtttatgaaaatgtcgcttttccaattcgtgcgcatactaagctttctgaaaatctcattgcagaactggtcgctttaaaacttgaatcggtgggcttgcgtggaacagaacagcttatgcctactgaattatcaggtggtatgaaccgacgggtcgctttagctcgtgcaattgcgcttgatcccgatttaattatgtatgacgaaccttttgcggggcaagacccgattgtgaagggtgttttaacacgtctcattcgttcattgcgagaagctttagatctaactacgattattgtttcgcatgatgttcctgaaaccctatctattgctgactacatttatgttgtagcggaagggaagattcaaggggaaggaacgccagaagaattacaagcttatgcttctccatttgtaaaacagttcttaaccggctcggcagaaggtccggttgaataccagtttagccaccaagcttatttagataacgaggttcgtccatga

SEQ ID NO: 1957 - DNA, 291 bp, Acinetobacter baumannii
agagtggttcagtatcttaaccaagagttagttgtttcaggcaaaattgattttgaaaatgctgaacaacaataccaagctggattggcaattattaaaaagcaaacaagctttcctttaattgttgatttaaagcagcttgagcatggtaatacgttagccttggctgttttagtgcaatggctacgtcaaactccacaaaagtctggattacattttaaaaatgtaccagagaagatgctgaaaatcattcaagcctgccatttgcaagaagacctacatttggtttga

SEQ ID NO: 1958 - DNA, 1449 bp, Acinetobacter baumannii
cgtctttctcaaattctctcaatgtgtaatatgcagccatctgacaaacaactagatgctcagcatcagaacagtactgcacctttaaaaagagccatgagtacccgccaccttgtcatgttatcgctaggtggagcaatcggtactggtttatttttgggttcaggggaagtcatttcacaaactggacctattggcgcaattattgcctatattcttgggggtgcaattgcttacatggtcatgctctgtttaggcgagctggctgtacatatgcccgtttcgggttctttcggtgcatacgctcgaaagtacattagtccaagtacaggctacatgatttcatggatgtactggctaacatggacagcaacgctaggaaccgagtttaccgccgccgctctacttatgcaggaatggtttccacaaatttcaatgtggatctggacacttatttttgcagtaactattttcgggttaaatatcagctcaacccgagtatttgccgagtcagagttctggctagcgctggttaaggtcattaccgtcattgcttttattgtgcttggattattagcaatttttggtttaattcctttccacggcgctcaaactgctccattgtttagtaatttaactgcccaaggttggttcccacacggttttcttcctattttcaccactatgctcattgtcaactttgctttctctggaacagagttaattggcgtagctgctggcgaaactaaagatccggctcagaatgtccctaaagcgattaatgctgcaatctggcgtcttctgattttctttgtaggcaccattattgtaattagtgcattacttcctttccaacttgctggtttaggtggtgacaacgtaagtaatagtcctttcgttaccgtatttaattacatcggtattccatatgcagatgacatcatccgttttgttattattactgcactactctcagccgcaaactcgggattatatgcagcttcacgtatgatgtggtctttatcggagcaaaaactccttccgggtgtatttgcaacactttcaaaaagcggaacacctattgttgctttagttgtaacgatgttcggcgcaattccaggcttattatcagaacaatttgctcctgaaaccatctttaaaaacttgctaggtgttgcagcttttaccatggttattgtctggatgagcatttgtttaagccagttcaatttccgtcgacaatggtaccgttctggacatacggttagcgatttaaaatatgcagcaccgttatttcctatcgttccaattttaggttttcttttctgctttattacatgtttaagtatggcggcagatcctgaaatgcgtgctggctttataggttgcttaatttttactgccttgtgctatctcagctactttattttctatcgaaataaagcttaa

SEQ ID NO: 1959 - DNA, 231 bp, Acinetobacter baumannii
ctgttgactcatttttttctaccccatatcaatccaaaaagcgaaatcagaattggaagtcctgaggctaaaaagggtgtggttatcaacgctaaagttgatccggcaaatgcagctttacgagtcaccttattctttaaagcagaaaaagtaagagcaattaaaatcgctgggaaaatcgcatctaagccaaatgttttagggtctggaatagcgctcccaataaaataa

SEQ ID NO: 1960 - DNA, 630 bp, Acinetobacter baumannii
aaaatggctcaagattatgtacgcttagacaaggataatgctgcggttcttttggttgaccatcaagcaggtttactttctttagttcgagatatcgatccggataaatttaaaaacaacgtacttgctgttgcaaatgcagcaaaatacttcaatcttccaacaattttaacaaccagttttgaaactggtccaaacggtcctttagttcctgagttaaaagaaattcacccagatgcaccttttattccacgtccaggccaaatcaatgcgtgggacaatgaagatttcgtaaaagcggttaaagcaaccggtaaaaaacaactgattattgcaggtgttgtaactgaagtgtgtgtggcattccctgcactatctgctttggcagaaggctttgaagttttcgtaattactgatgcttctggtactttcaacgaattaacacgtgatgcagcttgggaccgtatgtctaaagcaggtgctcagctgatgacttggttcggtatggcgtgtgaattacaccgtgactggcgtaatgatattgaaggtttgggtacattgttctcaaatcatatccctgactaccgtaacctgatttcaagttacaatcacaacactagccaaaaataa

SEQ ID NO: 1961 - DNA, 594 bp, Acinetobacter baumannii
tcgatttatcaacttttcgataagagtgttttcataatgaaaaaaacattagtcattgttacgcatcctcacatagtccagtctgtaattaataaaagatgggtagaggagttagaaaaatatcccgaccaatttaccgttcaccagatttatcaagcctacccagatggcgtaattgacgttgccaaagaacaagcgcttgtagaagaacacgaaaatttagtttttcaatttccagtgtattggtttaactgtccgccgcttttgaaacaatggcttgatgaagttttggcgtatggttgggcttacggttcaacaggtgataagcttaaaaataaaaaatttatgctggcggtgtctgcgggtgctcaagaaaaagtttattcagagcaaggcgaatataagctttcgttagaccaagtttttagttcttttcagctcactgctttatatgttggggcggactatcaaccacttcatgcattttatggtttagacactaacccttcagaagatgacgatgttccgactcatcaagacgtagcaaataatgcgattgagtacgttcagaagttgttagcgttgtctgagtga

SEQ ID NO: 1962 - DNA, 444 bp, Acinetobacter baumannii
tacttttgtcaaaacgtatcatcgattatgatgaaaaaagatttaatcaaggaaaaacaaatgtcccgtcaagtcattcatactgaaaatgcccctgctgccatcggcacatattctcaacccattttagtaggtaacacactatatctatcagggcaaattggtttagatccttacagtatggaacttgtagacggcattgaagctcaaatccgccgtgtttttgataaccttaaagcagtatgtgaagctgcaggcggcacacttgcagatattgcaaagctcaatatttttcttactgatttatctaatttccaactcgttaaccaaattatgggcgaatattttgctcaaccatacccagctcgtgctgcacttggtgtagcaagcctgcctaaaggggctttagttgaaatggatggaattgttattattaatcagtaa

SEQ ID NO: 1963 - DNA, 1575 bp, Acinetobacter baumannii
ataaaacgtcagaatactgggctttttcgttataatagttccaatttttattttgacccattaactatgaaagttcgtactcgtattgcaccttctcctaccggtttcccacatgttggtactgcctacatcgccctattcaatatgtgttttgcgaaacagcatggcggggaattcattttaagaattgaagatacagaccagcttcgctctacgccagaatctgaaaaaatgattttagactctctacgctggttaggcttaaattggtctgaaggtccggatgtaggtggtcctcacgctccttaccgccaatcagagcgcatgggaatttataagcaatacgcgttagaacttgttgaaaaaggtcatgctttttattgttttgctacagcagaagaacttgaccaaatgcgtgccgagcagcaagctcgtggcgaaacaccaaaatacgatggtcgtggtttaaagctgtctcaagaagaagtagctcgacgtcttgaagcgggtgaacctcatgttatccgtatgaaagtgcctgaagaaggcgtatgtaaatttaacgacttactccgtggggaagttgaaattccttgggcacaagtcgatatgcaagtgcttcttaaaacagatggtttaccaacctaccatttagctaacgttgttgatgaccatttaatggaaatcactcatgtattacgtggtgaagaatggcttccatctgcaccgaagcatcaattgctttaccaatactttggttgggaaatgccaacgctttgccatatgccgttgcttcgtaatccagataaatcgaagttatctaaacgcaaaaacccgacctcaattaactactaccgtgatatcggcgttttaccagaagccttactcaactatttaggccgtatgggttggtcaatgccggatgaaagagaagttttcacattacaagacatgatggataactttgatattcaacgcgtatcactaggtggaccaatttttgacgttgaaaaactcaattggttaaatggtcaatggattaaagggttaaccccaggacaactattagatcgtttattgacatggaaaagtgatcgcagcactttagaagacattgctgccgctattcaaccacgtattaatttactttctgaagctgtaaattgggctggtttctactttaaccatatgccacaaattacggctgaaatgtttgaaagtaaaaaattgactcaagagcaagttcgtcaaagtttacaattcgcaatttggcgtcttgaaagtcagtttacttggaataacgacacagttagtcaaactttaatggatttggcaaatcagatgggcattaaattacgtgacttcatgccaacgttctttattgcaattgctggctcaacaagttcaacaccagttatgcagtcaatggttacgcttggccctgacttaacctttgctcgcttacgacatgcactagaaattgtaggtgcaccgagtaaaaaagaggtaaaaaactgggaaaagcttaatgaaagtttaaaattgccgaaaaatgaagcaactagcgaagcttaa

SEQ ID NO: 1964 - DNA, 2001 bp, Acinetobacter baumannii
aataatagccacagtctcgagatgggatgcacaagatcaaggaagttgcgtatgaatgagatctatccagtaccagaggaatttaaaaaaacagctcgtactgttgaagcagactactttaaacgttatcaacactctatcgagaacccagatgaattctgggcagagcaagctaaaattgtcgattggataaagccatttacccaagttaaaaataccagttttgacaaagacaatttcaagattgaatggtttgctgatggtgagttgaacgtatcagcaaactgcttggacaggcatcttaaagaacaccctcacaaacctgcaattatttgggaaggtgaccatccttctcgtcataaaatcgtttcttataaagaattacacgacgaagtctgccgtttcgccaacgttttaaagaaatatggcattggtaaaggtgaccgcgttgtgctgtatatgccaatggtgactgaggctgcaattgccatgttagcctgtgcccgtattggtgcggtgcactgcgtggtatttggtggtttctcaccagactcgttggcgagtcgtattgaagatagccaagctaaacttgtgattacggctgactcaagcctacgtgccggtaagttgttaccacttaaagaaaatgttgatttggctctagcattgccgggcacagagtgcgttgaaaacgtgattgtggtttaccgtaatgcaaacccaatcgagatgaagccgggtcgtgatttgtggtatcaccttattattatggaggtggatgcaaactgtcctccagaaccaatgaaggccgaagaccctttatttattctttatacctctggctcgacaggtaaacctaaaggagtgttgcatactacaggtggttatctggtgtatgtggcgagtacctttaaagaagtttttgatttaaaacaagatgatgtgtactggtgtaccgctgatgtcggctggattacaggccatagttatctaatctatggaccattggcaaatggtacgacgaccttaatgtttgaaggtgtgcctcagtatccaacatgggcacgtcttggtcatgtggtcgataaacataaagtctctattttatatacagcgccaaccgcgattcgagccatgatgcgagaaggtgattcgtatgtacgtgaaagtaaccgtagtagtttgcgtttgttaggttcagtgggtgaacctattaaccctgaggcttggaactggtactacaatgttgtcggcgaaggccgctgcccgattgttgatacatggtggcaaaccgaaacaggtggtattttgattgcgccattaccgggggcaacagctttaaaaccaggttcggcaacgcgacctttatttggtattcaaccagctattgtagatggtgaaggcaatgaactagaaggcgctgccgaaggtaatcttgtgattaaagattcatggccgggccagatgcgtaccatttggggtgacccagatcgctttattgaagcttacttctcgacctttaaaaatacttattttacaggtgatggcgcccgccgtgatgaagatggctattactggatcacgggtcgtgttgacgatgtcttaaacgtttcaggccaccgtctaggtacggctgaaattgaaagtgctcttgtatcgcatgaatcggtggcagaggctgctgttgtaggtatgccgcatgatattaaagggcagggtatttgtacttttgtgactttgcaggcgggtgttccggagtcggaagaactgcgaaaagagttaattagctgggtacgtaaagtacttggaccagtggcttcaccagatgcactgcactgggcgccggcattacctaaaacccgttcgggtaaaatcatgcgccgtattttaagaaaaattgcagcgaatgaactggatagtttgggcgatacctcaaccctagctgaaccggcagtggtggatcaactgattgcgacagtttatcctgatagacaaaaataa

SEQ ID NO: 1965 - DNA, 522 bp, Acinetobacter baumannii
agcataagtctattttttatagatttatgtgtacttaaggctctttacggttgtcgtaaagggaaagttaaacgggttgatatgcgctttagcctctatccccagcggaaactcaggcctcttctgactccgcacatattggagattcccacaatgagtggtaaacatcctttagttcaagctattgaaaattcacagttaaaaactgaccttcctgaatttgctcctggtgacacagtagttgttcaagttaaagtaaaagaaggtgaccgtgaacgtcttcaggcatttgaaggtgttgtaatcgctaagaaaaaccgtggtttgaactctgcgttcacagtacgtaaaatttctagcggtgttggtgttgagcgtgtattccaaactcactcaccagttgttgctaaaatcgaagtgaaacgtcgtggtgacgttcgtcgtgctaaactttactacctccgtgacttgtctggtaaagctgcacgtattcgtgaaaaattaccagctcgtaaagcgtaa

SEQ ID NO: 1966 - DNA, 438 bp, Acinetobacter baumannii
aagttgagtctggaaaataatcttaaaaattataggaatacaataatgaaaaatatatttgcatctttactgcttgtttctacggttattttttctgctcacatttatgcagagccgactagtacctgtaaggaagtgaaattccaaaagactgatcaggcttggagtgggcactattatttacatggtgtaatggaagtcggttcagagcttttacttcagccagacggtaagtttcaatggatgcttgctgtaggtgcgttagaccaatatgccgaaggcacatggtggaaaaacggtgactgtattggcttaaaaccagaggctaaatttaaaaaggatttaagtattttccctgaaagcctaacgatttcggataaatccttagatgcaatctgggaaggtggacgccagcaaggcacatatagcaaagactaa

SEQ ID NO: 1967 - DNA, 198 bp, Acinetobacter baumannii
gttaatctacagattaagcaggacttatcgagagtgaggagacatttctcgttattacgtaaaggagaaatagtaaatgttgggttttctgaaaattatgttgcccttgttgttggttgtatttttattgatgggaatatgggtcagtattttgcacttcccttgggagtggatgacttatgttgtcatggggattga

SEQ ID NO: 1968 - DNA, 1032 bp, Acinetobacter baumannii
aagttcctacacaggcgctacaccttcatggagggaagaggtattctatcaaacttcacagatgttttttgcaggttttccatgtcggtttataccccgttgagtttagatgaagttcgcacctttgctgcaccttatggattagaggtgttggagctgaacccaattcagggaggtattcaaaacaccaattattttctggttgatgtaaaccgcaaacaatatgtactcaccgtgtttgaagagttagatgcacaaggtgcaggtgaacttattcctgtacttgagcagttaggtactcatgatgtacccgttgccgtgccattaaagcacagcggccaagcggttcattttattgcgggtaagcctgcacaaattgcaccacgtttaatgggacaccatcccatgcaaactacagtagcccaagttgctgcaatcgcagatgcacaggcgaagctacatgtagctttacaagattttccgcttgaacgcgaatatcgccgtgatcatcaatactggacaggtgttgctgagcagcttaaaccaaatatgactcaagatgaccaaacgttacttgagcaggtttatcaagcctttaatgcgaaaacagcgcagtattcaaatcgaccgacaggttttattcactcagatttgttccgtgacaatactttgtttgaaggcgagcaactacaaggtattctagatttttacgagttaaatcaagatgagttgctgtttgatattgcgattaccattaatgatttttgtactgaatatccagcagcgcatttaaacttagacaaagtcgacgcttatttagaggcataccaaaaagttcgtgcgctgacttcagatgaacttgaatgtttagatgtattcttggcaatggcggcttgccgtttttggtcaatgcgtttgcaagttgctcaaaaaaataaagaagaaggacgtactggcgatgacatcttgcaaaaagacccgcaagaaatgcgagcaatgatgcaagaccgtttaagccatataaaagcataa

SEQ ID NO: 1969 - DNA, 636 bp, Acinetobacter baumannii
acgactggtctaatagttgtttatgatgaatgcatgaaacgattaaataaaagcgaaaccacacgacaacacattttagataccagttttgaactggtgctacataaaggttttgtcggtgttggtttgcaagaaattttaaaggcttgtgacgtacctaaaggttcgttctatcactactttgcttcaaaagaggcgtttggctgtgcgttgctcgagcaatacatggccaattataaagtccgtatggaacagctttggcagcacagtgagcaaagtgcccatgcccgtttaatggctttatggcaagcgtggattgatgatccggtacatggtagctgggctgaaaactgcttgattgtgaaattggcagccgaagtttcggacttatcagaagatatgcgtcaaattctaaatgacggtgtgcacaaactaacgcaacgtttggctttgctactcaaagaagggcaacaagaaggatcaattccaaaacatattgatcctttgaaaactgcgcaagtcatgtaccagttatggttaggtgctgctttactcacaaaattgtcgcaagacaaagcacatctacatctagccttagaaaccacccaacaactcttaaaaccgatagaggaataa

SEQ ID NO: 1970 - DNA, 315 bp, Acinetobacter baumannii
ggggatgaacagaaaatgaaaattcattatggaaaagctttaagcttgggtttggtgcttagttttgcatcacaactgtctacagcagctgtactgaaagatacaccaagtaaaagtctttcagataaacagtcttcacttattgaaaaagctttagatcagcaaaaacgtaacactattgtacttccatcaacagatgatgagttaaaagtacttaatactatccgtgttacaccaactcaaaactttcttgcagcacagcatgaacgtttttcacgttttgttcaggcaatcttccagccacacacttcttaa

SEQ ID NO: 1971 - DNA, 1272 bp, Acinetobacter baumannii
ttgctgagacatagtggccgctattttgaagtgtacaaactcatgaaaaatattcaaacgacagcgttgaaccgtacaacgttgatgtttcctttagctttagtgctatttgaatttgcggtttatattggtaatgacctgattcagccagccatgttggcaattactgaagatttcggtgtaagtgcaacttgggcgccgtcttcaatgtcattttatttattaggtggtgcatctgttgcatggttactaggacctttatcagatcgattaggccgtaaaaaagtacttttgtctggtgttttattttttgccttgtgctgttttttaattttattaacgcgacaaattgaacactttctgacattacgttttttacaaggtattgggttaagcgtaatttcagcagtgggatatgcagcaattcaggaaaattttgccgagcgtgatgcgattaaagtcatggcacttatggcaaatatctcattgcttgcgcctttgctaggacctgtacttggagctttcttaattgattatgtttcatggcactggggtttcgtggcaattgctttacttgcactgctgagttgggttggcttaaagaaacaaatgcctagtcataaggtgagtgtaaccaaacagccttttagttatctttttgatgactttaaaaaggtatttagcaatcggcagttccttgggttaacgttggccttaccgcttgtgggtatgccgcttatgctttggattgcattatcgccaattattttggtcgatgaactgaagctaacgagtgtgcaatatggcttagcacagttcccggtatttttaggtttaattgttggtaacattgttttaattaaaattattgaccgtttagctttaggtaaaactgtcttaattggcttaccgattatgcttactggtacgctaattttaatattaggtgttgtctggcaagcctatttaattccttgcttgttaataggtatgacactcatttgttttggtgaaggaattagcttctcagtgctgtaccgttttgcactcatgtcatctgaagtgtcaaaaggaactgtagctgctgctgtttcaatgctattgatgacgagcttttttgcaatgattgagcttgtacgttacctctacacccaatttcatttatgggcttttgtcttatctgcttttgcatttattgccttgtggtttactcaaccacgtttagctttaaaacgagaaatgcaggaaagagttgcacaagacttacattaa

SEQ ID NO: 1972 - DNA, 417 bp, Acinetobacter baumannii
tccatgttgcaacctaaacgtaccaaattccgtaaagtgcacaaaggccgtaacactggtctagcacatcgtggtagtacagtatcatttggttcgattgcaattaaagcaactgagcgtggtcgtatgactgcacgtcagattgaagctgcacgtcgtaccattagccgtcgtattaaacgtggtggtaaaatcttcattcgcgtattcccggacaaaccaattaccgaaaaaccattagaagttcgtatgggtaacggtaaaggtaacgtggaatattgggtttgtgagatcaaaccaggtaagatcctgtacgaaattgaaggtgtgaacgaagacttggcacgtgaagcttttgctttagctgctgctaaacttccgtttaaaaccactatcgtgactcggacggtaatgtaa

SEQ ID NO: 1973 - DNA, 651 bp, Acinetobacter baumannii
aggtttatgcacatggctattggtttagtcggtcgcaaatgtggtatgactcgcatctttacggatgctggtgtttctgtacctgttacagtcatcgaagtcgatccaaaccgcattacgcaaatcaaaacacttgaaactgatggttatcaagctgttcaagtaactactggtgaacgtcgcgagtctcgcgtaactaacgctcaaaaaggtcacttcgctaaagcgggtgttgctgctggtcgtttagttaaagagtttcgtgttactgaagctgagcttgaaggccgtgaagttggcggtactattggcgttgatttgttcacagttggtcaaattgttgacgtaactggtcaatcaaaaggtaaaggtttccaaggtggtgttaaacgttggaatttccgtacccaagatgctactcacggtaactctgtttctcaccgtgttttaggttctacaggtcaaaaccaaactcctggacgcgtgttcaaaggcaaaaaaatggctggtcacttaggtgatgaacgcgtaacagtacaaggtcttgaattcgtatctgttgacactgaacgttcagttttggttgttaagggtgcaattcctggtgcaactggcggtgacgttatcgtacgtcctaccatcaaggcctga

SEQ ID NO: 1974 - DNA, 4548 bp, Acinetobacter baumannii
gcactatcgcaaaaagaagttgtttgtttgacgctcgaaagagccttattgaaagaagggtacgctatgcacatgccatcgcctaatactgtagctcccgctcaaggtttatatcagcctgatgagtttaaggataactgtggttttggactgattgcccatatgaagggtgaatcaagtcatcatctagtagaaaccgcgattcacagtttaagttgcatgacgcaccgtggtggtattgccgcagatggcaagacgggagatggttgcggcttattattggcgatgccaaagcaatttttccgtgatgaagcaaaaaaactgagtgatattacactgagtgaaatttttgctgtgggtacggtatttttaaatattgatccagcattagcacagcactctaaaaatattttaacgaaagaaattgagtcagaaggtttacgtgtacttgcttggcgtatcgttccaacaaacaacgatgcattgggtgaaatcgcgcttcaatctttacctgcttttgagcaagtcattgtgaactgtccaatgggcgtaactgaggttgaatttaaccgtaagttattcttggcgcgtcgccgtgcggaacaacaactccaaaatgatccgttattttacgtgactacgctttgctcgacagtcattagctataaaggcttaatgatgcctgcggcgattgccgagttttatacagatttggcagatgagcgtttaaaatcacatattgtggtattccaccaacgtttctctacaaatacattaccgcgttggccattagctcagccattccgttatcttgcacataatggtgaaatcaacacaattacagcaaaccgtaactgggcattagcgcgtactcctaaatttgaaaacccattattaccaggtttgactgagcttaacccgattgtaaaccgtacaggttcggactcttcaagtttagataatatgcttgagattctggtgggcggtggtatggatttattccgtgctttacgtatgctcgtgccaccagcttggcagaacgttgaaactttagatgcagacttgcgtgcattctatgagttcaactctaaacatatggaagcttgggatggtccggcaggcctcgttattcaagatggtcgtcatgcgatttgtatgcttgaccgtaatggtttacgtcctgcgcgttgggttattaccaaaaatgattacattaccttggcatctgaaattggtgtttggggctatgagccagaagatgtagtatcaaaaggtcgtgtaggtcctggtcaaatcttggttgttgatacccttacaggtaaagtgcttgatactaaagacgttagcaatcacttgaaaaacatgcgtccgtaccgtgagtggttgcgtgaccatgcgattcgcttaaatgcaaacccggaacttgaagaacaacttgttgataaaggtttaactggcgatgcattaaaagcggctcaaaaaatgtttatggtgacatttgaagagcgcgatcagttgttacgtccaatcgctgagagcggtcaggaagctgttggttctatgggtgatgatacaccaatggctgtattgtctcgtcaagtacgtcatgtgaccgattacttccgtcaacagtttgcacaagtaacaaacccaccaattgacccattacgtgagtcaattgttatgtcacttgaaacctgtttgggtcgtgagcagaacgtattcgaacaaggccctgaacatgctgatcgtatcatcatctctagcccggttttatcaaattcaaaaatgcagcaaattcgtagcattgaacgtgcgggttatgaggcggttgatattgatctgaactatgctgaaaccgaaggtttacaagctgcgattactcgtatttgtgaagaatctgcacaagctgttcgtgatggtaagaccttaattgttttaactgataaaaacattcgtcaaggttatttacctgcaaatgctgcgcttgcaacaggtgcggtacaccatcacctcataaaaactggtttgcgtactgatgcaaacattatggttgaaaccggttttgcacgtgatccacatcaatttgcggtgttactcggttttggtgctactgccatttatccataccttgcatatgatgtaatcaatgatttgattgctaaaggtgagcttttaggtgatccaatccatgcacaggcaaacttccgtaaaggtatcgagaaaggcttattaaaagttctttcaaagatgggtatctcgacagtagcttcttaccgtggtggtcagttatttgaagcagttggtttatcttctgaagttgtagatcaatgtttcttaggtgttcctagtcgtatccaaggtgcaacatttgttgatcttgaaaatgaccagaaaaagttagcggctacagcttggtctaaccgtaaaccaattgatcaaggtggtttgctgaaattcgtatttggtaaagaatatcatgcgtttaacccagacgtgattaactcgctacataaggcagttcgttctggcaaatacgaagactttaaagaatatgccgagttagtgaataaccgtccgatcgcgactattcgtgacttatttaagttaaaaacaaccaatccaattccggttgagcaagttgaatcggttgaagctatcttgcctcgtttcgactcggcagggatgtcattaggcgcgctttcgccagaagcccatgaagcaattgcaattgccatgaataccattggtggtcgttcaaactctggtgagggtggtgaagatcctgcgcgttacggcacaattcgtaactccaaaattaagcaaattgcatctgggcgttttggtgtaacacctgcatatttaacttctgctgaagtcttgcaaattaaagttgctcaaggtgcaaaaccgggtgaaggtggtcagttgccaggtggtaaagtgaatggcttgattgcacgtttacgttactctgttccgggtgtgacacttatttcacctccgccgcatcatgacatttactcaattgaagatttgtcgcaactgatttttgacttgaaacaagttaacccgaaagccatggtatctgtgaagttagtatctgagccgggtgtaggtacaattgctgcaggtgttgctaaagcatatgcagactttattaccatttcaggttatgacggtggtactgctgcgtctccgctttcatcaattcaccatgcaggttcgccatgggagcttggcttgagtgaagcgcatcaggcacttcgtgtaaatgacttgcgtggcaaagtacgtgtacaaactgacggtggtttaaagactggtcttgatgttattaaggcggctattttaggtgctgaaagtttcggttttggttctacaccaatgatcgcattaggttgtaaatacctacgtatttgccacttaaacaactgtgcgactggtgttgcaactcaacaagatcatttacgtcaagagcactatattggcgaaccacaaatgctcattaatttcttccactttattgcagaagaaactcgtgaatggttggcggctcttggtgtagcttcacttaaagatttgattggccgtgtagatttacttgaagtcttaccgggtgaaacagagaaacatgctcatcttgatttaagtgcattgttaacttctcatcctgctgctgaaggtaaagcacagtattgtgaagtagaaggtaatgcaccgtttgacaagggcgtattggctgaaagaatggtcgaagaaatgcttcctgcaattgagtcaagcgctggtggtcaattcaactttaatgtcgtgaactgtgaccgttcaattggtgcacgtgtatcgggtgagattgctcgtcgctatggcaacttgggtatggaagcacatccggttgtaatgaacctaacaggtactgctggtcagtcacttggtgtttggaatgctggtggtttgcacatccgtcttgaaggtgatgcaaatgactatgtaggtaaaggtatggctggtggtcgtatttcgatcttcccaccaaaaggttcacctttccagacacaaaatacagcaattattggtaatacttgtttgtatggcgcaactggcggtaagttatttgctgcaggtacagcaggtgagcgtttcgcggttcgtaactctggtgcgtttgctgttattgaaggtgcaggtgatcactgctgtgaatatatgactggtggtgttgtgactgtgcttggaaaagtgggtcataacttcggtgcaggtatgacaggcggttttgcttacgtgcttgacctcgataatgactttgtagattactacaaccacgagttaattgacttaacccgtatttcaacagaatctatggaagatcataaagaattcttattgcgtattattgacgagcatatcaaggaaacaggtagtgcttgggcttacaaaatccgcaacgagtttgacttctacagccgtaaattctggcttgtaaaaccaaaagctgctaacttgcaatcgcttttgaaaactacacaagctgacccacaataa

SEQ ID NO: 1975 - DNA, 1086 bp, Acinetobacter baumannii
tccatgaagcatttccgattttcgatattttttacggtggtgtgtttagcactatccgcttactggggttttacccatggacctgaagcgggcgtgtcaaccatgcttaaagctttaaccattaccgcgattttagctgtgatggaagtttctttatcttttgacaatgcggtcgtgaatgcatcggttctccgtaattgggacccgttctggaaaatgatctttttaacggtaggtattttaatcgccgtttttggtatgcgtctgattttcccagtcgtgattgttgcagtgactgctgatatgggtgtggttgaagtagccaaaatggcacttaatgatccgaaaacctactctgaacgtttaatggcacatcacgctgaaatttcggcttttggtggaacattcctattactggtgttcttaaactttttctttgatgacgaaaaagaaacgcattggtttagatggcttgaatctaaacttgcaagcttggcaagcgtaccggcaatgtctgtatttcttgctttgattgccttaattgtgatggcaggttatgtcgatgaccatcaacgtttagctgtaactatggccggtatttggggcattgtggtttatattggcgttgaagtgctcagtcatttgttaggtggtgagcctgaaattgatgaaaatggtaatgctgtattacaagatggatcaggcgctgcttctggtgtggttaaagccggtttaggtggtttcttatatcttgaagtgttagatgcatcatttagttttgatggcgtaattggcgcatttgccattactagcgatgttgtcgtgattatgctcggtcttgcaattggtgctattttcgtccgttcaatgacagtttatcttgtagaaaaaggtacgttagatgcctatgtgttcttggaacatggtgcgcattatgcgatcggtgctttagcattcattatgattgcaagtggtacaggcgtgcatgtaccggaagttgtcacaggtttaattggtgtagcgttcattgtttgggcggttatcgcttcaattcaatattcgaagcgcgagcaacagtcgccttaa

SEQ ID NO: 1976 - DNA, 891 bp, Acinetobacter baumannii
gtactttttaaaacaaatctattaaagttagaaattttgttaggagcgtttagagcagtgcaaaatgacttagatttactttatagaaaatccgaaagttatgtatgggggaatagcaaccttagtgacgttctaaatcaacccttacctttagcgtactgctcattgatatttattaagcaaggtagtgctgatattaatattttatttaaaaactaccatgtaaaatcaggtgattttttatttttgtcggaagactcattggcaatactacaaaaacgatctgacgatttttcttgtgattattgtatttttaatcgtgactttgccgcagaagttgcatctgtcttgccaaactctttatttacttatctacatttattccctcatttttcaccagaaatgaactatcaatccttaattaaaacatggataaatcagaccacttttatcctacaatcaacctctgaatatcaacgcatcttactatgtaatcatcttcagaatttctttttagttctttctgaaacaattaatcgtgaaaaacttttgtctaaaaatgaatatagtagaaaagaaaaaatttgttggcagttttgggaaatgatctcattacattgtaaagaacatcgtgatgtaaatttttacgctaaagctttaaatattaccccctattatctatctaaattgtcaaaacaattttttaacgataacgcaaaaactttaattgatcggcaagtaattcttaaattaaaagaattattacgcactccttcaaattctattcaaagtattgctgatcaactgaattttgaagatacctcatatatgtgccgttattttaaaaagcatactggttttaccttacttcaatatcgtaaaaacgcctaa

SEQ ID NO: 1977 - DNA, 915 bp, Acinetobacter baumannii
tgcagatttaacatggcaatttctcttgctgccgaaacccagcctccagcatttaagctctacttatgtattgctgtaaccgttttttgttggggctattcgcctattggtgtacatagtgctttgcattcatatacaccgcagcatatagccttgcttcgctttttaattgcttcattttttttattacttctggtcataaaaaaaggaattcagcctttaaagtggaaagatgttcctgcgcttgctgtattagggtttttctctgtaacgctgcatcatttgctgataaatacggggcagcaatatgtaactgctgtcgcatctagtattttgagccaatctattccgctatttacctttattatttcggttttgctttttaaagaacaaatcagttttaaaaagtggttgtgtattttgctagggctttgtggcgccgtgttagtgctcagcggagatcatggttttggtatgccgagcccttatagtttgttgattgttttagctgcaattgcatgggggctttattttaatttatataaaaaatttgccttaaattatgatgccttgagcatgatgtgctacatcatttggttcgggacccttcctttactattttatagtgctcatttacctagtgaaattttacatgccacttggcaagccaatatgtcggttatcttattgggtattttcccaagtgcgatggcttatgtactttggggatatgtacttaaaaatatgccgttaacgattgcatcgaattttttgtattgctcgcctattgtcgccatgagtttggcggtgattttcttaaatgaaaaaccatcaatgatggtgctgctgggtggagtgattattgtggggagtttggtatggatgaattgggggaataggcgtactatcgaataa

SEQ ID NO: 1978 - DNA, 258 bp, Acinetobacter baumannii
caaaacttcctgtaccagctgagcaagcaatgcagatggtgtcgaatatgcacattattcctgcaaaccctgaaatcgcccaacaaattaagcaagttaaaacgtggtgatttggtttatttaaaaggtgatctggttgaaatcaaagataaagatttggtttggaagtcatctttgaccccaactgataccggcgatggtgcatgtgaactcttccgtgttcaatccattcactgggttgaaaaacaaaatatttaa

SEQ ID NO: 1979 - DNA, 291 bp, Acinetobacter baumannii
ttagcatctaaacgtttactttctaataaatttgacattgatggtgcagccatcagtgcaataatagccatgaccgcaatcgtcaccattagctcgaccaaggtgaacccttcttgcggaataattcccctcatccccagaaccccaaataaaactaaaattttttatttcttatttaaattttacttttacaaattacaaaacaaatacaaaacagacaaagggtataaaaaaacagataactgtcatgttaacaattatctgtttaactatttaaaatcagtatgttaa

SEQ ID NO: 1980 - DNA, 195 bp, Acinetobacter baumannii
ttcgtcgctaatgtcgtgagtgtgtcatttaattcaccatttgagtgggcaaattgtttggcaccattaatgactaaaatattgctcatgggagttactctaattcaattcttaaacttgagcgatactgtagagaacttactcttaaagaaaaatgtagtaattggaaaaatattattgattaaaaatcattaa

SEQ ID NO: 1981 - DNA, 1098 bp, Acinetobacter baumannii
tggttttataaattcatgcaaactttacatgttgaattaggcgaacgccgttatcctattttcattggtagccaacttgacccgaaacaattactagagccttatattcatggtcaacaggtcatgattgtgagtaatgttacggttgcgcctttatatttaagccactatcaggaagctttggaaagtctaggtaaaacggttgcgacctgtattttacctgatggcgaaaagtataaagatattcagcatttaaacttaatttttgatgcattgcttgaagctggttttaaccgcgattgtacggttttagctttaggtggtggcgtcattggtgatatggctggttttgcttctgcttgtttccaacgtggcgtttactttgtacaggttcctacgaccttactttcacaagtagactcaagtgttggtggaaaaacaggaattaatcatccgcttggcaagaatatgttaggtgcttttcagcaaccacaagtcgttttagctgacatggcacaattgaatacgctgccagaacgtgagctttcggccggtttagccgaagtaattaaatatgcacttttaggtgatgaagatttcttggtttggcttgaagaaaatatggatggcctggttgcaagagatgctgaccttttagcagaggctgtttatcgttcatgtgctcacaaagcccgcattgttgccaatgatgagaaagagcaaggtgaacgtgctttacttaacttaggtcatacttttggtcatgcgattgagtcgtatctaggttatggaacttggttgcatggtgaagctgtagcaactggaatggttatggcggcagatttatcacaacgtttgggttggatctcaaatgaagatgtggcacgtacaaaaaaaatcattcaacgtgcaaatttgccgatatcatgtccacaaattccattggatgatttccttggatatatggctcatgacaaaaaagttcttaatgggcaattacgtttggtgttgttaaaacaactcggacaagctgtaattactaaggactttgatgttgaacttatgaaacaagctattttggcgaatcaacacggataa

SEQ ID NO: 1982 - DNA, 972 bp, Acinetobacter baumannii
aagaaatataaaaaggagagggacttgggtcaagaagatgacaataagtcgaagcctacaacgacatcaacagtttcagggaatcctgaccctataaaactgtcattctcacgccgtttgctgcataaaacattacagcatgcgcaagacgccgtcgggtttgctagtgatactacacgtaatcttgctgaagttgctgatgcagccctagatgctttagatcaagtgacctctcatacaaagcgtggagtggtgggcatgaccaatctggcagcagggactgtcagagatatggtgtctgaaacaagtgaaactgcaagacaggttgccttaatcatggcacgtacttttctaggtaaaagtaccttgaatttgtatttgcctgaaatgctattaaacagtcaaattcgtaaacgcatagatcgttctgaaattgatgatattaaagttcaatgtggcaatgatcggtttcaggttgaaatcgatggacactatcaccgtttcctatatcgcctaagtttagattttcgagtattggaatgccgcattggacaagaaaagttcttgcgcttacgccaaatggatgaaagtctggatgtgcaaatacgtcatggtggaacattatcgaattgggctgttcgccgtattggtcgagtaggttttgaagtgattaatatgttgcctattccatcgctgattaatcatttgattcgtgatattccgggtattcagcgtgatggtcatcgcatgtggttcattgaccttgagcaagcgggttttattgatttcattaataaccgttcatggatggtagaaaaacttttaaatttaaccgactttagtattctaccgggactcaatattttaagagaaagtcgtgagcttgtgcagcaactggtagatcagttcgaaataaaaggactacgtgttcaatcaggccgtctggaagttcaagttggaatcgcaaattaa

SEQ ID NO: 1983 - DNA, 984 bp, Acinetobacter baumannii
ttgtctcataaatgcaataatgtgttgctaatcctgatctataaactgcaattattgaggcgtaaaatcaatctcagttcaagaaaatcctacatatataggagagatcagatgaagaaatttcttggtgcatatcaaaataaccacatgcattgggttggtgatggtttccctgtatataacctgttctcttatgaccgtttaggccaaaccctaagcccatttttgttactggattatgcagcgccttataacttctcaccaaccaccgaacaacaaggtgtgggttcacatcctcaccgtggcttcgaaactgtgactattgcctatcaaggtgaagtgactcataaagactcaagtggtggtggcggaaccattaaaaccggtgacgtgcaatggatgactgcgggtgcaggggtgttacatgaagagttccattctcctgaatttgcagagcatggcggtctttttgaaatggtgcaattgtgggtaaatttaccttcgcattcaaaaatgacccctggaaaatatcaagccattgaagctaaagatattccggacattgcactagacgagcacggtagtcatttgcgtgtgatcgcaggtgaatatgcagatgcaaaaggtgcagcaactacatttagtccattaaatgtatgggacggtaaattggtaaaaggccaaaaacataccctgtatgtacctgaagggcatactacccttgttgttgtgctagagggcgcggttgtggtcaatgatacaaaccgtcttgaaggcaaaaccgttgcgattttatctcgtgagggcgttgagtttagcttaaatgctgaagaagacactaaattcttggtgttgactggccaaccactaaatgagccaatcgaaggttatggtccatttgtcatgaataccaaagccgagattatggaagcgattaacgattttaatcgtggaaaattcggttcaatcatgcaagaaggataa

SEQ ID NO: 1984 - DNA, 897 bp, Acinetobacter baumannii
tcaaataataaaatgtccagtccaagccagaaatcccagcttcatgctttgggctttcttattcttgccatgttaagtgtccaaagtagcgcatccttagctaaagtcctgtttcagaactttcctgtactgactgtttctgcaatgcgtttatgtatgggggcatttattttggctttcatttttcagatctggaaaattaattttagtcaggtccgatggaaagctattttgagctatggctttgctcttgctggcatgaatgctcttttctatttatcgcttgaacgtttacccattggtattgcggttgcatttgaatttattggtccactcagtgtggccctttaccatgctaaacaaaaatatgattttgtctgggtcactttcgcaattattggtctcattttattatttccttttaaccaagcacatagtttggactggatcggagtcctatttgcgatgagtgcgggtgcttgttgggccctatatattattgcggggcaaaagccttctggtatctcaggcaaccatacagtttgtttgggcatgactgtaggtgcttgtatacttttacccattacttttttctcaggctcgattgggcaagttatagaattaccatactttttttattttattggtctcgccgttttagccagtgcacttccattctctttagaaatgttagctctacgcaatttaacacctttaagttttggaacattgatgagcctagagccagctgttgctgcactttccggttttatcttcttaggtgaatacctgttatggaatcaatggttggcactcgccaccattattgctgcttctgtgggttgtaccataaccacccaaagagcccgacaacaacgtgaaaaaacagtaagttaa

SEQ ID NO: 1985 - DNA, 486 bp, Acinetobacter baumannii
cttatgaataagtactacattttacggttcaatcagggttttaccttgattgagcttatggtcgtgattgttatcgttgctatttttgcttcaattgctatcccttcatatcaaagttatagccgtagagctactgcatctgcggctaaaagtgaaattttgaaattagctgaacaattagaacagcataaatcaagaaattttacttataggggttttaccacaacctctataaccctacctcgcgggggatatacgattcaaattactgatgatacgaccacaggaaatttattgacgaatgctgctgcaaatgggcaaacatgggtcattaaagcaaccacaacagattcgagaaattttaattttattgctaaaaattcaggtatacgttgtcaaagtttaacagttacagccgttgataatgattgtggtggtacgactacttgtaatacatgtgaaacgaacagtgaggtttggcagtga

SEQ ID NO: 1986 - DNA, 927 bp, Acinetobacter baumannii
aaatacagtaaaattaaaaacttaagccttaataatttaataacatatattactttagagtttttacccatgaaaaaatcaaaatttttgtttgcaatattcacagctgtatctgctttcaatgcaaatgcctatcaaactgaagttggtactatgtatgaatttacagatatggatgggggagaagttaatagctttggaattaatggcaaatattattttaatccagttgaaaccaaaaattatcctttagctgaagcagcatttttaaataaagcctccaatattggtgctggttatacgtatagtaaagtagaagatgatcaagactatgcaaaacttgaatataattctgtaggaatagttggagaatattttgtcccaaatactccactctacttatctggagcatttaacagaacaaaaagagaagttactgtagatgatcttggatcagtcaatgataacggtaatggttatgctgtagaagtcggttttctaccaacagatggcttattattggctgctggcgtaactgatttatctgaaagttttgatccagtacaagcatctaaatatggctttattacttctttcgcaaatgctacgaccgtaactggtgaggatgatgatacagctgtaactctacgcgctaagtacattactcaaatttctggcttttatactaattttgaaggacaaacttatattggtgatgaaacgacttatcgtttgggcgcagatctttatcttgatcctactttaagtattggagcatctttcgcagattcaacggcagaagattcagatacgatctttagtcttcgcgcacaaaaattctttacacctcaagtagcagtaggcctaacttatacaactgttgatgatgctaactcttttggtattaacggagcattccgcttctaa

SEQ ID NO: 1987 - DNA, 252 bp, Acinetobacter baumannii
gttcatatcaacattatttttttcagtaggcaatccttttgtaaatatgacatgagcttgcttttcattcgagcaattttttgtcacatcgtttcaattaaaaataaaaaagccatcttttcagatggctcatcgttatttattgagtttcaatttcccgtaaacgcatcaaaccctcttgcaccgtactacatacgagttggccattttgccacatacggccaaagtttaaaccgcgagaagccgcactaa

SEQ ID NO: 1988 - DNA, 1338 bp, Acinetobacter baumannii
gtgataatcaaaaaaattctcgaaaaatgggacatcattttggatatcgcaattattggcagtggaatggcaggacttgcagcagcaagaattctgaaagatgcaggacatacaatcacgatatttgaagcacttcctggccggggaatggacagtcatagcattgagttcgatggtgggattattgatgcaccattgcgtgttatgaacccgcatctatggaaaaatacactcagccttgctgcacacttaggcattaaaacctttccggttcgtacctatatgtcttgtagctggttatttgaagatcgtactgaaacatggttaaccacatctcgtagccgtattggtaatttcccaattatcaataaccgtaaaggtatccagcaatatggctggcgtctggtaaaagggatgctgcaattaaaaactgcgattcaccagttctttaaatctaaaaatcaagatattactctcgctgaatttattaatcagaacgatattgaagaagtattctggcatggtgtagttatgccggtgctttatacgatttgtacatgtaacccaaaaacaattggtgattggcctgcgaaaaaccttcttgagtttttgcgtcatttaactgatggtgacatgttgttgcgtatgaaaggcggtacacctgcatttgtagacagcttaattaaaggcattgatatccatagcggttcggcaattaaaaaagttgagctacaaggtgaaaaagtactggtcgaaaatgaaaaaggtgaccaaggtacatttgaccgcgttattgtggcgacaccgacatctaaacttgaagagttcttaaaccctgaacagtttgcagaagatatgaatctgcttaaacagttccgctttgaacaaggcgacttggttattcatacagatgcaacagtaatgccaccacgccgtaaagactggtcagtgctgagctatatgatggaccgtaagtttactcgtcagcagtttacagtttggatgaatgccgttgagccatcactagtaggtaaaaatcctgtattccaaacttggcgtccagtagttgatattgaccctaaaaaagtcatttcaaaagtgaccttaacgcgtgcagttgtagactcgcaaactattgctttaaacaaagagctacaacaacgtcacttagaaccaaatcgtaaagtattctactgtggttcatggtcatgtgatggtttgccaattttagagtcagcagtgacttctgcgatgcatattgctgaaatcttgggcgcacctttaccatttgtgggattaaagcctaaggtcgaagttgcccctgaactcggttactaa

SEQ ID NO: 1989 - DNA, 798 bp, Acinetobacter baumannii
ctattgatcaatactttgctaagatgtgcacaatttcataaacatgatgaagcaaggagcgaaagcatgctaatcattccagcaattgacctgaaagatggtaaatgtgtgcgtttaaaacaagggcgtatggaagacgataccgttttctctgacgatccggttgcaactgcccagcattgggtaaatgaaggcgcacgacgtttgcatttggtcgatttgaatggtgctttcgcaggtacgcctattcataaacctgttgttgaagcaattgcaaaagctcagccagaattaccaattcaaattggtggcggtatccgctcattagaaaccattgaacactatttagaagctggcgtgacttttgtcattatcggtactaaagccgttcaagagcctgaatttgtagaagaagcttgtaaacgttttgcaggccacatcattgttggtattgatgccatgaatggtatggttgcaactgacggctgggcaaacgttactgatgtgaaagcaactgatttagcaaaacgctttgcagatgcaggcgtgtctagcattgtttacacggacattgcgcgtgacggcatgatgcaaggtgtaaatgttgagcagactgtaaacttggctcaatactcaggcttaccagtcattgcgtcaggtggtgtaaccaaccttgatgacgttcgtaacttaaaaggccaaccgggcattttaggcgcaatcacaggccgtgcaatttatgaaggtactttaaaccttcgtgaagctcagcttttgttagatgaaaaccgtctttaa

SEQ ID NO: 1990 - DNA, 510 bp, Acinetobacter baumannii
attattcacaaactactgctcaagttcgaatttttattttatcttttcaatacatcaaaacaaaaagtagaaatccatatgttcattattcgccaatttacaaatgcagatctggatgatgtggtcaatttatgggaaagctgtggcctaactcgcccttggaataaccctgaaacggatattttcaggaaagtttcgcagcaggacgatttattcctcgttgctattaaggatgagcaactgattggcacgcttatgggcggctacgacggccatagaggctggattaattatctggctgttcatccccaccaacaacgcttaggaatagccacagcgcttgttcaacagcttgagaagcggcttatggcgcgtggctgtcccaaattacaattattagtgcgtaaagataatctgaatgtgttgaatttttacgagcagctcggctatgacgaagtagaagcagtatgtttaggaaaacgtcttatttgtgacaaccctcatgactaa

SEQ ID NO: 1991 - DNA, 267 bp, Acinetobacter baumannii
agatataacaacgagacaatagctatgtttaagccatttgaaaagggtactgagtcttcttcaattgaagatttaacattagaaaatgatgtcgatcgcgtgagtatttatggcaatttgcaaatcactaaagacaaagtcggattagagcaggcaaaggcattgcagagttttttaaatgatgtagtcgcagctttggaaaaagaagaattgcctgagaaaattgaacgtccagctgaacaagaaattaataatccgtttttgtaa

SEQ ID NO: 1992 - DNA, 1473 bp, Acinetobacter baumannii
tgcaaaagcaatggagcaatctgcatgattcaaaataatttgcagtatttattaaaacatcctgatatttcattagaagcacctgcatcaaatgactatatcgaggtgaatgatgctgctacgggtgaaactttggcatgggtgaaaacctatgaccgtgcaggggttgaagccgcaattaaccgttcggcaaaagcgcaagctgcttggaaaaagcaaactgccttggcgcgtgctgatgtgttattggcatggtacaacctcatgctagagcacaaagaaaatctggcacagattttaacggctgaacaaggtaaaccattagcagaagcacgtggtgaaattggttatgcagcatcattcattcgctggtttgccgagcaagcgcgtcgtattgatggtgaagtcttaacacctacgttgccaaaccaacgtctgctcgtgattaaacaagcgattggtgttacagctgcaattacgccgtggaactttccggctgccatgattacgcgtaaagcaggtccagccattgctgcaggttgttcaatgttggttaaaccggcagagcaaacgccgttaaccgcctatgcgcttgaagttttggcgttacaggcaggcttaccagcagatgttttgattaacattagtggtgatgctgttgaagtcggtaaaaccctttgcgaaagcgatattgttcgtaagttaagctttactggttcaacgcaagttggccgtatcttgatgcaacaatgtgcgccaaccattaaaaagctttcacttgaacttggtggtaatgcaccagttgtggtatttgacgacgctaatcttgaacaagcagttcagggtattatggcaagtaaatatcgtaacagcggtcaaacctgtgtctgtgctaaccgtatttatgttcaagacggtatttacgatgcattggcagaccgtttggttgaagccgtgtctaaattgaaagttggtgatggccgtcaagaaggttcaactcaaggacctttaattgatgaagatgcgattgcaaaagtgcagtctcatattgcagatgcaactgagaaaggcgcaacagttcgtattggtggtaaacgttcggcacttggcggtacattctttgaaccgactgtgttaactggcgtaacgcaagacatgaaagtatctaaagaagaaacttttggtccacttgccccattgttccgctttaaaactgaagatgaagcagtggcaatggcgaacgataccgagttcggtttagctgcttatttgtttactcaaagcacagctcgtcaatggcgagtaggtgaggcacttgagtacggtatggtcggcattaacacgggcgcgatttcaaacgaagttgctccgtttggtggcgtaaaacagtcaggtctaggtcgtgaaggttcaaaattcggcatcgaagaatatgtcgaaatgaaatacctctgcgtagacttatctgagtaa

SEQ ID NO: 1993 - DNA, 1299 bp, Acinetobacter baumannii
tattttttaaacgatgtcataaatgagtcgtttgatatgtctgatcgcattcgggaaaaactacaaattcttgctgatgctgctaaatatgatgtgtcttgttcatcaagtggcagtgatcgtaaaaacaaaaataaaggtctgggggatgccagtcattcgggtatttgccatagctataccgaagatggccgctgtgtatctctcttaaaaattctatttagcaatatttgtatttttgactgcgcctattgcgtttcacgccgttctaatgacgtccaacgtgcggcatttacggtgcaagaggttgttgacttaaccattaatttttaccgtcgtaattatattgaaggtttatttttaagctctggcatttttaaatcggcggatcatacgatggagcgtatgcttcaagtcgtaaagaagttgcgtcttgaagaaaactttaatggttatattcacctaaaaactattccgggcgcatcgcctgaactgatccatgaagcaggtttatatgctgaccggatgagtattaatttagagatgccgactgagattgggttaaaaacttttgcgccagaaaaatcacatcaggaagtacaaaaagatttaggtttagttcgtgaccggctcattcaacttaaagatgagcgacaaattattaagcacgtgccgaaatatgtaccggcagggcagactacgcaaatggttgttggcgctcatcaagagtcagaccaagatgtattgtttatggctgacaaacactataaagaatttaaactcaaacgtgtctatttttcgggttatatcccaattaatactgaaaataattacttgcccgcagttggctctgcgccgccagtgttgagggaaaaccgactctatcaaagtgactggctgatgcgtttttacggttttgaagtcaatgaaattgtcaatgaaaaacaccctaacttagaccttgatgtagacccaaaattaagctgggctttaaggcatcctgaacagtttccggtagatttaaaccgtgcagattatcaaatgattttgcgtgtaccgggcattggtgtgaaatcggccaagaaaattgtgcaggctcgccgttttgggaaaatccatatcgatttacttaaaaaactcggtgtggcctaccaacgagcaaaattctttattcgctgtgaagacagtcctaaattccaaaaagaattgtcttcaagttttattcggcagcagattttaacgcaaggctcatcgaaatatgtgcagcaactctcgccacaattaagtcttgggttttag

SEQ ID NO: 1994 - DNA, 756 bp, Acinetobacter baumannii
agaattttaaaaatgattaaatcgattattacaggttgcgcggttcttacactttcagctttaacggtaactcatgcagagttttcttatgaacaagaattacaacaaggctgtaataaagtgaagcaatacgcgagtttaggtaagaaattctacgatcaaaaacaatataaaaaagcgctcgaaaatttccaaaaccaagcctcttggactgctttttgtaaggccaatgcagacgaaaccacagttaaatttaccgaccgtgatattgaggttgccaacaataacgtgggcttagcctatgccaaattgggtcaaccactttgggcaagagcatggtttatgctcgatgaaaaatcaaagtctagtcaatttaaccttaagcagttgcctcaacctaaagcatcaaatgatttgtcgggtgaatacgtccgttactcaggttttggtgagtgggatcacatcacggtaagtcgtaagcagggccaatatgccattggttattcgggtgtttatatgggcttacgaagcttaatttacggcccaaatatgggtgagtttggcactacaatgccgacaaatgccaagcaaaccatttataaagatcaagactgccgtattcagctcgattttaaatctaatgcgaaattaggaaattatattcaggtcaaacaaagcgaaggtgagtcgggttgtggctttggacataacgtttatgccgatggaacgtatttaaaagttgagtctggaaaataa

SEQ ID NO: 1995 - DNA, 642 bp, Acinetobacter baumannii
gtgatgttaaaagggtttattgccggaattgcagttgcgaatgcatttgaatgggtagcacacaaatatattttgcatggtgtacaccgtgccggacaaccgcgctatagcccagtgccgaaaagtatggagtcgcattgggcacaccatcgtgaagtccgtaaacaacagtttcatgatgattgttatgttgagggcgttggaaactggcgaaccaaaaatgagttaatttcacttgccgtggtggcaaccgtttcaagtgcaattttctaccctttttcaaaaggtatggcacttgcagcttggtacagtgctggtaattattactatattcatcgccgtgcacatttagagcctgactgggcaaagcgtaaaattccgtggcattacgaccaccatatgaactctaaccaagatgccaattggtgtgtgaccaaaccttggtttgactatgtgatgggaacacgtgtggtgtcttcagcagacttaaaagaacaaaaccctttggggatacggttacctactgcgcttgctaggccactcgctcatgctgtagaaaaaatctttccagcaaaatgggtcgagaaaaaagcacagcctaaactcattagtgatgtaagtgcgatagagggtgctgcataa

SEQ ID NO: 1996 - DNA, 642 bp, Acinetobacter baumannii
aagggaataaagatgcgagatcaggggcgtttagtcgaatggttcgacgaaaagggttatggctttattcagccggatgatgctgaaaaagagcgagtctttttgcatatcaaagattttgcacgccccggacctcggccaattattggttgtgcactggaatatctggtgattctcgacgaacgaggccgttttcgtgctcagcaggtcacttatttaaaggcatctcaaactcgaaaagcatccaagcctgcaaaaacacaatcttcttttcaggcgagcccatggtcagcaatgcaaatggggattgtgttttatttcgttttaatgggcattatgagttttattcatattttgccggcttataccttattgtttgtcttaatgatgaatgtgttgagttactggctatattcacaagataaagaagcagcgcaattgggcaatcgccgtgttcctgagcagactttgcacattgtcagtttcttagggggatggccagctgcgtggtgggcacaacaaaaactgagacataaaacacaaaaacaaccatttcgtaagatttatttttgtaccatattctttcatttacttttgattttgtggctaatttctcctttaaacgttttgcggggatcataa

SEQ ID NO: 1997 - DNA, 2847 bp, Acinetobacter baumannii
ttgagatgttttatgagccaaagtcatatccgtattcgaggcgcacgcacccataacttaaaaaatgtgtcactcgatattccacgcgacaaatttgtggtaattacggggctatcaggttcaggaaaatcttctcttgcctttgataccttgtatgccgaaggacagcgccgttatgtcgaatcactttcggcctatgcccgtcagtttttatcgcaaatggaaaaacctgaagtcgactcgattgaaggtttatcaccagccattgcgattgagcaaaagtctactagccataacccacgttcaacggttggtacgattaccgaaatttatgactatttgcgtctgctttatgcacgtgtcggtacgccttattgccctgaacacgacttacctatggttgcgcaaactgtttctgaaatggtcgatgcggtaaagaaccttgaggaaggcactgcactcatgttgcttgcccctgttgttcgtgagcgtaaaggtgaatacagcaacttgttcgaacaactacaaggtcaaggttttgttcgtgcccgtgttgatggtgaaatcattgatattgatacaccaccagaactcgacaaaaagaaaaaacataccattgaggtagttgttgaccgctttaaagtacgtgatgacttaggcaaccgtattgctgaatcatttgaaactgcactgcgtttaggtggcgatattgcagttttatcgtggatgaatggcgaacacccagatcgcgttttttctgcaaaacactcatgccctgaatgtgatcgcgcagtcgcagagcttgagccacgtttattttcatttaataacccgttcggtgcgtgccctgtctgtgatggcttaggtacacgtagccattttagccctgaaaaactcattcctaaccctgagcttgcaattagtgaaggtgctattcgtggttgggatcgtcaacgtccttattactattcaatgctgcaaaaagttgccgaccatttcggttttcaacttgatacaccttggaatcagttagataaagacacccaaaagaaattcttacaaggtactggcaaagaaaaaatcgatttaagttatatcgatgaacgcggccgtaaacatacacgcgtgcaaccttttgaaggaattttgccacaccttgaacgtcgctatcgtgaaactgaaagtaactatgtacgagacgatttagcacaatatttgtctaatgcagcttgtgatgcatgtggtggttcacgtctcaatgaaatttcacgtcatgttcgtgtaaaagataaaaccattgccgacattacccgcatgtcgattggagatgccgaaagttactatcaaggtataaaccttgaaggtgccaaaggtgaaattgcagataaaatctttaaagagattcgtgagcgtttgcacttcttagtgagtgttggcctgaactatttaagtctggctcgctcagccgaaacattatcgggtggtgaagcccagcgtatccgtctagcttcgcaaattggtgcaggtttgatgggtgtcatgtacgtccttgatgaaccatcaattggtctccatcaacgtgataatgaccgtttattacaaacgctaattcgcttacgtgatttgggcaatacggtattagtcgtggaacacgatgaagatgcaatccgtgcagctgaccatattattgatatcggccctggtgctggcgtgcatggtggtgttgtcattgctgaaggtacgtatgatgagctggctaaacatgccgactcactcacaggtcaatatctttcaggcaaactcaaaattgaagtgccaaaacagcgaactcaaccacctaaacctgaagaaaaaattaaactttcaggtgcagcgggtcataacttaaaaaatgtcgatttaaccatcccacttggcattatgacttgtgtcacgggtgtttcaggttcaggtaaatcaacactgattaaccgtacgttactcccactggctgcaacacagctcaacggtgcaacaaccttaacagccgaaaaatttgactcgattgatggtctacaacatctggataaagtcgttgatattgaccaaagcccaattggccgtacaccgcgctctaatccagcgacttatacgggtctatttacgccaattcgtgaattatttgctcaaacaccagaagcgaaagcgcgtggttatagtgcgggtcgtttctcatttaacgtaaaaggtggacgctgcgaagcgtgtgaaggcgacggtatgattaaagtcgcaatgcacttcttaccagacatgtatgtaccttgcgatgcatgtcatggcaaacgttataaccgtgaaacacttgaagtcggttataaaggcaaaaatatttctgatgttttagaaatgacggttgaagatgctgctgagttctttagtgctattccagttattcaccgtcgtttagaaaccttaactcaggtaggtctaggctatattcgtttaggtcaggcggctactactttatctggtggtgaagcacagcgtgtcaaactggctcgtgagttagcgaaacgtgatacgggtaaaacgctttatatcttggatgaaccaacaacaggtctacatttccatgatattgccaagttactcgatattttgcatgagctacgcaacaagggtaataccattgtggtgatcgaacataactttgatgtcattaacacagcagactgggtggtcgacataggtccagaaggtggttcgggcggtggtatgatcattgctgaagggacacctgaacaagtagccgaggtcgagatttcccatactggccgcttcttgaaaccgatgttgaaacaataa

SEQ ID NO: 1998 - DNA, 1026 bp, Acinetobacter baumannii
aaaaaatcccttactttttttatggatttatgttttgatgtatctaacctatttcgatcatctttgagggtcattatgcaacatccgacttcaacagatattcaacgtgtccgcgaatttctcctcgatttacaagcccgtatttgtgccggtttagaacaacaagaaaaagctggtggtgggacagcagaatttatcattgatgattgggagcgccctgaaggcggtggcggccgttcacgtgtactgcaaaatggtacagtgattgaaaaaggcggcgtgatgttttcacatatcaacattagtaaactgcctgcttctgcaacagaacgtcaccctcaaattgcaggggcaaaagctcaagcgctaggtgtgtctttagtcattcaccctaaaaacccgaatattccaacctcgcatgcgaatgtccgcttattcgttgcagagcgtgaaggtcaagatccgatttggtggtttggtggtggttttgacttaacgccattttatccagatgagcaagatgttttaaattggcaccaagccgcttatgacctctgtaagccttttggtgacaatgtttatgctgaacataaaaaatggtgcgatgactatttctatttaaagcatcgcgatgaacaacgtggtgtgggcggtttattctttgatgatttaaattgctgggatttcgaaacctgctttaaatatattcaagccgtaggtaatggctatttaaatgcgatcttgccaattttcgaaaaacaccgcgaacagccttataccgaagctcaacgcgaatttcagctttatcgccgtggcagatatgtcgaatataacttggtgtatgaccgcggtacgttgtttggattacaaacaggtggccgtattgagtcgattttagttagcttacctaatctagctgcatggtcttatcgccctgaatggggtgaagactctccagagaagcgtttaactgactactatttaaaacctcgtgattggttaggtttagaagaaaaagtcgcctaa

SEQ ID NO: 1999 - DNA, 189 bp, Acinetobacter baumannii
accacttcaaagacatatacatcattcacatacaacagcaatgctacagttcaaccttattgttcaggaacgatatcatcgctgctacaaacactttcagccccgaaacagtgcattttagtagatgttgctttcattgatttaaaccatttacatattttaaccatttttagtttcatgaacctttaa

SEQ ID NO: 2000 - DNA, 1104 bp, Acinetobacter baumannii
tttaaatcaaaggagtgccgcatgagaaatactatattgcttcagcctaagcaaattagggtattcgttattaccttaattgttctctgctgtggtgttctgtttcagaatgcggcttggagtgagaataatattgccactgctaccgatgaaacggatacggtagtggcaggcaaaattattcaacagcagcaagctcaagcatctaagcctcaaataaattctcaggcagcttcgagtgtcacacctcaaacgcaagttgcaaatgatatggctgatggtgaatcaattcgcggtttaccaacattaaatcaacctgtcattgatcaagctaacgttttgagtgaaaccgaaaaacaacagcttagccagaaaatcttaaatctttaccaacaaggtaaagcacaaataggtattgtgattgtaccgactacaggtcaagaagatatttttgattatgctttgcgagtaggtgaaaaatggcaactcggttcgagtaaacgagataatggcttacttattgcagttgcaattaatgaccatagaatacagattctaactggatacggtttagaaggagtattacctgatattgttgcaagtcgaattattcgaaatcaaattaccccttattttaaacaagcccaatatgctcaaggactaaatgcaggacttgatgaaattggaagaattttaaatttagatccggaagttgctcagcaagctgctcaagatttaaaagaacgccaacatcaagctgccgaagaacaacaagccaaacaaacaacgcttacaatggctttatttattcttgttgctggagttgtaggatcatttattgtcggtcgaccacttagcgcgtcaacagctggcgttgcggcagcggtagctggttttgtaaatggtgctggcgtaataatgagtttactactgggttttggtattttctttttactcataacttcaattgcccaactgattttacaggctattctgagtggagctggtggcggcggacgcggaggaggctttggcggtggtggcggaggctacggtggcggcggtggacgttttggcggtggaggtgcttcaggctcatggtaa

SEQ ID NO: 2001 - DNA, 360 bp, Acinetobacter baumannii
gatgcgtcaaaggtgattctttatatatttggcttggagtttactggtatgtctaaccagagaattcgtatccgtcttaagtcttttgatcatcgtctgattgatcaatctgctcaagagatcgtagaaaccgctaagcgtaccggcgcacaagtgtgtggtccaattccgatgcctactcgcatcgaacgcttcaacgttcttacttcaccgcacgttaacaaagatgcgcgtgaccagtacgaaatccgcacctacaaacgtttgatcgacatcgttcaacctacagataaaactgttgatgcattgatgaagttagatcttgcagctggtgttgatgttcagatcgctttgggttaa

SEQ ID NO: 2002 - DNA, 237 bp, Acinetobacter baumannii
atcacacaaaacaatgccgacacaataatgatatccatcataaaaacagaaactttacagcgaaaaagcccgctattcacacttgatagcgggctttttattactttgcttttaaacatcattaagtacagcttagcaatttatccttcttgcatgattgaaccgaattttccacgattaaaatcgttaatcgcttccataatctcggctttggtattcatgacaaatggaccataa

SEQ ID NO: 2003 - DNA, 807 bp, Acinetobacter baumannii
aaagcgcaaaatatgacacaatccttacatcctgccgctcaaaaaggcttcagctctgctgccgagctttatcagcaagttagaccaaattatcccgtagaaatagtaagttggctacaagatcggctccaaatacatgaaaattctactgttatcgatcttggatcgggtactggcaaattcttaccttacttaaaacagacacatgccaatattactgcagtagagccaattggcgagatgttacaacagcttcagcaagcctatcctgatattaaaactttacaagcctttagccacaatattccggtaaatgaccaacaaattgatgctgtcatttgtgcccaatcttttcattggtttgacaacatagaaacattgaccgaaatccatcgggtattaaaacctcaaggacatttaggacttgtttggaaccagcgcgatgaaagtacagattgggtaaaagctttagcggattttctactaccacttgaaggtgatacacctcgttaccatagtgaaaggtggaaaaaggtttttgaagagcaagatttatttacttttgacaatttaaatactttttcgcaatcgcagcatggtactgtcgaacaagtggtgagtaaacggttactttcaacaagttttattgcagcaatgactgaaaaagatcaactacagctcaaagctcagtttgaaaaaattgtttatgattttactgggttaggcccacaagatcagattgtttttccatatattacatatgcatatcattttcaaaaaagtacgtcgtcaaatcatagagaatag

SEQ ID NO: 2004 - DNA, 1284 bp, Acinetobacter baumannii
ataggaaaaaagatgtcagatctttcatacgtaaacgaacatagcgatgcatggcaaacttacttggctcaaattgaccgtgtagcgccatacttagaacatttagctgattatatcgatacattaaaacgtcctaagcgtgcgcttattgtggacgtgccaattgtaatggacgacggttcaatccagcactttgaaggctaccgtgtacaacacaacttgtctcgtggtcctggtaaaggtggtgttcgttaccatccaaatgttgacttaaatgaagtgatggcattgtctgcatggatgacaattaaaactgctgttttgaacttgccatttggtggtgcaaaaggtggtatccgtgttgacccacgtaaattatcaaatcgtgaattagagcgtttaactcgccgttatacgactgaaattggtcacattatcggacctcaaaaagacattcctgctccagacgttggtacaaatgccaatatcatgggttggatgatggatacctactcgactagccaaggtcacacagtgactggtgttgtaactggtaaaccagttcacttaggcggctctttaggtcgtgtgaaagcaactggtcgcggtgtattcgttactggtcgtgaagttgctgcaaaaatcaacttaccaattgaaggcgcaaaagttgctgttcaaggttttggtaatgtaggtagtgaagctgctttcttatttgttgaatcaaaagcaaaaatcactcacgttcaagaccacactggcacaattttcaatgctgatggtattgatcttgttgcgctacgtgatcacgtaaatgcaaaccaaggtgttggtggttttgctggtgcacaagcaattgcagatgaagatttctggactgcagaagtagacatcattattcctgctgcattagaaggccaaattacagttgagcgtgctgaaaaacttaaagctaagttgattttagaaggcgcgaacggcccgacttatcctaaagctgaagatgtattggttgagcgtggcattgttgtagttcctgacgtggtatgtaacgccggcggtgtaactgtaagttacttcgaatgggttcaagatatggcgagctacttctggagcgaagaagaaatcaacgagcgtttagacaagttgatggttcaagcaatggatgacgtttggaatacagcgaacaagaatgcttgtactttacgtacagcagcttacatcttggcatgtgagcgtatcttaaaagctcgtaaagaacgcggtattttcccaggctaa

SEQ ID NO: 2005 - DNA, 2127 bp, Acinetobacter baumannii
gcaacagaaaaagggtggtctatgccaggcgaagaggtcagccaagccaagcaacagctcaaattaattatcgacccttacttatcggcaagtgaagtcgaaaaagtgcttgctgcctgcgattttggagatctggcacacactggtattacccgtaaaagtggagaaccttatattctgcatcctatcgcggttagctgtattttagcgaatatgcgtctggatcctgaaacattaatggctgcacttttacatgatgtcattgaagacactcaatatacaaaagacgatattattgagcgatttggacaaacagttgcagagcttgttgatggcgtaaccaaactaagccagtcgagcgataaagaatataataaagctgcttcttttagaaaaattctacaagctactttgcaggatccacgtgtcattattattaaactagctgatcgctaccacaatatgaccacattgggcgccttacgtcccgataaacgtgctcgtattgctcaagaaacctttgatattttcgtaccgatggcaagattagtcggcatgaatgaaatggccgataaccttgaaaatttatgttatcaaaatctcgatttagatatgtttgataacgttcaaaatgcgttgcttcaaaccaaaccagagcgatgtaaataccaaagtatctgggaacaaaatcttgcggagcttctccacaattatcatattcaaggtcgaattaaaaagaaaaataataatattgagctcttacgccatttcgtaaaaaatgaaatggatttacaagaacttactcatagccatgcctttgaaatcgttttgcaatccattgcagactgcgatcgtttagtagcagcattaaaagaaaattttcaagtcatccaatatcaagatcatatccgccggccattaccaggtggtaatcagtcattaatgatcaagcttaagggtgaaaaaaccacgttatcgctcactattcaaactgagttgatgcgtaaagctgcacgtttcggtgtcgtactcggcgaaaatgctccacaaacttgccgctctgccattcaagcttccatgcagaacctaaatacactcattgatggtgaatgcgctaaaacgacttttaatgacttacttgattatttacatcaagaaaaaatttgggtttacacaccacacggccagttacatgaattaccacaaggtgccacagtagttgattttgcctattcagctagtcttttcttaggcaaccatgcggtaggtgcgaaagttgatggtgaaattaagccactttctacaccattagttagtgggcaggttattgagattattactgacgttttagcaacgccaaatccagattggttgagcttcattaacactcaaaaagctcgccgtgctttacagcacgtactcaaagaccaagatattgaagaacaacgtttagttggtgcccaagcactttcacgagctttgaaactctttaatcgttctattaacgacctttcagatgcagattggttagatctcttacaatggcgtcatattgataataaagatgcattatttgagcaaattgctgttggagatttacttcctcaacttgtagctaaccatttgtttgcaaatgacaagcatcctcgagcagaaaattcagatcgactaattcaaggtactgaaggcattgatgttaaatatgcccactgttgtaatcctattttaggcgatccaattcaaggccatttaacgcgacgtggtttaattgtgcaccgtattcgttgtcataatttgcttcatgaacaacatttacacccagaaaacattatgccgcttcaatggaaagcagatgacgtagatgatgtacgttttactgcttaccttgcgatttatatggcaatgaatgatgaacaggtatcagacctcatctatcaatgtcgtaaaaataatgctggggtagaaatggtacattccaacgaacagcgtactttcgtcaatatcgtagtaaacaaccgtaaacatattgccaaagtcattcgtgatttacgaatgcactatggcttcccacgtattgagcgtctacatgcccctgctccacaaatggaaatttccaaagtcagctaa

SEQ ID NO: 2006 - DNA, 1050 bp, Acinetobacter baumannii
aaaaaaggaaagctagccatgatgattgtccgtcatgccgagtttcgagaccttgaagatatttataaattagcaggtaagtcaggtgttggtctgacttccttgccacaaaatatggatacgctttcggctcgaatttcacgtactcgcaatactttaaatggcaatgttcataagagtgaacagggatatttgtttgttctggaagataccgaagctcaacgtgttattggtgtaagtgcaattgaggttgcggtaggtttaattgaaccttggtacaactttcatgtgggaacacaagtacacgcttcaaaagcattaaacgtatataagtcattaccgactttatttttaagtaatgacagaacaggaagtagtgagctctgtacattatttttagatccggaacgccgtgaaaatcaaaacggtaaatttttatcgaaaatccgttttatgtttatcgcagcatttaagcaatattttgagaaaaaattaattgcggaaatgcgtggctactctgatgaaaatggatgttcacctttttgggatgcgattgggcaccattttttcaatatggatttctcaactgcagactatttaagtggtattggccaaaaagtttttattgccgagctgatgccgcgttttccagtctatgtcgaccttttgccaaaagatgcgcaagaagtgattggaaaaatgcatccacatactttgcctgcttatcatgtgcttgaatcagaaggtttacgttatcaagggtatgtcgatatttttgatgcgggtccaactattgaagccaatattgatgagttgcgtgcagtcaaagaaagtcaactcttaaacgtcaaaattaccaatgaggcaacagtgggtaaaacacaataccttgttgctaatgataattaccacgactatcgggccatgttattgaagcttgatctcgtagataacactttaaatttaacgcatgaacaagctgaaaaactcggtgtacaagaaggtcacgctgttcgtgtgttatcactaaatcctatggaagtatcctga

SEQ ID NO: 2007 - DNA, 1758 bp, Acinetobacter baumannii
aggaagttgaagccatcacgcatgagaaaggactacactaatatgaaatggaattcattaaaagcgaaagccttattggcagcagcatcgctatattcaactgttgctatggcaagcccggacttaggtgaagcagaacagcaagccaccaactggcatgccattatcatgtttatcatctttgttggctttaccttatttattaccaaatgggcggctaaacaaactcaatcggcgcaagacttctatactgctggtggtgggatcagtggtttccaaaacggtttggcgattgcgggtgactatatgtcagcagcgtcatttcttggtatttctgcaatggtgtttagctcaggttttgacggcttgctctattcactcgggttcatggtcggttggccaatcgttttattcttggtggcagaacgcttacgtaaccttggtaaatataacctttcagacgtagtgtcattccgtcttgaagaaaaaccagttcgtactttagctgctttcagctcgcttgttgtagtcgcgttctatttgattgcacaaatggtaggggcaggtcagctcatcaaactattatttggtttgaactataacattgcagttgtgattgtcggcttgctcatgatggcatacgttattttcggcggaatgctagcaaccacatgggtacaaatcattaaagcagtgatgttattaagtggtgcaacgttcatggcctttatggtgatgaaagcggttggtttcagctttagtaatatgttcacccaatcaattgaagtgttcagtaaagttcatgatgtaagctttgaagatgctgcaaaaattatgggaccaggtaaacttgccgcaaacccgattgatgccttatctcttggcttagcactcatgtttggtacagcaggtcttccacacattcttatgcgtttcttcacggtaaaagacgcaaaagaagcgcgtaaatcagttgtcgttgcaacaggttttattggttacttctatcttttaacttttattattggtttcggtgcgatccttttcgtatcaaacaacccgcaattccttgatgttgcgaaaatggcaatgaccggcaaacttgagcttgttggtggtaacaatatggcagccgtgcatttaagtgacgctttaggcggtgacttattcatgggcttcatttcagcagtagcgttcgcaacgattcttgctgttgttgctggtttaacactttcaggtgcatctgcgatctcacacgatttatacgctaacgtatttaaaaaaggtcaaaccacgccagcttcagagcttcgcatgtcaaaaatcgcgacgcttggtttagccatctttgccatgattttaggtattttgtttgaaaagcaaaacgtagcattcatggtaggtttagcattctctgtagcgtgttgtgcaaacttcccaattcttgttctttcaatgttctggaaaggtttaacaactcgtggtgcggtcattggtggcgtagttggtcttgtaacagcggttgtactcattattctgtctaaagcagtatgggtagatactttaaaaatctctgataccccaattaacccgttcaatggtcctgcattatttgcaatgcctttgtcgttcctttgctgctggttcttctcggtaactgacagctcagcacgtgcgaaaaaagaacgcgcttctttcgacgctcaatatgttcgttcaatgacaggtattggtgcttctggtgcatcagaccactaa

SEQ ID NO: 2008 - DNA, 549 bp, Acinetobacter baumannii
gttcggttgaaagctatgttaaaaaaaacgcctcatatcatcttaatgtctttgctcagctctagcctattattgacggcttgtaaaaaagcagatgagccagcaaagactgaacaatctcatacaagttcatctaccgatcaggtcttggaaaaactcaatgaaagaccagtgaagaaattcccagctactgcggatgacgctcatgatattgcgctactagaagattacgatcgccgctttactgaaatgagtgacgagatggaaaatgagttagcgaaaatgcatgaggctggcacactcaccgcagagtttgaacaaaaacgtacgcttgataatgtgcgctcagcattgaccatgttaaaagacctcgatttaaaaactgaacaaggtcgttatattcagggcttactctatcaatattgggaaaaccaagaaaagaactttagtgataagcaggcaagtaaagatgaacaggtcaaacagcttgctgactatttacaagcacaaaatcagttaaagtactggaaagcctcacagcagcattaa

SEQ ID NO: 2009 - DNA, 657 bp, Acinetobacter baumannii
tcgcttatgaatattttaatcgttgatgatcatcctttgtttcgtcatgctttgattcaagcagtacgttatagcctgccgcaggcacaaattcatgaaacagcttcggttgatgagttttatgagcgtttggaaaatggggcagaacctgatctggtattactcgatttaaacttaccgggtgcttcaggcttttcggctctggtctatgtaagagcacaatatccatctattcctattattgtggtttctgcacacgaagaagcgtcaattattcaacgtgcaattgcgcatggtgcaatgggttatattcctaaatcggctcatccaagtcatattggcgaagcaatccgtcaagtgttagatggggaaatctggttaccgccaaacttgccatcaaatattaatcttgatccgagagcggcagatgaaactgctttggctgaacgtattcagtcgttaacgcctcaacaattccgtgttttgatgatggttgcagaaggtttattaaataaacaaattgcttatgaactcgatgtttcagaggctaccatcaaagcgcacgtaacggctatttttagaaaactaggcgtacaaaatcgtacacaggctgtattggcaattagtgcattaaatattgaagataaaaaaatctaa

SEQ ID NO: 2010 - DNA, 1197 bp, Acinetobacter baumannii
cgccccatgaaaaagcataacaatttccaaacccaactcattcatgcaccacgaaaagcacctcaatttattgaaaccgtgcaacctcccttatttcgtgcatcaactattatttttaaatcgacttcgcacctttttgaccgtcattggaccgatccttatgactatagttatggcacccacggtacgcctacgacatttacactaggcgacaatattgctcaaattgagggtggtttatactgcctacttgctccaagcgggttatctgcgattaatctcgtaaattctgctgtgttagcaacaggtgatgaagtttgggtgccagacaacatatatggtccgaatctggaacacctaaactacttaaaagatcaatatggaattaatgttcaagtttataacccgatcgatatctcaagtttccagccttctgataaaaccaagttgctatggttagaagcagcaggttctgtcactcttgaatttccagatctcaaagcgctagtaaaaaaagcaaaagcacatggcgttttaactgcactcgataacacttggggagctggcctcgcctttaatgcttttgatttttccgatgagcatttatcagtggatttaaccattcatgcgcttaccaaatatccaagtggtggtggcgatattttaatgggaagtgtggtaactcgtgatgagaagttacatcaccgtttgttccgaatgcatgccattttagggatttcggtatctggtgatgataccgcccaaattcaacgcagtcttgcgcatatgtcattaaggtatgagcaacaatcaaataatgctaaaaccctactgacatggttaaaagaacaatctcagtttgcacaagttctacatccaagcgataaagctgcacctggtcatcaatactggcaagaaatttgctcaacaggtaaaagtgcaggcttagtgagtgttgtattcaaatctgattatgatatttcagcagtacgccgtttttgtgatgctcttaagctattcaaacttggttttagttggggaggacctgtgagtctcgtcatgctttatgatttaaaaatgatgagaaaacttgaaaatacacatttacaacaaggtttgttggttcgcttctgtatagggctagaagatccacaagatttaattcaagatatcgaaaatgctctgaaacaaatgtaa

SEQ ID NO: 2011 - DNA, 426 bp, Acinetobacter baumannii
tccaaaatgaaagccataaaaattttatgtattacaagctctatcttggtttcatcatctctctttgctgaaacacctcaacctcaacaagtgaatgaagcaacttctaagacaatgccttatggtgataatccaagcttaggccgcgtactgttatacaaaacaggaaaaggcattcaaaatttaggagattctattcaaggcgcttctgaaaaaacttcaaataaaattagtgaaaaatggaaagatacgaaagaatttaccgccgaaaaagcagaagttgttcaacaaaaagcggatacagccaaagtatttactgaacagaaaatagaacaagctaagcaaaatatcaccagcagtagaaacggtgaaaatattccaatcgaacaaggtgagctaagtaaatctagtacgactgccaattaa

SEQ ID NO: 2012 - DNA, 897 bp, Acinetobacter baumannii
aatgctgtgaataaaaaattagaagctctgttccaggaaaaggtacaaggtaaagtcatcttagtgacaggcgcctcaagtggaatcggtttaacgatttccaataaacttgctgatgctggtgcgcatgttttactggttgcccgtactcaagaaacattagaagaagtcaaagcagatattgaaagccgtggcggtcaggcatcaattttcccatgtgatctgaatgacatggaaatgattgatcaggtttctaaagagattttagcttctgttgaccatattgatattttaattaataacgcaggtcgctctattcgtcgtgccgttcatgagtcttatgaccgtttccacgactttgaacgtactatgcaattgaactactttggcgctgtacgtttagtgctcaatattttgcctcacatgattcaacgcaaagatgggcaaattattaatattagttcgattggtgtattagcaaatgcaacccgcttctcggcttatgttgcttctaaagctgcgcttgatgcatttagccgttgtctatcggcagaagttcatgcacataaaattgcaattacttcaatttacatgcctttagtgcgtacaccaatgattgcgccgaccaagatttataaatatgtaccgactctctcacctgagcaagcagccgatttaattgcttatgcgattgtgaaacgtccaaaacgtattgcaactaacttaggccgtttggcttctatgacctattcagtggcgcctggcattaacaatatgtttatgtcgattggtttccgtctgtttccaagttcagacgccgcaaaaggcaaaaaagctgaaaaacttaactgggtgcaaaaagcatatgcacgcattttcccaggtgagcattggtaa

SEQ ID NO: 2013 - DNA, 810 bp, Acinetobacter baumannii
gcgcgagccctctcatttaaaaagttattttttatgcgtcgtagtgaaaaatcgaaagacaccaaagccagactcgcacccaagcaaaagatcagttacgaaaagaaaccggatccagcgattacagcctatgctgtgcaatctctaaactggttacgccaagctgaatttttaatgagtgctccgaaattggcactatgtgttgaagatagcggctacgagattgcgtttgccggacgttcaaatgcaggaaaatctagcgcaattaatgcattaacaaaccagaaacagctcgcacgtgcctccaaaaaacctgggcgcacgcaaatgattaactttttcagcctaggtaatccagatcaacgcttagttgaccttcctggttatggttatgcagccgtaccagaagatatgaaacgtgtatggcaaaaagaattagaaaactatctaatccatcgtaaaagcttacaaggtttggttttactcatggatattcgccaccctttacagcactttgacatgatgatgctagagtgggcttattcacgccatttatttgttcatattcttttaaccaaagcagataaactgaaccgcggtccagcgaacaaagtcttgctcgaagttaaacaacaactgaaaaaaatgaagcttgatttctcgattcagcttttttcttcattaaacaaactaggtttagaagagctagcaagtgtgatggctggacgattgcactttacgcttgaacaacagccagaatttgacgttgatgcaatcccagaagcgagcgatgaggatgcagaagagtaa

SEQ ID NO: 2014 - DNA, 768 bp, Acinetobacter baumannii
cgcagcaggaaaatagaggagtctgcggtgttttttgcagtcattacgctttttcctgaaatgtttgacgcgattacagcctacgggattagcgggcgtgcagcaaaacgtgacatagtacaagtcacttgtattaatccacgtgattttgctgaagggaattaccgaagagtggatgaacgtccatttggtggtggccctggtatggtgatgatggcggagcctttggcaaaagcaattaaccatgccaaacaacttgcttcgcgagcaggatgtgttcatgtacctgtggtgtatatgtctccacaaggcaaaactttaaatgaacaggcagtacagcagtttgtcgattatgatggcttaattgtattgtgtgggcgttatgaaggcgtcgatgagcgtttgatccagcattatgttgatcaggaatggtcgattggagattacgtcttatctggtggtgaactacctgccatggtgttgcttgatagtattattcgccgtttgccgaatgtaatgtcagatgagcaatcagcgatacaggattcttttgtagatggtcttttggattgtccgcaatacactaagccagaccagtttgaagggttagatgttcctgaaattttaaagtcgggacatcatgccaatattgagaaatggcgttttttgcagcgttatcaacgaactttagagcgtcgacctgagttgattgaacaggttacgttgactaagcagcaaaaaaaatggctgtcagatgaacaagggtaa

SEQ ID NO: 2015 - DNA, 1398 bp, Acinetobacter baumannii
atgaaatttgaatttaaaaacttaggcccaattcatcaaggcgaaatagaacttgctgatttaacggtattgtgtggaaaaaataacacaggtaaaacatatgtaactaatgctctttattcattttttcaaaattggctggatttaatagattggagtttgcctgactctattgaagccgaaatacaccataaaggtattgcaagtattgatttagaaaaagatgtcattagtaacatagatactaaacaagctatgaaaaatttatcggaaaatttgtctaatttttttgcttgttctcctgacttatttaaaaatgttgaatttaatatccaatttgaaattaaggaagattggcaagaatatgaatttagctctaaaacaggaagtccttcaggagaggtatttttaactataaagaagccaaaaaatagtaaaatagctgaaattgcatggttggatagcgactcagctcctcctttatttcttttagatgaatatataaagaaaaacttatttgaagcctgttttaaaactacatttccggaagtctttattgcaagtgctgaacgtactggagcatcgatttttaggaacgagttaaactttaacaaaaatcagcttgttagcttgcttgctgaaatggaaaagaatggtaataaaaaatttaatccattcgatatcgcacgtagttttaaacgtacttatgctcagtctgtggagcataatgtagattttataagttacagaatagaaaatttagttaaaaaggggcaaagtgaatttattaaaaaaaatgcctatttattagctaaatttcaagaaattgctggaggggtttataaataccataaagatacaggagtttattttcaaccaaatggtgcaagaggagtaaaacttggtttaggagaggcttcaagtgctgtgcgttctttaatgattatttggttttggttaaatcatgttgctaaaccaaatagtttattaatgattgatgagcctgaattaaaccttcaccctgaaaatcaaagaaaattagctaaatttgttgcggccttagtcagtgcgggcgttagagtttttatgactactcatagtgattatattattcgggaattaaatactttggtaatgctcagttgtgataaacctcacattcaaaaagtacgtgataaatttaattatgatgataatgattttataaaaccagaaaatatagctgtttacaatacaacagaagatctttttgaagtggaaggttctagccgtcgtaaaaaaatgggcacaattgagcgttgggatgtcgtacaacatgttggaattaaaattcagagttttgataaagaaattcgagaaatgaacaaagtacaagatgctcttcgttatggaatttag

SEQ ID NO: 2016 - DNA, 318 bp, Acinetobacter baumannii
aaggggtttgaagtgttgccgatggtcggcgcagggataatccgtaagaattataaggcttttatcatggttgttattcgtttagcacgtggcggcgcaaaaaaacgtccattctatcaaatcgttgtgactgatagccgcaatgcacgtgatggtcgtttcatcgagcgtatcggtttctttaacccaactgcacaaggtcaagcagaaaaacttcgtttagacgcagaccgttttgctcactgggtttctcaaggtgctcaaccttctgaacgtgttgcttctttggctgctcaagctaaaaaagctactgcataa

SEQ ID NO: 2017 - DNA, 2388 bp, Acinetobacter baumannii
tcagtgcttttaaactttatccttgtgggatcaaacacgatgactgacttagttcagcagttggcaagtgagcttgccgtacgtccaaaccaagtagaagctgccatccgcttaattgatgaaggtgccagtgttccattcattgcccgttaccgtaaagaagtaacacaaggtttagatgatacgcagttacgccaattagatactcgtttagcgtatttacgtgatttatatgagcgccgtgaaaaggtcattcagtcattgcaagaacagaataaattgaatgatgacttgttggcgcgggtgaatgcagccgaaacaaaaaatgctttagaagaaatttatgcgccgtaccgtcctaaacgtacgagcaaatctttcaaggcgaaagaagcgggccttggaccaattgccgaaaaaattatttcagaacaaattgatccgacagaagcattggctggttttagtcatgaagactatccggacgttgaaagtcagttagacgcaatccagcatattctgattgatgactgggcacaaaacatccctcttactacagaattaaaagcgacttttgcaaaaacagcagtattaaaaagtactgttgcatctgaagagaagaaagaagtgggcaaaaagttccgcgattactttgaattctcggaaggcctaaacaaattaccatcacatcgtttattggcgatgttacgtggccgccaagaaaacgtactcggtttaaaagttgatggcgaagatgatgcaccattggctcgtattgaaactgaatacaaccttgatcaggttcagccacaaacacgtcaagattttttaaaacaaactgcaaaattattctggttaggtaaagttcgtcctcaaatcgagcattcattacttacagaaaaacgtcttgctgctgaagcagaagcaatgcaggtgtttgctgaaaatcttcgtcacttattgttatcagcgccagctggtagccgtacgactttgggtgtcgaccctggtattcgtactggtgtgaaactagctgtggtaagcgaagctggtgatgtacttgcacatagcacgatttatccatttgcgcctaaagaagataaagaaggctcaattgctgagcttgcacgtctatgtcgtgaatacaatgtcgagcttattgctattggcaatggtactgcgagccgtgaaacagaagctgttgtagctgaaatgatggctgcaaatacagatcttaaattaactcgcgtaaccgtaagtgaagcaggcgcctctgtttactctgcaagtgaacttgctgcggcggaactgccagagcttgatgtttcaatccgtggtgcagtttctattgcgcgccgtttacaagacccgcttgctgagcttgttaaaattgatccgaagtcgattggcgtaggtcaatatcaacatgatgtgaaccaaactggtttagcaaaaacgcttgatgcagttgtagaagactgtgtgaacgctgttggggtagatgtaaatactgcttcaccagcaatcttggcttatattgcaggtttaaacaaagcaattgcacagcaaattgttgaataccgtaaagagcatggccgttttgacacacgtcaggcacttaaaaatgtaccgcgtcttggcgaacgtacttttgaacaggcagctggtttcttgcgtatccaaaatggttcagagccattagatgcatctgctgttcaccctgaaagttatggtcttgttgagaaaattgttgcagcaaaagcgacaacggtaaaagacattattggtaataccgaaattattcgtcaggtaaaagcagaagagtttgttgatgacaaattcggtttgccaaccattcaagacgttttagcagaacttgaaaaaccgggccgtgaccctcgtccagaattccgcacagctaaattccgtgaagacattactgaagttgctcagttgactgaaggtatgcagcttgaaggtgttgtgacgaacgtgacgaattttggtgcttttgttgatattggtgtgcatcaagatggtttggttcatatctctgaattagccaatgagttcgtttctgacccgcataaagtggtaaaaccaggtcagatcgtacaagtgcgtgttatgcaggttgatgttgaacgtaaccgtgtgaacttgagtatgcgtgcagaaggtgcggcacctgtgaaagcacagcgaccaccacgtcgtgaacaaaataacgaacagcgttctgagcgtaaaccacaaggtaaacgtccacaaccgcgtaaagatcaagttgaacgtccgcagcgtagtaagcaagaaaaaccacaagagcaaaaaattggtggttttggtgcattattattgcaagcaggaattaagggttctaaataa

SEQ ID NO: 2018 - DNA, 717 bp, Acinetobacter baumannii
tttcgtgttgactgcggtcatgttcggagggatttaatgaaatcacgtactagtgagctggccgtaggtatctttgtcattatcttcggtattgctttattctttttagcaatgaaagtgagtggtttagtgggcacgaacttgagcgacggctacaccatgaaagctcagtttgataacgttaatggtttaaagcctcgtgctaaagtgacgatgagcggtgtaacaattggccgcgttgattcaatcacgcttgatccggttacacgtttggctacggttacttttgatcttgatggaaaactgacaagctttaatgctgaacagttaaaagaagttcaaaaaaatgctttagacgaattacgttatagttctgattatacgcaagcgactccagcgcaacaaaaaacaatggaacagcaactgatcagtaacatgaactccatcacaagtattgatgaagatgcttatataatggttgcaaccaatggtttattgggtgagaaatatttaaaaatcgtaccgggtggtggtctaaactaccttaaacgtggcgatactatttctaatacccaaggaacgatggatctagaagatcttattagtaaatttattactggtggtggcgcaggtaaggttgccgctggttcatcctcagcagaagaaaaagctcctgcaagtactgacagcagtgcacagccgtcatttgttgagtaa

SEQ ID NO: 2019 - DNA, 501 bp, Acinetobacter baumannii
ctttacgttgagaaaacagttgaactcaacaatgattcactggcaaagaaatacggcacaacgacagctaaaaactcatttaaaacctcttcttcaaatccttattcttggttagtttctcatcctcttcctgatacagtacgtgtttcttctaactttggtggtcgtaccatgggtggtcgtgcagagcatcatggtggtttagatatggctgcaccaagtggtacgccaatctatgcgactggcccgggtattgtgactaaatcaggctggggcacaggttatggccaatatgttgaaattaaccatggtaatggttatttaacacgttacgcgcatgcttcacgcttaatggttcgagtaggtgatcaggtttctgctggtgaccatattgctaatgttggttgtacaggccgctgtactggtccacatttacattacgaagtagttaaagatggtcaacgtaagaatccatcaacttacttagcaatgttgccttaa

SEQ ID NO: 2020 - DNA, 1233 bp, Acinetobacter baumannii
atagatactgaggtaagcatggaacagccaatttctgtaactcgaagcaactttaatgactggatggttccagtatttgcaccggcaaatttcattccggtacgtggtgaaggttcacgtatatgggatcaagaaaataaagaatatatcgattttgcaggcgggattgcagtaaatgcattaggtcatgcgcatccagtggcagtcaatgcgttaacagaacaagcaaaaaaactttggcacgtcggtaatggttataccaatgaaccagtactacgccttgctaaacaactcaccgaaaatacatttgccgataaagtattcttctgtaactcaggtgctgaagcgaacgaagcagctttaaaattggctcgtaaagttgggctagacagtggtatagctggtaaaagtggtatcgttgcatttaacaatgctttccatggccgtaccttatttaccgtttcagcaggtggtcagccaaaatattcacaagactttgcaccacttccaaacggtattagtcatgttgcttataatgatttagaagcggctaaagcagtcataaatgaacaaacttgtgcagtaattgtagagcctgtacaaggtgagggcggggtaattccagctgatatcgagtttttaaaaggtttacgtgaactgtgtgatcagtttggtgcattgctgatttttgatgaagtacaaactggtgtcggccgtacaggtgcactatatgcctacatgaactacggtgtgattccggatgtactgactactgcaaaagccttgggcggtggtttcccagtcggtgcaatgttaacaactgataaatttgcaccgcatttttctgtaggtacacatggtacaacttacggtggtaacccgttagcaagtgcagttgcaggtgcagtttttgagtttattaatacaccagaagtacttgaaggcgtgaaacaccgtcatcaatatttccttgatgcattaaatactttaaatggtgaatatcaagtatttgatgaaattcgtggtcaaggtttattgattggctgtgtactaaaagctgaatatgcaggtaaagcgaaagacattaccacatgggcaggcgaagaaggattactcgctttaatcgcaggacctaacgtggttcgtttcactccttctctaattattcctgaacaagatattgatgaagggattgctcgtttaaaaagagctttggcaaagttggctaaataa

SEQ ID NO: 2021 - DNA, 339 bp, Acinetobacter baumannii
aaaatgactgactgccttccatcaaatacgccattagaagaaacaggatttggctataccctttctttaattaatggcaaatataagatgatcatcatgtattggctgtatggaaaaactgttatgcgtttcaatgagttgcagcgctgtattggcaatatttcatttaggacgctgagcaatacacttaaagagttagaaagagacgagctgattattcgtaaggaatatcctcaaattccaccaaaggttgagtaccgtctttcggaaagaggacagtctttaattcctttgctagatatgatgtgccaatggggcgagcggaatatgaattcttag

SEQ ID NO: 2022 - DNA, 396 bp, Acinetobacter baumannii
catcaaggtgaagttgtggtggagttgagtatgaaaaagattggtttactcatgatgtgtaatttgttgattctgagtgcttgtacaccaaatacaaatccacctacacctcaagcgaacagtccgatacaagctgttttactcgatcaacctaatcttttaaataatgccagtaatttaagtatttcacagcaaatgaatgccttagaggatccttctaatgctcaagttactattttgcagacagagccgagtgaggatgctgtttcgaaaacacgtactgagtatttattaaaaaaagatcagactgtttggaaaatcgtgaataaaaaacaaagttatcaatgtacaaaaggcgaggaaacagcagactttcaagttaatccttgtccttaa

SEQ ID NO: 2023 - DNA, 603 bp, Acinetobacter baumannii
cactttagcgagaaatcattaatatattttttaatgaaagcaattgaaataggtggcgccttgccaagcaaagcgtttgaaaccctaccaaatatttatttggtagggcccatgggggcaggaaaaacaaccgttggacgtcatttagcagaactattagggcgtgaatttttagatagtgatcatgaaattgagcgcaagacaggggccactattccctggatttttgaaaaagaaggagaagtcggcttccgtacgcgtgaaactgtcgttttaaatgagcttacttcacgtaaggcattagtgcttgccacaggtggcggtgctattactcaggcgcctaatcgggagtttttaaagcaacgtggaatcgttgtttatctatatactcctgtcgaattacaactacaaagaacctatcgcgataaaaatagacctttattacaagttgaaaatcctgaacaaaaattgcgggatttattaaagatcagagatcctctgtatcgtgaagttgcacactatacgattgaaacgaatcaaggtgctgcacgtgatcttgcccaaaagattttgcaacttattctatcgaacaagttaaaatag

SEQ ID NO: 2024 - DNA, 1158 bp, Acinetobacter baumannii
aataaaagcgaaataagcaaattgttagttgaaaaactacggagaaaaataatgcaaagtaaaacgttgtttctattaggtctatgtacaattttcagtacaactgtgtccgctcttcctttggattccaaaggggccaaacagcggttaagtcaggcagcaaaacaaaaagtgttccaaggtaaaatagatttagatgccttggttagtaatgattcaaacgatttaattgtcgaatacaatattccttcatcgagcgtaccttccggtttagaacggcgaagttatattgctacaaataaaaagaatcttcagacaaggtttaatcgtgccggcggtgtacaagtacttcgggattacaataacctgcctttggctttttatcggattagtaaccgtgaggctttaatagctttattaaatgatccgaacgttaaagcagtttatccaaaccgtattaaccgtactacaactactgaaagtttgcctttgattaatcaaccacaagccaataccaatggttttacgggggagggatctagtgttgctgtgctggatacaggggtaaattatctacattcagatttcggatgtaccgctgtgaatactccatcaagtacttgccgtgtggtttattcttttgatagtgcaccagatgatggcactttggatgatgatgggcatggtagtaacgtttccgctattgtgtcgaaagtcgctactaaaactaaaattattggtattgatgtatttagaaaggtcagatcgcaaggtaagtgggtaagcaccgcttatgatagtgatattctcgcggggattaactgggctgtaaacaatgcacaaacctataatattaaagcggtgaatttgagccttggtgtgccgggagtcaaatatacctctgagtgtagcgatagcagttatggaacagcatttgccaatgcgcgagctgctggcgtggttccggttgtagcctctggtaatgatgccttccctgacggaatttcatctcctgcttgtgtggcaggggcagtaagggtaggtgctgtttatagtagtaatattggtggtgtgtcatggggttaccccgtgaaatgttctgacccaactacagcagcagataaggtagcctgctttagtaatgggggaagcttgtga

SEQ ID NO: 2025 - DNA, 1047 bp, Acinetobacter baumannii
ataacaacagaaatacctgatgaggcagttaaattgccaataaagataaaaaggttaaaagtgaaaaaattttgtttagctctctttttgagtgtaacgtcagttacgagttgggctggggatcaggtgtggtgtgcatatgatccagcgggtacccaaggggatattacgcgtcgactaaatgacattcgtttatatgctcagcaatatcaagtcaaattcaaagtcgttagttatcaaaaagagcagcaagccattcaagcctttgatgagggtaaatgctcaggcttagcagccagtaactttaatacttatcagtataatcattttatgggtagtacctcaggtattggtcttatacctaataaccggactgcacgaaatctattgcagcttttaaatcatcctacaattgagaaaagattaattaataaagactatgaagcagtcggtatgattccagttggaactgcaaatatggtcatgaaaaccaaaaaaatatcaaaagtggcacagcttagaggtcaacgaattggagttctggccaataatccgccacaacaagctttggtgagaagtgtaggtgcgcagccggtatatgttgatttatcgaatgcgattgcgcaatttcaacaaaataaaatcgatattatgccagcgcctgtttatggtcttttgccttataacctacagaaagattttgggccagatactcaggtgattaattttcctttggcgtatttcggggtaaatataattattaaaccacaagcttatccagccaattttgggcgaaaaattcgggcttggtttgtccaaaatagtcaattattaacaaatcgagctatacaatgggaaaatcatttaccagcctattattgggttgacgtttctttttacgaaaagcagagctatgacattatggtggcaaagatacgcaatcaatatgttcgctctggttattacgatgcctactttgtggagctaatgaaacgcttacgttgtattgatgatccgcgttactttgaatgtccaatgagtagataa

SEQ ID NO: 2026 - DNA, 741 bp, Acinetobacter baumannii
atgagtcaagacgaacttcaagaattgtcattagaacaattatctgcaaagaaaaagaaatttaatctcgataaattccttcagcaatttaatacgctggatatgaacaactatggtagttggccaatatctgtaaaaattacgtgttggatttttattttctttgctgtgttagctttggggtatttcattgttattcaaccgaaattacaagctattgataatgctcaagctcaggaaagcaatttattaaacgaatttcgtgaaaaagactcgaaattacgtaacctgcaacagtatcaggtgcaacttcaagagatgcaggcaaatttcaaccagcaactagagcagttaccaaaagaaactgagattccgagtttagttgaagatatcaacttaacaggagtgaactctggattgaaatttaaaaatattcgcttggaagatgaagtaaagcaggaaatttttattgagcaaccaattgccatagaagcgaccggggactatcacgcatttggagcttttgtaagtagtatcgctgctttgcctcgtattgtaactatgcacgattttactgttgatgtatcgccagctaaagataacaagtctgatattcctgtgctgaactattccattaaagcaaaaacataccgatacgtagggacaacagatacatcggagcaaacaggcaaagctccagcagcatctgcctcaacgaacactactgttcagccgaaatag

SEQ ID NO: 2027 - DNA, 624 bp, Acinetobacter baumannii
aaatataaagaaaaacttgaggataatgtgacgatgaaaacgtttaaacaacttgctatcgcgacaacacttgccagtaccctattattttcaggctgtggctataataccttacaggttaaagatgaagctgtaacagcggcttggtctgaagtacaaaaccaatatcaacgtcgtgccgatctagttccaaatctggtaaatgttgtaaaaggttatgctaaacatgaagaacaggttttaacagaagtcactcaagcacgtgccaatgttgcaggcttgaaggttgataaagaagtattagaagacccagcattacttgaaaaatatcaacaggcacaaagccagttaactggggcattatctcgacttattgccgtttcagaaaattacccagatttaaaagccaatacccaattccaagaattgcaagttcagcttgagggaacagaaaaccgaattgctgttgcccgtaatcgttatattacaactgttcaggactataacgcttatgttcgtcagttcccacaagcagtaacagcgaaagtgattggcatgcatcctaaagccaatttctctgcagaagcatctgctcagcaggctccaaaagtttcttttgattaa

SEQ ID NO: 2028 - DNA, 573 bp, Acinetobacter baumannii
ggccgaggagacttgttaatgcatcactataagcaaaaagcccaagctggggtgggcttactcgaagttttggttgccttaattttacttgctattggagttttaggttatgttgccttgcagctaagagctatggatgcatcttcagaagcattaagtaaatctcaagccattctagtgatgaggggattagcagaaaatatccgtacaaatagtactcaagctagccagtatcctacatttgtgcgtagttatagcaactatacatctgatactcctgcacccacgtcatgttttaactctctatgtactgcctcccaacttgctcaatttgatgcctatcaagcagctagaaatgctaatcaactgggtatgagaattacgatgtcaaattgccctggcgttacaaatacaatggtgcaacaacgccagtgcctatttgtcttttggggtaaaactgcgccagtgattactacaaatggaacaaatactagtgtggatgtttcaagttgtatgaataataacggtgtttacgtgaataattcaacttgcttaatgatggaggcatattaa

SEQ ID NO: 2029 - DNA, 873 bp, Acinetobacter baumannii
ttaaatatggatattacccagttaaaaatgtttcaaaccgtggttgaatgcggaaccatggctaaagcatcactacaactacattgcgtaccctccaatatcactacacgcattaagcaacttgaagaaggactaggcgcaccgctgttttatcgtgaaggaaaaagcttaaaactcaccccatcaggagaaatctttctcgattattgccataaaattttagcgctatgcgatgaagcgaaacaaagtattcatccagatgcaccgccctctggcccgctcaaaattggggctattgaatcttctgctaccactcgcctccccaatttacttgcgaaatatcatcaacgttatccagaggtttccattcaaattattacaggcacatggaaacagttattagtcgatatttctcagcacaaacttgatggtgcaattgtcgcgggtaatatcgagtttcctatgttaaataaactgagtatttatcaagaagacatggtcttaattgcatctcattctttgggagaaattcgttaccaagaagatttgattggtaaagaaattttcatgtggactgaaggctgtccttaccgcgcagctcttgaagaatggcttaaactgaagaatatatctctccctatcaccagtattaccagttacgccaccattattgggtgtgtcagtgcgggttctggcgtggcgttagtgcctaagagtatttatgaacaatataaaaatttagcgcatattcaaagttataaattcgaataccttgcctttatgcaaaatcattttttctggcataaaaatgtgagtaaccataaagcgagagacatgtttatagagttgattaagactgaatttagtttatga

SEQ ID NO: 2030 - DNA, 1056 bp, Acinetobacter baumannii
aaacttaaggaagatatctttatgcaaaggatgcagaaaaagatatggtggtgtgtgctcggattttttattttgagcatcatcgcatgtgtgtattggctaagcccagactcggaaaatacttcacctcagccaaatcaggatgaagctaaaagtttggtagctacttcacaatctactttaaattcaccattaaacgaaaatacttatttgagtaaaagtcagcaagatactcaagttaactgccaattaaaaattaatagttcacagcatttagttgtgaatagccaaacccgtgactgctttgaatattttattacgcagtatggcgagagcaatttacaacaagttaaaactcattttgagaaatttatacaagatcaatatttagagccagcccgctcacagattattgatttgtggacgcgttatttaaaataccgtgagcagcttgcacaaattcaaccgcctcaatctaaacaacaagatcaaaattattttcaaaagatcttcagttcaattcaagatataagaaaacgtttcttctctgcttctgaaattgaagggttattttcaacagaagacatttatcagaactacacattagatcgcatgaagattttagaagattcatctttaagcgaaattgaaaaagctaaaaacctcaaagagcgctttgaacaattaccagaagactggcaagaaaacctacaagaactctcaaagcttgatgatttacacacactgaccaaacaaattaaagctcgcaatggttcagcagaggaacttcggcaaatgcgtacagcacttgttggagccgaggcaactcaacgattagaaactttagatatacagcgtaatgcgtggcaacagcgagtgactggctacttaaatcaacgtgatgaagtcctgcatagcaatatgagtgacagcgctaaaaaacaagctattcaacaactacgccaacaacaatttagctcatcgcaagaacagcttcgtcttagaacttttgaaacagtccatgaccaaggaggtgaactaccctttaactactag

SEQ ID NO: 2031 - DNA, 372 bp, Acinetobacter baumannii
aataaaaaggaaaattgtatgattggacaaatattgattgcgcttattgcgatattacatgtttatattttagtgttagagatgtttttgtgggacaaaccttatggcatgaaagcctttggaaataatgccgaaaaagcaaaactcaccaaagtcatggcacagaaccaaggtctttataatggcttcttagcagcaggtttattttggtctttattggctgatgcaccatttgcaacatcaattgccaacttctttttaggctgtgtactgattgctggtatttatggtggtctgactgccagtaaaaagattatttatattcaggcggttccggcattgattgctttagtcgctgttaattttctttaa

SEQ ID NO: 2032 - DNA, 363 bp, Acinetobacter baumannii
ttcatttttttattgacgtgtgagcgcattcaccctaatattgcgctcacacaaactggggtcatagctcagttggtagagcgctacaatggcattgtagaggtcagcggttcgatcccgcttggctccaccaagctcctttgtgtttgcctcatcaagtccctatcgtctagaggcctaggacatcgccctttcacggcggtaaccgggggtcgaatccccgtagggacgccactttttatcttaaaaattcctttaaagactctatcgtcaccttcctgtctattctttgactgcttcttgattgcacatttgtctattttatctaaaatagcgtctttctcaaattctctcaatgtgtaa

SEQ ID NO: 2033 - DNA, 1371 bp, Acinetobacter baumannii
aataagatactccgcaatcataaattggcaaaacacctattttgtttcatttttgacgatgtatgtgggagtaaattttctttcggtgtgagcatggataagcaaattatttttgaagacgaacacattagagccatttttttacaaggcgattctaatacattagttctctcttttggcgatttgattacccgggcgagtggcttatctatcaatgctgaaaagtctctaataaagtatcaatacaatgtcattggggtgatgccaaaacaaaaatcatggttcccaaaggccagtatggttgagttggcaaaagtcattttgcctattattcagcgttttaaaaatattgtaggttatggtggctcaatgggcggctatgcagcaattaaatattcgaatttattaaatatgaatcgaatcattgcatttgtgcctcagtattcaattgaccctgaacaagttgaagaccgacgctatgctgagttcttcgatgctgtcgcgaataaagacatgcaaattcagccgcaagatgtagatgcaagtcgtgaatacattattgtttatgatccttacttttcaattgatcgcgaacattacttaaaaataaaagaggtcttaccaagtttacatacaattcatttgccttttacaggacatgaagctttatctgtattggccagctcaagccttttacatgattttattgagcatgaatttgatgaaacgtatttctatcaacaagttcgtaaaatcaaaaaacaaagcaagttctattatcgtaatgttcttgcaaacgtgctgacataccatgacagcatgttattgaaaatattgcgtcaaaatgactttcagttagatgaacgttatttagacaatccacttaagcaagcagtcactcgtagtcttattaaaacaaagcaagctacagagcaagatttccagaagcttggaattaaaattcagtatagccagcaagctgaaaaccataaaaagggtttgaaaaatcaatttgaggcaatactggtatttaatttgattaatctaaagcttgaaacctatgctgtagatgtagtgttggcgaacccattatatttgattccgattgtggcagaacacactggggttgttcagattgaattaaataatgaactttatttgttagggatgaatgaccgaaaaattattaaattgtttaaacagggtgatgcactcacttcggatatgagtccgtttgttattaaacaatattctgatttctttgcgttaagctacaagcaattaaatttaaattgtgatgaacaaggtgtatgtgattacgttgaaagttccattcagccatctcaacagtttgtattgaccagttactaa

SEQ ID NO: 2034 - DNA, 273 bp, Acinetobacter baumannii
atgttgggttttctgaaaattatgttgcccttgttgttggttgtatttttattgatgggaatatgggtcagtattttgcacttcccttgggagtggatgacttatgttgtcatggggattgaagtgtttgtcgctactctgattttaccccttgaatatcaaactggaacaagtaacagccatattggttttatcagtataagtgcttgttttgcagtgctgttaggaatagcccgtttattcgtgtggacatgggtaaaattttttgcctga

SEQ ID NO: 2035 - DNA, 339 bp, Acinetobacter baumannii
acaaagctttgttcgtttacaagacgtgttgagcctatggatattgatgcaattagcaaagccctagccaatcctctgcgtcggcagattctgcaatggttaaaagagccagagcattatttaccagtagaagagtgtggtggtagttttgaaaaaggggtttgcgcaggtcatattgaacgtttgggtaaagtagctcagtctacgatgtccaatcatttgtctgtattacagcaggcgggtctcattcaggtccaaaaatatggacaatggtcttatttttcacgtaacgaagctttgattcagcaatatatcgaacatttaaaacaaacactttaa

SEQ ID NO: 2036 - DNA, 1848 bp, Acinetobacter baumannii
gtaaggccttgctgtatggtagataagcgaacaaagcaaacacgaaaaaaacagcagtctatttcggaaaaaccaagtcttgcctttgatatgtggcggttttatctgctctgggcggtagtgctactgtgttttgtggtattaattgcacgtgcattttatgttcaagtcattaataaagactttttgcaaaataaggccaatgccaatattttgcgtactgaacgtatagaggctatgcgtggagtgattagtgatcgccacggtgtacctttagcgattagtagtccaatcatgaaaattgtgattgatccgcgtgattattttgagaccaagcatttatatgatcaaattacggctgaactaaaacaagatccaaacaaccgtaaattaaaacgccaattgccagataaaaatttaaatcttgatgaacttgccgacgtggtgggtgttgatcgtgctgatcttaaaaaacagatgaatgcgcgtccgcgttctcgctatcttgttttgaaaaaagaagtacctcctcagcaagctgacctcattatgaaaggtaatttccaaggggtgtatgcagaaaaaacttataaacgttattacccgcaacctcagccaaatgcccaaattattggtttgaccaatagtgaaggtcaaggtatcgaaggcttggaaatgcagttgaataagcaactgtcaggtgtagacggtgagcaaaaaattattcgcgataagcgtggtaaccgtttaaaagtttctgaggtaattcgtgagggcgaacctggtgaaaatatcactttaagtatcgactcacgtttgcagtacattatgtaccgtgaattaacggctgcaggtgtggctaacaatgcgcgttcagcaacggcgattgcagttgatgttaaaacgggtgaaattctggcaatgaccagttggccatcttataacccgaatgataagaatggcttatcaaataaagatgctatgcgtaaccgtggtgcgatcgatatgttcgagccaggttcaaccatgaaaccttttactatttctgcagctttagaaactggtcaatatacgccaaatacgattgtaaatacctctcctggctcaatgcgtttaggctggcatactattcgtgatacccataactatggggctttgaccgtaagtggtgtcattattaagtcttcaaacgtgggttctgcaaaaattgcattatcacttccgaaagaaactttgccgagcttctttaatcgtgttggttttggtaagcgttctgcagtaaggttccctggggaaagttcaggtctggttttacctgttaataaattaaactcttctcaaatcgggaccatggcatatggttatggcttaaacgcgacaatccttcaattggctcaaggttatgccatgcttgcaaatcatggtgtcaaaatgccattaagcttgcataaactagatcagccacctaaaggtgagcaagttttaaatccgaaaattgccgatcaagttttgttaatgcttgagcaagtgactatgccgggtggtactgcaaaacaagccaatattcctggttatagggtagttggtaaaacaggtactgcacataaattgcgtgcagatggtaaaggatattcaaataatgagtatcgtgccttatttgcgggtgtcgcaccaattagtgatccacgtttagccgttattgtagtggtggaaaacccacaaggtcgctattacggtggtttggttgccgctccagtttttgctcgtattatgcaagagtcgttgcgcttaatgaatgtgccgcttgataagccacttaatactccagaaaatcctattcgcaggtaa

SEQ ID NO: 2037 - DNA, 1902 bp, Acinetobacter baumannii
aaatcatattggtttaattacacaatgcaaaatacggccaaaaaagcgaccttgcctgccacggctttggcagctcttggagtggtctttggagacatcggaacaagtccgctatatgccttgaaagagtccttccatgcagcgcatgggttgggaattcagcgtgtaaacgtattaggaattttatccattattttttggtgcttaatgctgattattagcatcaagtatgtcgcaatcgtgatgcgtgcagacaacaatggcgaaggcggcatcatggccttactcgcgttgaatttgcgtaaagcgaaaattgccgacaacaaaaagatctacatgattgcgataggctttataggggcatcactgttctttggtgacggtattattaccccagccatttcggtattgtctgcggtcgaggggttgtctattgcaaccgatgtgtttgacccgttcattatgcctattgcaattgctattatcgtcacgctgtttttggtgcaaaagcacggtacggcgtttgtaggtaagttttttggtccaattacgcttgtgtggttcttatctttaggaatcttgggtattcacagtgtcatccaaacccctgtggtactaggcatgtttagtccgcattgggcgatccagtttatctatcaccatccgattatgacattttttgtgatgggtgctgtggtgttaacagtgactggtggtgaagcgctatatgccgatatgggacatttcggaccagttccgattcgtctggcgtggttctttgtggtattgccatgcttggttttaaactacgcaggacagggcgcattattactcagagacccagcggcaattgaaaatccgttctatttactggtgccgcagtgggccttgtacccaatgattattatggcaaccatggcaacagtcattgcctctcaagctgtaatttctggggtgttttctcttgcgcgccaagcgattcaattgggttatttaccacgtttaagtattaaacatacgtctgagtctgaagaaggtcagatttatgtacctttcttaaactggttacttttaatcgcgattattatcttaattttaatcttcaaaaccagctcgaacttggcaagtgcgtacggtttggccgtaactttgactatgctctgtgacacgattttggttgccgtgtttatctactcggcgtggaagtggagtttgccaaaagtgcttctcctgattattccgttctttattttagagtcggtgttggtcggtgcaacttcacttaaaatcttgtcgggcggttgggtgccattattgattggtgcgattgcagtgaccattttaatgacatggaaacgtggccgtgagcttacttttgctaagcttgaacacgatactttgtcactcgatttgtttgtaaaaagtattggtaatagtgtgcattgggtgccaggcgatgctgtatttatgacgggtacgccaaatgttgtgccacatgccatgctgcataatattaagcacaataaggtactacatcagcgtaatatcttggtcactgtagtgattgaagatgtaccgtttgttgcacctgaagagcgtattacaacagaaaccttagctgaacatttcttccgtattaaaattttctacggctttaaagatgaaatgaatgtgccgaaagcattaatgcaagcctatgaacaattaggccttgaatatgacttgatgcatatcagcttctttatttcgcgtgatcgtattgttcattctgtgggagacggtatgtcgccatggagagaaaagctgtttatttcaatgcagcgtaatactagtccggtgagtgacttctatcaaattccaaccaaccgtgtggttgagttaggtagccaaatcgaaatataa

SEQ ID NO: 2038 - DNA, 858 bp, Acinetobacter baumannii
cgtgacaattgctttacgcaatgcaatgggggaaacactatgacccatttaaattataaaaatatcaaaggtcgatctaaggaaacgggtgccacacttattgttgtacttattattttattgattgttatttctgtcggggttttggcaataagagtagcgattgtttctctaaaagttgcaactaatagccaagttggccaattaaactttcaatcttcagatactccgttagagcttattgtacagatgaacccaaccacattgacaaatattaccaatgtgattggagcagcactgaaagcacatgaaagtaaccctggtgcggaatataacttttgctataaaccaacttctacatctgtaagttttgctcaaactcggggagcaagtttgcttcgggctggcagcgccaataatgctgtggttgaagacggtggagtagcaggtttctgcgatttaacaagtgactatgggagtaatcgtcaagcggtagttactcaagttgctgtcaatatcccaaccgatgccatggctgatattccgggttcaaatctacctcgggacataaatctttccgaaggaacccaacttcctaaaagcatgctatctacgcaacgtattcgggttattacaacagcgtttttacctgcttatgcctcaaattctttagaaactctgcaatctgattgcttaagtacgagttccgcaaaaattagtgacaactttgatagtgcattaacggataagcaaactctagctgattgtttggcaaaccataacgtaccttttagtactcaagttcaagaatttaactataccaataagctgactgaaatcacggcaccaggttcataa

SEQ ID NO: 2039 - DNA, 492 bp, Acinetobacter baumannii
ggcagaaattgttttggagtagctacaatgaaaggcaatcgtgatgttattaatcagctcaaccaagtgctgtatcatcatttaactgcaattaatcaatactttttacactctcgtatgtttaatgattggggaattgaacaactcggttctgccgaatataaagaatcaattcgccaaatgaagcatgctgataaaattattgagcgtatcttatttttagaaggtctccctaatcttcaacacttaggtaaattgtatatcggtcaacatacagaagaagttctgcaatgcgacatccgtaaagtaaaagaaaatattgaagcaattcagaaagcggtcgctttagctgaaacagaacaagactatgtaacgcgtgatttggtacaagaaatcttagaaaaagaggaagaatattgggattggttagatactcaaattgatcttattggcagtgttggtatcgaaaattatatccaaagccaaatgtaa

SEQ ID NO: 2040 - DNA, 3189 bp, Acinetobacter baumannii
agtccgaattggaaaaaggagaggctgagcatggacattaataagcctgagctgcccaagccagaaggactgtttgacagagttattcagtttgctattcaaaatgccatttgggtcatgctttttgttctggcgtggattggtgttggcatttggagttatcaaaaactccctattgatgccgttccagatattaccaatacccaagtccagattaatactcaagccaatgggtataccgctttagaggtcgaacagcggattacctatcctattgaaaatgcgatggcaggaattccaaatctggaacaaactcgctccatttctcgttatggactttcccaagtcaccatcatttttaaagatgggacagatatttattgggcaagacaactgattaaccagcgtttacaagaagcggatggccaactacccgaatcagttgatcctatcatgtctcctgtttcaacaggcttgggtgaaatttaccaatgggtggtaaaagcaaaatcaggtgctaagaaagcagatggcacagcctatacagccatggatttacgtgaaattcaggactggattgtacgtcctcaattgcagcgtgtgaaaggcgtggcggaaatcaacagtatcggtggctacaataaaacctatattgtgtcacctgatttaaaacgtttgcagcagcttcagatttcaatcaatgaatttcaaactgctctgcaagaaaataatgaaaatcgcggtgcaggttttatcgaagaaaacggagagcaactcaccgttcgtgtgccgggcatgttaagtagtgttgaagatattcaaaacattactgtaagtaccaaaaatggtttgccgatccgcgtggctgatgttgcgaatgtctctattgggcatgatttaagaacaggggctgcaacttacaacggtgaggaaacggttcttggcattgccatgatgatgatgggagaaaacagccgtacagttgctcaggcggttgataccaaaattaaggaaatacaatctaccttacctaaaggggtggaaatcgagacggtttatgaccggacgagcttagtaaacaaagcaattgcgacggtgcagaagaaccttgtagaaggcgcgattctggttattgtgattttgtttatttttctaggaaattttcgagctgctttaatcacagcctgcgttattccactttcgatgttatttactctgacaggtatggctgaacaaaacattagtgccaacctcatgagcttaggagcgctcgatttcgggattattgtggatggcgcggtagttattgtagagaactgtattcgacgtctggcagaagcacagcatgctctacatcggcctcttacacggtctgaacgattcaaagaagttttccttgcagcaaaacaggcccgtcgcccacttatttttgggcaaatgattattttggtggtctatttacctatttttgccctatctggtgttgaagccaaaatgttccatccaatggcgatgacagtggtgatggcattattgggtgccatgattctttctgtgacatttgtacctgcggcagttgctctttttgttacgggtgaagtgaaagaaaaagaaacacgttggatgcagcttttaaagcagaaatatcaaaatattctcgatcaggcttatcaacttaaaattgtggtcgttagttttgcattaagtattttagttctcacaggtgtattagctacccaaatgggtagtgaatttgctccgcagctcagtgaaggtgactttgccctgcagcaaatgcgttcaccaagtactggtctcgagcaatcactgcgaatgcaggaaaatactgaaaagctcattttgaaaaactttccagaagtgaaagctgtttttgctcgaacagggacagctgaggttgcaactgatgtgatgccgccgaatatctctgatgcggtcattttgcttaaaccgcatgatcaatggccaaacccgaaagagacgctaagtgagctacgttcacgtatggaagctttcttggcaaccttaccgggtaataacagtgagttctctcaaccgattgagctacgctttaatgagctaatttcagggattcgtagtgatattggcgtcaagatttttggcgacgatatgcaagtactcaatgagcaggcacaggcactcgctcagaaagtacaaaaaatttcaggtgctaccgcggttaaggtagaacaaacgagcggtttaccggtgctgagtgttgaaattaaccgacctctggctgcgcaatacggattatctgcaaaagctattcaagatattgtggcggcaagtgttggtggacaaaatgttgggcagattttacaaggcgatagacgatttgattttgaaattcgcctagaagaccagcagcgtaccatccaaaacttagctcaacttccgattcaattaccaaatggtggactcatccaacttcaagatgtggctaaagttgaatgtacctcgggcctaaatcaggtgggacgtgaaaatggtaagcgccgtgtcattattactgcaaacgtagaaggccgtgacttaggatcatttgttcaagagttaagagcaacactcgcaaaagaacaactgccagcgggctattggttggaatatggcggtcagtttgaaaatctcgcttcagctgctgcgcgaatgaaaattgttgttccattggcgcttgctatgatttttattctgctcatggctgtattccataatgttaaagaaagtctgttggtctttagcggcgtgccgtttgctttgtcaggtggtctgattgcgctttggctaagagatattccactgtccatgtcggctggcgttgggtttattgcattatctggtgtcgctgttttgaatggtttggtgatgctgagctttattaaagagcttagagaaaaatttgatattcaaacagccacgtggaatggggcgatcttacgtttaagaccggtactcatgacggcttgtgttgcttcacttggttttattccgatggctttggctacgggaactggtgcagaagttcagcggcctttggcaacagtggttattggtggcattatttcatctacgatattaactttggttttattaccggtcatttatcgatggatgaatgaagacaagacgaaaagtgttgagcattcataa

SEQ ID NO: 2041 - DNA, 822 bp, Acinetobacter baumannii
actgaaagttgtaacaaaacatttataaaatcgtttttagaggggagagattccatgaaaaaactagcaattgcatcagctcttttatctgcgcttgcagtaagtggcgcagcaaacgcttaccaagctgaagttggtggttcttacaattatcttgatccagataacggcagcagcgtaagcaaattcggtgttgatgggacttattatttcaaccctgttcaaacacgtaatgcaccgcttgcagaagcagcattcttaaaccgtgcaagtaacgttaacgcgcatgttaactatggcgataacagcggcacaaaagacactcaatatggcgtaggcgttgagtacttcgttcctaactctgacttttaccttagcggtgatgtaggcagaaacgaacgtgaaatcgacaacactaatatcgacagtaaagtgactacttatgctgcagaagtaggttatttaccagctcctggtttattacttgctctaggtgttaaaggttacgacgagaaagacggtaaagacggtgcagatcctaccgttcgtgctaagtatgtaacccaagttggtcaacatgacgtaaaccttgaagcttatggtgcgtttggtgaccttgacgaatataaagttcgtggtgactactacatcgataaaactttaagtttaggtgtggactactacaataacgacttaactgataaagatgaatttggtatcaatgctaaaaaattcttaaatcagcaagtaagtgttgaaggtcgtgttggattcggtgataacgacaacacttatggtgttcgtgcagcataccgcttctaa

SEQ ID NO: 2042 - DNA, 1491 bp, Acinetobacter baumannii
ttccacgactgcaaagacataggcaggtgcgggcaacaaggaaatccgcgcctacccacggagagagacatggcagaacgcctaaataatgactttcaatttctggatgtaccacgtcaagatccagagaaaaaagatattactgtccgcaaagcagagtttgtggaaatttataaaccttttacttcggaaactgtaaccaatcagacgcaccgttgtttaggttgtggtaacccatattgcgaatggaaatgtcctgtacataactacattccaaactggctaaaactcattgctgaaggccaaattttccaggctgctgagctttgccatcaaacaaatactttacctgaggtatgtggtcgtgtatgtccgcaggaccgtttgtgtgaaggtgcttgtaccttaaatgatggctttggtgcagtaactattggtaatgctgaaaaatatatcaatgacacggcttttgctttgggttggcgcccagatatgtcacatgtgaagtggacaggtaaaaaagttgcaatcattggtgcgggtccagcaggcctaggctgtgctgacatcttagctcgtggcggcgttaaaccagtggtatttgacaagcgtcctgaaattggtggcttactaacatttggtattccagaattcaagatggaaaaagatgtgatgaagcgccgccgtgaaattttcactgggatgggcattgaattccgcttaaatactgaaattggtaaagatgtcacgattgatgaattacttgctgaatatgatgcagtattcatggggatgggtacttatacctacatgaaaggtggtttccctggtgaagatcttgacggtgtttatgatgcgcttgatttcttaatctctaacgtgaaccgttgtcagggatgggaaaaggacccaagtgaatacattagcatggatggtaaaaaagttattgttcttgggggtggtgataccgcaatggactgtaaccgtacttcattacgtcaaggtgcccacgacgtaacatgtgcataccgccgtgatgaaagtaatatgccgggttctgcacgtgaagtaaaaaatgcgtatgaagaaggcgtaaagttcttgtttaaccgtcaaccaatcgagattgttggcgaaaatggcaaggtaacaggcgtaaaagtggtaacgacacaaatgggtgaaccagatagtcgtggccgccgtagccctgagccaattccgggttctgaagaagttttacctgctgatgcagttttgctagcgttcggtttccgtccaagccctgctgactggtttggtagtgtgaatattaatcttgatggttctggtcgtgttgttgcacctgaacagcaggaatttaaattccagacttcaaacccaaaaatctttgctggtggtgatatggtacgtggttcagaccttgtagttacagcaatctgggaaggtcgccaagctgctgaaggtattttagattaccttggtgtttaa

SEQ ID NO: 2043 - DNA, 1119 bp, Acinetobacter baumannii
atgctgttatggttgtttgaacaacttgcgggctatcacagttcgtttcaggttgttcgttatttaacattacgttctttactcagtgtattaacgtcactgaccattggtttggttctcggaccaatcatgattcgtaaattacaagcgttaaaatacggtcaggcagtaagttcgtttgctcctgaaaatcatgctaagaagatgggtacaccgaccatgggtgggattttaattctgctctcaattggtattagtactttattgtgggctgatttatctaacccttatgtttggattgtacttggtgtaatggttgtgttcggtgcggttggctgggcagatgactggattaaaattcgctataaagataatgcaggtctacctgcccgtaagaagtttttctggacttctgtcgcatcgctgggtgctggtattgcgttatatttaattgctacccaacaatctaatgcagaatacacagcaaatatgctggatttattgattcctttctttaagaatctttcaattccgctttctattgttcctttaggtttagcatttattgtatttacctatttagtaattaatggtgcctctaatgcggttaacctaactgatggtctagatggtttagccattatgccagtagttatggtagcgacgggcttaggcgtatttgcgtatttatctggtgatattcgttttgccaactatttgcatattccttatgtgaaatacacttcagaacttgtggtgatctgttctgccatgattggtgcgggtttggcatttctttggtataacgcacatccggcgcaagtctttatgggtgatgtgggcgctttagctctaggtgcaatgcttggaaccattgccgttatggttcgccaagaaatcgtattcgcaattatgggcggtgttttcgttatggaagcggtatcggtattcctgcaaatcggctcattacgaatgcggaataaacgcgtatttttgatggcacctttgcaccatcactatgaaaaacaaggctggaaagaaacccaagtagttatccgtttctggattattacgattatgctggttgttttaggcctaatgaccttaaaattgcgctag

SEQ ID NO: 2044 - DNA, 282 bp, Acinetobacter baumannii
gccaatggactggtaggtacagcaaataaaagaacagatgaggcccccattggtgcaatgtaccaagcattaattccgcctaaaacataccagctaattaacgaggaaattgctaaaccacatagcgctccaacgccacaaagcaaccgttcttttagtggtaaaaccttaaaattcggttttaaaatctgtaaccattctggatgtataacactcacagtacaccttaggggatatgccgttatttataacgggcaaaagtatacgcccaaagccgcataa

SEQ ID NO: 2045 - DNA, 993 bp, Acinetobacter baumannii
attcgtggatgctacatgagtcgcgccatctcgcacattgatacatttcagggcttaattcttgccctacaaaactattgggccgaacaaggctgcgtcgtactacaaccttacgacatggaaatgggcgctggaacattccacaccgcaacattcttacgtgctttagggccagagacttggaacgcggcatacgttcaaccttcacgtcgtccaaaagatggccgctacggtgaaaacccgaaccgtttgcaacactactatcagttccaagtggtacttaagccaaacccagacaacattcaacagctttatctcgattctttaaaagcaatcgggattgatacgcttactcacgatatccgtttcgtagaagacaactgggaatctccaactcttggggcttggggcttaggttgggaagtttggcttaacggtatggaagtaactcagttcacttacttccaacaagttggtggtgttgaatgttacccagtaacaggcgaaatcacttacggtttagaacgtcttgcaatgtaccttcaaggcgttgactcggtttatgaccttgtttggacgaaaggccaattcggtactgtaacttacggcgacgtattccatcaaaatgaagttgagcaatcgacttataactttgaatacgctccagttgacaaactatttgaactatttgatttctacgagtcagaagctaaccgtttaatggaagctaaacttccacttccagcttatgagcaagtcgttaaagcgtctcatacctttaacttgcttgatgcacgtggcgcaatttctgtaactgagcgtcaacgctacattttacgtgtacgtactttggcgcgcgctattgcacaaagttatgtacaagcacgtgcagagcttggcttcccaatggcagaaccacacttacgtgatgaagtattggcacagctaaaagcacaagctgaaagtgaagcagcaaaggcggagaaaaactaa

SEQ ID NO: 2046 - DNA, 207 bp, Acinetobacter baumannii
aatctattgtgccataaaaaactatttgtacatggaacaatcagtcaacttctgacaaacattgcctttaaaacagctaaaaatacgatttttaacgataaaaaatgccaaaagaattataatttatcagaaaatagcatattgttttttttaataaataccgcaaaatatttaccctctgcctttggtgccgggatttgtctttaa

SEQ ID NO: 2047 - DNA, 639 bp, Acinetobacter baumannii
attaaattgtgcaatatactgcacatattgcgctattcttctgttttgtgcaatatattgctcaaattttctttattcatctattttatgagccagtcgagtagcgttttacaacatgtaggcacaaatatccgttcattaagagatgagcgcagtttaagccaacaggacttggctgatcgggcaggtgtaagtagacgtaccattgctgctttggaaacaggccaagtcaacattagcttagctaaactcgatgcgattgcggcagtgttgggagtagattttagaacaattgtgagtgcgcctgagctaaaagaacatggcctagtaaatgcactcgcttggcaaggtgaaaaggaagaaagcaaagcaacttttcttgcttcagttccttcccgttctcaagttgaactttggacatggtctttggctgttggggagtcttatgttgctgaagccgatgccgaaggatggcaagaactgatttatgtgttagaaggcgaattgaccatacaatttacagacagctcaaaaaccattgcggctggttcatcttttatttttgccagttcagtgacttatacctatatcaatagcggtagccaagtacttaaatttattcgtaatgtggtttattga

SEQ ID NO: 2048 - DNA, 1371 bp, Acinetobacter baumannii
aacatatcgtgtcccattattaaatatattagaaaaataccttttaaattgctaattttaatttatcgaattttctcgatgcagcatgcctttaggcactgctcttttttctgtcatggtcatgatatgaactcttcatctacacccagtactttaaacactgaggcaacgtctgttctttcccgtgagtggattcacaaagggactaaagcttataaacatgcaggatttgctttattcctcgtaggttttgccagcttctctctaatttattgtgtacagccactcttacctgcatttagccaaagctttcagattagtcctgcgagtagctctttggcactgtcattaacgactgcctttttagccatttcgattgtgctatcgagtgccttttcacaagcgattggccgtcgcggtgtgatctttgcgtcaatgctgtgtgccgcaattttaaatattgtctcgatgtttacaccgaactggcacagtttactcatagcacgcgcgttagaaggtttactgcttggtggcgtacccgcagtgactatggcttggattgccgaagaaattgcgcctgaacacctcggtaaaaccatgggtttatatattgcagggacagcctttggtggcatgatgggccgtgtcggtatgggtattttggttgaatatttttcatggcgcaccgccttaggcctacttggagcaatctgttttatttgctcgattgcctttttaaaattacttcccgtatcgcgtaattttgtgcagaaaaaagggctgaatttaggctttcacatgcaaatgtggcgtgctcatttaagcaatactaaattattacgcctgtttgccattggtttcttgctcaccagtgtttttgtcaccctgtttaactatgcaaccttccgcttaagcggtgcaccttattcactgagtcaaacacaaattagccttattttcttgtcgtatagctttggtatggtgtcttcatcgttggcaggtagcttagccgatcgcttcggtaaaaaaaccatgatgatgagtggctttgccttgatgatcgtgggtagtctcatgaccctgctcagctctcttttcggcattatcattggcatcgcatttattaccacaggcttctttattacccactcacttacgagtagttctgtgggtgccgaaagcaaacaagctaaagctcatgccagttcgctttacttgctgttttactatatgggttcaagtattgtcggctcggcgggcggttggttctggttacacggtggctggagtgcgattgtcggtttaaccgtgttcttgttctttattggaatatttttagcgatttatacatcacatgccaaagcgcattaa

SEQ ID NO: 2049 - DNA, 993 bp, Acinetobacter baumannii
tttaaaaagtgtagcaaaaagctacacttttttttgcttagagactggctttatataatctaccgttgtagatttaaatttatattaaaaaacaattccttgtatacaatgaaaattatatttatccatgggatgaatcagcagaattacacagcacatcgtttaaaagagcactggctaaaagtatttaaactgggcttaaaacaattgcactgtagagttaatttaagagatctacatatacatatgccattttatggcgatttaatgacgaagtatcaattatccaatcaacttgatcttaatactttacttccaaaaacttttaactttcatttacccatccatttacatcatcaaccatcaacccccaaggaacatactccttttataccccaccttcctctttcacccgatcaacccgcacaaagcttatcagagcgtttatatttaacttcacagttggtgaaagatcgcgttcttaaggaaatggtggttcttttaaataattttccaaaattacatgaaagtttaattcagcaattcttgattgaaacttatatgtacctatctaatcctgattttatgtatgaggttcatcaaagaattttaaaacaaatgcatgatgatgaagattgtattgtagtcgcccactctttgggttctgtgattgcctatcatttattatcagatccttcttatcagttttcagtacagcgctttattaccttagcatcccctctttcttttcgcgtcatacaaagcaaactccccactcccattgaacgtcctaaatgtttaaagggcgactggtataacttttattctaaagatgactttttaaccgcttttccattaagtgaggcaccttttaattttactccccccattattaatcaagagatttttacttttgccaaccaacctcatgaaattgtcggctacttacaacatcatgctgtggtaaaaacaattattgagcctttccaataa

SEQ ID NO: 2050 - DNA, 1536 bp, Acinetobacter baumannii
aaaactcggtgtacaagaaggtcacgctgttcgtgtgttatcactaaatcctatggaagtatcctgatgtcaaactctttatttataaacggtgtctggttacaaggcagcggtacaacatttgtaaaaacaaacccggttgataaccaaactgtatggtcaggcgctgaagctacggctagtgatgttgagaaagcttgccaagctgctcgtacagcattcccagcgtgggcgcgtttaccttttgctgagcgtgtggcgattgtagaaaagtttgcagctttgcttgaagaaaataaaaagcatttagcggaagtgattagccaagaaaccagtaaacctttttgggaaacattaactgaagttcagtcaatgattggcaaggttgcaatttcgattcgtgcttatcaccaacgtaccggtgaaagctcaactgaaatggcagatggtgtggcatctttacgtcatcgcccacatggcgtacttgcagtttttggtccatataacttcccgggccacttgccgaacggacatattgttcctgcgttacttgctggtaacacagttgtattcaaaccaagtgaattaacgccttggactgctgaagaaactgtaaaactttggcaacaagccggtttgccaaatggtgtaatgaatttggtgcaaggtggtcgtaccacgggtgaagcgctagctgcctcacatgaaattgatggcctattatttaccggaagcgcaaacacaggttatcacctacacaaacaaatggcgggtgctcctgagaaaattcttgcgcttgaaatgggcggcaataatgcattgattatcgatgaaatcgaaaatatggatgctgttgttaacctcactattcaatctgcatttgtttcggctgggcagcgttgtacatgtgcgcgccgtatcttggtaaaaaatggtgcgcaaggcgatgcatttattcaacgttttgttgaggttgctaaaaacttaaaagttggtcgttggaacgatgagcaacaaccatttatgggcggcgtaatttcatcggctgctgcaacaaacatgatgaatgctcagcaaaagttgcttgagcttggtgcaaaaagcttgttgccaatgacacgtcctcaagaagacagctcattacttactccaggcattattgacgtaacaggtgtggcgggtattccagatgaagaatatttcggtccgcttaccactattcagcgttatgacagttttgatgaagcattaaaaattgccaatgcaactcgttttggcttgtcggttggtttggtttctccaaaacgtgaactgtttgatgacttactcattgaagcacgtgccggaattgtgaactggaacaaaccattaacaggagcatcgagtgcagcaccatttggtggtgtcggagcttcaggtaatcaccgcgcaagtgcattttatgctgctgattactgtgcttggccaatggcttcactcgaaagtgaaagcttgacgttgccagaaaaattatctccagggattgtgttgccttaa

SEQ ID NO: 2051 - DNA, 1596 bp, Acinetobacter baumannii
ttttcagggtgctttacaacgactgcctatgcatgtaatttcgctcgtctgatggcaactgacgagagccactttttaactgtaggagagagccaattgcgtagtttacttggagatcatttgctgcaacgactccaacaggacactgaagggaaactacatcaacgccttttccgttgcctgcgtggtgccattattgatggagtcatccagcccaagactcgtctacctgcatcacgcgatttagccagtgaaattcatgtttcgagaaataccgttcttagtgcctacgaacaactacaggctgaaggctatttagaagcacggacaggacatggcacatgggttgccgaaaagttaccagagagttttttaaatacacaaaacaagaaaaaagtagtttctagcccaaatattcaaagttcttacgccctctcacagcgtggctcaaacttattgggctatgccgcagcctcgccacatcaatggggagcctttgttccgggagcacccgatgttaccgagtttccacatcatatttttagtcgtattcaagcacgcttaagccgcgaaccggacattaaccgcctgatttatagcaacgcaggtggatgcatagagcttcgaagtgcattggcagattacttacgtgttgcgcgttcagtccagtgcgatgcggaccagattattattaccgaaggcattcaccaagctattgatttagtctcacgtgcactgagtgatatgggagataaagtctggattgaagatcccgcttattggggaatgcgtaatacattacggattaatggcctcgatattcagcccatgcctgttgatgctgaaggcattattcctgaagaaaatccggctgtaccgccgaaactcatttttgtcacaccatcacatcaatatccgcttggctcacatttaagccttgatcgtcgcagacaattgattcaaatcgcacgtcagcacaatagctggattgtagaagatgactatgacagtgagttccgtttctcgggccagccttatccatctttgcaaggcttagaaaataacgcacctgttttatatatgggcacgtttagtaaaactatttatccatctttaagaattggctatttggtcgtccctaagccgttattttcaccgctacgtattgttgcggccgaactttatcgtggtgggcacttgcttgagcaaaaagccctcgctgaatttattcgtgaaggccattatgaagcgcatattcgccgtatgcgactgctctatggtaaacgccgtgattacttggtgagcttaattcaacgctatcttggccccgaatttattcatgaatatgacgaagcggcaggattacatctggttttaaaactaccgaactcttgcgatgatgtcgcgattgcagccacagcgcttgaacgtggtgtcaaggttcgtccactgtctcagtactacatgcaatcacatgcacatgcagagcgtggactgctgatgggctttgcctgtgtaaatgaaaaagacatggtgatggcttttggtgtcttgcttcaatgcttacgtgaagcaggcttacctacactgaattga

SEQ ID NO: 2052 - DNA, 279 bp, Acinetobacter baumannii
ctaatgcctcgttctctgaaaaaaggcccattcgtcgatgcgcacttgttcgctaaggttgaagcggctgttgctagtaactctcgcaagccgatcaaaacttggtctcgtcgttcgatgatccttccagactttgttggtttaacaatttctgttcacaatggccgtaaccacgttccagtaattgttactgagcatatggttggtcataaactcggtgaattcgcgccaactcgtacctatcgtggtcacggtgttgacaagaagtctaaacgttaa

SEQ ID NO: 2053 - DNA, 333 bp, Acinetobacter baumannii
ggtagaactcggatgaacaacgaacgtatctatcaagtcctaaaaggaccagtcttctcagaaaaggcacaagttttaggtgatactgctggtgttcaagtatttaaagtagatatcaacgctactaaacttgaaatcaaaaaagcagttgaaaaactttttggtgtagaagttgttaaagttaacacaactattactaaaggtaagactaagcgctttggtcgtacattaggacgtcgttctgatgttaaaaaagcatacgtcaccctgaaagccggccaagatgttgaaatggctgacttgggcgataccgctgaaagcgcagcggaataa

SEQ ID NO: 2054 - DNA, 228 bp, Acinetobacter baumannii
aaccactatcgtgactcggacggtaatgtaatgaaaactaaagatctacgtgaaaaatcggtagaagagttgaaagctttgcttgatgagcaacagcttaaccaattccgtcttcgtatggcgaaagcaactggtcagttgggtaaatcgcacgaagtgcaagttgctcgtaagacaattgctcgtattaagacactccttaccgaaaaacaggggaacggacaatga

SEQ ID NO: 2055 - DNA, 972 bp, Acinetobacter baumannii
aaaggagtccgcaaaatgggtggacatcatggtcatgatcatagtcatgctgtagtgactgagggtaatgctaaaaaattaacgattgccttggcgcttaccacgacattcttaattgttgaggtgattgcaggtttaatcacacaaagtttggcattgctctctgacgctgcacatatgtttacagatgcagctgctttagcaattgctttggttgccatacagatttctaaacgtcctgccgataataaacgtactttcggttatcagcgctttgaaattctggccgctttatttaatgcacttatgctttttgtggtggcaatttatattttatatgaagcctatatccgcttttcgcagccacctgaaattcaaagtgtaggtatgctcattgtggcgaccattggtttggtaataaacctcatctcaatgaaaattcttatgtcgagtgctaataacagcttaaatgtgaaaggtgcttatctagaagtattgagtgatgcactaggctcagttggcgttattattggtgcaattattatttacttcactaattggtattggattgacacgcttattgcggtactgattggcttttgggtattgccaagaacatgggttttacttaaacaaagtattaatattttgctcgaaggtgtacccgaagaagtcgatattgaaaagctacgtgcagatttactttcattaaatggtgtggagagtattcaccaactcaaagtatgggcaattacctctaaaaatatccatttaactgtacacttatttgcgcctgaagctgaccgtaacaagctctatcaagatgcagttgaaatgctttctcatgagcatggtattggtgaagtgacattgcaaattgaagatgatgctgagattaactgtcagcatattgctcaacatgcttcacacgagcataacgataatgacaagacgcattcacatcagcattaa

SEQ ID NO: 2056 - DNA, 945 bp, Acinetobacter baumannii
tgggttgaacggacattgataagctcttttgatgatttttattatttctatttggtcgtaaaacacggcggctttagtgcggccagtgaggccgaaaatattagtaaatccaagctcagccgacgcattattgaccttgaaaataaatttaatgtcagcctgattcaaagaacaacccgccattttaaagtgaccgatttaggtcaagagttttacgaggaatgctgcaaagtcattgctcaagttgaatgtgcagagaacgtgttattaaagcaaaaaagtgagccacaaggtttggtaaaagtaagctgcccacctttaatgatgcattttcaaattagaaaaattttaaatcagtttttaaaaacctaccctaaagttgaaatatctcttgagctaacgagccgtcgagtagatatcttgcatgatgacatcgaccttgcgattcgaaccaattttgaaccgaatgaagattcaaatttaattgttcgtgatgtgattaaaaccgatcattgtctggtggcttcgcctgaattactgcaaggtcgcaccattaagcattattccgaattacaggactttccaagtattagcttaggcacacaaaagcaaaattatatttggcatttatgcaatatacgtaatggtgaatcggttgatgttccttatcaaccacgaattaaaagtaatgacttagctggcgtttactatgctgtaatggatggtctaggtattgcagatcttccttttttaaccgttgaagcggaaattcgtaaaggaacactggtccatatacttcctgactggaagtcgaatattggcatgctacaactggtttatgtgtcccgaaaaggccaacgccttgtggtcgaaaaactcattgaaaccctcattgatgagcttcgtcgtttacccgaaagccatgaaggatatttgccgacttaa

SEQ ID NO: 2057 - DNA, 258 bp, Acinetobacter baumannii
gtaattcgacgttcttgttgcatcatcggtcaatttcgagtactctttgagcctttcgaaattgtgaccggtgatgctcggttttggagtagggcaatgattcaaaccgaaactatgctcggagtaacaagacaacagtgggtgctcgccgcgtacaatggattaaagtacttggtgggtcacattcgccgttatgcttctgttggggacttttttaaagtttctggtaaaaaaactttttcacgcgcacgtgtttaa

SEQ ID NO: 2058 - DNA, 600 bp, Acinetobacter baumannii
ccgattttgcgggcagagaataaccttgttttatcttataccaacaagagtattctcatgaaacaagcactattagttatcgatgtacaaaatgattattttaaaaatggcaaaatggaattggttggaccagatcaagcgctcgataaaataaaacagctcgagcaatattttaatgaaaaaggtttaccgattatttatgtgcaacatattaacccgccacaagccagcttctttcaagaaaatactgaaggtgtgttacttcatccagaacttagtgctggcagtaattcattaatcgtgacaaagcattatccaaacagttttttagaaaccaatttaaaagaacttttaaaagcacatcaaattgaacaactcgtgatcacaggcatgatgacacatatttgtattgattctggcacacgtgcagccaaagagttaggttatcaacccatcttaattggagatgccactgcgacccgtgatttaagccataacggaaaaactgttaaagccgaagatgtacaaactgcttttttagctgctcttggcatgtttgcaagcgtacaaaatactgctgaatttctagcaaaattttaa

SEQ ID NO: 2059 - DNA, 1845 bp, Acinetobacter baumannii
ttcaaaattaggattaaagccatgccagcatataaagctccgctacacgatatccgcttcttaatgaatgaagtactagactatcctgctcactacaaaactttatcaaatggtgaaagtgcagatcctgatacagtagatatgattcttgaaggtgcagcagattattgtgaaaatgtactgtctccacttaaccaatctggcgatgaagaaggttgccattttgacaacggcgaagttaaaacgccaaaaggttttaaagaagcttatgaccagtttgtaatgggtggctggcaaggtctttcttatcctgaagaatttggtggtcaaggcctaccaatgtctttaaacctgattaaatcagagatgatgggtactgcgaactggtcatttaccatgtatccaggtttaagctcaggctgtatgaatactattttgcaattcggtacagatgagcaaaaacaaacgtatatgccgaaacttgttgaaggtacatggagcggcacaatgtgcttaaccgaacctcaatgtggtacagacttaggtcaggtaaaaaccaaagctgaaccacaagctgacggcacttataagatttctggtacaaaaatctttatttctgccggtgagcatgatttaacagaaaacattattcatattgtgcttgcacgtcttccagatgcaccagcaggtactcgtggtatttcattatttatcgtccctaaatttatcccaactgcggatggcggcgtaggtgaacgtaatactgtaagctgtggttcaatcgaacacaaaatgggtatccgcgcttctgcaactgctgtattgaactttgataatgcaacaggttacctcattggtgaagtaaacaaaggcctacatgccatgtttacctttatgaacacagcgcgtattggtactgcggttcaaggtattgcccatgcagagttatctttccaaggcgctctaccatatgccaaagaacgtatgtctatgcgtgccctttctggtaaaaaagatccagataaagttgctgatgcaatcattcaccatgctgacgtacgccgcatgttgttaactcaaaaagcaatcgctgaaggtggtcgttcaatgatctactacgcagcacagcttgctgacaaaatgacagatgctttgacacgcggtgaccaagctgcatttgaagattatgacgataaacttggtttctatacaccaatcttaaaaggtttcttgaccgagcttggcctagaagctgctaaccacggtatgcaagtgtacggcggccatggttacatcaaagaatggggtatggagcaaatcgtacgtgatgcccgtatttctactttgtatgaaggaacaactggtgttcaggcacttgatttgattggtcgtaaagtgttgttaagctcaaaaggtaaagtagttcgtgaatacactgctgaaatcttaaagttctgcgctgcacatgcgcgtaataaatacttacgtcgttttgcttgggacttaacaaagctttgtgctcagtggaacactttaactgttcgtatcatgcttgctgcacgtaaagaccgtgacatcgtatcttctgcttctgtagatttcttgatgttctcaggctatgtgatgatggcttatttctgggcacaacaagcagttgtcgcttctgaaaaattagaagcaggtaatggtcaagaaactcctgagttctataaagcaaaaattaaagttgcagatttctactttgaccgtttattaccacgtgctcaaggtcatgcagaatcaatggtaacgacttctcgtacgctgacttcattaccagcagaacattttagtttcgactactaa

SEQ ID NO: 2060 - DNA, 264 bp, Acinetobacter baumannii
tgggggaagcttgtgactttattggcgccaggtgcaatgattaccgcaggtggctataccatgggtggtacctctcaagcgacaccacatgtggcaggcgcgattgctctattgagagcgaatagtgtgagtccaacagaaagtatcgatcaaaccattagccggttaaaagctacgggtaaacctattactgactcaagaacgggcttggttttcccacggattgatttactggcggcaaccaatggtttaaccgttaactaa

SEQ ID NO: 2061 - DNA, 807 bp, Acinetobacter baumannii
cgcctgtgtaggaactttcaccaacggcgattatttttggaaaaagctatgcttgctaaacgtattattccttgcctagacgttgataacggacgcgtagttaaaggcgttcaattcctcgatattcgtgatgcgggcgacccagttgaagtggcacgtcgctataacgaacaaggtgcagacgaaattactttcttagacattaccgctacacatcatggacgcgataccacttaccgtactgttgaacgtatggccgagactgtatttgtgccattaactgtcggtggtggtgtacgtaaggttgaagatattcgtgcgttattaaatgcaggtgcagataaagtgagtattaactcggctgccgtatttaaccctgaatttgttcaagaagcttctcagcactttggcgcgcaatgtattgtggttgcaattgatgccaaaaaaactggtgacaacaaatgggaaatctttactcacggtggccgtaaaccaacgggtattgatgccattgaatgggctgtaaaaatggctgactacggtgcaggtgagttactcattaccagtatggacgccgacggtactaaagcaggttacgatattgcgttaatgcgtgctattaatgaccgcgtgactattccaacgatcgcatcaggcggtgtaggtaacttacaacatcttgcagacggtattttacaaggtggtgccgatgcagtattggcagcaagtattttccactttggccaatatacgattccagaagctaaacaatatttggctgaacaaggtatcgaaatgcgcttgtaa

SEQ ID NO: 2062 - DNA, 273 bp, Acinetobacter baumannii
atgagtattttttatactcaaaaaaaatccctgatgggatcagggattgaaaacacaaataatggtggcgagacccaggatcgaactggggacacacggattttcaatccgttgctctaccaactgagctatcacgccgaagtgggcgtattaaacaatgtttacaggaggacgtcaagcaacttccgcattttttgtaacaagtgtttaattttaaatcacaagtgtcgtaaaaataggtttttagctatgcaatttaccaatatgagctaa

SEQ ID NO: 2063 - DNA, 687 bp, Acinetobacter baumannii
ggtataagtagaacaagtgtgctgctgaatataactgaatttatgaaaacgatacttattgcaaatcaaaagggcggatgcggaaaaaccatgacagccattacgttggcaacagctttggcacaaaaaggatataaagtagcattggcagattctgacaaccagaaatcttccttacaatggttaaagcaacgtccagataacgtagctgtaattcaaagcctcgactggcgtcaagaaaaatcaattggtgatgcacctaaaaatttagactatttaattattgatgcaccgggtgccctttcaggtgatcatgctgaacaattagttagcgaagcccatgcgattattactccacttcagccttcatttttcgatatcgacagtacacgacgttttctcaagcatttgcaagatattaaacgtattcgtaaaggtaaagtacaaattttactacttgcaaaccgagttaaaccgaatagcgccagctcaaaagatattcagcaattttttgaaaaaatcgaacatgaacctattgcatggattgcagagcgtagtgcttatggcagtttagcaatgcaaggtttaagtgtatttgataaaccacaaaagaactttattgcaattcaaagccagtggcagcctcttttaaataaactgattgaagataaatctgagtggttctaa

SEQ ID NO: 2064 - DNA, 801 bp, Acinetobacter baumannii
cgcgtcaacagctggcgttgcggcagcggtagctggttttgtaaatggtgctggcgtaataatgagtttactactgggttttggtattttctttttactcataacttcaattgcccaactgattttacaggctattctgagtggagctggtggcggcggacgcggaggaggctttggcggtggtggcggaggctacggtggcggcggtggacgttttggcggtggaggtgcttcaggctcatggtaacaacatcagaaacaacccaaattattactcagccaaaaattgaggaatctgtagagccaagtttaaaacgttggtttaagcatttttgttatttaccagcaagtagccgatatttttccaaacaagataaacaagctattgctgaggctgtacagcaagcagagcatggacatgttggcgaaatacaggttgtcatagaaggccatatcccatgttcacaagcgtatagacaaaatacccgtttaagagcccagcaattatttgcagaactgggtgtatgggatacagagctcaatagtggtgtattgctctatttaaatctgtgtgaacgcacagtagaaatcatctttgatcgtgggattaggaatgcaactactgaacaaatatggcagcagatttgtaagtcgattgtagagcagcttcaacaaaagcaatatcagaaagcggtagttacaggagttcagcaaattggagaagtgatggcacgcttttacgatgaaaacatgccagatcaattaaatgaattaggtaacgcacctatcattatcaattaa

SEQ ID NO: 2065 - DNA, 1128 bp, Acinetobacter baumannii
actatcgacagagtttttttttgcaaaatagcgtattggcaagtgtttttcggcaaatccttgtctaaaatacacccatcaatttccatcagactgcgtaaggaaaaaagacacatgcttgaagccttttatgccacagaacgcggaagtctggaagatgccaccatcaatggtggatttgatctacatcccgaattagtatggcttgatcttattgcaccctctcaagaagaacaacaatgggtcttagatgcttacaatcagaacttacccacactaaagtcgttagaagacatttcatcttctgctcgattctaccgtgatgatgacggtattttgcatatcagcacctattttttaacgaaaaataaaaattatcaggttgatggggatgccgaagattcttcccatatgcttgccatggtgcagactgttgcattcatcttacataaagaccgcttatttactttacgtggtgaaaagttagttgcctttcgtgcttttcgtgctcgagctcgtcgtaatgactacgaaatggattataaagatccaacatggattttattgggcttacttgaagcaaagctagatgagcttgcggatatcttggaagatatccacaaggatctagaaaaatactcaaccgaggttctcaataaccatcaacgtgaacagattttagatcttgatgacatgattacccgcttggcacaacaagaagacatgcttggaaaagcacagctctgtttaattgatttgcgccgtgttttaacgtttttgtctcgtccacgtgctttaggcagtcatatctacgatgcagatattcgagaacttagtgaagatgttcgctcgcttgtcgaacatgacgctttcttatttcaaaaagtacgattcttgcttgatacaacgtcaggatttattaacactgaacaaaacgatacgatccgtcgattctcgatattaccaagtatgttggcaccacctatgttaatcgccagtatctatggtatgaacacggatgtacttcctttcgcacacggtacaaccagctttattatcgttttactaattattattggtttctttattgggcctatcatttatttccgctggaaaaaatggatttaa

SEQ ID NO: 2066 - DNA, 1539 bp, Acinetobacter baumannii
gaattgggcagaacggctaaatttttaggggatattttttggcttcggaggatttccgagactagccgatatcctccatatattaaggaaaatgatatggcagctcatcaaaatggttctgaagccaatcactcccaaagtttaaaacatggacttaaatcacgccacttaaccatgatctcgattgcaggggttattggtggttctctctttgttggctcaggaagtattatctacaacaccggccctgtagtttttctaacttatgctttaggtggccttctagtttggttcattatgcgtatgttaggcgagatggccgttttaaatccagacagtggctctttttcaacttatgcggaccgtgcgattggtcgttgggcagggttttcaattggttggttgtactggtgtacgctggcgatgctcatgggctgggaagcttatgtagcaggaaagattttaaacaactggttcccgtttataccgatctgggtttatatgaccgttgtcattgtcgcactggttgttgtcaatttacaaaacgtcaagaactatggtgaattcgagttctggtttgcgctcatcaaagtcatcgcgattgttgttttccttgtgattggtagtttagccatcatgcatttgtggccttggggcaatccggctgcatctggtataagtaacttaacctctcaaggctttatgccaaatggcggttcgtcagtgattaccgccttgcttggggtgatgttcgcctatattggtgctgaaattgttaccgtagcagcagcagagtctgcaaatccatctaaagaaattcgtaaggcatcaaactcggtggtttggcgtattattttattctacgttggttcaatgttcgttgctgtatgtcttattcctcacaacaatgaacttttaaaagattcgacttggggtacttatagtgtaactctgtctgcacttggtattccgggcgcgcgccatatcgtaaattttgtagttctaacatcggtatgtagttgctttaactcagcgctttacacgtgttcacggatgctattctcgttgtctaaacgtggtgatgcaccaaaaagttttggttctgtaaacagtaaaagcagtccttgggtgggcgtgattgtgtcatgcttcttctctgtaattgcggtaattttaactgcaacagagagtatgaatgtttatgacttcttcatgctaacaacaggtgcagcaacactatatgtgtacctgaccattgcttattctcagcttcgtatgcgtaaaaaattagaagctgaaggcgtgaagattgactttaaaatgtggatgttcccttacctaacctatgtggtgatctttgcaattattggtgcaattcttaccatgttgattgaaggtacttattttaaagaagtgatttacaccacagcattgttcggcattattgtgttcttcgggttattgtcagaaaaattgggttggggtaaagagcgtagggcgacccatttaactcatacccatgaagaaaagttagtttaa

SEQ ID NO: 2067 - DNA, 1995 bp, Acinetobacter baumannii
ggggaactaagcatgcaaattaagacccctgatattggtgtagataaagcaaacgtcgctgaaattttagtaaaagttggcgaccgtgttgaagttgacgacagtatcgttgtgcttgagtctgataaagcaactgttgaagtgcctagcacttcagcaggcgtcgtaaaaagtatcttgattaatcaaggtgatgatgtgaccgaaggtgttgctttgattgagatcgaagcagaaggtgcggcacaaccagcaccggaaccaacaccagctcctgcggctgaaaagccagctgctccagcacctgcgcaacaaactcaagcttcagctcaacctgctgccgctacatcagctgcaactgttgaagtgactgtacctgacatcggtgttgaaaaagcattggttggtgaaatcctcgttaaagtgggtgaccagatcgatgttgaacaaagtattgtggttgtagagtcggataaagcaactgtagaagttccaagtagtgttgctggtactgtagaaagtattcaagtaaaagaaggcgataccgttaaagaaggtgttgttcttattcaagtgaaaacagcagctgcatctaatgcgcaagcagaagctcctactactacaccagctccagctgcggtagcagaaccggttgctgcaaagcaagaaactgtggcagcggttccagctcagtctggttcagttgatatcaatgttcctgacttgggtgtagacaaagctgttgttgctgaaatcttggttcaagttggcgataaagttgatgtagaccaaagccttgttgttgttgagtcagataaagcaactgtggaagttccaagtaccgttgctggtgttgtaaaagcaattcacttgcaagcaggccaacaagtttcacaaggtgtattgcttgcaacaattgaagctgaaggccaagcacctgctgctgcaccagcggcaaaagcagaagcagccccagctccacaggcagcagcacctaaagcagccgctcctgttgcaactcagtctgcacctgcggcgtctacatctggtactgataagttaacgaaagagcaagaagcagaaaacgctaaagtgtatgctggtcctgctgttcgtaagctggctcgtgaacttggtgtgatcttgtcacaagttaaaacttctggtgagcatggccgtgttgttaaagaagatatctttgcttatgtgaagagccgtttaactgcgccgcaagctgcaccagtggctcaagctactgctgctccggctggattgccgtcattacctgactttactgcttttggtggcggtgaagtgaaaccaatgacgcgtttacagcaagtttctgtaccgcagttgtctttaaacaactacattccacaagtaactcagtttgaccttgcggatattactgagctagaagcttggcgtggtgagttgaaagacggctttaagaaacaaggtgtgagcctaacaattttagcatttattgcaaaagcagtagctcacttgttgaaagaagagccttatttcgcgggtcacttagcagatgatcagaaatctgtattactccgtaatgaaatccatatgggtattgcggttgcaactccagatggtttgacagtgcctgtactacgtaatcctgaccaaaaatcaattaagcaaattgctgttgaattaggtgagttgagtaaaaaagcgcgtgataagaaattaacaccgaaagatttacaaggtgctaacttcacgatcacaagcttgggctcaattggcggtacagcatttacgccactagttaactggccacaagttgcaattttgggtatttcacctgcaacgatgcagcctgtatggaatggtaaagactttgatccacgcttaatgttgccgttgtcattgtcttatgaccaccgtgtaattaatggtgcggatgcagcgcgctttacaaataaacttacgaaacttcttaaagatattcgtactttattaatctaa

SEQ ID NO: 2068 - DNA, 984 bp, Acinetobacter baumannii
caatttaaaaggtatttttctaatatatttaataatgggacacgatatgttttatatataacaatggaactcaggcatatacgctactttttggcagtagcagaagaaaaaaactttaccaaagctgcgcagcgcttaaacatgagtcagccgcctttaagtatgcaaatacgagacttagaagaagagctaggtgcagatttatttattcgttcgcctcatggggtggagctgaccgaagctgggcttgcctttttaaatgcaattcagccagtacagcagcgtgtagaagatgcagcaaaccttgttaaacaagtggcaaatggcgaagtgggtcaattacggttaggctttacaggtacttcaatgttgaaccctttaattcctaaatgcgttcgctatttccagcagcaatacccaaaagtaaatttaaagcttgaagaagccaataccttactactcatcgacttattgcttgaagaccgtttagatgtcgcaattattcgttcgccacgtaatatgccagatagcctcattctgcaagaattattggctgagccgctcattgctgctttaccttccgagtcttttaatctggacgatgcatcacaagaaattgatttaactgcactgcgagaacttgattttattgtctcgccaccttcagtgagtgcagggctttttgatgcgattaaacaggcctgtcatgagcgtggctttgaaccgaaaattggacaaaatgccccgcaaattgtatcaattttatcgttggtgtctgcaaacttaggggtgtctttggttcccgagtcgaccaaacaattgcaaatacaaggtgtggcttatcgctctttgaaagcacctgtacctacggtgggtttagggcttgcttataaaaaacatgccccttcacagatggcgattaactttgccagtgtggtgcaagtggcttgtcaccacgccaacgaaataaatgaaatcagctag

SEQ ID NO: 2069 - DNA, 906 bp, Acinetobacter baumannii
attccaaaaagaattgtcttcaagttttattcggcagcagattttaacgcaaggctcatcgaaatatgtgcagcaactctcgccacaattaagtcttgggttttagtcatgtttaatgaggaagtcgcttactattttgatggttcaatggttgggctgctgagctgtgtatttcgtgcatttcaatttaaagaattacaggtcaggctctgtttgaatgatacagctcaacatggattatttgccgataaaattgaggttgtaaataacgagcaacatgctgaacgtgtttgggctgcgctacaaaaaaagctttcatcttcttcgttaaaacaattttattttgcttatttatccgaatctttagatgcctatcagcatttatttaattactgtatttatgtgtttagtagccatgtttctatagaaaaagattattcacatcccagcgttttagcgattacacagtggacgaaaaaagtcggacgagagaagcatcgaatggaggcttttattcgttttaagaaaaccaaagatgagctttttttaagtctggttcgtcctgattttaatgttttaccgcttattcagccgcattttaaacggcgttatcaagatcagcgttggctcatttatgatgagcaacgcaagtttggcctatattatgatttacgggaaatacatgaagtttcactcgaagcctctgacgttgaccgtaatttaaaaaatggaatgagccaaagttttcagcttgagctagatgagcaagaagtcttatatgaccagctttggaaggattattttaaaagcgttaatattacggaacgccagaatattaagcttcatgtgcaatatttgccaaaaagatactggcgctatttaaatgaaaaattaattgaatattaa

SEQ ID NO: 2070 - DNA, 978 bp, Acinetobacter baumannii
aaaatgaaaaggaacttaatatttttctgtgctgcaatactctcaggactgagtgtttcagcaacccatgccacaaatgcagagcaagtcaaaagctcattcgtctattcaacttatgcacaaaccaaatatccattggtttttaaccatggtatggcgggttttaaccgagttggaacagatacgcttggtctggactactggtatcagattcttcctgatcttgcgcgtaacggaggaaatgtctgggcaacaagagtttcaccgtttaactcaactgaagttcgtggagaacaacttgcccaacaagtagaagaaattattgccatcaccggaaagcctaaagtcaacttgatcggacatagccacgggggaccaacaattcgctatgtcgctgggatcatgcctgaaaaagtcgcttcgcttactactattggtgcacctcacaaaggatcgccaatggcagatgtcatcctgaatgttgagggtactcctctatccggactggcaacattagtaaactggttttccgcagcaattacttgggcaggaggtctagacccaaatagttatccgcatgactccctagcaggtgcccacagtttatcgactcaaggctctgcacagtttaatgcccagtttccaatgggtgttcctaccacgtcttgtggtgagggtgcttatcaggagaaaggcatttatatgtattcattctctggtaataaagcgctgacaaacccattagatccatttgatatagcattgacaggaagtagtctagtggttgacccatttggggataatgatgggctggtttctcgatgcagtgccaaatttggtaaaactattcgtgacgactataactggaatcatttagatgaagtcaatcaggtcatgggaatacgttctatttttgcagcagaccctgtctcggtttaccgtcaacatgctaaccgtttaaaacttcaaggattataa

SEQ ID NO: 2071 - DNA, 981 bp, Acinetobacter baumannii
  unsure (732): Identity of nucleotide sequences at the above locations are unknown.
agcatgcgaagtattatccatcgtaattttggcgaacctgtagaagttttagagcaggcggatatgtcaaagcctgaaccaaaagcaggcgaagtgcgtattaaaaccatcatgtctccgatccataatcatgatgtatggacagtacgcggtagttatggctataaaccaaccttacctgcgattggtggcagtgaggcagttggtattgtagatgcgttaggtgaaggtgttgaacatgtacaggtagggcaacgtattgcagttgcggctgtgcatggcagttgggctgaatactttattgcgcctgctcaaggtattattccactcaataatgaaattgatgatgaaacagcagcgcagctgattggtatgccaattagtgcactcatgctactcgactttgttaacgttcagccgggtcaatggctcattcaaaatacggcgaatggtgcagtcggtaaaacagttgccatgattgcgcaggcacgtggtttacctgtgattaatctggttcgtcgtagtgatgcaattgccgagatgcaggcattaggcattcaacatgttgtggcaactgatcagcctaactggaaagagcaagttaaacagattcacggtgaccaacctcttattgctggtgtggactcgattggtggaaccgcaagtggcgaaatgctgaatttactcagtgaaaatagcttgctcgtttcgttcggtagtatgacgggtganaccatgcagatttcatcgggtgatctaattttcaaacaagcgacagtaaaaagtttctgggcgagtgtggttaataaagaaatgccagcagctcgtaaaaaggaattgatcgttgagctgctaacattagcgactcagaaaaaattaatccttcctgtagaaggtgtatttagttttgatgagattaaaactgccgctcaacgagcaacgcaaggtgctcgtcaaggcaaagtgttgttaaagccgtaa

SEQ ID NO: 2072 - DNA, 207 bp, Acinetobacter baumannii
cctctaagaagtgaattctatgcagagtcgtggggtcgaactgctttaaaagagtgcgaaataagtcaaaacatttttctagcaaaaaccagtgtacgtaaaaatggaacagcgtatattggcttatccgcccaaaatttttttttgcgaaacattgagctaactatcgtccataggcactatcgcaaaaagaagttgtttgtttga

SEQ ID NO: 2073 - DNA, 909 bp, Acinetobacter baumannii
aaattaggaagaattataagagtgaataatttaattattggaaccctatttgcactgtgtgcagcggctttaaatgcatctattggtgtaattagtaaattactcatgcacagtggtttaaacccgcaagatattgcctttttaaaaaccattatcgcctttttctttttaagtgtgtttttatttaaagtacctgttagccaaaagattgcatttattagcagcacaccaagtaaactcagtgttttttctcaaattgctatctgtgcttttttaggtattttctcgctattcttttttgagaccattgcttataaccacggtgctgcggccaatgtggtagtggtactcatggcttcggctgccatttctgccctattttttgggcggttcattttaaaagaaagcatctacattcattcgcttattggaacattattggcggttgctgggattagcattatttcgtggaaaggtgaaaatagccttttaatgctgattaatgcttctattgccggtacgggttatggcttattttcggttttagtgaaaaggttcaaattaaatggcgggctgtttctgactaaatacttactgctgtttggtagcgtttatcttgcagttccgtttttagtaaatttgcatagcattacttttaatagtgacatcattttaggtttgattggtttagctgttctaccaaccatactcggctttttctgtaccactaaagcgttgtcttatatgagtgccgcaaaggtacaagtgaccgagctttcagaacccatttttgcagcgcttatggcttgggttttcattcatgaacaaccgactttatcgtttttatatggtgcaatcttcattatttcaggcatctttttaatgaacaaagcgccgaaatcaaactag

SEQ ID NO: 2074 - DNA, 615 bp, Acinetobacter baumannii
cgttttttgaggaacgtgtccatgacgcaacgtatcagtgaagtggttagaaataccaatgaaaccaaaattcgagttcgtttaaatctcgatggtactggtcaaggcacactaaacaccggagttccatttttagaccatatgattgatcaaatcaagcgacatggcttatttgatatcgatattcattgtgatggagacttagagattgatgatcaccataccgtagaagactgcggtatcacgcttggacaagcttttgcacaagctttaggtgataaaaaaggtttacgtcgttatgggcatttttacgcaccattagacgaagctttatctcgtgtggttgtagatttgtctggtcgtccgggtttatttatggatattccatttactcgcgcgcgcattggtacctttgacgtagatttattttccgagtttttccaaggtttcgtaaaccatgcgcttatgaccttacacatcgataacttgaaaggtaaaaatagccaccatcaaatcgagagtgtatttaaagcactagctcgtgctttacgtatggcatgtgaaattgatccacgtgctgaaaacacgattgcatcgacaaaaggtagcctctaa

SEQ ID NO: 2075 - DNA, 438 bp, Acinetobacter baumannii
caatatttgaggtataaagcgatgaaaaaacaacgtttgatgatagctttgctggcaactttaggcatgggttcagcatttgcatcaacctcgagtgaatacaatattgccaatggcttgcttccagttgaaaaagatcaatcaatttctgtattacaaccatttcagggaaattttaggattttaggttcaaaaatttatcacaatgatgagcaagccaaattttcaccgattgattatgcggtaagttggggtttatttgctcaacctgaaatcgcgcgacatatttcagtgaaacaatatgaccgctatttaaactggaaaatagcaaaacttcctgtaccagctgagcaagcaatgcagatggtgtcgaatatgcacattattcctgcaaaccctgaaatcgcccaacaaattaagcaagttaaaacgtggtga

SEQ ID NO: 2076 - DNA, 915 bp, Acinetobacter baumannii
tttaacttgagtatgtcaccaatttctctgagttcaagcaaagctccacagttagccctcattttgattacgatcatttggggtggaacatttcttactgtgcagtatgcactaagtttttcatcgcctatgttttttgtaggctgccgttttgctgtagcagctcttactttgcttcttatctcattaaaaagtatgaaaggtgtcactttaaaagatttaggcgctggtagcgcgattggccttgtgattgtcgcaggctacggcacccagaccattggcctgcaaaccattccgagtagtgaatcagcatttttaacagcgctatatgttccgcttgttcctattttaatgtggctcatctttagaaaaactccacacatcatgacttgggtgggagctgctcttgcctttgctggccttgttttattaacgggcaatggttttgagcaaatttccttaagttttgggcagcttttaacaatcctgggtgcgtttgcgatcgctttagagattatttttattagctactttgctggaaaggtaaatttacgccgcgtcacaatcattcaacttggtgtcgcttctctactttctttcgccatcatgcctatggtaggtgaacatacgattccagcattttcatggcccctagtactcattgctgttgcattaggtttagcgagtgcgctcattcaatttgttatgaactgggctcaacgtgtggttgatccttcacgtgctgcaattatctatgcaggcgaacctgtttgggcaggcattattggtcgaattgcgggtgagcgtttaccagttattgctctttttgggggtgctttagtagtcttaggcgttttagtcagtgagttaaaaattaagttaccaattaaaaaagctaaaagaattcgagaataa

SEQ ID NO: 2077 - DNA, 462 bp, Acinetobacter baumannii
ctaaaaatgaggaagagaatgaatattttcgaagcattaagagaaagccacgaaaatcaacgcaacctttctgaacaattaatccagacacatggtttaaccgaagaacgaaaagaattatttgatgcattaaaaaacgaactttatgctcactcagttgccgaagaccgttatttatatattcctttaatgtttgatgatgtcggtttggatattacgagacatgctttatctgaacaccatgaaatggatgagttggtcgagcaacttgaaaaaacggatatgagtagcccaagttggttggcaaccgctaaacagttgagcgaaaaagtccatcaccacttaaaagaagaagagcataagttttttcagcaagccggtaaaattcttaaagacagtgaaaaagaaacgctaggcaataaatatttaaaggaatataaaaagtataaaaaacagcaataa

SEQ ID NO: 2078 - DNA, 330 bp, Acinetobacter baumannii
aaaaaaatgagtcaacagttactgattattgtaggaatagctctacttgcacttggaacgtacagtattcgttttgctggctttcacttaggtgccaagttttcgttttctgaaaaataccaagttttactctcaaacggcgcaaccgttttgctctgtgccattgctgtgaccactacattttttgaaggtcatcatttcgcaggtttcgcacgtatatttggggtgggtttggcacttttcttagtttggaaaaaagcaccgcttttattggtgatttgtttggcagcggctggcacagcactggtacgtttacttggaattgaataa

SEQ ID NO: 2079 - DNA, 864 bp, Acinetobacter baumannii
cttatagtgaggcctgctgaatattcagtgcaggctctatctgcttcatgccattttaaaattttggatacaagaatgaccaaacagtttgcagtaattggcaatccgatcgaacaatcacgctctcctgaattgcatcatgctttcgctgaaaaaacaggtgttgagctaaactatcaaaaacggcttgctcctcttgacggttttgaatcgagcatgcgaagtttctttgcagaaggcggcagtggtatgaacgttactgttccttttaaagagcaagcttttgctttatgtgatatgttaaccgagcgtgctcaaattgctaaagctgtaaataccttatggatggaaaatggcaaattgcatggtgacaatacagacggccaaggcttagttgccgcaattcaagctttagaatggaatcttgaaaatacaactattttaattttaggagctggtggcgcaacgcgtggtgttatttatccccttgtacaggctggtgccaaaaaaatcgtcattgcaaaccgaactttagctcgtgcagaacaacttgtagatgacttaaaaacagcagttccacaagcccaattacaagcaatttccctaaatgatttagaaggcgattttgatattgtgattaatgcaacttcggcaagtctttcaggcgatgctttacaactacctgaaaaattaaaatttaaatatgcctatgaaatggcttatggcaaaccttctagtttccttgatcaagcgaaacagcgtaatgtgccttatgcggaaggttttggcatgttagtaggccaagctattgaagccttctctatctggaatggtgtacgaccacaattaaaagattttctataa

SEQ ID NO: 2080 - DNA, 1464 bp, Acinetobacter baumannii
aatagagtgagtttagagccaataccaccgcaaacctttaccgactacgttgcgtactcagagcgtaaacggacccgatgggaacgttttctcgacaagattaagccacgttctgcggccatgcgtaccacaattttggtactgctggtagtactctttagcttatttatgtcattgtggtttttttggcgaaccctctatttacctgaaattcagcaacatgcgcgctatctagcagttgaactagaactggtaaataaccctaatattcgtatttttcatcgcgatagcgaagttgacgtcgacacatggttacgcaatcgggttggcattgaatatgtcacgaaccccaaagaatatccaagtgtccgcgataaaattattgccgagttttttaccaaccaagttgagcaaaaactggcaaatgaaattggcgcaaaagacgttactgtctatttccaatttaaacctagcccacgtatctggattcaaacgccagaaatgcatggtaactgggttcgtgaacctttaaaaacctatgccaactatagccccgagctactggtaggctgggttgtgggtgtcccattagtttcggccatcattattttaattttggttcgacaaatgaaccgaccattacgtcgtttgcaaaatgctgccaacgaatacagtaagtctggaactgcaccttatttagatactaaccatggccctttagaaattcgccaagtaaaccaagcatttaaccgtatggtatatacgcttgaacaaactgagcgtgaaagacgaatcatgctagcgggaatttcacatgatttaaggactcccctcacacgtattcgtttaactgcagagatgctacctgatgaatttctacgtgaaggtctagtttatgacgtagatgatatggatgcgattctaaatcagttcatctcatatatgcgcgatggttcagatgaggaattaaaagacactaatattaatattcttttacaagaattggtcgttcagtttaaaccccttgatattcgctttaacatgcaggatgttcccattattcctgcacgcagcctctctttaaaacgacttattgccaacctcattaataacgccaagcgttatggtgctgaaccgatcgaactcagtgcaaaggttgaaaatgaacatattttaattacggttgctgaccatggtgaaggcattccagaagatcaaattgaagaattaatgcagccttttgtaagaggcaactcggctagaacgattcagggaagcggtttgggtcttgccattgttaaacgtattgtcgatattcaccaaggtgaaatacagattcacaatcgtgaacaaggcggtttagaggttattatttctttaccaattccaaaacccgcccctgaagaaaatacaacgcacaatcctttagaaaaaatcaaacaaactttaagtgagcgcttttaa

SEQ ID NO: 2081 - DNA, 636 bp, Acinetobacter baumannii
agaaattcgagaaatgaacaaagtacaagatgctcttcgttatggaatttagttatgccaatagaagaaatttttacttgcttaaaacgagaaattaatcctagtatttgttgtgttgcgaaacctgctgagaatggagttgaagttattttaactgagaaggttcggcgaactgatcctaatccacctgcattaaataaactaacattatttgggtttgatgaagttatttcgattaatcaagatcttgtaagagcttattatccaattttattgcccactaaaaaagcaattaataaaacttgtgatggaatattattggcagctattaaaggaaagctatattttttagtaactgaaatgaagtcttcattaagtaatatggatgagcatattttaaaaatgcaagctggaaaaaatatggttagttacttgaagtgtattttatctgagtatctaggtattgatacatcttcttggaatacatactattgtatttttcatattgctgatcctaaacgtgaaacaaatgagtcattattaattagctgtgatcctaaataccctatgtatttttgtgttgagaataatgatcgtttttcagctctaaaattaattaatgaatctttaatttaa

SEQ ID NO: 2082 - DNA, 729 bp, Acinetobacter baumannii
tcgctatctggccgaaaaatcatgaatattgttttactagagcctgaagatgttcaatcggatacatggtctatccattcaaaacgtcaattacagcatttgcgtgaacatcttgatattacagtcggccagaacctaaaagttggtattcgcaacggcgcccgttatatcactgaaattgtttcgatgaatgagtacgaagtctgtatacggcctattcgtgaagaaccactaccagcaaaacttccggttcatttaattgtagctttaccaagacctaaagttttacgccgtctaattatggacagtgtgactttaggtgttgaaaggataagcctgattcatagttatcgtgttgataaaagctattggcaaacaccttttttacagcaagtagacaactacgttacgctgggacttgagcaagcaggcgatacaattgttcctgaaattcaactttataaacgttttaaaccttttgttgaagacatcttgccaagtttaattacgcaggaaacacctgcctatgtggctcatccttatgctgagcagcgtatgccaattaatattagctatgcttgtagtgtagtggtcgggccggaagggggatttattccttacgaagtagatttgctcataaaaaacggctgccaagctatgagcttaggcaaccgtattttaagaaccgaaacgtctatttcttatattttaggtcgtttgtttagctga

SEQ ID NO: 2083 - DNA, 852 bp, Acinetobacter baumannii
aagcgcagcggaataaggacgaaaattatgccgattcaaaaatgtaagccaacgtctccaggacgtcgctttgtagagaaagtggttcatgaccatcttcacaaaggcgcgccttatgcaccgttggtagaagcaaaaaaacgtactggtggtcgtaataacaacggtcacattactactcgtcacgttggtggtggtcataagcaacattaccgtatcgttgacttcaaacgtaacaaagatggcgtacctgctgttgtagaacgtattgaatacgatccaaaccgtacagcgcatattgcattattgaaatatgctgacggtgagcgtcgttatatcattgcgcctaaaggcttacgtgctggtgataaagtacaatctggtaacgatgctccaattcgtccaggtaactgtttaccacttcgtaacatgccaatcggttctacacttcataacgttgaacttaaaatcggtaaaggtgctcaattagcacgttctgctggtgcttctgttcaattgttgggtcgtgatggttcttacgcaatcattcgtcttcgttcaggcgaaatgcgtaaagtacacgttgaatgccgcgctgtaattggtgaagtttctaaccaagaaaacaaccttcgctcattaggtaaagctggtgctgcacgctggcgtggtgttcgtcctaccgtacgtggtatggcgatgaacccgattgatcacccacacggtggtggtgaagggcgtaacaaaggtattcaacctgtaagcccatggggtcaaaaagctaaagggtacaagacacgtaccaacaagcgtacgactaagatgattattcgcgaccgtcgcgtcaagtaa

SEQ ID NO: 2084 - DNA, 1947 bp, Acinetobacter baumannii
cccagcttaggatttgccaggcttataaaggctttgccacatatgttgtataccgaaattccaactcaacgccctgttacgccattgttagatgcgattgatcatcctcaacaattacgtcagctcgagcatagccaattactacaagtggctgatgagttgcgtcaatatattttatatgcagcaggccagagtggtggccatttcggtgctaacctcggcgtggttgagctgacggtagcgctgcattattgctttaatacaccaaatgaccgtttagtttgggatgtgggacaccaagcatacccacataaaatcctgactggacgtcgtgaacaaattacgaccattcgcgctaaaaatggattggctgctttccctgccagagaagagtctgtttttgatacctttggggtagggcattcttcaactgctatttcagctggtttgggtatgtctttggcacgtcgctatcagaaagacccatgtgaagtcgtttgtattgtgggtgatggtgcaatgactgcgggcatggcatttgaagcaatgaatgatgctgttgctcatgatgcagatttaattgttgtactcaatgacaacgatatgtcgatttcttgcagtacaggtggctttgccaaacatttagctgcgatttgggaaaaaggtcatttagttaatgtcaatgaacatggtgaagcttatatccagccacacccaaaatggacatataactctcgattacaccaatcggcaaccgacgcggcagataatttatttaaagcaattggttttgattatttcgggccttttgatggacacgatgtcactcagttggttcaggtgttcaacgcgctcaaaaaacgcaaaggtccacgtttagttcacgtttataccaagaaaggtaaaggctttgctcctgctgaagcagacccgattacttaccatgcgattggcaaaattaatgctgcttcgggcgggaaaacaccaccaaaatactctgatgtgtttggtgagtggttatgtgatgaagctgcacaagatgagcgtttgcttgcgatcacgcctgcaatgtgtgaaggctcgggcatggttaaatttgctaagcaatttcctcagcgtttcttcgatgtcgcgattgcagagcagcatgctgtaacacttgcagcaggaatggcatgcgaagggctaaaacctgttgtcgccatttattcaacattcctgcagcgtggttacgatcagcttattcatgatgtcgcattgcaaaatcttgacgtgacttttggtattgaccgtgcaggcttggttggtgaagatggtccaacgcatgcaggtgcatatgactatgcttatatgcgtactgtgcctaatatggtgatcatggcaccgaaagatgaaaatgaatgccgtcaaatgcttcatacggcttatgcctataatggcccggctgcggtacgctatccgcgtggtgcaggtgtgggcgtcgaaatccaaaaagagatgactgttcttgaattgggtaaagctgaaattgttgcagaaattaaagcaaacagtgatgagcagattacggttttagcatttggtagtcgtgtcatggttgctctggaagcagctgagcaatttgcgcaaaaacatgacgtcagtgtgtgtgttgtaaatatgcgcttcgtaaaaccgcttgatgaacaaatgattcgagacttggctgagcatactcatttattcgtgacagttgaagaacacgcgattatgggtggtgcgggtagtgcagtgaatgagtttatggctcaagaacaaattgttaaacctatcattaatttaggtctacctgactcgttcttgcatcaggcgacacataatcaaatgctacaagattgtggtttagatgctaagggtattttgaactcgattgagcgagcatggcttaaggtaaatcaggtggtttaa

SEQ ID NO: 2085 - DNA, 348 bp, Acinetobacter baumannii
acgttaataggtgtcatgatggaagtaactgctaaattacgcggtgccgctatctcggcacaaaaagcacgtttggttgcggacttaatccgtggcaagtctgttgcacatgctttaaacatcttgaacttcagcaacaaaaaagctgcagttttagttaaaaaagcattggaatctgcaattgcaaacgctgaacacaataacagtttagatgttgacgaccttaaagtttctacgatttacgttgacgaaggcatgagccttaaacgtattatgccacgagctaaaggccgtgcagatcgtattactaagcgtacttgtcacatcaccgttaaggtaggggtttga

SEQ ID NO: 2086 - DNA, 2094 bp, Acinetobacter baumannii
agcagcaaaggcggagaaaaactaatgagcaaacatactgttttattcgaacttggctgtgaagaacttccaccaaaaagcttaaaaacattacgtgatgcactacaagcagaaacggtaaaaggcttaaatgaagctggtttaaacttcgcatctgttgaagcttatgccgctccacgtcgtttagcgcttaaaattgtagatgtagatgctgcgcaagcggatacacaaaaacgttttgacggtcctgctgttcaagcagcttacgatgcagaaggcaaaccgactaaagcacttgaaggctttatgcgcggtcaaggcattactgttgagcagctttctacgttccaagcaggtaaagttgaaaaagtttgctatttaaaagatgtgaagggtcaaagccttgacactttgcttccacagattttacaaactgcattagacaatttaccaattgctaagcgcatgcgttctgctgcaagccgtaccgaatttgtacgtccagtgaaatgggttgtcttactcaaagatgaccaagttattgaggcgactattcaagatcacaaagctggtaatgtgacttatggtcaccgtttccatgcacctgaagctgtgaccttagcgcatgcaaatgactatttagctgcgttagaaaaagcatatgttgtagcgaactttgaaaagcgtcaggcaaccattcaagaacaagtgaaaaagttagctgatgaagtgaatgcaactgcgattgttccagctgacttacttgacgaagtaacaagtctggttgaatggcctgtggctttacgtgcaacttttgaagaacgctacttagctgttcctcaagaagcactcatcacgacaatgcaagacaaccagaagtatttctgtttgatcaacgcggaaggtaaattacagccttactttattactgtttcaaatattgagtctaaagatccgactcaaattattgaaggtaacgaaaaagttgttcgccctcgtttgtctgatgctgagttcttcttcttacaagatcaaaagcaaccgcttgcatctcgtaaagaaaaactagcaaacatggtattccaagcacaacttggtacgctttgggacaaatcaacacggattgcaaaacttgcagttgcattatcttcaatcactggtgcaaacccagctgatgctgaaaaagctgcattacttgctaaatgcgacttaacctctgagcttgttggtgaattcccagaacttcaaggtattgcgggtacttactatgcgcgtattgaaggcgaaaacacagaagtttcagaagctttaggtgagcaatatttaccaaaatttgcgggtgatgttttacctaaaaccaaaacaggtacaaccattgcccttgctgaccgtttagatacgcttgttggtatttttggtattggacaagcgcctacaggttctaaagacccgtttgctcttcgtcgttcagcaatcggtatcttacgtttaatcattgaaaacgaattagacgtaacaattgaagagttagtaaatcttgcgcttcaaggttatggcgatatcgttaaagaccacgacaaaactcgcgctgatgctgttgcgttcttggagggtcgttaccgtgctaagtatgaagaccaaggcgttgctgttgacgtacttcaagcagttcaagctcttgcaccaaaatctccacttgattttgacaagcgcgtaaatgcagttaatcacttccgcacattacctgaagctgctgcacttgctgctgcaaacaaacgtgttgctaatattcttgcaaaagaagcggcaccagaaggttctgtagttgaagcgaacttggttgaagatgctgaaaaagcattatttgctgagcttcaagcagtgactcctgtggttgaaccattacttgcagcaaaagattacacaactgccctttctaagcttgcagcacttcgtgcgccgattgatgcattctttgatggtgtaatggttatggcagatgatgctgacttaaaagcaaaccgtttacgtttattggctcagttacgtaacttgtttactgctgtggctgatgtgagtgtgttgcagggttaa

SEQ ID NO: 2087 - DNA, 564 bp, Acinetobacter baumannii
cattatagaggtattaaaaacatgatactaacgactgaacgattaattcttagaccttggcaggacagtgatgcttcaagcttatatgagtatgcaagtgatgatcgtgttggaccaattgctggatggcctgtacatgaaagcgaagcacaaagtttaaaatatattcagaccgtttttgctaaagaagaagtatatgcggttgcaaaaaaggaagataatcgtgcgataggtatggttggtttactaattggtaaggagagtaattttaaaattgctgataatgaagcagaggtagcttattggatcggagtaccgttttggggacaaggtttaataccagaagcagtaaaagcagtgatgaaacatgcgtatgaagatttaaaattgaaagctttatggtgtggctattttgcagacaatgaaaaatcatttaaagcacaggctaagtgtggatttaagcatcaccatactgaagaaagtaagttcaataaatttttaggcgactatcggacagagcatataagttatttatcatatgaagactggaaacgagaaatttag

SEQ ID NO: 2088 - DNA, 1554 bp, Acinetobacter baumannii
aaatatatgggtacaccgattgttattgcaaaaaatattaacgacacatcaaaagaaattgttttactttcccaatttgccaaccggcacggcctgattgcaggtgcgaccggtacaggtaaaacagtcaccctaaaggtgctcgcagagagtttttctcgaatcggcgttcccgtctttcttgccgacgcaaaaggtgatgtttcaagcctcgcaaaagctggtgaagcttcggataaatttaatgaacgcttaaagcttttacaaatcgacagtgttccatttgcagccaatccagttgttttctgggatttatttggtcagcaaggccaccctattcgaaccactatttctgaaattgggccaattttattagcacgtatactcaacttaaatgacacccaagaaggtgttttatctgccgtattccgtattgcagacgaccaagggttacttctggtcgactttaaagatttaaaagccatgatcacttttgtaagtgaacatgcagctgagtttaaagccgaatatggcaacctatctccagccagcttaggcgctattcaacgtaatctccttgctcttgccgaccaaggtggagagcagttttttggagagccagctttaaatattctggactttatacaaaccgacgcaaatgggcatggttatatcaatattcttgcggctgacaagctcatgaatacacctaagctatatgctactttcctattatggatgctttcagaattatttgaacagcttccagaagttggtgatatggataaacctaaactcgtgtttttcttcgatgaagctcacctgttattcgacaacgccagtcaagctttacaagaaaaaattgaacaagttgtacgtttaattcgttctaaaggtgtgggaatttattttattacccaaaacccgctcgacttaccagaaagtgttttagggcaactcggcaaccgtgtacaacatgctttacgtgcctttactcctaaagatcaaaaagcagtaaaaacagcagcagatacattccgctctaatcccgattttaaagtagatgaagcaattaccgagctcggtgtaggtgaagcactgattagttgtctagatgaacaaggtacacctcaaattgtagaacgtggttgggttatgcctccttactcttcatttacgcctatcactccagaagagcgtcagaccttaatttcgcaaagtattattgccggggtttatgaacaagctgtagatcgtgatagtgcctatgaaatgctccaaaacaaagtggctgaacgggaacagcaaaaacaagatgcagaactcgcaaaacagcaagcgaaagaacaggaaaccttagcgaaacaacaagccaaagaacaagagcgtctagcacgtgaacagcaaaaagaagaggaacgtgcggcgcgtgaaagagctaaacttactcaagatattgtcggaacttttgcaaaaagtgctgctcgcagcttaggtggtagtactggccaaaaattagtacgggggctactcggctcattatttggaaaataa

SEQ ID NO: 2089 - DNA, 477 bp, Acinetobacter baumannii
ggaaaatttatgtccgtatggctggccatgcttattggtgctggtattggtattattatcacgacgctcattttatcaaatacccgtaatggccgaatcaaggctgaatacgagcaatatattgccgagttggagcttgagcatcaacaagcccttgcccaagcacaaaagagaagtgtgaatacgagccgcgccgtattaaaaggaaaaatggcagaacaatttgcgccagtcttgccggaatttcagtatttgccaagtgatgccaagtttatgggcgacccggttgattatattattttcgatggctataccgattttcgagatggagacggaactgccgatgatattcaaattattttgctggatgtcaaaagcggaggggcacgtttaacaaaagggcagcaagcgattgctcaggcaattaaggaagggaaagttcgctttgaaactttaagaatagattttgaagattaa

SEQ ID NO: 2090 - DNA, 2568 bp, Acinetobacter baumannii
agcttacttatcatgaaaaagctatccagtttgggcttcgtgcgtccaatttttttgatcattattattatcttggtctcacttccgatgggattctatggcatgtatctctatattgccccaacgcttccggaaatgagttcactaaaaaaagcaccgcttttaaaaccattgcaagtctatacagccgacaatcaactcattgctgaatacggtggtaaactttctattccggttgaatacaaacaaattcctcctaattttattcatgcattcctagcagcagaagattcttctttctttgaacatagcggcattagttttaaaggtttaggccgtgctttgagtgaaagtgtgactggttctgatgtacaaactggtggctcaaccatcacgatgcaggtcgcaaagaactattatttgagtccagaaagaacattaaaacgcaaactaacagaaatctttttggctcgaaaaattgagcaaaacttatctaaagaagacatcttaagcctctatgtaaataagattttcttaggtaaaaatgcttacggtatcgcagcggctgcaaagatttactacaacaaaagcattaatgagctcagcattgcccaaatggccatgattgccggcttgcctaaagcaccatctaaatataatccagttgttaaccctgagcgtgcacttgaacgtcgcaactggattttaggccgaatgcttcaacttggttatatctctcaaacggaatatcaaaaagccgttgcagaaccaatcaatttgaatatgcccaaccgtgacttaaataatattcacccctacgcaggtgaaatggtccgctcagagcttgtaaaacattttggtgaacaagcaattgattctggttataaagtctatacaacaattaatgcgaaacgccaagcgattgcggaaaaagctgtgcaagacggtcttgaagcttatgaccgtcgtcatggctggcgtggtgcagaagcacatgataagccattaagcgaatttagagcatatgccaacacttatccggcgcaagtcaccaaggtaaatagcagctcttttgaagcattaatgcaagatggctcaacagtaaccgtgcaatggtccggcatgtcatgggcccgtccctatcgcaatgcaaataacgtaggtgcagcgccttctcgcgcatcccaaattgttaaagttaaagatattgttcgcttacgcccaaatgaagctaaaactgcgtggtcactagttcaagtaccaaaagttcaaggtcagctcattgcaattaacccaaacgatggctcaattgaagcaattgtaggtggttataatttctatcaatcaaaatttaaccgtgctttacaaggctggcgtcagccaggttctaccatcaaaccattcctctatgctttagcattagaacgtggcatgacaccttatagtatggtgaatgatagccctattacgattggtaagtggacaccgaagaactctgatggtcgctacctaggcatgatcccgttacgccgtgctttgtatttgtctcgtaatacggtttcagtaagactcttacaaactgtaggaattgaacgtactcgccaattattcatggattttggtttacaagaggatcaaattccacgtaactacaccattgctttaggcacgcctcaagtattaccaattcaaatggcaactggttatgcaacattcgcaaacggtggttaccgtgttcaaccgcattttattcagcgtattgaagatgcatacggtaaagtcatttacgaagccaagccagaatatgcatgtattccatgtattaatgctcctgagacaactgacgatgcacaggtaactactccagatgatcaagttgttgaagtcacaaataaagagctagagcagaaagaaaaggcaaccaaacaactcaatcttaaacagactgacaaaaataacagtcaatatcgtcaagctcagcgtattttaaaatcaagctctgcttatgacatggcaaatatcttacgtgacgtaattgagcatggtacaggtcgtgctgcacttaaaattggccgtagtgatttaggaggtaaaacaggtacgactaacgatgcaaaagatgcatggtttgcaggttttaatggcaagttagtaactgtaacatgggttggttttgaccagccgactacacttggtcgccgtgagtatggtggtattgctgcactaccaatctggattaactttatgggtcaagcattgcaaggtacaccagctgcttgggttcgtttagaaaaagatgctcaggcacctatttctcgcgataagcaagaagtcacaactgaagtaggcgataagaaaacatatcgtgctgcccctccattagcacgtccactctatcgtcctgcaccaccacaacctaaaaccaccaataatgacttcgatgacttacctggtgaggaaattgtgattccttccaagacaacccctccagcgatgaaaccttcgcaaggggcagcgccgaagcgtgaaaaagatgaattagaaaacttgattaatcaaattgagtaa

SEQ ID NO: 2091 - DNA, 513 bp, Acinetobacter baumannii
aatgcacttatggcttatgacatggttagctccacaaatttggataaaaatataatcggagtccatttaatgatccattcaaagattattggtattggcgtaatcacaggattgtgtagtatggctgctttggctgaaccagcagtccagccaggtgatactttagaaagcttatctaaagtaaaagtgactacaaccgttaacggccaaccaggttctattagcgatttggtcaatagcggacaagtacagcaagtttctgctgcaccaacaagcgcagcgcctaccggtgctcctattccggcagatgttccaccagcacctccagcgggcggtgaaatggctcctccagctgcaccaactgatgcagtgccacctgcaccgaatcaagcggctccagcgccacaagatccgaacactccaccgccagctgctaacccgaaccaatcagcagacccaatggcaaaagatggggcgttaccagcagatgcacctatgccacaagctcaataa

SEQ ID NO: 2092 - DNA, 693 bp, Acinetobacter baumannii
atgcgatctatcattgaattctggtcgagctttcgattgttgccttctgcatggctgctgttggtgcaattcattttacttattctggctatgctgacttttgataatgaggcttacaggaccttaacttgggcgctaggggtacttgcattactcattattgctaaagttattcgccaaacacccatgttcacttttctcggtctcgcatttgtcagtggggcaattatagcttcggtctttattttattaggctatagcaatttaactatccagatttttgcccatagctgtgaagccttagcttacttttcggctgcttatggtttatttcgctatatgtttgccgaccgatatttaacccgcgatgagttgtttgcagctgccgcagtttttaccttgttggcttggggatttgcatttttatataacatttgccagctactcattcctaatagctttcaaaatccaaaccacatccatcacttacaaacttggttagatttactgtttttaagctttagtttgcagtccgctacgggactgtctgacttaatgccccttagtccaccagcacgtgttttagcgatgttacagatgttttgtggtgtgatgtatttggccctaatagttacgcgtttaatcgctttacaatatatcaagcacacgcctaaaaagaattctgataaataa

SEQ ID NO: 2093 - DNA, 387 bp, Acinetobacter baumannii
tcaatgcctattaccgtacatgcttatagttctctagataattcagagatccgcgatcagcttgagcgactgtatgacacaagtccggagtttggtgacgggcacgatgcgattgaacaacttgaacaagatttacaacagtataccacgctatacactgccgaatttaataccaaaattataggtgcaatctggtgttcaggacaaggtgaaagcaaggtgcttgaatatatagttgtacatcctgcaaatcgtggacgtggagtagcagagcgtctggttgaagaagcttgtcgtatagaagaagcaaaaggcgttaaaatttttgagccaggttgtggtgcaattcatcgctgcttagctcatattggtaaattgcatagctaa

SEQ ID NO: 2094 - DNA, 606 bp, Acinetobacter baumannii
tctgtgcctatagagttcattgcaacatcaaaactcccgaccgcttttggtgaattcaatatttctgtgtttcaagatcccgtaacaggtgaagaacatgtggcactttctaaagggttagaaaatccgccaacaggtcctgttttagtccgtgtacattctgaatgtttaacaggtgatgcttttgcatcattaaaatgtgattgtggcccacaactacaagccactcaaaaactcatcaatgaagcaggacaaggtgtaattttatacttacgccaagaaggacgcggtattggtttaaccaataaaattcgtgcttatgccctgcaagatcaggggcacgatacagtagatgccaatttactactgaatttacccgccgatgcacgtcgttacgatatgtgcagtattatgctcgaccacttaaaagtgaaagaagttaaattaattaccaataatcctttgaaaattcaggcactcaaagatcaaggtattaatgtcgtagaccgtgtacctttaactgtcggccgtaacccttttaatgaacaatatttaaaaaccaaacgtgaaagaatggatcacctttaccaaaaagatgatttttga

SEQ ID NO: 2095 - DNA, 1638 bp, Acinetobacter baumannii
cctgtcactatgcaagtattttttctgttcctcgctgcaattttgttgggttttgcgtggttatcaccatttcactataacccttgggtaatgttttctagtgaaatgagtacttttgcggcaggtttaagtgtcttagctgtacttttttaccaaaatattaaaattccgcgtgcacaattattgctattgccatttactttaattccagtggtgcagtgggcttttggtctagtttttgattttagtacagctttgttaagttcactttacttattaggcttctggtttatggtcttggctggctataacctatctttagatcaaaaaaagagagatcaaattttttcaggttttagcttattaataattattacatcgctattcaccagtcttatagcaattttccagtggttaaatattgagtcacatttaatttatacacttcatctaattggtaatcgtccttacggaaattttggtcaacccaacaacatggcaacattcttaattattgggttgttaggatgtttgtatttatatgaaaagcataaagtaacactatggttattattgccttccgccctgattattctatttactattgcattgagccagtctcgaacgtcatggatcgtttttccatttttactcatctattggatggttaaacaatttggaaaacaaaaaaggtttagatttgttcaaggtttattatggtgcttagctttttttctaattgctggcctaatcttaccttatataactcaatttattgaattctctacaaatacagaaattactgaaacaagttcgtttgtcgcgcgtgcggggtcggggcatgagcgtatagggatgtggatacaaatattacatgctatagctcagcagccatggttaggatatggatggagtcaaaccagcgttgctgtagttgatagtatccaatatgggacagtgcatgtatggtttaatagtgctcataatgtgctactggatatcatcatctggaacggtattccaataggtatagtcattattgcttactttgcatgttggttcgtttggctaaatcagcaggctaaagaaactatctcaattattgcaattatgatggtgtgtaccgtactcattcatgccatgttagagtttcctcaacgctacgcttacttcttacttacttgtggtttcttattaggcataattcaggcacagacacctgtactcaaaggcattgtactcaacaagcaggttcttcgattaatttggggaataagtgtaatacttctggtagcaatttggcgtgactataatgtctatgtcacaaatagtaatttgctgtttaagaataaacagccaaatgctgagattttaggaagtaatcagatttttattttaacgcagtttgagcagcgtctaaaatggattgagatgaagcctgaaactactttatctgatgctgatttagcagtatggggtaattttgtgaagaataaagcgacgccttataacttgcgtaaatatgcccagctacttgcctataatggaaaagtagaacaggccgagcagcaaatatttattttgcagcatctttatcgacagcaaataactttggcagagttgttaaaaaataaataa

SEQ ID NO: 2096 - DNA, 657 bp, Acinetobacter baumannii
atgatgtatatgtctttgaagtggtctagtcttttaatgaaacatttgggtgtggcagccatcttgtgtatggggttaagtgcctgcgatgtaaatcatgccaactctaaagatcactccgcggtagcaacgacttctagacatgaagatagtttgattaaaagcaccacaaaggttaaaactttagatgatgcagcggggcgaactttcttgcctgagggcgtcccagatcaaacctcaaaactatccgaagcagaccaacaatatgcaggccgttatcatactcgtatttcatgtgaagataattttgccgattgtgaaacaggcgaggcagaatatattttaaatttattacctgatggaactgcgtattggaatgttgttcattttggtcgtgttggtagtaaagatggctcaaaaagcgcagtcatcaatcaattatgtccttccttgaaatggaaggtcgaacctgccgctcatgagttaacgattcaatgtcctttatcagatgttaacttctattttgatattgatgcaaaacaaagattagtcgtaaatttagaaaaattattttatagcgattttggtaaaaaccgtgagtttttggaacaaaattattttgttcctacaaaagcttatgtacttgataaagagtaa

SEQ ID NO: 2097 - DNA, 510 bp, Acinetobacter baumannii
cgcgatcatatcgcgcttccaaagaaacacactttaaaaaagacatacatccactacaaagagctaggaacctgccttatgaacagtcaaaaacttctcttttctaccctgtgctgcttagcattaactgcatgtgcaactaccgcacctctttcttcttatcctcaggcacaagttttagaacaagataccaatatcgaagcttatccaaccactacaggcaatgtagccaaactcattaaacacgataagcaagcttgtatgattgaatttacgggttatttaggtggtggacaagtaactgaacattggatttttaataataaaggtctgatttcagctcaatcatttacagaacaatatccagactcttctggcatattaagtcaagcgaccaattcgacaaccaaaagctctaccacttttaatatccaagatcccgaaattcaaaataatttcaaaaaacttcaaagtaattttagtaaagacaacttagcaaagtgtgattaa

SEQ ID NO: 2098 - DNA, 621 bp, Acinetobacter baumannii
aaggtaaatatatctttctggaaaatcatgaaaaaaattaaactttatactattgctttaggggtagctgttgctacgcaacttactggttgtctttcagtcaaatcttatgttgatcctgcttataaatctgttacctattcggatattaaaagaccagttcaacctattccagtggttttaactactgagttccagcgaaatggaacagttattccaaaagcaagtaaagaactacaatcagcagttgaacgtagtttaagagcaacaggtatattttctccaacagctcagccgaacggtgggacgcaggcaaaattatatgtaactgcaaataatgtggcggatttaggagaagctgcgggtaaaggagttttaactggcctgacttttggcgctgttggtaatgcaattgctgataaatatgaatttaaatttaactacgttgatgttcagggtaaacaaatatctcagcgttatccgcatatgattttaacaacggttggaaacaaaaaggcgcctattgaaaatgtgcaaccaatgtcgatcaacgaagcatttaataaagttgttgatgacgttgtgatccgtttttcttctgacttacaaaaacagcaataa

SEQ ID NO: 2099 - DNA, 897 bp, Acinetobacter baumannii
gtgttgaatatgaatatcgcaggtatgacggcagaaaaatcatatttaaatcgtcgaaaagcgttgggtattactgtgcgtcgccttgagtttaatcctcaagctatcaaacgctattattttgcaaattcacctttaatgtcccattttttaactgcactctcttcaacatttcccgtaggagaacagttttttgtaaatagcgtgcgtaatgtacgtgacaaagtttccgaccctcaattacaggctcagattgcggcatttattgggcaagaagcaatgcattcgaaagcacatggagagttcaatgaggcttggcgtcgtgatgactataatctggatcgctttcagaactggttgaatgagcgtgacaagtatttaagaacaatttctcctaagctgcagctagcactgacatgtgcatttgagcattttacggctttgctggggggatatattttacagcatccagaacttctaaaaactttggatcaagatgcgctaaagctttgggtttggcatgctatagaagaaattgagcatcgttcagttgcattcgatgtctatcaacaggtatatggcgatgaccgtattcgtcgtttactcatgcggagtgttactacagggtttgcaagtcttgctttttatggcactacacggctattttggcaagataaatggaagagcttgcctaaaatcggaggtaacttatttgggctatatttgcttgctaaaatgcttatacagctaactcctgaatattttgcttattacaaaaaagacttccacccgagtcaaaaagattatggccatatggtcgattattggaaaagctatttggccgatgaatatcaaatgacaagtttccaagaggaaaaaaattcaagaccaagctaa

SEQ ID NO: 2100 - DNA, 417 bp, Acinetobacter baumannii
aaaatgaatattgaattagaccctattgatctaaaaattattgcattgcttaagcaagattctcgcttaacaaataaagaaattgggcagcgtgttcatcggacaggacaggcagtaggagcgcgaattgctcagttaatggatgcaggcgttattaaaaattacaccattgctgtgcaatacaggcataaacaatttattcatttgcatttaaatgaacagcgctcctttgaagaaattgaaaatttagtgaagcaatatgaacaaatcgatgagtgctttaaagttatgggtaatgcttgttatatgatcgttagtcatttcgaaccagcagaactcaatgcttttattgaagtcctctcaaaatggtgtcgttactcagttgaaactgtcattcgagaagtagagaaagcttaa

SEQ ID NO: 2101 - DNA, 762 bp, Acinetobacter baumannii
gggtttgatatgggtcagaaggttcatccaatcggtatccgcctaggtgttgtgaaacgtcataacgctaactggtatgcgaatccgaaacaatacgctgaatacttgcttaaagatcttcaagttcgtgagtttttaactaaaaaacttaagaatgcgatggttagcaatattcttatcgaacgtccatcaggtgctgctaaagtaacaattagcacagctcgtcctggtatcgtaatcggtaaaaaaggcgaagacattgaaaaattacagcgcgaacttaccaacatcatgggtgttccagcgcaagtaagcatcaacgaaattgatcgcccagacttggacgcgcgtttagttgctgaagcaatcgcttctcaattagaaaaacgtgtaatgttccgtcgtgctatgaagcgtgcggttcaaaacactatgcgtgctggtgctaaaggtatcaaagttgaagtttctggccgtttaggtggtgcagagatcgctcgtacagaatggtatcgtgaaggtcgtgtacctttgcacactcttcgtgcggacatcgactatgcaactatgcgtgctgaaactacttacggtacgattggtgttaaagtttggattttccgtggtgagattttaggtggcatgaaacaagtcatgaaccctgctcctgctgaagaacgtccagctaaacgcggtcgtggtcgtggtgaaggtcaagagcgtcgtggtcgtcgcggtgaccgtgctgctgacaagggagaataa

SEQ ID NO: 2102 - DNA, 198 bp, Acinetobacter baumannii
atctcattcatacgcaacttccttgatcttgtgcatcccatctcgagactgtggctattattttactggatcttatttgtttgccttttcagtatgatgactctttcaaagcctagacaatgcgactttggtcatatattaatcacttactcaagcatacgaaattgtgaacatttttataaaattaagttgatttaa

SEQ ID NO: 2103 - DNA, 870 bp, Acinetobacter baumannii
ggtacttccatgcaaaatcttccaattattgctgtgctctatatgattttgtcgatggtttcgtatcaaatcagcgcttcatttgccaagcaacttattgcggctttagatccgcttaccgttactattttaagattatgttttgcagcagtgattgttgccgttatgttccgttcttggaaaatctggtctcgcttaccttatttaaaatggcgtgatttattaatgtactgcgcatcattagggttaatgaatatcttattttatacctctcttggaaaattgccccaagggattgcggtaggtctagaatttattggtccattaggcctagccctagtttctatcaaacaaaagagcgattatatctgggtagcttttgccatgctgggtattgcactcatggtaccttggcaagatccaactcaacaccacttttcttacgtaggtgcagcctgtgctttaggcgcagggctttgttgggcattctatatttattttggccaaaaagttgtaactcaaaatataggaatgcatgccttaaccatagggattaccgtatctgccctctccttattaccaattggtatttggtataatggcccagcattacttgatacacagtactggggcaaagccttacttattgcagttttagcgactgctattccctatgcacttgacctaatggcactcaaacaacttaataaattaacttatggcaccctaacaagtttagcgccagcattggcagcattaacaggtttcttattacttcacgaagaaatcagcatgctgcaatgggtggctttagcttgcgtaatgctagcgtcaattggggttactttaagaagtaaaacagcatcatag

SEQ ID NO: 2104 - DNA, 198 bp, Acinetobacter baumannii
agcattgtcttggcatgcaaacttcgaagaaacaggccaaatgcttcagccaacaccagttgcaaaatcagcttaagtcatacttttaatttaagcactcctacgggggtgcttttttatttgtgtaaattattcacaaactactgctcaagttcgaatttttattttatcttttcaatacatcaaaacaaaaagtag

SEQ ID NO: 2105 - DNA, 774 bp, Acinetobacter baumannii
ggtctagccatgactccacaacaaattgaactcgttaaatctactgtacctgtattgcgtgaacatggtgttactctaactacatacttctataagcgtatgttgaataacaacccagaattaaaaaatgtttttaatcttgatgatcagaccagcctgcgccaacctcgtgctcttgcagcagctgtactcgcgtatgctgaaaatattgagaatcctacggtgcttgccaaagcggttgaacgtattaccactaaacacgtgagcttagatattcaaccagatcaatatgcaattgtgggcgacaacttgcttcattcaattagtgaagttttaaatgttccatttgaatcagaactcattgaagcgtggaaacaagcttatttacagttggcagatatcttaattggtgttgaaaaacaaaaatatgaacaacttgaaagcttgaaaggtggatgggctggctggcgttcatttgaaattacgcaaattgacccacttgagtctggcaaacgctttactttaaaggcaactgatcatgaagatgtactcaccagcccagcaaatgcttttatctctgtaaaagttcaagtacctaaccaacagcttgaacaaccaaaagcatttaagttcacagaggctcaagaggacaatacttatcattttgatgttcaaccagaagaagaccatacagagttctctgtttcaaacattttgcttgagcactatagagttggtgatcaagtacaagtttcagctcctttaacgctgtaa

SEQ ID NO: 2106 - DNA, 561 bp, Acinetobacter baumannii
gcgatctacatgaaaaatttagaagcttcatttagagcattgcgagtgctccacacggcaaaagatttatttaaccaatacgggtttcataaggtaggggtagaccgaattattgccgactcccaaattcccaaagccaccttttacaactacttccactcaaaagaaagactcattcagatgagcttaacttttcaaacagacgctttaaaagaagaggtattttctacgatctattcgtaccgtgaactgatggtgttcgataaactcaagaaaattttctttttacatgctgactcagacgggctttatcgtttgccttttaaggcaatttttgaaatagaaaagcattatccgttggcttataaggtagttattgattatcgaaactggcttattcaggaaattcataaactccttttaactgtaaaacctgccgctacagttgaagatgcgcatatgtttttgtttgtggtcgatggcgcgatggtgcagcttttaagctcaaatcaaactgatgaaagggaatatctgattgattattttctaagtcgagtttga

SEQ ID NO: 2107 - DNA, 189 bp, Acinetobacter baumannii
atcttatacataaacattttgcaacttattgaaaaagaaaattgtttgataaatccgtacgatggaaatcataacttcaagtcattagtgttttcatcgtataatacgcgcgattattttgtcgcgtcttgcgatgtattggtttttcaattgaggagtcctgcgtggcccaatatatttatacgatga

SEQ ID NO: 2108 - DNA, 984 bp, Acinetobacter baumannii
ggaggtgacatgcaagattttctagcattaaccttacaaggtgagcaacctgcaacgcgtgagggaaaacaagcaaatttttcttggcgttggttaggtgagggacttcttgaatgtacaccacatgcgcagtacgacaaagctgtcgtactgtcagctggagtacatggaaatgaaacggcaccaattgaattgctatctcatctttgcaccgatttatttgccgggcgtttaaagcttgcggtgagattattgcttgtattgggtaatccctatgcgatgcgtcaaggcaagcgttatgtacatgacgatgtaaaccgtatgttctgtggtgggtataaaaatctgcctgtaactgaagaatctaagcgtgctgaggttttagagcagactgttgccactttctttcaggaaagttcgagtcaggcaaaacgttatcattatgatttgcacacagcaattcgggcttcattattaccaacatttgctttatttccatatcaaacgcatagctatgatgctgatctaacggcaagtcttgaagcagctgatttggatgctttggtttatcataatgcggtaggtaaaacgtttacccattttacgagtgagaattttaaggcggcgagtgcaactttagagttaggcaaagcattgccatttggtcaaaatgacttgagtcaatttgcttcaattgatgaagtcattcgtaacgtggtttctgagcaagctttaccagtgcgtaataaaccaaaaattcgtgtgtttcaggtatctgactctttaataaaaagagatgaagagttccacatgaatttatctgctgaggctccaaacttttcaacttttactaaaggcgaaatcattgcgactcagccttctggtaactatgtagttgaacaagatcaggtctggattttattcccaaacccgaatgtgaagatcggtttacgtgcaggcttggttttaactgaaacaatctga

SEQ ID NO: 2109 - DNA, 351 bp, Acinetobacter baumannii
gatcagcgcatgtgggcgttatttttaaagtgtatgttgggggctggggttgtcctcataatttcgattttatcgaaaagtaaggcattttatattgcaggtttagtcccgctttttcctaccttcgctttaattgctcatgtgattgtctatcagcaaaaaggagccgaagcattacagaaaacggctttatttggtctatggtcactgattccttatgccatttatttagctgctgtttatgtgctggcaacgcgtatgtcgatgtggtcttgtttaggagtcgcaacgctatgctgggttgtggctgcggcaggtttgatttacggctggcaattgtttcaaagttaa

SEQ ID NO: 2110 - DNA, 609 bp, Acinetobacter baumannii
gtcataggcatttatgctagccagagaaccgacatgcaagaatttctgatttctacctcgattgttgccctcgctgaaatgggcgataaaactcaattgttggcacttttattatctgctcgttttcgtaagccaatccctattttaatcgcgattcttttagcaactttaattaaccatggtatttctgctgtgcttgggcagtggattacaacagttttaagccctgaaatcttagtctgggtacttgcagttggtttcattggtatggcgttctggatgcttattccagatgagcttgatgatgaaacagcgagtattaataaatggcaaaagtttggcgtttttggcgcaacctttattttatttttcttggcggaaattggcgataagacccaaattgcaacagtcgctttagctgcacgttatgacagcattttctgggtaatgttaggcacaactttaggaatgatgattgccaacgcacctgctgtatttattggcaataagttggctgaacgtttgtctattgcgctcattcataaaattggcgccgctattttcttcattgtaggtgtttctacgctcgtacagcattatttcttctaa

SEQ ID NO: 2111 - DNA, 780 bp, Acinetobacter baumannii
aacatgggcatggaatgggatgttatccttagtttgatcttttttgcgtttactgcgggagcaattgatgctgctgttggtggcggcggactcatccagattcccgggatcatgagcacttttcctaacatgtcgactgctacggtgattggtaccaataaagtctcatccatttttggtacggcatcggcagcttatacatttgctaaaaaagtaaagttgcaatggaagcttttagccgttattgccatttgtgccttgattagttctttcgctggtgcggcttgtttgtcgcttatccctcaatcggtattgcgtccttttgttttcgtgatgttgattgtgattgcgatttataccctagttaaaaagaacttcggacaagtccataccgagcaaaaaattactacgaaaatgctcgttttagctggtatcggtagtctggcgattggcttttatgacggtattttcgggccgggtactggtagtttctttatctttttcttcattcgttttttacaagtcgattttttacatgcttcggcgttgtcaaaaatcggtaattttatgactaacttagctgcgctgagtttcctcatcccaactgggcacgctattttacatattggtttaatgatggcagcggctaatgtgctaggttctattgttggggtgcgtaccgcgcttaaatatggtagtggttttgtacgtattatctttttaattttggtgagtatcctgatttgccgtttgggatatcaaatgtttgttacaggttaa

SEQ ID NO: 2112 - DNA, 213 bp, Acinetobacter baumannii
gacgttttaatgtatcgatataatcagctaaatgttctaagtatggcgctacacggtcaatttgagccaagtaagtttgccatgcatcgctatgttcgtttacgtatgaaagatctgacatcttttttcctatctacctacacagactcagatgtgataaatctgcagtctttattattcagcaaccaaaaccttgcaataacaatgttttga

SEQ ID NO: 2113 - DNA, 834 bp, Acinetobacter baumannii
aaatatctaatatttaaagtttttttggggaattttatggggtttgaaaaaacaacatcacagatattatttgataatggcgtacacaaatgtattagttttaccagtttggtcaaaggggaaggcatacaagccaatcaatttttaattattgatcatgagcgtgctgccgtgatcgacccaggtggtgatttgacctatgttccgttgacaatggaacttaataaatatacgcgccttaaaaatcttgattatgtgatggcttcgcatcaggatccagatattatcacctcaatgccccgctggttagtctataccgatgctaaagtggtggcctcaaaattatgggcacgttttttacctcacttaaattcatcatttatgagtgagcgtatgaaagggaattgggaagaccgtctgattgagctgcctgatcgtggtcaagtgattcaattaggtgaatcgaaacttgtaatcattccagcgcattttctacattcggtgggtaattttcagttttatgatcccgttgctaaaattttattttcgggcgatatgggagcatctattgtagatgatgcaagtcagcctctaaaagattttgatagccatgtgatgaaaatgaaagcttttcatcaacgttatatgtgttcaaataaagttattcgcttatgggtcaacatgattcgtcagatggatattgaaatgattgtccctcagcacggtagtccatttattggtaaagagatgattaatcagtttttagactggattgaaacattgccatgcggtgtagatttaatgacagaacaaatttttagctgtccaacataa

SEQ ID NO: 2114 - DNA, 591 bp, Acinetobacter baumannii
agacagctaatgcgtggtgtaaataaggttattttggttggtactttgggtcgtgatcctgaaacaaaaacttttccaaatgggggctcgttgacccagttttctatcgcaacaagtgaagtttggaccgataaaaatacaggtgaacgtaaagaacaaacagaatggcaccgtattgttttgcataaccgtttaggggaaattgctcagcagtttttacgtaaaggttctaaagtttatatcgaaggttcattacgtacacgtcagtggacagaccaaaatggtcaagaacgttacactacagaaatccgtggcgaccagatgcaaatgttagatgctcgtcaacaaggtgaacaaggttttgctggcggtaatgattttaaccaaccacgttttaacgcgcctcaacaaggtggcggctatcaaaataacaaccaaggtggtggctacggccaaaacaatggtggttatggtggccaagttggtttcggtaatggtggcaatagcccgcaaggtggtggtttcgctcctaaagcgccacaacaaccagcatctgcaccagctgatttagacgacgacttaccgttctaa

SEQ ID NO: 2115 - DNA, 1143 bp, Acinetobacter baumannii
ataaaaataatgaaattgggagagagcaccatgacgcaattacaacaatcaattaaatttgcttattgggtaccaaatgtaagcggtggccttgtcgtaagtaacatcgaacagcatacagactggagttatgactacaatgttcgacttgcacaggctgccgaaaacaatggttttgaatatgcgctcacccagattcgttttacggcagggtatggggcagaaaaccagcatgaatctgtgagtttcagtcatgcattacttgcaaaaactgagaaacttaaagtgattgcggctattctgcccggcccttggaaaccggcacttgcagctaaacaactcgcaacgattgattatctaaccgaaggccgtattgccattaatgtggtgagtggttggttcagaggtgagtttgatgctattggcgaagaatggcctgagcatgatgaacgttatgtccgctctgaagaatttattcgcacgttaaaaggaatctggactaccgataactatagtttcgatggtaagtattaccaatttcagaactacactcttaaaccaaaacctctgcaaaaaccacatattgaagtctttcaaggtggtagttcacgtgccgcacgtgacatggcctctcgtgtgtctgactggtattttaccaacggtaatactgtcgaagaaattcaaaaacaggtcgaagatatccgagccaaagcaaaagccaataaccatcaagttaaaattggggtgaacgctttcattattgctcgagataccgaagaagaagctaaagcagtacttcaagaaattattgataaagccaacactgaagcagtcaacgcgtttggcgatgcaactcgtgaagcgggtgcggcctcaccagaacaagaaggcaactgggcaaaatcaacttttgaagatttagttcaatataacgatggctttaaaaccaatttaattggtacacctcagcaaattgcagagcgtattgtggcgcttaaaaatgtaggtgtcgacttggttctttcaggtttcttacactttattgaagaggtggaatactttggtgaaaaagttctgccgctcgttcgtcagttagaactacaacaggaaaaggaggtagaaattcaagctaaatcagcctaa

SEQ ID NO: 2116 - DNA, 2202 bp, Acinetobacter baumannii
atggttgtttttatgccggctttagaactgaaaaatagatttcacgtaaacgacctcctttcgggagtggtcgtatttctcgtggctttacccttatgtttgggtattgccttagcctcaggtgctccaattatttctggcattattgctggaatagtgggtggaattattgttggcctgctgagtggctctcatatcagcgtttctggcccagcagcagggttgactgcggtcatccttgtacaactcgatcaattaggcggcaattatgccgcctttttattgtgtattgtatttgcaggaattttacaaattctgtttggtgtatttaagttgggtttctttgctaactttattccaaacaatgtcattttaggattattggcagccattggtgccattctgattgtgacacagttaccttatttatttgggttgactgatttttcatggaaagaagtttggactgctacaccggatacgtttatccaaaaatttgatgctggagcagcattgattggactattgagcttatttttaattttagcttgggacagtagcccacttaaaaagttagcgttgccttctgccttaattgccgtggtactcgcagcagtttttaactttgttttaataagtatcggttcttcatgggctgtgcaaagtaataatttgattcaactaccaaatatattgcaagcaccagaagaggtattggtttttcctgactttagctatttagctgaaccattaatttataccggagccattacacttgcgatcgtggcatctttagaaacattactaaatttagaagcggccgataagcttgatcctcaaaagcgttcatctccacctaatcgtgagttatgggcgcaaggtgcaggtaatattgtgtcgggtttaattggcggaatgccagtgacctcagtgattgtccgtagttctgtaaatgccaatacaggtgcacgtagtaaatgctcaaccattattcacggtgtgttgttactgcttgccattctattttttgtcccactcatgaacatgattcctttgtctgcacttgcagcaattttgatcgtgactggttttaaactgactcatccaaagttattcaagcagctttaccaaaaaggttggagacagtttttaccattcattattaccttggttgcaatcttgctgacagatttattaaccggaatcttggtggggctatttaccagtagcgcatttattttatatggcaacttcaataaaggtgttcgtgtttataaagaaaagcatttacatggaatcgtgacgcgtattgagcttccttcacaagtgacttttctgaatcgttccgcactcatttctgccttggaacatattcataaagatcaacagttgattattgatgccactcaatgtgattcgattgatccggatatttatcaagtcattcaagactatcaaaatgagacggcagttaaacgccaagtcgaccttaagcttattggatttaaacagcactatgaagaggtagatgatgcagtactggatatctacattagtacgagagatttacaacgtaaattaagtccacagcaagtcattactttacttaaagaaggaaatgaacgtttcgtaaaaaatgagcgtttgcaacgtgatatttatcgtcaaattcgtgttaccgcagatgaaggccagcatccaattgctgccgttttgggatgtatggactcacgtgctccaactgaaatgatttttgacgtgggtattggtgatctatttagtttaaggattgcaggtaatattgcaggtcaaaaggtattaggctcgcttgagtttgcttgtcaggccaaaggctcaaaagtcattttagttttaggccatactgactgtggtgcagtgactagtgcatgtcagttacgcttacagcaaaagcaaatctctgatgtcaaagagatgccgcatattcaatatgtgcttggtccgctcatgcattcggtagaaagcgtatatgacattatgcaaccccgtgaattaaacaagaccttcgtaaatcaggtaactgctatgaatgttcactacaatatccaatatattattaataacagtacggtacttaaagacttactggatcgtggtgaaatagcgattgttggcgcgatttacgatgttaaaacagggcatgtcgagtttttagatgcgtaa

SEQ ID NO: 2117 - DNA, 195 bp, Acinetobacter baumannii
aacagttcaatgtttattgtaataatgcgtaaaagtaagcgaaaagagtcgcctttggcatggttgagtaaattcttatttcaacgtggtttgccatatctttttattgcacttgctttgtgcaatggaatttactttgcctatgctttattaactggccatttcgtagaccagtttcaagttctcgatcaataa

SEQ ID NO: 2118 - DNA, 1524 bp, Acinetobacter baumannii
ggatgtccaatgtctttaagtcgtattcgcctagcttctcttcatgacaaggtcatcagtgctgaacaagctgcgcaattcatcgaaaatggaatgaccgttggtatgagtggttttactcgtgctggcgaagctaaagctgttccacaagcacttgtagagcttgcaaaaaagaatccgttaaaaatcacgttaattacgggtgctagcttaggtaatgacttagacaaacaactcacggaagcaggtgttttatctcgtcgcatgccattccaagtggataacactttgcgccgcgccatcaacaacggcgaagtcatgtttattgaccaacacttgtcagaaactgttgagcaaatgcgtaaccagcaacttaaacgtccagatgttgcggtcattgaagcaattgcgattactgaagatggtggcattattccaacaacttctgttggtaactctgcaagttttgcgatttttgccgaaaaagtaattgttgaaatcaacacttctttaagcgaaagctttgaaggtttgcacgatatctatattccaacttaccgtccaacacgcacaccaattccattaacaaaagtggatgaacgtattggtacaacagctatccaaatcgatccttcgaaaattgttggtattgtatttaacgatacacatgactctccatcgacagtcactcctccagatgatgagactcaaggcattgccaatcaccttatcgcattctttgaaaaagaagtggctgaaggtcgtttaccgaaaaaccttggtccactccaagcagggatcggttcaattgcaaacgctgtactaacaggtttaaaagattctaattttgaagacctcatcatgtactcagaagtactacaagactgtacttttgaattaattgatgcaggcaaaatgaaatttgcttctggtagttcaattacgctttcagcaaaatgtggtgaaaaagtttttggtaatatcgaagcttacaaagacaaattagtgcttcgtccacaagaaatctctaatcaccctgagcttgtacgtcgtttaggtattatcggtattaatactgcacttgagtttgatatttacggtaacgtgaactcaactcacgtgtgtggtactaaaatgatgaacggtattggtggttcaggtgactttgctcgtaatgcacacttggcaatctttgtaaccaaatcaatcgctaaaggcggagatatttcttctatcgtgccaatggtgagccacgttgaccacagtgaacacgacgttgatattttagtgacagagcaaggtttagcagacttacgtggtttagcacctcgtgaacgcgctcgcgctattatcgacaactgcgtacacccgctttaccgtgatgcattaaatgactactttgatcgtgcatgtgctaaaggcggacatacacctcatttacttcgtgaagcattgtcttggcatgcaaacttcgaagaaacaggccaaatgcttcagccaacaccagttgcaaaatcagcttaa

SEQ ID NO: 2119 - DNA, 699 bp, Acinetobacter baumannii
gtaatcacaatgaataaatattttgctgaattcctaggtacgttttggctagtctttggtggttgtggtagcgcagttttagccgcagctttccctgaacttggtattggctttgcaggtgtagcccttgcctttggtttaaccgtactcacaggtgcttatgctctagggcatatctcaggtggacatttcaatcccgcggtaagtgttggcctttgggtcggtggccgcttcgatgttaaagatttaattccgtatattgttgcgcaagtggttggtgcgactgctgctgcatttgttctttatattattgctcaaggccaagcaggctttagtggtgttggcgggtttgcgaccaatggttttggtgacttatcaccaaataaatttggtttaggttctgctttcattattgaagtggttcttactgctttcttcttaatcattattttaggagcaactgaccgccgtgcacctgctggcttcgctcctatcgcgattggcttgggcttaacactcattcacttaatcagtattccggttacgaacacttcggtaaaccctgcacgtagtacaggtgttgcgttctttgctgaaacggctgctttaagtcagttgtggttgttctgggtagcaccgattttaggagctgtgattggggcaattatttataaagtggttgctggggataaggattaa

SEQ ID NO: 2120 - DNA, 402 bp, Acinetobacter baumannii
gtgaaaacaattacggtcgccgctgcggtgatcttaaatgaacaaaatgaattattgcttgtcagaaagcgtaatacacaagcttttatgcaggtaggcggtaaactggagccgaatgaggctccggaaagtgctatacagcgtgaaatcttggaagaaataggcagcccgtgtgtaatagaacagtttatagggcgttttgagacagcagctgccaatgaaccggatcacaagcttattagccatttatatttggttcgattaaaacaatccccacaaattgcagctgaaattgctgaaatgaagtgggtgaaatttaatgattccgagacaaaactcgcaccattaaccaaagaaattgtaattccgtggtgtgagcagaacttatctataactctataa

SEQ ID NO: 2121 - DNA, 315 bp, Acinetobacter baumannii
tctgttcaaatttaccattccaaaacgagaacttttatggcacgcgtcaccgttgaagattgtttagatcatgtagacaaccgttttgagcttgtgctcgttgcaagtaaacgtgctcgtcaattggcacgtcaaggcatggagccaactgtagaatgggataacgacaaaccaacagttgttgctttacgtgaaatcgctgtaggtcacgtaacgaaagaaattcttaaacaacgtgagcaagattaccaaacttctagtcttgatcttgccctttctacaaacagcttaaatttagaaggtttttctttctaa

SEQ ID NO: 2122 - DNA, 1302 bp, Acinetobacter baumannii
gggaatcaaatggatactcaacattctgcacttaacgcacgtaaacagcaagcaactccacgtggtgtaggcgtgatgtgtcagtggtatgcggaaaaagctgaaaatgccacgatttgggacaaggaaggcaaccaatttatcgatttcgctggtggtattgcggttttaaatacaggccatcgccaccctaaagtcattgcagcggtgactgaacaacttactaaatttactcacactgcttatcaagttacgccttatgaaagctatgtggctttagctgaacgtattaatgaacgcgcaccaattgctggtcctgcgaaggcagcttttttcacaacaggtgcagaagctgttgaaaatgcagtaaagattgctcgttgttacacaggtcgtcacggtattatcacgtttggtaacggtttccacggtcgttcattcatgaccatggcaatgacaggtaaaactgcgccttacaaacgtgatttcggtgtaatgccagcgggtgtgttccacgcacgttacccagtacctgcaaaaggtatttcagtagatgcggcaattgaaagcgttgaagatattttcagtgaagatattgcaccacatgacgtagcagcaattgtacttgagccagtacaaggcgaaggcggtttcaatgtggtgccagccgagttcttaaaacgtttacgcgcaatttgtgataagcacggtattttacttatcgctgatgaagttcaatctggttttgctcgtactggtaagttatttgcgatgaaccattatgaaactaaagcagacctcatcacgatggcgaaaagcttgggcggcggtttccctatttcgggtgttgtgggccgtgcagaagtgatggatgcaccaaacccgggtggtctaggcggtacttatgcaggtagcccgattgcagttgcagctgcgcatgccgtgattgacgcgattgaagaagaaaacctatgcgaccgtgcaaatgaattaggcgctgagttagttgctacgcttaaagatattcagcaagcaacaggtgacgtggtcactgatattcgtgcattgggttcaatggttgcagtagaacttgagactgctgaacaagcaaaagttgtacaaaactatgcaatggaaaacgggttgttacttcttacttgtggtaaatacggtaatgtaattcgtttcttatatccattaaccattcctgctgagcagttccgtcaaggtcttgatatcttgaaacaaggttttgcgacactaaaagcaggtagtgcaaaagcaatggagcaatctgcatga

SEQ ID NO: 2123 - DNA, 333 bp, Acinetobacter baumannii
gcctggcaaatcctaagctgggtcaaaatgggtcgatcatacaatcgaatgaagtcaccttcaatcagccacatttgcgaacgagatcatgcaaagcagtctctcatacagtatgggtatggttggcagattatcctgaataatctgactatttatcaactattatcgtcttctttatacaaaaaagaaaaccttagtgtgcaaaatgattatgacaattcgaccaatctcccagcattacgctatactttaaaccgttttcggttaaaagatgagttaatctgtgcctatagagttcattgcaacatcaaaactcccgaccgcttttggtga

SEQ ID NO: 2124 - DNA, 1701 bp, Acinetobacter baumannii
atgacaaaaatacaaattaaacaaagacctttattgacacgccctgaacagtttcagggcgtgcctccgtttattgccgaaattttggcaagacggggcgtacaatccgagcaagaactagagttaaagcttaagaatttactggctcctgaactcaaagggttggacgctgctgtagcattaatggatcaagccatcgatgagcagaaaaaaatagttattgtgggggactatgatgctgatggcgcaaccagcactgctttaatgatgctcgtgcttcgcgatatgggagcacaagtcgactatctggtaccggaccgttttaaatatggctatggacttactcctgccattgctgagcttgctcatcacacctatcaacccgatctattaattacggtagataatggaatttctagccatgctggtgttgatgcagcacatgccctaggcatgcaagtgattattactgatcatcatttaacgactaaagaaacaccacttgcagaagcagttgttaatccaaatcaattaggctgtgagtttccaagtaaagcattggcaggtgttggtgttgctttttatgtacttgccaatttggcgagcctacgcaatagacaaggtaaaagcacaagtaaagttacccaatatttagatttggtcgctttaggaacttatgctgatgttgctgtcctagattataacaaccgtattttggtcgatgcaggtgtaaaacgtattcagcaacatcagtgtcgagtgggaattttagccttactcgatatcgctggtcgggaagctacttcaatacgtgcccaagatttaggttttgtgctcggaccgcgcattaatgctgctggacgtatggagagtatgcgtattgggatcgagtgtttattagctgacacgatggaaactgcatatcccattgctcagcaattaaatcagttaaatatcgatcgccgtcaaattgaaggggagatgaagcaacaagctttatctgctttagacagtttacaactctcacaacaagatattcccgcggcgcttgttctgtttgaagaaaactggcaccaaggtgtcatcgggattgtcgcgggacgtttaaaagaacagtttcatcgcccaacgattgtgtttgctccagatgaagatggtattcatattaaaggctcagcacgttccattgatggggtgcatattcgagataccattgaacaagttgccgaacaacatcctgagctggtgagtcattttggtggacatgcggcagcggcaggcttaacgattcgtaaagaaaactttgaagcttttaaaaccgtatttaatgattgtgtagctgctatggatgaatcaatctttcaagcgacattatggaccgatggtgagctacctgtctctgctttgcaattagataccttaaactggattgagcaattaggtccgtggggacaaaaatttccactgcctcaatttgaaggacattttaaagttatcgattttcgttggctcaaagagacacatttaaagcttagattagcgatagaccaatatagtttcgatgctattgcttttaatgcggcaggtcgcttcgagtttgatccgatgcgtgaccatgtgcatttggtttatgaaatagaccgtaatgtctttaatggtaatgtgagcttacagctacgcattgtgcatttaaatcaataa

SEQ ID NO: 2125 - DNA, 312 bp, Acinetobacter baumannii
atgatgaaaattatagcttccctacttgtaatagtcggcttgatcgccgttgttctttatttcaaacccacaagcggtgcatctgatgtgttcaattctgctttacatgagacgaattcaccacaaccagatacttcatcttccctttctaaacttaaggagcctactcaacctaaaaacgtatctttaaattcaaaccactctcaatcggtatcagcagataccgttcctttttatgacacaaaaagtgatccttcgattcaaccgattgatccagaaaaagatccagcaaatgaaataaaagcgaaataa

SEQ ID NO: 2126 - DNA, 261 bp, Acinetobacter baumannii
ttaatcgaaataacttcatcaaacccaaataatgttagtttatttaatgcaggtggattaggatcagttcgccgaaccttctcagttaaaataacttcaactccattctcagcaggtttcgcaacacaacaaatactaggattaatttctcgttttaagcaagtaaaaatttcttctattggcataactaaattccataacgaagagcatcttgtactttgttcatttctcgaatttctttatcaaaactctgaattttaa

SEQ ID NO: 2127 - DNA, 1002 bp, Acinetobacter baumannii
atgaaaagaatagcaataattgcagtcgctacatatatggggttggcagtaagtgctgtgcaggcggcgactacatttttaaatgtttcttatgacccaactcgtgagttttatcaggaatataatcaggcatttggtaagttctggaaacaacgtaccgggcaggacgtggattttaaacaatcccatggaggctcaggtaaacaggcacgcgctgtagcaactggtcttgaggcagatgtggtgaccttagccttagccaatgatattgatgaaattgtaaaagcaggctttatccagccaaactggcaaaaagaattccctaataattctgcaccgtatacctctacagttgtgtttttagtaagaaaaggcaatccaaaaaatattcgtgattggaatgatttaaccaaacctggtgttgaaattattacacctaatccgaaaacgggtggagcaccgcgttggatttatctttctgcatggggatatgctttaaagcagccgggtggaaatgacgctaaagccaaagagctggttaaaaaactttatcacaacgttaaggtgttagattcgggagcgcgaggctcgcttactacatttgctgagcgtggaattggagatgttctactttcttgggagaacgaagcactattggcaacgaaaggtctcgataaagataaatatgaaattgtttacccatcaatttcaattttggcagaaccatctgttgccattgttgacaaaacagtcgacaaagacggtaaccgtactttggcaaaaggttatctcaactttttatactcacctttaggtcaagagttggctgctaaacactatttccgtcctcgtaatcctcaagttgctgctaaatatgcagcacaattcccaaaaattaaattatttacgatcaatgatgtttttggtggttgggcaaaagctcagaaaacccattttgccaatggagctatctttgatcagatttatgatgtaaagcagtag

SEQ ID NO: 2128 - DNA, 306 bp, Acinetobacter baumannii
aaatgcaccttaaataaggcgcattttttaatatggtatgaacattacaaagtagtaattgcaccaacggctggtgttccaccacctgtacatccttttggtaagaattcgtcagtagtggcaatatctgtactacaagtccatgcaccggtcgctgaacgtgaaagtgaaataatctttccagcgatttttggatttccttttaaagtacacgtaatagcgttagtagctgcgccatcgttaccaaaatttgtaacacctatggctgaacatgcgccagatgaagtcgcagtaaagccaacttga

SEQ ID NO: 2129 - DNA, 573 bp, Acinetobacter baumannii
aatcaaatgattaggataaacacaatgaattcaccttttgaaaatcagcccatttcacaagattcaccgtttaaggcaaatggtcgttttggacgactctcttatgcagcttggacattcttatttacgctagtccttgttaccgccattctacttattatgtttacttttggttttacaaaccctgaaggtgccccagacttttctacgcctggcttaatctgtatagcaattctttatatagtcggtatttatattaacttcgtatttaccatccgccgtttgcatgaccgcaataatacagggtggctctctttactgatgctagtaccgatcgtgaatattggccttgccatttatttattctgtgcaaaaggaactgaaggtccaaatgattatgggcctaagcgtccaacgccaagctgggagcgtgttttaggctggatttatattgtgcttattccgcttgcattaatttttggtgttattgccgtaattatggctccaacctatgaaggttatgtcgagaaaagcgaaagtattgtaattggtagcccatctcagtctgaataa

SEQ ID NO: 2130 - DNA, 450 bp, Acinetobacter baumannii
tttttggtgatcatgcaacttaataaatttaccgattatgctttgcgaatattaatgtatgtcgctcgtccaagtgatgcgccgtacacgattgcagaaatcgctcaagatttatatgtttcgcaaaatcatcttgtgaaggttgtccattttatgggtaaacaagagtggattattaccattcgcggcaaaggtggtggaattcgattaaatccaaaagctttagatttaaaacttggaacaattgtccgaattttacaaggtgaccaccaaattgttgaatgcaatacaccgccttgtgttttgcgctcccattgcggtttaaaaggtattcttgatcaagctttggaaagcttttatcaaagtttagatcaatatacgttaggtgaagttttacaacagccaaaatctgcttcagatcattcccctatcgcctttttacaactctag

SEQ ID NO: 2131 - DNA, 399 bp, Acinetobacter baumannii
agctatgccttttgttttttggtgatgaaaatgcaacgtttatttttaatttctgcactctgtgctggacttatgacgggttgtgcaaccacaagtaaattaattccttttgtgggctcagaaaccccaatgcaacaagtacttaaaacgcaacccgagattgtaaaagagcataacaatacttcagttcagcaggtatttaaccgagtagaatccccaactgtttctcgcattactgttatacaaaccggtttaatggatgactctgtctcagcaattcggacggaatatttatttaaattggttgatgaaaagtggcaattgcaaaataagcaaaagagctaccaatgtgcaagaggaaaaggttctagaggtttccaaacgcagctttgttcttaa

SEQ ID NO: 2132 - DNA, 1071 bp, Acinetobacter baumannii
gtcgaggcgatcatggctgaactcaatactcccttaacagttggtgattttgaaattaaaaatcgactggtaatggccccattaacacgtgcgcgtagtggcgaaagccgtgttccaaacgatttaatggtgcaatattatcagcaacgtgcaaatgctggtctcattctcactgaagcaacagtgattggttcaaaaaccgtaggttatgcagatactccgggactatggtcacaagagcaagcacaagcatggaataagattattgaagcagttcatgctcaaggttcaaaaattgtagttcaactgtggcatgtgggtcgtatttcacatccagagcttttagacggcgatattcctgttgcaccgagtgcgattcaacctgcgggtgaagtaagtttattacgccctaaacgtccatatgtaacgccacgtgcgctttcaattgaagaaattcaggaaattgttgctcaatataagcattcagctgaattggctaaagcagcaggttttgatggcgttgagctacatgcagcaaatggttatttaattgaccagttccttcaaagtaatactaaccagcgtgatgatgagtatggtggtccggttgaaaaccgcgctcgcttgttattagaagtagttgatgcctttattgaagtgtggggcgctggccgagtaggtgtgcatattgcaccgcgtggcgactcgcatgatatgggtgatgaaaacccgctagcgacatttggttatgtggttgaacaactcagccaacgtaatgtggctttcattttctctcgtgaatatgaagcagctgatagtattagcccacaattacgtaaaaaatttaatggtgtatggattgccaatgaaaatctgacaccagagtcagcaaaacgtatcttgcgtgaaggtcaggcagatgctgtatcttttggtaaagcatatatcgctaacccagatctattacagcgtttagaacaaggcttaccattaaatgaacttcaaccaacgactttatatgctaaaggcgctgaaggatatacagactatccggctttagaagcttcataa

SEQ ID NO: 2133 - DNA, 618 bp, Acinetobacter baumannii
ggacaacagatacatcggagcaaacaggcaaagctccagcagcatctgcctcaacgaacactactgttcagccgaaataggagagttatgatgaaaattaagcaaattactctttatgttttggcgtgtgctgtgcttgtcggttgtgattcaagaattgatgcagtaaatcaggaaatggccaatattcgtaatcagccgccactccctattgaaccagcaccgatttttactcctgtaccacaatttaattacgctgctcatcaattaaaaagcccatttatgccaagttctcttgctgccgagctcaagattatggcggggaaacgggtttatccgaatttctcacgtgcgccgcaaccactcgaaagttatgcacttgaagctttaaatatgaaagggagcatgcgtaataatcgagggcagatattggccctgatccagacaccagatcagcagattgaacgggtacaagtgggtaactatatgggtatgaatcagggccgtattacccatattagtccaacccagattgatctggttgaaatcgtacctgatggtcgagaaggctatgtcgaaaggccaagaaccttggtcttgattgggcctgcaccctaa

SEQ ID NO: 2134 - DNA, 210 bp, Acinetobacter baumannii
attttgaagatacctcatatatgtgccgttattttaaaaagcatactggttttaccttacttcaatatcgtaaaaacgcctaaaccctcacgtttaggcctccctaccttaaacctcactcagacaacgctaacaacttctgaacgtactcaatcgcattatttgctacgtcttgatgagtcggaacatcgtcatcttctgaagggttag

SEQ ID NO: 2135 - DNA, 294 bp, Acinetobacter baumannii
gagaatgagatgattgttgttaccttgacctataaaaaaccattagccgaagttgatgcagtactgaaacagcatattgcatttttagatgattattacgagcaaaagaaatttttagcgtcgggacgccgggaaaatagagtaggtggtgtaattttagttctaagctcttcgcttcaagaagctgaagaaattatgaaaaatgatccgttttatattcatgatgtggctgattatgattttatgtggtttgagccatcaaaaagtttagaagaaattaaaaaatttgtttaa

SEQ ID NO: 2136 - DNA, 1128 bp, Acinetobacter baumannii
aaaagcaggattgttaagctgcgcgtggacagtggtattgatagaaacatggcaagtaaaaaacgtagtaaaggtacaaattcattttctctaagtgagcattttggcaagattattcttgcttgtattgcagccggaagctttgcaattgctttcggcagtgaaaagatttcgcagtggttttcgcctttaagtactaactcgacttgtcttaaccagttttatcgtgaagttccgcctgcgttaaataaagaaagcttaaaaaaagacagctatccgctgtgctttaacggttttaatgtcctctattcaggcatttctaaaacaccattatggtcggccgagcatttagatgcagaacgtttaagtgtcaaaattaaacgtgaagataacttccatgaagaaacgcgtgttcctcaaaagcaccgggcacttttaagcgactaccgtggttcagggtatgaccgtgggcacatggcaccaaatggtgatatgccaaataaagaatcacagtctgatagtttctcgctcagcaacatggtgccgcaagcgcctaaaaataaccaagaagtctggcgtaaacttgaagaagcaacccgtgccattgtcaccaagcaaaaacaagatgtatatgtcgtgacaggacctgtttttgagggtaaacgtctcaaaacgattgggcagggtgtgattgtacctaccgcagtttataaagcggtgtatatgccaaaaactggcgctattggggcttactacgcacctaataataactcgcagcaagtgaaggtagtgagtgtttgttatatagaagaaaagcttggtattaacttatttccacagttaaccgagcagcaaaaacgtaacgtttatcgcttaccgttgactgctagccaagttaaacccaaccaaaagctcgactatttgcattgggatggtgaaagccagtgcgaacaagacctaagcgcagaacaaattcaagcgttacaagaccaatttaaaaagcaaaaaactggctcttctgaaccgatggaagcaaaagttccaagtattgatgaagaaactagaaatgccattgtgaaacaattggttgaagccttggtgaactatttcttgcaaataatgaaataa

SEQ ID NO: 2137 - DNA, 786 bp, Acinetobacter baumannii
acgcaaaggataactgccatgaatatttctgataacaccccacaagggcaactctcgtctcaacaattttatcgtcaatacagtgccaatgccttacttcctgagttagattggcaaagtatttttccgcatagcaagctgagcgaagcacatatcaaagcactcaatactatttatcagtgtgctgtacctctcgcacttaatgtatttcatgatctaaattttgatgtatttgcgcctgctgcctatcatccgcaaggcttaggtttatttgataaattagcccaacaagaagagaacttcttaaaagttcttactgctgaaagtgaaaaccttgaccatgagacacgccatcaaatctggagtatgcttctacgcggtggtgctgttctggttttcaaggcttggcttggtcatgtcaaactcggagaaaaccagttagatatgactcagttcgatgagctttctgacttgctgtttattaagacacctccacatcaacttgctgaacgtttgcatgtagatgaaaaagcaaaacttgaccatatcttcttaatgtatggcaatgatattttccttgaccggttcaatagcctagaaaccgcagctctctttgttgatttaggtgtttatgatgcggcgttcttaagcttgcgtgatgaccgcgtagctgaatatttaaaaagcaagggctatgtgacccaagaacaaattgatgatttgcaatgtgctcttaacccactgtactgcgatagcctaacacctaagcaagattgccttgcctaa

SEQ ID NO: 2138 - DNA, 219 bp, Acinetobacter baumannii
gtttattactttatttctaaaataaatttaaaaacaacaaggaacgacatgtctaatctaccatcaaatctttttcaatctttagtgatcatacttgcatgccttattatccttgtaagtaaaatgcctcagctaaaatttagaaaaaccatattatttttagctcttggcagtcttactttaatctgtgctttggcaatatttggcttctttaattaa

SEQ ID NO: 2139 - DNA, 1815 bp, Acinetobacter baumannii
tcgaactttgttgctgaacttctgttcagtaaagtgctaggatgcggattaattacttcattcaatagtagtgatcatggtaggacatttacggagtaccagctagaaatgtcaggattacgttcagaacatatcagtaatcgactgtttttcttcatgttggtcattattttgtccttactgtttatggcggttccgcttattgtcagcagttatcaagaatatttaaaaactaaacaagctttggttgaaattaaaagcttaagatcaattgctgaagttgcaaataaagtctctaaagaacgtgcgcccgcaaataaattaatgtcgagtaacgctgccgactttttaaaaaatcaaaaaaacttaaaggaatatcgcctttctgttgatcgccaacttaatgaaactattcatattttaaaagaagaaggttataccgatttagcaaatactttagatactaaatttagagatgatttaaaacaggctcgcgctgtagttgactattatgttgcaactcctgaacaagcgagaagctctatacaattcgataatgcaattttggctatgtttggagcttgggatagctgccgagaagttttacaaaatttgatgctacagttaaaaagtaaagatagccaaattaacaattattttactttgattgtggtgttgaccgatatgcgggatcaagctggtcgtaccgcatctaatgttattgcgcctgtgacttttaaagaaaccatacctaatgataatcgggcgcggtctttgcagactcagcagcaagcacgctacttatgggcacttgtagatacactacagtcagagcaagctaaaactccagaatatcatcgcctttactcaagggttaaaactgaatttttagataaaggcgtacctattgtgggtcagcttttagatgaaagccaaaagcaccaagcctatcatttaaacggaacagaactgacagaccagatcgttgataaatttaccacggttattgatttgcaaaagtttttacttaataaaagcgtcttgattgcatctcaagaaaactatttagcaaaaaagaagtttttccttactttactcatttcaagcatatccttagcagcagcgttacttacactaatttatgcaaagagaagggtgtttgagcctcttattcaggcccgtaccttaattcttgatttatctcatagcacagattacccaatagatgagttgaaacctaaaaaaggcgaatttatttcgttgttcgaagctattgatcgtttacaaaggatgctcaagcagcgagatgcttttgaattccagcttaaaaatattgctaatacagatccattaacgggtgtatccaatcgtttggctttatctgagtatttaaaaattgttgagagttaccctcaaaaattttctcaaacttgtttgatgattattgatattgatcgctttaaacacgtgaatgatcaatatggtcatattgtgggtgaccaagtgattcggcgtatcgcagatcaattaaaagcaaatgtacgggcttctgatttaattgttcgttatggtggtgatgagtttttaattttgttagaacaggtgcagtttttagatgcacgtctcttggccgaaaaaattcgtattgcgatttctttagaggaaattgatctatctagtacgcaagaaaaattgcatgtatcggtcagtattgggtttgcgattggagcgacaagctggatggagttattagagaacgctgatcgttcactcttaagagctaaagctcggggacgaaatgtagtagagggataa

SEQ ID NO: 2140 - DNA, 1503 bp, Acinetobacter baumannii
gctatgactgtttcttttcaagaaattcatccaatcgaaattgatgctcaatggcctcaacagccatttcacggctttagtttagatagtcgtaaagttgaaacggaccaaatttttattgctttgacaagttatagccagcctgaaaaaacgcgtacatttgctgaagcggctttagcaaatggagcgttggctgtcattagcgaaaccgaattaggtgtagcaaatgaatgggtatgccctgatgtgcgtcagcgcatgggagagtggcaaaaacgttatttgcaacaggctgatgtagtaaaacctttacggattatagctgtaacaggcacaaatggtaaaacaacaatttctcgtttaattgctgagttaattagttcacaacagcagcgctgtgcagtgatggggacaacagggaatggtattttacctaacttaacgccttctacgcatactaccctcgacgctctacagttacaaaatgcgctacatgactatgctaaacagggagcaacttttgcttctttagaagcaagttcacatggtcttgaacaggggcgattaaatggttgcgatattgaaattgctgtttatagcaacttaagtcgtgaccatctggattatcacggcactttagaagcttatgcagaagcgaaggcgcgtttatttcagtttaattcgttaaaagtcgctgttattaatttagatgatgcgcatgctgacttgatgattaagtctgcccaaaataatccagcacaacctaaaattttgacttattcactaactcaaaatacagctgattattacattaccgatttaagctatagcttggcgggcgcaacttttaatttagtaagtcagcaaggttcatttgcggtagaaagcccattattaggtcatttcaatgttgaaaatttaattgccgcactcatcgctgctgagcaagctagtttcgatttacaggcattggttaattttgttcctaaactaattggtgcgccaggccgaatgcaagttattcgtgatgatgagcgattatttgtagtggattatgcgcatacaccagatgcattgattcaagtgcttaaaacattaaagcgtcatgtttcgaatcagctttgggcggtgtttggatgtggtggtgaccgtgaccgtggtaagcgtccactcatgactcaagcagctttggatggcgcaaatcctgttattctgacttcagataatccaagaacagaagaccctgaacaaatttttgctgacatgaagcaaggaattgatttttcagggcatcgtatgcatgaaattcatgaccgccgtgaagcaattaaatttgttgcagagcaagctcaagctggtgacattgtagtgattgccggcaaaggacatgaaaattatcaagaaattaatggtgtgcgtcactggtttgatgatgtggttgaagtgcgttccgcgattgatgcccaacatcatacggtagatgctgcttaccctgcacaatag

SEQ ID NO: 2141 - DNA, 879 bp, Acinetobacter baumannii
agcatgactgtatcacgtacactttggcagaatgttcaacaatatatctggttggttggtggtattgtctgcttattccttgcttttattttttgggtcataactgataataaaaaactggttgaggttgaaaagtcagctgattccgatgcacccgtacaaattcagccagagaaagttgcaaccactcctaacttaggtgctttagctgacgaggttcgtccactggatttaacaacgcgaactgtggcgtcaggtgaacatgagcctgagtttcgtggcacaaaatttattaatgaaaataaaaaacaatggacgcttgagttattcagagcttctgatgaggacatcattaaaaactttttaaaaagtcgtactgatcgtaataagtttatttatttccgcttaagcggagaacaacaagcagaacaatatgtgttggcttacggaacattcaaacgttcagaagatgcggttcagcaattaacacagattaatttgcagttacctgattcggttaaacctcagccacagcagttctcaagttatgccccactggtaaatgatttgggggcagatgagatgaaaggtggcaataatcagttatatgaagttagattgcgtccagcagctttgcctagaattgatgaatctttattaatgtcagctccagcgagtggtaccctaaacactcagccaaaacctgctagtactaactcggctacaaaaactactattgtgcgtcgtgatgcggcaggaaatgtggttgatgtacaacaatcgaattctaatattgatcagccaaataaacctgcacaaacacggattaatgagaatcaacccaaaaatgctacaaatgagggcacaagagggaactaa

SEQ ID NO: 2142 - DNA, 351 bp, Acinetobacter baumannii
tgtggagctgtcatgcaatatcgttgccctcaatgtcaaagtgttaaaattatgccggtgagccaaggtgttaatagtgctaaacctgttgtgcctaaaagcttagtgattttagttcctgccatttttgtacttttactcttggttgtgattagtatttttatgtggatttttggcaatggtgcaggcagctctcttcaaattgcaacagtagtcgcatttgtggttactgtaggtgcaggttttatgttctggcgcgatctgcctgattttaaattgtctatgcaagcatttatgcagtcacaaaaacattggaaatgtcgtgactgcaatcatgagtgggaaatttaa

SEQ ID NO: 2143 - DNA, 966 bp, Acinetobacter baumannii
ttgttccatgtacaaatagttttttatggcacaatagattctacacatctgtcctttaataccaattttgcctgcaatatgaaggtatctctcatgaatgcgttaacccaagaactggttgagctgctcactttagaaaagcttgaagaaaatatttaccgtggaattagccgtaatttggtcggtaaacgtgtttttggaggtcaggttctcggtcaagcattacgtgctgcttcttacacaactgatcgtcctgcgcattctctgcatgcctactttttatatggtggtgatattaatgctccaatcatctatgaagtagaccgtttgcgtgatggcaaaagctttgtcagccgtcaagttcgggcaattcagcatggacgagttattttctctgcaatggtgtcttttgctaaccctgaagaaggcttgaactatcagcatccagaaccagattacccagctcctgaagcgctaaaatcggaaagtgagttgaaagaaggtatcctgaattttgtaccggaaaatgttcgtgcaagttttatgcgtgagcgtcatgttgaaatccgtccgattgatccagtcaatccatttcaaccacaaccggaagcgcctttcaatgcgcactatatccgtacccatgaccgtattccaaaacagctggatgacatttcattgcatcaagcaattgtagcgttttactcagactttactttgatgacaacagctttaagaccacatggcttaagttatatttctccaagtttgcaatgtgccagtattgatcatgcgatttatttccatcgcccacttcgtgctgatgaatggatgctctatgacatggaagctacagttagtgcggcttctcgcggtttaaactttggccgtatgtggcaaaatggccaactcgtatgtagtacggtgcaagagggtttgatgcgtttacgggaaattgaaactcaataa

SEQ ID NO: 2144 - DNA, 1068 bp, Acinetobacter baumannii
gacaatagtgtgctcaggttatatcgtaaacctaataaggggttaatgggtgtcgatattagttcgacttctgttaagttgttagagctctctgtcaagaacggtaaatattgggtagaaagctatgctttgatgcctttacccgaaaacagtgtagttgaaaaaaatatcttaaatccagaagcagttgcagaggctttggaacgggcgatgaatttagcaaatccccaaaccactcatgctgcaattgctgttccgacatcgacggttattcataaaactatcgaaatggatgcagatatgagcgatgacgaacgcgaagttcagattcgtgtagatgcggagcagtatataccgttccctttagatgaggtgagccttgattttgaggttttgccggatcgtcttgcgaatccaaatcgtgtaaatgtgctcttggtcgccacaagaacagaaaacgttgaaacacgcgttgaagtgcttgaattggcagatttaaatcctaaattggctgatgtcgaaagttacgcggttgagcgcgcttttagcgtgtttgctgatagcttaccgatgggtgcaaataccatagggattttagatatcggccataccatgacgacattatctgtcatgcaaaatggaaagattatttatacacgagagcaggttttcggcggaaaacaacttacgcttgaaattcaaagtcgttatggtttgtctttagaagaagcaagccgagcgaaaaaagatcgctctttaccagatgattatgaaattgaagtgctagacccatttctagacgcggtagttcagcaggcggcccgttcactacaatttttcttttcttcatcccaatttaacgaaatagaccatattttgctcgctggtggaaatgcgaatattccaggccttgccaagcttttgcagcaaaaattaggttaccgtgtcacgattgccaacccattcttacaaatgggcttttctcctcaagtcgacgttcaaaaaattgaaaatgatgcttcatctttaatggtggcatgtggcttggctttaaggagttttgattaa

SEQ ID NO: 2145 - DNA, 1452 bp, Acinetobacter baumannii
gcccaaatcgttattttaaataaggtgtcccgtatttttagaaacgaatcggcttataatttacttagtttgataacgtgtattgatatgatgaatgctttggaacgtcgctcaacttttgccttaagtagtatttttgcactacgcatgttgggcttgttcatgattattcctgtcttttctgtagttgggcagtcatatcaatatgcgactccagcactcattggtttggctgtaggtatttatggtttaagtcaggccattttacaaattccatttagcttacttgctgaccgttttagccgtaaaccgcttgtggtctttggtctattgctctttgcgattggtggcgcaattgccggactatctgacaccatttatggcgtaattattggccgtgctatcgctggggcgggtgcagtttcggcagtagttatggcacttttagccgatgtgacgcgtgaagagcagcgtactaaagccatggctgccatgggtatgagtattggcttatcttttgtagtcgcttttagtcttgggccttggctcacaagccttgtgggtatttctggtttgttctttgtgacaaccatcatgggtttgatcgcgattgcgatgttattgctggtgcctaaagtcactcgtcaccatcgtaattatcagcaaggctacatggcacagcttaaacaagtcattcaaatgggtgatttaaaccgtttacacgtttcggtttttgcattgcatttattgctgaccgccatgtttatttatgtaccgtcacagcttatcgagtttgcgcatattcctttggctagccacggtttggtgtatttgccacttttggttattagtctgttttttgcatttcctagcattatcatcgctgaaaaatatcgcaaaatgcgcggcattttcttaacagcaattacaggcattatcgcaggtttactattactgatatttggttatcagtctaaatatgtcttgcttgcaggcttaggtattttctttattgcctttaatgtgatggaggctttattaccttcttggctgtcaaaatccgctccaatccagtcgaaagccactgctatgggggtaaatgccagtagccagttcttaggtgccttttttggtggcacactaggcggtcaattattgatgttacataatactgcgattggatggagtgtcttagcagggattgctataatatggctgctaattagttttggtttagctcagccgcggtatttgtcatctattgtgctgccattgccgcaagtgcaacaggtgaatgagtggaccacacaactattggcaattcgtggtatcgaagaagttgtggtgatgcctgaccagcaagttgcttatattaaagtcgataaacagtctcttgatgacgcttcgcgacgtgatttaacgcagttgttcggtaaagaggtagccatttaa

SEQ ID NO: 2146 - DNA, 990 bp, Acinetobacter baumannii
agacttgtcgtggctgatgaacaaaaatccttaacggatgttgcaaaaaatacaggcgaacttttgcaagaagcaggtactaaaaccactcaaacagttttagcgcataccgagaaataccatgatgcctataccactatcgacaaaattgtagatagtttttgggaacgtgtaccttatatctgcattgcgattgttgtttttcttattttttggctactgaccaaattatttaagttctttgttcgtaagactttagaaaatcgctcttatactcgtcaaaatcttgttttagttttaaaccgtgtcggtagtacagcgattttattctttggtttcttaatagctctcgtcattatgattccggggttcacaccaggccagcttatgagtgcgctaggtattggttcggtcgccattggttttgcatttaaagatattttccaaaacctactttcaggtattttgattttattgagcgagccattccgtattggcgattcaattgtggtgaattcacttgaaggaactgtagaagacatccagatccgtgcaaccttcctacgctcaccggatggtcgccgtattgttattccaaatgcaacggtttatacaagtgccttaactgttaatactgcttatcaacaacgacgctgcgagtttgtagtcggaattggctatgacgatgatgagcaaaaagcaaaacagattattttagatattctcaacaatgaccgaaatgtactgagtcaacctgcgttttcagttaacgtcacagctttagcagatttctcggttaacctgactgtgcgctggtgggttgataccactgaaactgatatctcttcatctattagtaatattcaagctcaagtaaaacaagctttcaatgaaaatgatattgatattccttacccaattcaggaattaaaaatggtatctaatccaccagctttaaaccctgaaacatcagctaaacaaacgacctaa

SEQ ID NO: 2147 - DNA, 1272 bp, Acinetobacter baumannii
tcaacgtgcttggcaacaagctcaaacttttccaactcaggcaggagaataataatgtcggcaaatttaaagaaaaattctcaatggctttgggttggagtaattgctgccattactgcaatattaattggtttactcgttttaaattcaaaaaataaatctaattcttcggaaccatcggaaggccacgggcatgctgaagaagagggtgaagaacaccatgatgagggagaaaaaccactactactcactgctcagcaaatgcaggaacaaaatttaaaaattgaacaagctgaactaggtgaagttcctcaacttcagacttatccagccaaactagtagttaatactgaccgccaagcccatgtttcgccaagttttagtggtcgtgtcgaagcggtatatgttgaactaggacaacaagttaaaaaaggccaggcacttgcaagcttattagtgccagatttagtcgatcagcaagccaatttgcaaatagcccagtctaatcttgagttagcacgtcaggactatgagcgtgaacgtagcttatggtctcaaggaatttccgcgaaacaagattatcaacgagcttataacgcttatcagcaagcacaaattcaggttaaagcatctcgctcgcgcttaagtgcattcggggcaggttcgggttcagcagggcgttatacattaacagcgccgattgcgggtatcgtgagtaataaagatattgtagtgggtgaaaacgtacagttagcagatcagctttttattattaatcagcttgatcagttatggctggaattcattttaccaagcaatgcaaatatcaatgtacagccaaatcaacagattgaatttaaatctttacaaactgggaatacattttctgctcaggttcaaagtttaataacagaggcagatgctcagactggacgcttacaagtgcgtgccaaggttttggcaaatagcagtgagctgcgtccaaacttgatggttaacgttgagctaaatgcaggatcaacacaaaaagtgactcgtgtaaaagcgcaagcagttcaacaagttgaaggtaaagacgttatctttacaccaaaaatagtcaaaacaggttttgagtttgaacctgtgactgtacagctaggccaacgttctaaagatggtcaatgggttgaagttgtaaaaggaattaatccaagccaacgctatattgcagaaggcagcttcttactgaagtccgaattggaaaaaggagaggctgagcatggacattaa

SEQ ID NO: 2148 - DNA, 2160 bp, Acinetobacter baumannii
aaaaaagccgtgaataatctgactcaactattcaatcgttttaaagcgaattcaattttaatttattgcctgcaaattttaattgtactcacaggcacaactttaggtttactttggttaggacataatgagctgattgttcctgtgactttaggtgcaattgccgctgcccttactgattttgatgatcgcttaagtcttcgtttacgcaatctgctttatgtctgcctactctttttcactgttagcactattcttggttttttagcaccttataaatttttatttattttatatctttcaatttctagtgcctgtttcattttattgggcgctttagggcaacgctacgctaccatttcttttggtacgattttactctcaatttatagtatgtttggtttaggagaatatgcacactggtaccaacagcctacttattttgtctatggtgcgttgtggtacggcctaacttctattttattttttattcttaaaccaacacttcctttacaagataaactttcacaaatttttgaagaaatttcagccttacttcaagctaaagcacggttgttcgacccagataataaagaaaatgttgaacagcttttatttgagttatcactacaaaatacacaagttgcgcaaagtcttaaccaaatacgcagctctctgctaactcgccttaaggcatcacgagtcagtaataaaagtatttactggttaaacctatacttttttgcgcgagatatacacgagcaggcaacttctaattatttacactacgagcatatccaacaaaattttagccgtagtgatctcatttttcgttttcagaaaaacctacgcttacaggcacaagcttgccatgatttagcccaatgcattttgcataatcaacaatatcagtcttctcaagaaagccaaattggcctaaaccatttggaaagctccttgaaagactggatacaacagcatccacaaaattttgaagttaaaaatttaaagctgatttttaataatttaaaaggaatgcatgaacaatttgaacagcttcaatatgctcaaccgtttaatgaaacgctaagtcagaacaagcaagaacatctcaatttactagatgatgatattcaaggattttcagaccttgttttaaaaattcggcagcaactgacgccacaatcggccctatttagacatgcagtacgaattgcggttgtatttgccgcaggttatgccatttccctcttaccttttgcccaacatggttactggattttgctcaccagtttatttgtttgccaaattacttactttgcaaccaaaagtcgtttaaagcttagaacgattgggactttactcggcgttttattgggtattcccattttatattttgttcctagtattgaaggtcaactcattcttaccattatttgtggagttagctttttctacttacgccagaaaaaatatgctctagcaacactgatggcaaccttaatggtattgctcattttcaacttaaaaggtgcaggttacagcattattttacctcgcctaatcgacaccttattaggctgctttattgcttggcttgctgttaattttatatggccggactggaacttccgtaatattccaaacaatattaagaaaagtagccaagcaaccttcgattattttaatgtgattgttgagcaatatcagcacggaaaaaatcaagacattgaatatcgtagaattcgccgagctgcacataacgctcaaattgaactgtcgaatatgatttcaagcttaagtgccgagcccaacccaaatccagagctgattcattacgcctttcgttatttggtttatagccacagccagttgagttatgtcgcagcattaggcagccaaagacaaaaaattgatgatcaacaggtattacaacttttactggattgtcagcaaattcttaaacaaagtttatttgaacaagcttcggttaactttagtttccttgaacagactttaaagcaaattcaaagcttaataactcacgaacatttttcagagaactacacacttgtcttaaaacagatgagtttattattagaaaccttgcctgaactcttaagcttaaaaggcaaacttttagagcatgaaattaaatag

SEQ ID NO: 2149 - DNA, 189 bp, Acinetobacter baumannii
gtatatcgcttatctttcaaatggttaaaacgtggtcatcttttttgtaactctaatcggttttacgtaacagtctgttggcattatgagagcctttggctattgaattacgccaattgcgtatctttcgttgaaatgcacttatggcttatgacatggttagctccacaaatttggataaaaatataa

(The sequence listing continues in the following parts.)

What is claimed is:

1. An isolated nucleic acid encoding an *A. baumanii* polypeptide selected from the group consisting of SEQ ID NO:4238, SEQ ID NO:4750, SEQ ID NO:5107, SEQ ID NO:5244, SEQ ID NO:5840, SEQ ID NO:6076, SEQ ID NO:6300, SEQ ID NO:6889, SEQ ID NO:7025, and SEQ ID NO:7168.

2. A recombinant expression vector comprising the nucleic acid of claim 1 operably linked to a transcription regulatory element.

3. A cell comprising a recombinant expression vector of claim 2.

4. An isolated nucleic acid encoding an *A. baumannii* polypeptide fragment, wherein said nucleic acid is a fragment comprising at least 40 contiguous nucleotides of a nucleic acid sequence selected from the group consisting of SEQ ID NO:112, SEQ ID NO:624, SEQ ID NO:981, SEQ ID NO:1118, SEQ ID NO:1714, SEQ ID NO:1950, SEQ ID NO:2174, SEQ ID NO:2763, SEQ ID NO:2899 and SEQ ID NO:3042.

5. A recombinant expression vector comprising the nucleic acid of claim 4 operably linked to a transcription regulatory element.

6. A cell comprising a recombinant expression vector of claim 5.

7. An isolated nucleic acid selected from the group consisting of SEQ ID NO:112, SEQ ID NO:624, SEQ ID NO:981, SEQ ID NO:1118, SEQ ID NO:1714, SEQ ID NO:1950, SEQ ID NO:2174, SEQ ID NO:2763, SEQ ID NO:2899 and SEQ ID NO:3042.

8. An isolated nucleic acid that hybridizes under conditions of high stringency to the nucleic acid sequence of SEQ ID NO:112, wherein said isolated nucleic acid is at least about 40 contiguous nucleotides.

9. An isolated nucleic acid that hybridizes under conditions of high stringency to the nucleic acid sequence of SEQ ID NO:624, wherein said isolated nucleic acid is at least about 40 contiguous nucleotides.

10. An isolated nucleic acid that hybridizes under conditions of high stringency to the nucleic acid sequence of SEQ ID NO:981, wherein said isolated nucleic acid is at least about 40 contiguous nucleotides.

11. An isolated nucleic acid that hybridizes under conditions of high stringency to the nucleic acid sequence of SEQ ID NO:1118, wherein said isolated nucleic acid is at least about 40 contiguous nucleotides.

12. An isolated nucleic acid that hybridizes under conditions of high stringency to the nucleic acid sequence of SEQ ID NO:1714, wherein said isolated nucleic acid is at least about 40 contiguous nucleotides.

13. An isolated nucleic acid that hybridizes under conditions of high stringency to the nucleic acid sequence of SEQ ID NO:1950, wherein said isolated nucleic acid is at least about 40 contiguous nucleotides.

14. An isolated nucleic acid that hybridizes under conditions of high stringency to the nucleic acid sequence of SEQ ID NO:2763, wherein said isolated nucleic acid is at least about 40 contiguous nucleotides.

15. An isolated nucleic acid that hybridizes under conditions of high stringency to the nucleic acid sequence of SEQ ID NO:2899, wherein said isolated nucleic acid is at least about 40 contiguous nucleotides.

* * * * *